United States Patent 11,725,251 (METHYLATION MARKERS AND TARGETED METHYLATION PROBE PANEL) - sequence listing, part 4

SEQ ID NO: 33254 - DNA, 362 bp, Homo sapiens
  misc_feature 1..362: note = chr10:102483870-102484232
  misc_feature 1..362: note = hyper
  source 1..362: mol_type = genomic DNA
ggagttggagacgatgataaatatgataatttgtataaaatctgaatgggtcttgttttcagggagaatgccttggatgatgaatgggcccggctttcagatagatggctgataaaaagtgtattggattgttgagagcgattttaattctcattctgtacctgcagatgccgcggccgccgcgcccggcctcctcctccctcctgcccactgcgcggggcggacgccggcccggccggcctcggcggctcaggaggcttctgaaatgactctaattacagagttattaattttaagaggagggtgagcggggggtttatgattattaatcgagcgcccgagctcggcgggcggggcttggc

SEQ ID NO: 33255 - DNA, 13 bp, Homo sapiens
  misc_feature 1..13: note = chr10:102484233-102484246
  misc_feature 1..13: note = hyper
  source 1..13: mol_type = genomic DNA
ggccgcgggctag

SEQ ID NO: 33256 - DNA, 285 bp, Homo sapiens
  misc_feature 1..285: note = chr10:102484269-102484554
  misc_feature 1..285: note = hyper
  source 1..285: mol_type = genomic DNA
cgcggggccccggggcggctccaagcccggcgggctccgcggcggcggcgaccaggctcgcttcccacttgggctgcgggcggcatggtccctctgcgcccatccggctctcctcacccctgccagtctccgacccggccgtccaacgtccctccctggccggctcgcctgcgcagccgagcatcaggctccgcgccggggtaggcgagcaggtccccagccccaggcccgcagctgtaggccggtgaggaacagctctgctagagaaagcgcaccccaccccca

SEQ ID NO: 33257 - DNA, 30 bp, Homo sapiens
  misc_feature 1..30: note = chr10:102489083-102489113
  misc_feature 1..30: note = hyper
  source 1..30: mol_type = genomic DNA
tcccatctctgtctacgtagatacctagtc

SEQ ID NO: 33258 - DNA, 336 bp, Homo sapiens
  misc_feature 1..336: note = chr10:102489328-102489664
  misc_feature 1..336: note = hyper
  source 1..336: mol_type = genomic DNA
agaagaccctgggaacgggcagaatctgagccgcgtctctgagtcgcagtgggaaggcggctcaggaaatgcgccctccgctggcgctgggtcgcggttctggctgcgttactttttccttgcatctgtggcccggcgcgccagcctggacactagatccgcaagaagggagttttcccagggccggctgaagaatgagaagtccgagctgcggggacgttgggggtctgtgcttagcggccacagcctgcccaccacgggttcccgccaccccgcctccccacctcccttcgcgccagggctgaaagtcccaggcgcccaatgcgtgcccaagaa

SEQ ID NO: 33259 - DNA, 164 bp, Homo sapiens
  misc_feature 1..164: note = chr10:102489700-102489864
  misc_feature 1..164: note = hyper
  source 1..164: mol_type = genomic DNA
cgccatggacccaggacgacaccccacacccagacaccactctttccaggggcagatgctccggcgcgccccgcgccctgaagttcaacttggaatccaggtccgcgcgggaccccgcctagcgccccaagcgcacaggctgagcgccccgccctggcctcctg

SEQ ID NO: 33260 - DNA, 40 bp, Homo sapiens
  misc_feature 1..40: note = chr10:102495101-102495141
  misc_feature 1..40: note = hyper
  source 1..40: mol_type = genomic DNA
ggtgagagggtgtgccggcgtctaggctgggctgcggtcc

SEQ ID NO: 33261 - DNA, 67 bp, Homo sapiens
  misc_feature 1..67: note = chr10:102495142-102495209
  misc_feature 1..67: note = hyper
  source 1..67: mol_type = genomic DNA
tgggcgcctcaggcagcgagggtggctgcttgcctgcggctggctggggcctcggtgcgtgtgcacg

SEQ ID NO: 33262 - DNA, 182 bp, Homo sapiens
  misc_feature 1..182: note = chr10:102495437-102495619
  misc_feature 1..182: note = hyper
  source 1..182: mol_type = genomic DNA
aggacgcggcggccgcggggagcctagcatggaagagcgcgcgggtccggcaggtaagagcggcagagacccgtccgcgccgcaggcgaggactaggggagagggatgggggcggccatggccggggcgggctcctctcctctttcatccctgtgctcagtacccggcgggcgacgtgaagg

SEQ ID NO: 33263 - DNA, 23 bp, Homo sapiens
  misc_feature 1..23: note = chr10:102497153-102497176
  misc_feature 1..23: note = hyper
  source 1..23: mol_type = genomic DNA
acgggttagggcggccgcttacc

SEQ ID NO: 33264 - DNA, 46 bp, Homo sapiens; identical to SEQ ID NO: 3599
  misc_feature 1..46: note = chr10:102497252-102497298
  misc_feature 1..46: note = hyper
  source 1..46: mol_type = genomic DNA

SEQ ID NO: 33265 - DNA, 510 bp, Homo sapiens
  misc_feature 1..510: note = chr10:102497299-102497809
  misc_feature 1..510: note = hyper
  source 1..510: mol_type = genomic DNA
ggggggagctgcggagctgggcaggagacagggctgtgtttgggaaaaggaaaccgcacttcgaggcggctccgcagagcagagctgcagagtcttccgccctcccagccgccttctccctttgcctctttctcttttcaccgccccctccctcatctcttcggtagccacgtttggccggggcacaactccctggaggccctgcccccctagacggccccgagcccttttggacctcatccggctagtttaaaatgacaatgacagaggcgcgtgaccgaacgtgcctgccggacgtcctggcgcaactgccgcagccgggtttgcgaaggatgcgggttttacttagtctcgctgagcctgttccggagcagcgaaaaccatcaggaaagggcgagagaaggaggaaggggattgaatcagcaactagggcaattgtggtcttcagctatcgctgcctatacccccagaacttacaaaaataagccgtttattcgatgccctcccttt

SEQ ID NO: 33266 - DNA, 257 bp, Homo sapiens
  misc_feature 1..257: note = chr10:102498176-102498433
  misc_feature 1..257: note = hyper
  source 1..257: mol_type = genomic DNA
ctcccatctcagccccgcctggaacacagctgtctgcctatactaccttcgccaccccctggcactttttacacaccctcacaacactcaagcacactcctacgatcccctcatccagacgctcagcccccaaagagacacatcagaaattctccttaattgattcagaaattgaaaggggcttcctccctccatcagtttcttcaatgtattcgttatccgcgggtctagacctcccagcccgtctagacctagcg

SEQ ID NO: 33267 - DNA, 33 bp, Homo sapiens
  misc_feature 1..33: note = chr10:102498739-102498772
  misc_feature 1..33: note = hyper
  source 1..33: mol_type = genomic DNA
gagggcctaatccgtcgcgcgcgcgcacgcgga

SEQ ID NO: 33268 - DNA, 332 bp, Homo sapiens
  misc_feature 1..332: note = chr10:102498832-102499164
  misc_feature 1..332: note = hyper
  source 1..332: mol_type = genomic DNA
agcagcagccctagccccgacccgaggccccaagacggcgggccaggaacccctgggacgtcctggctccaggctggacgtaggcggaggtggcaggagtggacaaacccaggcgggtcccacgacgcccctttcctcgggtctctccttgtttcagccagccgctctcgcccctggtcccctctcccctgcgttcgggtcctttgtctccagccacctcgcagcctgtccccgcctcggcggccctgccctttgggcctcccagtctctctggcgggtccccctgccttaccagctcccggctgtggcgcgctctccgcctgctcctcaca

SEQ ID NO: 33269 - DNA, 39 bp, Homo sapiens
  misc_feature 1..39: note = chr10:102499518-102499557
  misc_feature 1..39: note = hyper
  source 1..39: mol_type = genomic DNA
tgggtcagcctgcaccgtctccctcgaccacagcccgat

SEQ ID NO: 33270 - DNA, 174 bp, Homo sapiens
  misc_feature 1..174: note = chr10:102501247-102501421
  misc_feature 1..174: note = hyper
  source 1..174: mol_type = genomic DNA
aggagggggaaaggccgggcaggagccggtcaggcctttctgcggaaggggctggggtgtaagtttcggctccctgggatctgacagccgagggtatgcgccctggggtgcgccgggacccagagggcgagtgagcctcggttggtcggctctggagttcggttgtcagaagaa

SEQ ID NO: 33271 - DNA, 743 bp, Homo sapiens
  misc_feature 1..743: note = chr10:102501726-102502469
  misc_feature 1..743: note = hyper
  source 1..743: mol_type = genomic DNA
ggcaggtcccggccacgggggaggggcgcggctgggatgctcccgcggccccctccgtctcaccaaggctcagccgccttcccaagctactggaggccgggcgcctgggccccgggtcagggccctgcaggaggaggagaggcaaccacgcttctgccttttctcgcctgggcagaaaacgctgggccagggaactggaaaccggaaaacaggagaaagggtttctggaaggcagcgggagcgggtggcagcggggcagcgggcagtggactaggtctacaccggcacttcacttttgcacaacatgcccagaaacgcatttgagagccctggagtcgcgcttggcttggcttggggcgccggtgcgtgggtacactcgaggtgcggggtgcctatccgccaccccgacacctacacccagacagagcaggcgcggcccagccagaaaaccaggccggcagtagctcggcctggagggcggaggcaaggttgggggccgccaggcgcctgggcaagcctggcagggaagggagccgagaaggcaaaggagccgagatccacaaggaagatttattgggcagatcagatgcacagaggcggctaatgaagcaaatcccgagatgggtatcagagcaactccccaaaagtttatttgcctttaaatttccgcagggaggcgggctccttgtttgaagtgtaaatgcccctaggttggggggtggaagggccgctttgaaaacacc

SEQ ID NO: 33272 - DNA, 142 bp, Homo sapiens
  misc_feature 1..142: note = chr10:102503828-102503970
  misc_feature 1..142: note = hyper
  source 1..142: mol_type = genomic DNA
ggcatcccaaaaacccgggtacaagacgcccagtagtagtagttaggctgagtcaggcaggtgcatctctccccatggtatctgccgcccaggctccggccagagggaggggagcgcgagtccgccgcgcttccgcggggcg

SEQ ID NO: 33273 - DNA, 216 bp, Homo sapiens; identical to SEQ ID NO: 10455
  misc_feature 1..216: note = chr10:102504302-102504518
  misc_feature 1..216: note = hyper
  source 1..216: mol_type = genomic DNA

SEQ ID NO: 33274 - DNA, 93 bp, Homo sapiens
  misc_feature 1..93: note = chr10:102505756-102505849
  misc_feature 1..93: note = hyper
  source 1..93: mol_type = genomic DNA
ggccattctgctgaccgcccagccccgagccccgacagtggcaagttgcggctactgcagttgcaagctccggccaacccggaggagccccag

SEQ ID NO: 33275 - DNA, 43 bp, Homo sapiens
  misc_feature 1..43: note = chr10:102505873-102505916
  misc_feature 1..43: note = hyper
  source 1..43: mol_type = genomic DNA
cgcccccgcgcgccccgcagcagccgggcgttcactcatcctc

SEQ ID NO: 33276 - DNA, 141 bp, Homo sapiens
  misc_feature 1..141: note = chr10:102507395-102507536
  misc_feature 1..141: note = hyper
  source 1..141: mol_type = genomic DNA
taatcatatatttagcgttgcgggggttggggggggcgtttaaaaatacttctgggataaaatatatttttctaagtaatttccaagcgcaggaaagccgcgccgagggcatcaggcctccgcgggtctcggcgagcgggc

SEQ ID NO: 33277 - DNA, 184 bp, Homo sapiens
  misc_feature 1..184: note = chr10:102507767-102507951
  misc_feature 1..184: note = hyper
  source 1..184: mol_type = genomic DNA
ggtggactggtgggtgagacaccgcagcccgagtcggtgctggcggccgtggcgcattccaggcccgactcagcgccgactcgctgcagtcccccagccctggactcccgccgtgtccccttcccatccccaccccttagactggggctgaggggccgggccctgagcccggggaggctgaatt

SEQ ID NO: 33278 - DNA, 10 bp, Homo sapiens
  misc_feature 1..10: note = chr10:102508280-102508290
  misc_feature 1..10: note = hyper
  source 1..10: mol_type = genomic DNA
cagtccgggc

SEQ ID NO: 33279 - DNA, 1201 bp, Homo sapiens
  misc_feature 1..1201: note = chr10:102508341-102509542
  misc_feature 1..1201: note = hyper
  source 1..1201: mol_type = genomic DNA
cggctacgggttgatcgctctgggtgcaggatttctagactgctgtaggccagggagaatggggcacaggaagcaccctcaggcctggcacccagtggccgcctcggttccgagatcgggagcccgcgctggagccgggttggaaaccccgtgcccttctcttggccgaaagagcaaaagcccgagccgctcggtttcctgggggggctgccgaggtctgaggggtcaaagggactcgagtcgggtttgggtcggctacacagggcgccccgagagttattaactcgccagcgaggcctatgccgtgccacctgggcgagacggtgggccccaaccaggctctgcgaggcgcggcaggcaggcgagcccaagcagccggcattctctgcctgctgcctggagccgctctgcctccctgtctctgagcgcagcagaccccgggcccctgcctcatccgccttccttgctctacttcagatactaaggaggtgaaagagagatacggtccccctacagataaataacattagaaaaacttcccatcaaaaacaaacaacacaggaaagaggtagaaaaattccgattacaatttaatactttttaaagaagaggcagagagcaaaggggggtgtgtgtgtcaggcacttatcccctgtctgtgctaggagctcggataaacagtcagccgagcctcgacgcccccaaatcgtccgcctccaagccccgcacgcgcggacagctcccgggttgcctgcggcgcaggcgggatgctgcttcgcactagtccagtcctctgccaggcccttcctctcctcgctttcttacgccctttccgctggcatgaattcccctttggcattttctcccctctcccctcttttctgtcatctggtttctctccagtcccccctttgctttctaccttgcgtcgcaaggcctgagtcgccctctcgcccagcccccagtcttcagcccagcgtctgtgcttccagtccccactcctccgcgtggtcgtggaggtccaccacctttcttctcaagctcgggaacatgcccttccgccctgcctgcttccttcgcccgtcccgggccgcggaccctgactaatggccggtccctgctgtgtgtggggtgttgtgtttttttcttgtctctccccagcagggcacgggggtgtgaaccagctcgggggggtgtttgt

SEQ ID NO: 33280 - DNA, 33 bp, Homo sapiens
  misc_feature 1..33: note = chr10:102586113-102586146
  misc_feature 1..33: note = hyper
  source 1..33: mol_type = genomic DNA
ggaggtagcttccgacgacggctcccaacccac

SEQ ID NO: 33281 - DNA, 39 bp, Homo sapiens
  misc_feature 1..39: note = chr10:102588299-102588338
  misc_feature 1..39: note = hyper
  source 1..39: mol_type = genomic DNA
catcggacgctctcccgggaccgccgcaggaccagtttc

SEQ ID NO: 33282 - DNA, 1165 bp, Homo sapiens; identical to SEQ ID NO: 914
  misc_feature 1..1165: note = chr10:102589250-102590415
  misc_feature 1..1165: note = hyper
  source 1..1165: mol_type = genomic DNA

SEQ ID NO: 33283 - DNA, 78 bp, Homo sapiens
  misc_feature 1..78: note = chr10:102890941-102891019
  misc_feature 1..78: note = hyper
  source 1..78: mol_type = genomic DNA
tcccctcccctccctcgcgctgtcattcaccccgctcctctccgcgcacagccaatggagagacccagtcgaaaccgc

SEQ ID NO: 33284 - DNA, 936 bp, Homo sapiens
  misc_feature 1..936: note = chr10:102891020-102891956
  misc_feature 1..936: note = hyper
  source 1..936: mol_type = genomic DNA
aagctctcttgcaccgggctttttcgcctggtgattgatgtcccagagtcaacagcgagcgagcagccggagcggggaagcagaagccagagaggggaagaatacggcgccccctctctccctcccctcccccttctactttagcctttctgcgcacttcgcttccaagtctccgcgcagccaggagccgctgttgcctcccagcccctgctagctgccccccgagccgagcgcagcgagcgccgccgcccgggccccccggtggggccagggccagcatggagcacctgggtccgcaccacctccacccgggtcacgcagagcccattagcttcggcatcgaccagatcctcaacagcccggaccagggtggctgcatgggacccgcctcgcgcctccaggacggagaatacggccttggctgcttggtcggaggcgcctacacttacggcggcgggggctccgcggccgcgacgggggctggaggagcgggggcctatggtactggaggtcccggcggccccggaggcccggcaggcggcggcggcgcctgcagcatgggtcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccctggatggagagtaaccgcagatacacaaaggacaggttcacaggtgagtccggcccgcgcgctccccgcctggccgcggcccgggctccgtgctacccctgccccgccgggtggctccccaaagccggttctg

SEQ ID NO: 33285 - DNA, 159 bp, Homo sapiens
  misc_feature 1..159: note = chr10:102892090-102892249
  misc_feature 1..159: note = hyper
  source 1..159: mol_type = genomic DNA
cggaggagctctccctggtcccctctccggatccactagccgggtcaggcagagagaaggaggccatagattcaggaccaccttctgcagctactcttggcctgggaatcttagagaaaggggtgcaacgtgaacagtttcttccgtcctggctgctgt

SEQ ID NO: 33286 - DNA, 369 bp, Homo sapiens; identical to SEQ ID NO: 915
  misc_feature 1..369: note = chr10:102893583-102893952
  misc_feature 1..369: note = hyper
  source 1..369: mol_type = genomic DNA

SEQ ID NO: 33287 - DNA, 1199 bp, Homo sapiens
  misc_feature 1..1199: note = chr10:102894090-102895289
  misc_feature 1..1199: note = hyper
  source 1..1199: mol_type = genomic DNA
cgcaggtcaaaacctggttccagaaccggcggacaaagtggaggtgagcaagcggggcgggccggccgcccgcgagcggcgcggtctcaggcagctctcggttcattggcctctcgtggggcgcacatactttttccgctcgcggtttctgatcctttcggaggagcgagctcccgctaggcttgcggggagctggaagcaaccgaggccgatagctgggatggggctgaagagccctggctctgttttaccggaggcttcagggctttctggttggcacactctctgccggtgtagacgcggcaggtctattccgccgcttgggcaaacaggcgggttagtgcactccacgcagtccaggctccagggatctgtgagtcctggggagctttttgtttgcgcaaactcttgcttatggaatcctgctctgtcctggagactggatgcagaacagcccgcaccttgttgcagcgctccagccgggctcccggcagagggtctgtggccccagaccgcggccctgctgacggtctcctcccccagacacccggcctttgcgcagccggtccctaccctggaaggagaaaatcaatccgcgccggctgcggcggggtttcgcgggtcccactggaaggggaatcaattaggagcagatgggtgtgtgtgagaaagagaattttccttctcccatagccacaactctagttactacgcaatgggctttttgttttgttttgttttttcacatttacgctcacggacgtgaagcgtccccaacactctcgagcagcctccctctccgcgcgcactgacgctttctccggctgcaccctctggcacgctgcaccctctggcacgctgcaccctcccgcacatctggcccttgcccgccggagtttctcccctagctcaggccccatggggtagcgcgggagagtctgggcgaagtcggcggcgccgagacgggcgggccttggggcaggaggaaggaattggagtttcctctttttctgaacgaaggcgaggaatctgcctgggattccgcctacggggccacaaaggaagccatggccccacgattctaccacaacatttctgacgctgggaaaggagtgggggatgcggcctcagaccttggaacgctaaagagggagccagggctagctcgggggttggggggactccggtttccaaggcct

SEQ ID NO: 33288 - DNA, 716 bp, Homo sapiens
  misc_feature 1..716: note = chr10:102899140-102899856
  misc_feature 1..716: note = hyper
  source 1..716: mol_type = genomic DNA
ggagggttcagggtccgaagacagcagccagcctttccgccccatccccgcaggcccgcggagtgctcaggttgggccctgacgagctgtgtggagcgtagtgagcaggttctggcggcagcgccgggtctgctgcaggtctcccgcattcaccggctgtggcacccagcgccaggccgcgcaaaatccagaaatagcctccagcacctcagaagtcgtctccctctacctgggcaggtctgctgtcccctctgctcccgcaggactggagccaccgagctcgcgccttcttctcggggtgcgatttctctcctcttttggactcaagatcaatgcttcccggccggcgcagatcacacagcaggaccccaggggagactgtggccttcttcccgcctcccaattccccaagaccgcctctagaggctgctgtgtccggagaactccgagcattttctggacacagattgcctaacagaggaacaggggttaggtggggagcggctggccggcccaaacacagcagccccaagctggctcccaagcctgggctctccacccccgctcccatcctctcttgagcacagttaggcccaacacccctgtcccccaaaacacctcctaccctccctcccccccagcccccatcttcaggaacatcacagggctcacactcactaaccgcggagagcacatgcaggccggagccctcagcc

SEQ ID NO: 33289 - DNA, 420 bp, Homo sapiens
  misc_feature 1..420: note = chr10:102900262-102900682
  misc_feature 1..420: note = hyper
  source 1..420: mol_type = genomic DNA
ggaggctggaggggaggggggctgcgagggtcacagtcaaggccaactactcacaacagaaagctcgaaactctccctctacctcccctgccggaaatgacccgtctctgttcaaaaatagaaaaagaacgatcggaataattgttcgcagaggtgccgggagagaaggggaattaacaaacctgcctgcgcggagaggtctgcttccttctttggcttcagaaccgacggcaatcaccaaattcctgcggccagcgagccctgcccctcagatctggccctctggttgagtgggtggcggcctgaggggccccaggaacccaggcagggatggggtcctagaggccctgtgcagtgcggtgggtggcacacagagaatctggctcaacctgttaactataatagcggctttgtgtggcc

SEQ ID NO: 33290 - DNA, 83 bp, Homo sapiens
  misc_feature 1..83: note = chr10:102905699-102905782
  misc_feature 1..83: note = hyper
  source 1..83: mol_type = genomic DNA
ccacaaggacttgtccgggccgggccgggctagatgccgagatgtaattcaccagatttgtgaaaagacgagaaatctgctct

SEQ ID NO: 33291 - DNA, 191 bp, Homo sapiens
  misc_feature 1..191: note = chr10:102975143-102975334
  misc_feature 1..191: note = hyper
  source 1..191: mol_type = genomic DNA
cggggctcccttcctcgctcttccttcggacacccacagcagctgctcctggggaatctgcccccaagtttcgaggaactgccccccagcgcccaggaggaaaggggaatggggctgtaaacgtgtctaattcagacccgttatccagatcggaattagtttctcgcggacacctccgcgccgcgggccat

SEQ ID NO: 33292 - DNA, 285 bp, Homo sapiens
  misc_feature 1..285: note = chr10:102975595-102975880
  misc_feature 1..285: note = hyper
  source 1..285: mol_type = genomic DNA
cgccgtctgggaactcgagatccgaggaggggcaaaagccgccggcgccggggtcaggcctggtggacccgagctccttggtgagacctggacccaccgtcttctccttcaaaagcacagggtggcagcggggaaaggatacgttcccattgaaggggcgatggaaaactggaatcagagactgaaggaggcggggcatgggaccccggaagatgcctcccagacgttccaggcctgcttgcccggctccggaggtcttagcagcatcctcggaggttgccaaac

SEQ ID NO: 33293 - DNA, 242 bp, Homo sapiens
  misc_feature 1..242: note = chr10:102976414-102976656
  misc_feature 1..242: note = hyper
  source 1..242: mol_type = genomic DNA
gcaggatggattagccgagcaacgacctagagtctgagaaacgggcaggcacaaacgcttactcagaccaagggacccagaagtcccggacttccacaccagccccgcatccaagcgcgcgcctttgaaaccttcggcctctcctgccagccagagacccgccctgccgttgccatcgggacacgcgggatctttatttatacgctggggtgggtcttttccttcctcgcagaggaggagcg

SEQ ID NO: 33294 - DNA, 1240 bp, Homo sapiens
  misc_feature 1..1240: note = chr10:102977051-102978291
  misc_feature 1..1240: note = hyper
  source 1..1240: mol_type = genomic DNA
attaaaaatatttatcgggagcagatttacgtttctgggtttccagtctcggggcgtctgggtaggctattaagagtaattagcatcttttgcgcatgcagatttacttcgctcattgccacataactcatccctaaaagccggcgcaggcgaaagcaggcgccgccggcggagccgctgccacagctaccgccgctgcccgcccgagcccccctcccctcctgcgctgcccgctcccagtctctccggcccgaattgtccgctccaggccccagacgctgaacacggaacgaaaaggcttccatcctggagacctggagacgagtgacgccagagcgacctcgtgcggttggggaaggcccagactaggctctccaggctggggccgcgccgtctggaccccaggcattgcgaccacgcatgtgtgtgcaccaccgagtgggcgcttgtgtgtgtgcacgctcacgtgcgcgcgagtgcacaggagtatggttgctagtgcgcgttcctgagagggcgaaggggcgcgtggaaaacgagctgatcaccatcctccccttccctgcagcccaccggttcccaggacgacgctcaaacgtcagtcctaggccacccacctagggcactgagtttcagagggagactcgggcccctaccttgcctcgaattcccttctacagagccagttccatccagccaaacggcctggagcactcagcgcccagccgggggaactgggaggcccaacacccggctgcagccgagcgcatggctggcctggtaccggtgagaggccgccagagaaagcgcaggcggagccgggggtcactgaacagagactttcagggtcgctggggggcggctggagacgatgaggccacgcgactgaagggattggggggtgaggagtggtggtgggggcggacaaagggacaacgtggcggtggacgaaccagggccagagagggccgctgtggctcccgctcttcgggccgaagcacccaccacgggttcgttattaacgcgctgggaagtccgcaatccgcccaactttcttctctttaatgagcctagaagaggctgccctgaaggggtttgttcattaaagatgtagctggaggaatattgtctcattaattatctggttttaattacactcctaccctttgaatccagagatgggaaaagttgatttggtggcgccgcccccttgagcttaaagggtcggcctggctagggg

SEQ ID NO: 33295 - DNA, 392 bp, Homo sapiens
  misc_feature 1..392: note = chr10:102978742-102979134
  misc_feature 1..392: note = hyper
  source 1..392: mol_type = genomic DNA
tccaaggacatggctcggtttccagggtccccagagctgggacgccgccgggaaaccatggtcctggaggggagggagttatttgagggggtgcttgtccctgcctcgtcccttgtcaggccccgcgcggcgctaaagcgggggccgttttccctttaaatcgcggacactttgacaggggacattaaggacccggctgctcaggctgagcagatcataaaaccggacaggcaatttctgctcccgccaaatagccgggcaaactcgttctgcatctttggttttaatgcactaaactggcagctaagcagggagcgagcaaaaggggggtgggaagcccccccccccacatacacgggcgcacacaccggcacaggcgcaaacactccttc

SEQ ID NO: 33296 - DNA, 770 bp, Homo sapiens
  misc_feature 1..770: note = chr10:102982287-102983057
  misc_feature 1..770: note = hyper
  source 1..770: mol_type = genomic DNA
gggggggggggtccccgcggcgacgggaaggggcggagggtaggcgcgcggccccagctcgtccctttcaggggggactcatgcatcaaacttcaattttccggacgattgaattagtgattttttttctcctgaactaaaatacacttaagtctttgggattaattaccacgttctggtccctcagactggagtattacttatcggagctgcgtctgacaccggcccgacacctcgtaaaatagggaactgcgcctctctgcctcaccccgcgccgctcgccaggccaccaagccgggaaaggcggagcgaggggaagccgaacaagcgggatcggccgtccgcgcgcggaggggttcctagactggagagcagaaactacccgcgtcccgggacttggcaagccccgtcgagccccgggacacaacggggaagggagagacaaagccgagccgcctctcctggccagcccggaaccgaaagtgggtccgtagagagcccagagtcctgggggaacagatgggcaaagggctctaggaggtgatggaactcaggcccgaagggcaggcagcccacaggataccaagccttaacgaactacgccagaagaatgggcgtagggcccacagcccctcacacaacccaggccaagctccctcgtacactcagaccaggagaagaaacagacacgcaatacacaagccccgctcccttggagcctacacttgggcgaacacaccactgctgtttgcagtatcccgagacaggcc

SEQ ID NO: 33297 - DNA, 293 bp, Homo sapiens
  misc_feature 1..293: note = chr10:102983087-102983380
  misc_feature 1..293: note = hyper
  source 1..293: mol_type = genomic DNA
cgaacttgggatttgaggctctctcacatcgccggtcccagcggcagcgcctgaggcacagccaagaccatccgaggtccccgggccgcgcgcaggtagcagacttcttcagaactgggggagctaaagagagagtgggcttagagcccaggcctccctggatcccagatcctcgcctccgcctacagccaagcccctcagcttttgcccagagctgctgacttcctcgccgcctccctgcgcaatgggacctagagataagccccaagcccgggtgctagtccaggcagagt

SEQ ID NO: 33298 - DNA, 492 bp, Homo sapiens
  misc_feature 1..492: note = chr10:102983434-102983926
  misc_feature 1..492: note = hyper
  source 1..492: mol_type = genomic DNA
cggctgggctccggaagcccacccggaacctgatggaggcagcgaattcctcagagcagaggacactgcggagaggctcgaatccacttcccacattgtgcgggaccgagcgcgcagggcgctctcgcgtggcctccttagctcgggttcagccgaggctctcacgtacacttcgttaccccttccccccgccgcagctctggtccttccttccactggctctcttctctggcctatggaaacaacgaactacttttcgcctttcaaggcccgggtcccaagccacctcctctgtgaagccgccaacaccctggtagctgcctctcagtgttttgcaactggcacggccctgtccctcggtccgcttctactagcgctgggggtgctgcgagtcttgcccactagactaggagctccttgagggcaggaaccgaatctgattcgtttccattttcccagcccccctgcgcggcctggcgcagaaaagacgcg

SEQ ID NO: 33299 - DNA, 15 bp, Homo sapiens
  misc_feature 1..15: note = chr10:102984356-102984371
  misc_feature 1..15: note = hyper
  source 1..15: mol_type = genomic DNA
cggaggtgccagggc

SEQ ID NO: 33300 - DNA, 29 bp, Homo sapiens
  misc_feature 1..29: note = chr10:102984512-102984541
  misc_feature 1..29: note = hyper
  source 1..29: mol_type = genomic DNA
cgaggaggcgcgcgcggggacctaatcca

SEQ ID NO: 33301 - DNA, 1806 bp, Homo sapiens
  misc_feature 1..1806: note = chr10:102985147-102986953
  misc_feature 1..1806: note = hyper
  source 1..1806: mol_type = genomic DNA
ccactccggtgacagcggctactcgccagcccagcgacaacaaaagcccggagagaaacccgctctgtccaggaaagtgaaagcggcctcagcccccgccccagccggccttggggcgccgcagacccgagagagtccttgcaagatccatacctctgcccccagcggtgtgccggggtgtggaggcagaattggttaatgttgccagaaattcacaccagctcccagacgcttgggcttacagttccaggtgcccacattgaaattcagcctggccttgatgcctttagcctttggcccccgactccccaaggatgaggccctcggggctagaatcgaaacttgggaacccaaggctccaccccgcgtctgactgagtgatacctgcagcgctcccggggctcagccctgttttcggggagtgcagggagaatgcccttgggtctggggtgggatgcaggaaatgcagggcaagaccccctcccaccctttgttcaacacaaattaatgttgtactgtggtgtgcccccacatacacaggcattttctcccagcatttcacggctcgttttttaccccgacctggcgaagcccgcttctctcccgatttagcagctgcctcaggtttatgggcaagaggcgcctcctcctgctgcttccccctcgcccttcactcttaagcctgtcctgaaaatcccccccaaatctccaaggctagggcgaccggcacgaagagcggcaagaagcccagcctgccgctgcttctcggaaacgggcccaccactcagacacggtcgccgccggttctagtaaaatggcaaagactttatttattggagaaagaggccttgggtacagtctagggaggagaggggaagggaggagcagggaaggggcactcgcagcccactcacatccagccaccctcctctggccaagtcgggtaggagtggggtgttcgaagtggcaagagagacccagagctgtggaggaggtgaggtgagggcttgggtcggcctcctctctgtctctgtcacatgcaaaaaaattctaaaaagagtacaaaataattatagggctttgggttctgttttcgatagttggttggttggatttccccctgcattgtccctaagagccggactccaacagtcagtccgaggaaatgcgggagggagggaggaatcttaaaaacagcattagtgggcattaggaggcagaaatggcatcgaaaacagacttttctctcagagggtggggaggaaagatcgattttgaaacttgcaagtcaggacctgactgcccacctcttcccctcccacatgaggaaaaaaggcccgaggaaatagaagtcaactgcaataaggccgagggaggcgaggaaggagcgggccggtgcattcgccacatgcagagaaaaatcaaaacagccggagctgccactcccctagaccgcagggttagtgttccccgccctggtttctgtctcgccctcagcaaacccggcagcccgagagctttgaaaacatcgaaatctccgagatttaaaaaataataataaaagaaaggaaaaatcaggctgcggtgggaagaacccgctatataggtttaaatatttatatagaagccatacagaattgcacggcgagggcttccggggcggcggaggccgctggtggcggccggcccggccggccagcctgggtttattgcttcgagagggaagaggcggctgccaggagccgagtccggggccggggacaggggaggaggcgggagttggcagaggaggtcccagctcccctc

SEQ ID NO: 33302 - DNA, 352 bp, Homo sapiens
  misc_feature 1..352: note = chr10:102987206-102987558
  misc_feature 1..352: note = hyper
  source 1..352: mol_type = genomic DNA
gccaccgccggctgtggcctccgagttctgctcgagttcggccagcgccacgatgtccatctgcccgctggggcccagtttcttggcggactctacgtcggccttcatctcctccaggtcccgcttgagcttagcgcgccgattctggaaccaggtgatgacttgcgcgttggtgaggcccagctgctgcgcgatttggtcgcgatcggcgggggacaggtacttctggtatagaaagcgcttttccaattcatagatctggtggttggtgaaggccgtgcgcgactttcgccgcttcttaggggtctgccgctgcccaaagatggtcataccgtcgcggcctgggaggaaa

SEQ ID NO: 33303 - DNA, 215 bp, Homo sapiens
  misc_feature 1..215: note = chr10:102988150-102988365
  misc_feature 1..215: note = hyper
  source 1..215: mol_type = genomic DNA
cggagagggcagaggcgagcagaggcataggggacgaagcgcgcagggcacagggcgcgaggcgctgggtgcaggggaacccagcagctgcgcctaccttcggctgcctgcagaacgctgacctccagccccttaaacgtcttgctggcgagctcctccagcgcgcacagcggcgaggtctgcgagagcagcgcgcggcccgccaggggcaagcc

SEQ ID NO: 33304 - DNA, 141 bp, Homo sapiens
  misc_feature 1..141: note = chr10:102988734-102988875
  misc_feature 1..141: note = hyper
  source 1..141: mol_type = genomic DNA
aggaggggagaacagcgcggggccccgggaagagggcgctgacgcgggcgccgctgctgctggggcttccagcaatccggggccggagccggggcgcgctgcgcggggctccagtttcgccaaccccggtgctatttaaag

SEQ ID NO: 33305 - DNA, 1125 bp, Homo sapiens
  misc_feature 1..1125: note = chr10:102989172-102990297
  misc_feature 1..1125: note = hyper
  source 1..1125: mol_type = genomic DNA
tctctccctctccctcgccctctctttcactctctgtctgtccaatgcaggcggctgtaagttgggaagctcattaattagcgggccgggggtaggaggagccggctggaattagcctgcctaatgcgcctgtcagtccgggcgctgcgctgcgttcggcccgagctgtttgtaaattacattagctgctcctttattgcacccgaacctcgggcgactgaaaagccaccgcccccaccccaaactgcgagccgcgctcctggcgcacccgcctcccgccggcctagctgcaatgaccgcaccggcccgaaggtctcggtctctccgacccgggatgtggagcccgaaagagtggtgggaaccccagcccgggagggacgcggccgccgctcgggccaggtaggaccaggagcccgggtgggccccgctgccacccagagtggactttgcggagctgagatcaagagcccagcgcctctacctctgaccctcttgcccctcaccccactgcctgggcgacgcgcctggggagagggaatctgaagccctcctgcgctggcccgcaggaggtcagagccggctgcgcagccttgggtgggcgacgcgggaagggggtggaggaccccaggggttgggggagggggctagtcggagagctcagccttctccacgcggagaggcggaggagggaattgttggcggctctggacgcctctccccggcctgattccgaagcggccgccctacctcctccggcaatcttgctcactttcctccggcagccgctccccaggctggctggggccaccaacggcctgatgatgggcgtctgaagagtagccaggccaggtgccggggctaacggggccggctccgtgcctccctgctgcgctccgcccgggccccggccggggccccgctgccggccccgcctagcccagcgcccggcttgagtgcatggccaggccgactccagctgttccggatgcggggcgggggcccggcgggagccaggccgcggctggggctttgctctcaggaactcgcagggaggccaggcttccagttaggctggggctaaagaccttagggcccgggatctgtgaatatcgggagaacatgttg

SEQ ID NO: 33306 - DNA, 462 bp, Homo sapiens
  misc_feature 1..462: note = chr10:102996019-102996481
  misc_feature 1..462: note = hyper
  source 1..462: mol_type = genomic DNA
aggtctcactactgtcggggggcgccgggcgcaggccgggcatggggcctgagcttaggccaggtggaaaggtggaaggacctagtggggacagacgaagagaccgaggagccgcccgcccggctaaatggacacaggaaaggcctgagtcaggcttctcataataaataaactgcacgtgaataattcagcagtcgcgcgggggccggttgcatcagcgccgccgccgccgcgcggcgcccaattccccgcggaggggagtagccaattaaggcacttgaaaagggagtcgggtggaagatcccccgcccaccagtatcctggatttacccaggtcgagttcagagagcctccccggtcccaaccccctcgggccccatgggtcagggggccgcctgctgggaagtgctacctcagctaagccgctcaggtgtcccgagactccgggcaagggaagacagg

SEQ ID NO: 33307 - DNA, 123 bp, Homo sapiens; identical to SEQ ID NO: 922
  misc_feature 1..123: note = chr10:102996596-102996719
  misc_feature 1..123: note = hyper
  source 1..123: mol_type = genomic DNA

SEQ ID NO: 33308 - DNA, 251 bp, Homo sapiens
  misc_feature 1..251: note = chr10:102996977-102997228
  misc_feature 1..251: note = hyper
  source 1..251: mol_type = genomic DNA
ttccattaattaggtcgactcccttccttcgccgctccctcctgtccccactcagcctccctacacctatgcggcgagcctcgggccaagacctccgccctggctccgccagtcctgcgggggccggcatgcaccagacctcaaaagggatcttcacgggaattccgcatagccagatcccaagcctccagggaggccaccagccctcccccatcttcttcttcctcctccgtctcctttcctcttccctc

SEQ ID NO: 33309 - DNA, 303 bp, Homo sapiens; identical to SEQ ID NO: 3619
  misc_feature 1..303: note = chr10:102997281-102997584
  misc_feature 1..303: note = hyper
  source 1..303: mol_type = genomic DNA

SEQ ID NO: 33310 - DNA, 581 bp, Homo sapiens
  misc_feature 1..581: note = chr10:102998278-102998859
  misc_feature 1..581: note = hyper
  source 1..581: mol_type = genomic DNA
gcctctctctgagatcgggtcctcctcctgcagggcagcagagtggaagccagggcctgggaccctctggctgggcaaggagggactggagtccggctcccggtgaccccgtccccagtgccagcggtggggtcgcctgtggcggcccggacaggccacgggtccctctccccaagtcccattacgttgtatttatgtttcattttatagtttttttttcctcctcccttattattgtctcactctgggggaggcaaaggatataatatattcatctttattataccaaatctgtgtgaagcatttaataaaacgctgtttccacacagccagggatattagtgtgagctatccttaagttaatgctcctggactgagggcgccgctgccacagcgcctgctgccggcgggtcgcgggaagcgtaggccctggccgccgcgctccccgcgcgggtccaacgccctgggtgcccttctcgcctgcgccttgaagcccccacgcccatcctagcgcgtctctctgtgacctctcggccgccagcctgggaggaggggtttggaagagccgaattcaagcaccc

SEQ ID NO: 33311 - skipped

SEQ ID NO: 33312 - DNA, 304 bp, Homo sapiens; identical to SEQ ID NO: 924
  misc_feature 1..304: note = chr10:103043924-103044228
  misc_feature 1..304: note = hyper
  source 1..304: mol_type = genomic DNA

SEQ ID NO: 33313 - DNA, 106 bp, Homo sapiens
  misc_feature 1..106: note = chr10:103044300-103044406
  misc_feature 1..106: note = hyper
  source 1..106: mol_type = genomic DNA
cgtgcctgcctcgcctccagcccggggtaaggagatccacggaggcctctgcgcctaaactcaggtggccagacagagttggggcgggaggcgggtatacggaaag

SEQ ID NO: 33314 - DNA, 79 bp, Homo sapiens
  misc_feature 1..79: note = chr10:103051188-103051267
  misc_feature 1..79: note = hyper
  source 1..79: mol_type = genomic DNA
tccacgctccctagccgggctgcgaaggcccagatctcccagcgcctccatgccgcgtcggccgcggccttgggggtct

SEQ ID NO: 33315 - DNA, 55 bp, Homo sapiens
  misc_feature 1..55: note = chr10:103052659-103052714
  misc_feature 1..55: note = hyper
  source 1..55: mol_type = genomic DNA
ggcaggagctgtgaccgcatcactctgcctcccgtttccacggattgacacagga

SEQ ID NO: 33316 - DNA, 80 bp, Homo sapiens
  misc_feature 1..80: note = chr10:103326534-103326614
  misc_feature 1..80: note = hyper
  source 1..80: mol_type = genomic DNA
cccagaccgaggagccgtgaaaccacgcggcccttctcggcggaggaacaaagccctgcgctcagcggccgcagggggct

SEQ ID NO: 33317 - DNA, 15 bp, Homo sapiens
  misc_feature 1..15: note = chr10:103534562-103534577
  misc_feature 1..15: note = hyper
  source 1..15: mol_type = genomic DNA
cggctgtagagttgg

SEQ ID NO: 33318 - DNA, 600 bp, Homo sapiens
  misc_feature 1..600: note = chr10:103534896-103535496
  misc_feature 1..600: note = hyper
  source 1..600: mol_type = genomic DNA
acaccctggggctcccggccagcccggaacagggaagcgagctccctgcccagcgcagggcccctgcccgggccttcctagaggagcagggcgcttttaagtagggaggcagccctccccgacccctgacatttataaagacaaatttacggagcaaatgttgagagtgcagggaacctgggcacccgatcattgggccaaatcggccacaagcctcccccgaggggcgctgagagggtctctgctgcagtcacccggcttcccctggcatcgaacatccatcccctggccgcggctgcccccttcctcggcggctgggtgttccctatgcccccagccggcgaggatgcatgggggacagtgctgggctccgagaccttcgtttctatcctggccactcactcgctgtgtgacctcaggaggggtgctacctctctgtgcctcagctccctcctcggggtggctcggggctgggtttctaaggtgccctcagccctcccgcgccggccgcagagtcagtcccggtgcccccgaccggcgctgcccacccgggtctcacaccggcgcgcccggcccccgcctccgcgcacccctcctcac

SEQ ID NO: 33319 - DNA, 49 bp, Homo sapiens
  misc_feature 1..49: note = chr10:103535722-103535771
  misc_feature 1..49: note = hyper
  source 1..49: mol_type = genomic DNA
acgcgctgagcagggcgcgagcggagagggtgcgggtgcgggaggccgg

SEQ ID NO: 33320 - DNA, 48 bp, Homo sapiens
  misc_feature 1..48: note = chr10:103535841-103535889
  misc_feature 1..48: note = hyper
  source 1..48: mol_type = genomic DNA
cgccgctgccggagccggtggccgctggctgctcgggagccggagcgg

SEQ ID NO: 33321 - DNA, 117 bp, Homo sapiens
  misc_feature 1..117: note = chr10:103536140-103536257
  misc_feature 1..117: note = hyper
  source 1..117: mol_type = genomic DNA
ggcggccggtctgggcgcctccccctatccccggcctgtcccctcgcgcgctccccggtcccggacgcgcggggatgggggcgcctagggctgcaaactctgcgggccgggagaccc

SEQ ID NO: 33322 - DNA, 204 bp, Homo sapiens
  misc_feature 1..204: note = chr10:103536299-103536503
  misc_feature 1..204: note = hyper
  source 1..204: mol_type = genomic DNA
cgggtctgggtctccgcctccgggcccagccgcttccgccgccggctacgcagtggtctccgagccacctactgtgtgtcccgccgggcccctgggagcggccgctaaccatgcagcgaatggctgcgcacccggccctcgcgcagtgcgtgccggtgccacccggaccccgctcccctgtttcggccgcgtgccccgtcctgt

SEQ ID NO: 33323 - DNA, 202 bp, Homo sapiens
  misc_feature 1..202: note = chr10:103986018-103986220
  misc_feature 1..202: note = hyper
  source 1..202: mol_type = genomic DNA
gaggcgtatcttggtcgagattggatagcggcggggcgcaggaaagaggtcgcgccagcccgggcaggcagctttgcaagtccgcgttatatatcgcagtggctgcgcccgggatagctggctgcgccgccgcgcacatgcctaggttcgacgccctcctccctttgcccaggagttccttctgtcccggctctgttccgtc

SEQ ID NO: 33324 - DNA, 172 bp, Homo sapiens
  misc_feature 1..172: note = chr10:104000813-104000985
  misc_feature 1..172: note = hyper
  source 1..172: mol_type = genomic DNA
ccctactccctgcctcgcgaagcccctatcctggtttcaagtctccggcttcgttccggatcctctgagtctcccccttccctatcccctggttcttaccctgagtttcccttttcccaagtcctggccccaggtctgcagtccgccctcccattctcgacctgttcccaag

SEQ ID NO: 33325 - DNA, 92 bp, Homo sapiens
  misc_feature 1..92: note = chr10:104001519-104001611
  misc_feature 1..92: note = hyper
  source 1..92: mol_type = genomic DNA
gcgctccggctaggacgcttaggcagagccaagtgggcgagagtagagtggtcccggtagccacgggtaaaagggatcggctggcagcgaag

SEQ ID NO: 33326 - DNA, 153 bp, Homo sapiens
  misc_feature 1..153: note = chr10:104168680-104168833
  misc_feature 1..153: note = hyper
  source 1..153: mol_type = genomic DNA
ggctgaccaccaggtcggtgtagagcacgggcttgaggctgcgcgagcgctgcggccagccgtagcacagggtctccgcgccgcggtgggtgcgcccgtagcgcacggagcacagcgagcgcgagcgcagccgcccggcgctgctgtggatgc

SEQ ID NO: 33327 - DNA, 216 bp, Homo sapiens
  misc_feature 1..216: note = chr10:104170047-104170263
  misc_feature 1..216: note = hyper
  source 1..216: mol_type = genomic DNA
gctggcgcctgggaacgggacctgctcacagggagccagaaagcagtttctagctccagctttgcgctaactcgctgccagaccttggaaaagcttagtccctctcaggcccctctccctccgggttcctgcagcgcagcagcaccgggaaggtctttttggctgtccacgcggcgggggagcagtgtggagtgtacccccatccaatccctgtcc

SEQ ID NO: 33328 - DNA, 106 bp, Homo sapiens; identical to SEQ ID NO: 3625
  misc_feature 1..106: note = chr10:104170407-104170513
  misc_feature 1..106: note = hyper
  source 1..106: mol_type = genomic DNA

SEQ ID NO: 33329 - DNA, 287 bp, Homo sapiens; identical to SEQ ID NO: 3626
  misc_feature 1..287: note = chr10:104170514-104170801
  misc_feature 1..287: note = hyper
  source 1..287: mol_type = genomic DNA

SEQ ID NO: 33330 - DNA, 78 bp, Homo sapiens
  misc_feature 1..78: note = chr10:104629270-104629348
  misc_feature 1..78: note = hyper
  source 1..78: mol_type = genomic DNA
aggagacagtgagtgcgcgccctgagtcgcaggccgaggagacagtgagtgcgcgccctgagtcgcaggccgaggaga

SEQ ID NO: 33331 - DNA, 209 bp, Homo sapiens; identical to SEQ ID NO: 3627
  misc_feature 1..209: note = chr10:105036450-105036659
  misc_feature 1..209: note = hyper
  source 1..209: mol_type = genomic DNA

SEQ ID NO: 33332 - DNA, 163 bp, Homo sapiens; identical to SEQ ID NO: 3628
  misc_feature 1..163: note = chr10:105036700-105036863
  misc_feature 1..163: note = hyper
  source 1..163: mol_type = genomic DNA

SEQ ID NO: 33333 - DNA, 19 bp, Homo sapiens
  misc_feature 1..19: note = chr10:105036864-105036883
  misc_feature 1..19: note = hyper
  source 1..19: mol_type = genomic DNA
ccttaaaagccgggcgcac

SEQ ID NO: 33334 - DNA, 877 bp, Homo sapiens
  misc_feature 1..877: note = chr10:105036893-105037770
  misc_feature 1..877: note = hyper
  source 1..877: mol_type = genomic DNA
cgccctgcctgccgcacctctcctttcttctgtagctcgcgttgaagccgcacgtccggccccgatcccggcaccatgagcttcggctcggagcactacctgtgctcctcctcctcctaccgcaaggtgttcggggatggctctcgcctgtccgcccgcctctctggggccggcggcgcgggcggcttccgctcgcagtcgctgtcccgcagcaatgtggcctcctcggccgcctgctcctcggcctcgtcgctcggcctcggcctggcctatcgccggccgccggcgtccgacgggctggacctgagccaggcggcggcgcgcaccaacgagtacaagatcatccgcaccaacgagaaggagcagctgcagggcctcaacgaccgcttcgccgtgttcatcgagaaggtgcatcagctggagacgcagaaccgcgcgttggaggccgagctggccgcgctgcgacagcgccacgctgagccgtcgcgcgtcggcgagctcttccagcgcgagctgcgcgacctgcgcgcgcagctggaggaggccagctcggctcgctcgcaggccctgctggagcgcgacgggctggcggaggaggtgcagcggctgcgggcgcgctgcgaggaggagagccgcggacgcgaaggcgccgagcgcgccctgaaggcgcagcagcgcgacgtggacggcgccacgctggcccgcctggacctggagaagaaggtggagtcgctgctggacgagctggccttcgtacgccaggtgcacgacgaggaggtagccgagctgctggccacgctgcaggcgtcgtcgcaggccgcggccgaggtggacgtgactgtggctaaaccagacctgacctcggctctgagggaga

SEQ ID NO: 33335 - DNA, 86 bp, Homo sapiens; identical to SEQ ID NO: 10504
  misc_feature 1..86: note = chr10:105041683-105041769
  misc_feature 1..86: note = hyper
  source 1..86: mol_type = genomic DNA

SEQ ID NO: 33336 - DNA, 95 bp, Homo sapiens
  misc_feature 1..95: note = chr10:106398593-106398688
  misc_feature 1..95: note = hyper
  source 1..95: mol_type = genomic DNA
tgcacctccccagtgcgcataggacttgggagaccacactcctccgggctgtgtgagcctcgggtccgcccagatctcttatactgtggcacctc

SEQ ID NO: 33337 - DNA, 61 bp, Homo sapiens
  misc_feature 1..61: note = chr10:106398825-106398886
  misc_feature 1..61: note = hyper
  source 1..61: mol_type = genomic DNA
cgcgcccacctgggcctgcggcgctggaacttttcttaggaatacccgctactccctgtct

SEQ ID NO: 33338 - DNA, 1259 bp, Homo sapiens
  misc_feature 1..1259: note = chr10:106399306-106400565
  misc_feature 1..1259: note = hyper
  source 1..1259: mol_type = genomic DNA
aactctatctactcccgaaggggaggagcagggctggaggctgtctctctctccctaagcctcctccctcctgcctcctcctttcttaatagctcctcctctagctcctctagtctcagacttttcaacccctagaatcccaggggcttctcggaggcggcgagctacaccacatgtcctggggcctgtaaaccgcagctcgaggtcgtctgtgggtttagctcatttcccttcagcccacctgaagtctccttcttcctacggtcacgaaggatctcagctgcaccaagcgcgcaggctacactcctgcagtagcggattggggaccagataagcccacgcggctcccgcctgagtaccctcttaactggcggccgacactttgaaacaattgagtccgttcagaaacggactggggagagtgagggcacgacctcaaaatcctaggcagcaaaatgaggtctggatcctccctggaagaacagacatctcgactactctctcgccccacctctggccgggaggtcggggcaaggagaatccctcaaccgagaagatctggcaagtccccgatcccaccggggccttccgcctcttttccctcatcccctaggaggctttatcaggttctaaccgcttgtagtgggggccgtgggtgctcggggcgccaagaggagggggctgccgagagcggcctgcctagttctcagcattgcctctttgaccactcgcaggctcctggaaatgcaaacacagcccgtgcgtgatccgcacgcgaccaaaagccgagcgcacacctcccgcccccgccccacttgccatcgctcacactaacgtgcacacatgctcgtgcaaacgcgcacgcacggaaccgcgcgccccctcacacccagccgcgctcccggcccggctcagccaggtgcccccacgcggcagcgcccggtctgcccgccggccccctgcgaacccctcgcctcacgcccgcctgcctgcgcgcacgcacgcgcacgcacgcattccccacgcccccgcgcgggggcgcaggccttgggtggcggggtttggccgggagccggccgggccagggagcggcgagcagagtccagggtgcatcccgcgcttggcttccgtgcgcagcctccccgcgcggaggcacctggctccctctcggctctagaacgcgaacagttggcgttgagcacacaactcctcctccttctcccccgagacccctgtaccctccccgcgcgccatctccc

SEQ ID NO: 33339 - DNA, 136 bp, Homo sapiens
  misc_feature 1..136: note = chr10:106400566-106400702
  misc_feature 1..136: note = hyper
  source 1..136: mol_type = genomic DNA
cccctcataacaggcccgaagagtaaacccccaaacgcgtccagaagcggctcccaactcttcgccgggagcacgttggaggctggatttcggagagactcgggattggggtctattgccggcccctcctggatcc

SEQ ID NO: 33340 - DNA, 215 bp, Homo sapiens
  misc_feature 1..215: note = chr10:106400703-106400918
  misc_feature 1..215: note = hyper
  source 1..215: mol_type = genomic DNA
gcttgattttcatattttaagaagattttcttattacctttgattactcctttttaccaaatttctggaggagctcagtggggaggattggggggaatctgattttaagaaagaaagcaccgaaggggcaattattaattttcctcgggtttggaatcaccctctggacaagagaacgggcgagcgggagctaggagggaagagtggagaggacc

SEQ ID NO: 33341 - DNA, 111 bp, Homo sapiens; identical to SEQ ID NO: 3633
  misc_feature 1..111: note = chr10:106401322-106401433
  misc_feature 1..111: note = hyper
  source 1..111: mol_type = genomic DNA

SEQ ID NO: 33342 - DNA, 681 bp, Homo sapiens; identical to SEQ ID NO: 3634
  misc_feature 1..681: note = chr10:106401510-106402191
  misc_feature 1..681: note = hyper
  source 1..681: mol_type = genomic DNA

SEQ ID NO: 33343 - DNA, 554 bp, Homo sapiens
  misc_feature 1..554: note = chr10:106402271-106402825
  misc_feature 1..554: note = hyper
  source 1..554: mol_type = genomic DNA
cggccaagtcggcccccagccttggccttcaggtaaccccggttcctccttcaaagtccagggagcggccctggaaagccgtagcagaggccgtaaaaaaaagtttaaagcgtgaagcgaaattccacacccatccagcgctcatgccacaccgctcgccctcacgcacgcacaggcacacggaagtcgctcagcagaaaactctcgacttcaccattgcgtcctgcgccacaaacggctccctgagcggagttgggtgcctgagcttcctgcacacctctccacccgcttttccccgccaccgggttctcctggacaaggatgtaccgagaggtggcgtcgttgagcccggtctggcctactccggcattccgaactgggcgcccgactgagcatcgcgcctgcctggcagctgcagcggcccgcagcgcgtgcccggaggggctccccctacctcgccggcacccagcgctgtgcagccaagcaaagaaaaggcgggggacaggttcccaccatctccccgacttccctccctcccgcggtccctactagag

SEQ ID NO: 33344 - DNA, 127 bp, Homo sapiens
  misc_feature 1..127: note = chr10:108923771-108923898
  misc_feature 1..127: note = hyper
  source 1..127: mol_type = genomic DNA
tgagtctcccgtcagcgcaaacgtggtgctggtcagtctcagctcctccatccggaagcgggtggctttgtccgggtcccgctcccgagtcccaggctcctgctgccctccatctcttagcactccc

SEQ ID NO: 33345 - DNA, 115 bp, Homo sapiens
  misc_feature 1..115: note = chr10:108923945-108924060
  misc_feature 1..115: note = hyper
  source 1..115: mol_type = genomic DNA
cgctccgctccgtctcctccggccggagcgtgcagcaaccgccatggatgccccagtgccccgagcccgctccagggatagcgctcggtccccgggggccactgagaacagggga

SEQ ID NO: 33346 - DNA, 21 bp, Homo sapiens
  misc_feature 1..21: note = chr10:108924345-108924366
  misc_feature 1..21: note = hyper
  source 1..21: mol_type = genomic DNA
cgctggcggctgtggggggcc

SEQ ID NO: 33347 - DNA, 34 bp, Homo sapiens
  misc_feature 1..34: note = chr10:108924367-108924401
  misc_feature 1..34: note = hyper
  source 1..34: mol_type = genomic DNA
gcgctcaggaccccaactccatccaagttgcgcc

SEQ ID NO: 33348 - DNA, 32 bp, Homo sapiens
  misc_feature 1..32: note = chr10:108924769-108924801
  misc_feature 1..32: note = hyper
  source 1..32: mol_type = genomic DNA
ggtcgaccccgggctcccggagcagtcgatgt

SEQ ID NO: 33349 - DNA, 27 bp, Homo sapiens
  misc_feature 1..27: note = chr10:109674181-109674208
  misc_feature 1..27: note = hyper
  source 1..27: mol_type = genomic DNA
ttcacactccctccccgcttcgctccc

SEQ ID NO: 33350 - DNA, 29 bp, Homo sapiens
  misc_feature 1..29: note = chr10:109674466-109674495
  misc_feature 1..29: note = hyper
  source 1..29: mol_type = genomic DNA
ggagcagcaggagcccggtctcgcagtgc

SEQ ID NO: 33351 - skipped

SEQ ID NO: 33352 - DNA, 117 bp, Homo sapiens
  misc_feature 1..117: note = chr10:109674855-109674972
  misc_feature 1..117: note = hyper
  source 1..117: mol_type = genomic DNA
gcagccgccagcagagcccggtgcgggaccgggagctgccggggcctcagctccgctctccccacagctctccgtggctgcaggttgaggtcgaactgcaagcgccacggaccctgc

SEQ ID NO: 33353 - DNA, 257 bp, Homo sapiens; identical to SEQ ID NO: 10516
  misc_feature 1..257: note = chr10:110225912-110226169
  misc_feature 1..257: note = hyper
  source 1..257: mol_type = genomic DNA

SEQ ID NO: 33354 - DNA, 175 bp, Homo sapiens
  misc_feature 1..175: note = chr10:110671709-110671884
  misc_feature 1..175: note = hyper
  source 1..175: mol_type = genomic DNA
gctctcaatagagggcgcgctgggcgaagtaggggcgtggcaggagccccgctccgcggatccaggttgaaattcctccctcctggaatccgaccgtgagcatttctgagcggtggtgaggaggaggccaccaagacacctccctcccgctgtgcaaaggaacgcaggagcccgg

SEQ ID NO: 33355 - DNA, 345 bp, Homo sapiens
  misc_feature 1..345: note = chr10:110671929-110672274
  misc_feature 1..345: note = hyper
  source 1..345: mol_type = genomic DNA
cgccgctgtctgccaacctttcccagcttttcccacgattggagccaagagaggtccccggggatctcagttgggcaattgtaagggaaggagctcaggacactgacttcaagatgaagggggaggtcagcgaagacagttctagggtgggcggcggccgctgacagagcaggagccacagccaccggggcttggagataggagcaagtcgcaggcggagggggctgcgggctggctgcctgggcagcacaggacttgagggagctgcggggactcctggagtctcatcaggccttccagtcgctgtggggaccccggctgcgcgcggatcgcctgcgccactgt

SEQ ID NO: 33356 - DNA, 51 bp, Homo sapiens; identical to SEQ ID NO: 3638
  misc_feature 1..51: note = chr10:111216345-111216396
  misc_feature 1..51: note = hyper
  source 1..51: mol_type = genomic DNA

SEQ ID NO: 33357 - DNA, 122 bp, Homo sapiens
  misc_feature 1..122: note = chr10:111216682-111216804
  misc_feature 1..122: note = hyper
  source 1..122: mol_type = genomic DNA
caacttttgccatcccgggagccatagcggcagagagggggtcccggacccgaggtggcagcgaggggctctgctttggcagctgtcggggctggagctcaggaccccaactccagccaagt

SEQ ID NO: 33358 - DNA, 74 bp, Homo sapiens
  misc_feature 1..74: note = chr10:111217161-111217235
  misc_feature 1..74: note = hyper
  source 1..74: mol_type = genomic DNA
cgcagcttatgccctggcttgggcagaaaataatattaattactgatcctttgtgctcccggtcctggcttcct

SEQ ID NO: 33359 - DNA, 120 bp, Homo sapiens
  misc_feature 1..120: note = chr10:112257819-112257939
  misc_feature 1..120: note = hyper
  source 1..120: mol_type = genomic DNA
ctggccgtgggcacccgcggggcgcgcggcgcggggccgctggccggcggcggcggcggcatgaaggtcacgtcgctcgacgggcgccagctgcgcaagatgctccgcaaggaggcggcg

SEQ ID NO: 33360 - DNA, 30 bp, Homo sapiens
  misc_feature 1..30: note = chr10:112258378-112258408
  misc_feature 1..30: note = hyper
  source 1..30: mol_type = genomic DNA
ctgtggcttgttgtgcgcttgggagggcac

SEQ ID NO: 33361 - DNA, 817 bp, Homo sapiens
  misc_feature 1..817: note = chr10:112403098-112403915
  misc_feature 1..817: note = hyper
  source 1..817: mol_type = genomic DNA
gcatattcgcacccacgcgccagggcattaagccgaaccttgcttggtggctctcagccttgaaaggccgcaggatgtccgcgtccacagctgtgaaccggtgagtgcaggtggacgggcgcacgcgggcgccagggtaattaacagggcttcagagggcgtgacggtgaccgtacgttgtcggcgaactctcttttcatcctttacatttccacggagatttggccaataaataacaagaataaaatgtacgcatggttttgtctttgcgctcgtggggtcgtggcggggtcttttaagtgaagagaaaaagaaaccagaaacccacggtggccccaccggctgcttccggggacacctgaaatcagcagctggaactgacaatttggagagccccggggatggtcatctgagacctgggttacaatacaagtctgacctcggggcgagtccaggctttcttcccctcagggtcgggtgcctcaagagccagtggcgctggccgggctccagccgcgagcagatgccaggcccggcacactttgcacgggcgatgcgcgcggacgtcccgggcgcgctcggtccgcccggcttggcaggagctgcgagaggccgcgcgcaccgtccccagggacagccggaggactcagggctcccgggtggagcgagagcgcggcggccgaccgcgggctgcgtgtgtcgccttcctcacgcggtatgctgcgccgtggaacgctgggctacggaccctgagggtgcactgtggcgggtggcgtacgccgcgctccctccccgcttcctgcgcccagggtcggcg

SEQ ID NO: 33362 - DNA, 168 bp, Homo sapiens
  misc_feature 1..168: note = chr10:112404226-112404394
  misc_feature 1..168: note = hyper
  source 1..168: mol_type = genomic DNA
agccatgagccaggacgcggaccccagcggtccggagcagccggacagagttgcctgcagtgtgcctggtgcccgggcgtccccggcaccctccggcccgcgagggatgcagcagccgccgccgccgccccagccaccgcccccgccccaagccggcctaccccagat

SEQ ID NO: 33363 - DNA, 253 bp, Homo sapiens
  misc_feature 1..253: note = chr10:112431872-112432125
  misc_feature 1..253: note = hyper
  source 1..253: mol_type = genomic DNA
ggcattgcttttacccggtgggcttcagggagccgtccctgccgcgctttgcgtttctccgcgcacttggacagggttctgccacgagggaggcgatgcctggcgccgcgggtgggggcagtggtgagacttcggcccctggtggccggagaggtcgcagcacttgtcagtttatggctccctcggctttccccttcttaatccgctttctgctgagctctccgaataattcaaccctcgtgtttgaaaacta

SEQ ID NO: 33364 - DNA, 79 bp, Homo sapiens
  misc_feature 1..79: note = chr10:112432360-112432439
  misc_feature 1..79: note = hyper
  source 1..79: mol_type = genomic DNA
ccctgaagatgcttccgtccgcggataggggacgtttcagacctggggtgggcacagcggtccccggtgagatggtctt

SEQ ID NO: 33365 - DNA, 41 bp, Homo sapiens
  misc_feature 1..41: note = chr10:112836758-112836799
  misc_feature 1..41: note = hyper
  source 1..41: mol_type = genomic DNA
ataaaacgagtccaccgtgagcgcagcggagcagcagcagc

SEQ ID NO: 33366 - DNA, 61 bp, Homo sapiens
  misc_feature 1..61: note = chr10:114712100-114712161
  misc_feature 1..61: note = hyper
  source 1..61: mol_type = genomic DNA
ttttctttggcaacccgcagggccgcgagcgccctgggcgccgtggcgggctccgctgccc

SEQ ID NO: 33367 - DNA, 116 bp, Homo sapiens
  misc_feature 1..116: note = chr10:115804051-115804167
  misc_feature 1..116: note = hyper
  source 1..116: mol_type = genomic DNA
ctcagcagtggacagcgggcatgggtctgctgatggcgctcatcgtgctgctcatcgtggcgggcaatgtgctggtgatcgtggccatcgccaagacgccgcggctgcagacgctc

SEQ ID NO: 33368 - skipped

SEQ ID NO: 33369 - DNA, 420 bp, Homo sapiens
  misc_feature 1..420: note = chr10:115804635-115805055
  misc_feature 1..420: note = hyper
  source 1..420: mol_type = genomic DNA
cgcgaggcccagaagcaggtgaagaagatcgacagctgcgagcgccgtttcctcggcggcccagcgcggccgccctcgccctcgccctcgcccgtccccgcgcccgcgccgccgcccggacccccgcgccccgccgccgccgccgccaccgccccgctggccaacgggcgtgcgggtaagcggcggccctcgcgcctcgtggccctgcgcgagcagaaggcgctcaagacgctgggcatcatcatgggcgtcttcacgctctgctggctgcccttcttcctggccaacgtggtgaaggccttccaccgcgagctggtgcccgaccgcctcttcgtcttcttcaactggctgggctacgccaactcggccttcaaccccatcatctactgccgcagccccgacttccgcaaggccttccag

SEQ ID NO: 33370 - DNA, 36 bp, Homo sapiens
  misc_feature 1..36: note = chr10:116163376-116163412
  misc_feature 1..36: note = hyper
  source 1..36: mol_type = genomic DNA
ccttttcaaaagaaccgcaatcgagacttgtagacc

SEQ ID NO: 33371 - DNA, 63 bp, Homo sapiens
  misc_feature 1..63: note = chr10:116164301-116164364
  misc_feature 1..63: note = hyper
  source 1..63: mol_type = genomic DNA
ctccccgtgaggtcacgctcgcggccggacctcctggcggggccgccgcgcccagggtcctcg

SEQ ID NO: 33372 - DNA, 30 bp, Homo sapiens
  misc_feature 1..30: note = chr10:116164624-116164654
  misc_feature 1..30: note = hyper
  source 1..30: mol_type = genomic DNA
tcccacacccctgcccgctgcaaacccaat

SEQ ID NO: 33373 - DNA, 195 bp, Homo sapiens
  misc_feature 1..195: note = chr10:116852246-116852441
  misc_feature 1..195: note = hyper
  source 1..195: mol_type = genomic DNA
gcagaaaaggagagacgtgcggtttcgaggcagcgtctgtaaggggtggagagcgcggggctcggagcctcgcagttctttgttgggggcgcgggcttcgttattcccgaggcagcaatggctccccctcggaggtccctccgcggagaccgcctcgcgcctctcgcagtccccaatccccgcccctcccagccc

SEQ ID NO: 33374 - DNA, 95 bp, Homo sapiens
  misc_feature 1..95: note = chr10:116853397-116853492
  misc_feature 1..95: note = hyper
  source 1..95: mol_type = genomic DNA
gaggaggaggagaagcggcggcggagaggttttctgcggccggaattcccttcaacagcatccctgtcggcgcccgcgagcgcagtctcgccggg

SEQ ID NO: 33375 - DNA, 64 bp, Homo sapiens
  misc_feature 1..64: note = chr10:118030642-118030706
  misc_feature 1..64: note = hyper
  source 1..64: mol_type = genomic DNA
gagggagcctgagtgcggcgggcggggaccccggccgcccctgctccgggcgagggcgcgcgcc

SEQ ID NO: 33376 - DNA, 202 bp, Homo sapiens
  misc_feature 1..202: note = chr10:118031329-118031531
  misc_feature 1..202: note = hyper
  source 1..202: mol_type = genomic DNA
accgcctccctaacccggggattcgcgatcccattccccaaaaagacacttcttccttccacatccaccacacccgcgccccaattttggtgcggagggcggggtgggctgctgcaagcgaccctaggaaagactcagagggtaagaaagcccgcggcgggcctcgacttacccaagagcggcagcgcgaagtacagggtcg

SEQ ID NO: 33377 - DNA, 16 bp, Homo sapiens
  misc_feature 1..16: note = chr10:118031848-118031864
  misc_feature 1..16: note = hyper
  source 1..16: mol_type = genomic DNA
ccctctcccctccccc

SEQ ID NO: 33378 - DNA, 365 bp, Homo sapiens
  misc_feature 1..365: note = chr10:118031865-118032230
  misc_feature 1..365: note = hyper
  source 1..365: mol_type = genomic DNA
ttcccgcctttggggaatttccaacaccggggtgaggacccacccccacccaggtcggggtgcatgtgcgtgttttccaggggccgctgacacggggatggaggtgagggctggagaggtctgaagagggttcctaaagtccaagggggtgtctgttgggttcaacccgagacgctgaacgcaagcaaataaataaataaacggtactttccgagcgtcgcgagcggagcctgcagctgcctggagtccgagccctcggtggcggcggcggcagctccctagccagccctggcgccgaaagagccccttctcccgggaagttggcctccccctcctcgcgtcagccagcgagctcgctcagccgc

SEQ ID NO: 33379 - DNA, 729 bp, Homo sapiens
  misc_feature 1..729: note = chr10:118032412-118033141
  misc_feature 1..729: note = hyper
  source 1..729: mol_type = genomic DNA
cgctcctctcacactctcgcccggtgcccaggactcgggcgcttccgcaccccagcccagggcgagcgcgccggcccgcagtcccggcgtgccccggcaggtgcagcccggcgccacgagcgccccccgggccctaaagttgggagacgccagcaaaaagaaaggggtggccggaggaggggggaagaaggagtggggaagagggacgggaagcggcaatgggttcccaaacagaacgaaaaaaactccaaatgccaccaacctggactcaaccgaccgcgtccagctgcggcgaggagccagtttgtttatttacttatttattctttcagggcaatggtgtccccgccccctccttccctttccgggctcactttatctgcgctaggaaaagaaaaaaaagaaaaaaaaatagatgcggtaatcttcgagagctcgaagggccgagttgggccaggacgatttccgagcagagccctcggctcggatgctcgttagggatgttagtggttattggaagcggcgcggagaatggcgtgttccgaggccagatttcttctggccagaggaccctcggcctgctcctgttcccgccgctccgcagctccagctccctcctaagctcgcccgccaggcagccgcagctgcacacgcccgcttgcggtgggacccgcggccggacccgtactcgcgcacaggacacgcagtgttctgcagccggccgcgggt

SEQ ID NO: 33380 - DNA, 452 bp, Homo sapiens
  misc_feature 1..452: note = chr10:118033261-118033713
  misc_feature 1..452: note = hyper
  source 1..452: mol_type = genomic DNA
cttagggcaatcgagccagacccttcttcggaacacaaagttttcccccacgtcactagtggctgtgattcaagacttggtgctttcaagacacactcagacccaggacgctggagcggcgatcctgggatgcgcccatccgttcgtccacgccagcgcgtgcacactcacactcacacgcacacatgcacacgcagtctctacctctctcctggagctccgacaaggagacaaaagcggagcccccagcccactgcatttaaacccggccagacctggctttagaaaatttataagctgacctccattttggctgtttcgagagtaaattaacaacaacaaaaaaagcctaacatgtacacagcccttcgccccaacccctgggaccgctggttcccagtcgtgctgctcaccccccgccccccacgcctgacacacgctccccttcccgc

SEQ ID NO: 33381 - DNA, 77 bp, Homo sapiens
  misc_feature 1..77: note = chr10:118033917-118033994
  misc_feature 1..77: note = hyper
  source 1..77: mol_type = genomic DNA
atggctcattttgatcgaggggggtaaattgaaaagggcacgggctttggttgaagtttgaggcccgggtgtcaggg

SEQ ID NO: 33382 - DNA, 26 bp, Homo sapiens
  misc_feature 1..26: note = chr10:118034142-118034168
  misc_feature 1..26: note = hyper
  source 1..26: mol_type = genomic DNA
cgccccaaacccgggggacatcctac

SEQ ID NO: 33383 - DNA, 191 bp, Homo sapiens
  misc_feature 1..191: note = chr10:118890913-118891104
  misc_feature 1..191: note = hyper
  source 1..191: mol_type = genomic DNA
tgaactgtctgtgggcggctgctgtgatctcagcaaaaagcggagctcaaggctcagggactccgccgcccacactgtgccccgccttattttggatgcctccaacttcagcttcaggcacagtacacgagtaggggcagtaaggcctggctagggccggtgccgcacgggagctgcgggtccctgcaaca

SEQ ID NO: 33384 - DNA, 145 bp, Homo sapiens; identical to SEQ ID NO: 929
  misc_feature 1..145: note = chr10:118891517-118891662
  misc_feature 1..145: note = hyper
  source 1..145: mol_type = genomic DNA

SEQ ID NO: 33385 - DNA, 59 bp, Homo sapiens; identical to SEQ ID NO: 930
  misc_feature 1..59: note = chr10:118891715-118891774
  misc_feature 1..59: note = hyper
  source 1..59: mol_type = genomic DNA

SEQ ID NO: 33386 - DNA, 444 bp, Homo sapiens; identical to SEQ ID NO: 931
  misc_feature 1..444: note = chr10:118892013-118892457
  misc_feature 1..444: note = hyper
  source 1..444: mol_type = genomic DNA

SEQ ID NO: 33387 - DNA, 135 bp, Homo sapiens
  misc_feature 1..135: note = chr10:118892517-118892652
  misc_feature 1..135: note = hyper
  source 1..135: mol_type = genomic DNA
cgccggctgcgcaggctaccgccggcagccgctttgctctttcctggaggagtgggaagctgtcggccaccgccccgaacaggctcggagaaaagattctgaatttcctttgattagcggcgttaccttttcctt

SEQ ID NO: 33388 - DNA, 362 bp, Homo sapiens
  misc_feature 1..362: note = chr10:118892876-118893238
  misc_feature 1..362: note = hyper
  source 1..362: mol_type = genomic DNA
actgtttcctggggtcgggggtggttgtgattggagttgccctaaaggggagaaaaaccgcaggatttgcccgccaggaagctgtgttgtgtaccgactatcccgagaggtccgcaaagcggggcccaggggctcccacaagccctggtttccctggcaagaggaaggaacgtcctccttttttggtctaaagaaacctggaagcccctggggtctgcgcgcagttttcctctttcaaatattcctaggaatagtcggcagcggcagcagccgcagcagccgcggatctagagcaaacgtcctgtgctttggagttagaaccagtcttttccctcctgggctgggcacggggtcagggcatc

SEQ ID NO: 33389 - DNA, 22 bp, Homo sapiens
  misc_feature 1..22: note = chr10:118893559-118893581
  misc_feature 1..22: note = hyper
  source 1..22: mol_type = genomic DNA
tccgggagtaaggctcgaaggc

SEQ ID NO: 33390 - DNA, 114 bp, Homo sapiens
  misc_feature 1..114: note = chr10:118893679-118893793
  misc_feature 1..114: note = hyper
  source 1..114: mol_type = genomic DNA
cgagcagcgagggcaccggcaggctgaagaggctgtggcccgcggccggggcgcctgcgtgcaatccccccggcccggcgggcccgggacctggagcaccgcccacagccggcg

SEQ ID NO: 33391 - DNA, 38 bp, Homo sapiens
  misc_feature 1..38: note = chr10:118894034-118894072
  misc_feature 1..38: note = hyper
  source 1..38: mol_type = genomic DNA
cgagtccttgccctggtccttcttctgcttggtgcgcc

SEQ ID NO: 33392 - DNA, 23 bp, Homo sapiens
  misc_feature 1..23: note = chr10:118894477-118894500
  misc_feature 1..23: note = hyper
  source 1..23: mol_type = genomic DNA
ggaatttccggtggagggtgtga

SEQ ID NO: 33393 - DNA, 628 bp, Homo sapiens
  misc_feature 1..628: note = chr10:118896177-118896805
  misc_feature 1..628: note = hyper
  source 1..628: mol_type = genomic DNA
aggggagatgtcagccgccagaaccctcccgtccccctccacctccttggcccgagctggatttggggacacagtccccagaagcgtgcagttttggggatggggggcggggtgcggagcgcgaccacaaccaggtagcaaagacactgtgtggagggcaaggggcctaactccataccgctgaccgaaggagggaccacactttgtctttttgtagagtcctccagacaggggagagaaaaaaatccaatcaattccacataggcggacgtttcttccggcctgggggggcctcggctgagccttccgggtcccctgtagcctgagggtacccttgtcgccccgcccgggtcctgcgggccccagctctgggcttgccgaccagaccgtgatccagacgtccccacccccaccctcgagtctccttccctccggagtccgcgcggcggaaggaggagggactgagtcggggccggccgggcccggagatctgctgctggctggggcggcgccgggccggggcccggcctcgcagcctccgccgccggggctaagtgcacgccgcgccatccgagagcggcagagcagagcaccaaagcggcaaccgcggctccgtaaccaagcccag

SEQ ID NO: 33394 - DNA, 30 bp, Homo sapiens; identical to SEQ ID NO: 10543
  misc_feature 1..30: note = chr10:118897545-118897575
  misc_feature 1..30: note = hyper
  source 1..30: mol_type = genomic DNA

SEQ ID NO: 33395 - DNA, 27 bp, Homo sapiens
  misc_feature 1..27: note = chr10:118897820-118897847
  misc_feature 1..27: note = hyper
  source 1..27: mol_type = genomic DNA
ctggtggagctgcggcgaggccgcctc

SEQ ID NO: 33396 - DNA, 307 bp, Homo sapiens
  misc_feature 1..307: note = chr10:118897848-118898155
  misc_feature 1..307: note = hyper
  source 1..307: mol_type = genomic DNA
tcagcacccgcgtcctctgagcacgtccagtgtccccagcctggcgatcaggtagcgaacagcgcaactccgaaatgctgcggctcccgcctgtttctgagacggcgagttgtagttgtccgacacccggggggacgcacactcgctgttgcaattgattacgggtaatttcgcagcccccacgtttcggttacctcatgaatacactaaattgtttggataatatatcagatcgtaatggatggtttctgtccttgtccccaatcaagtaggggtttagccagtgaataaacggaaatgattggtc

SEQ ID NO: 33397 - DNA, 174 bp, Homo sapiens
  misc_feature 1..174: note = chr10:118898864-118899038
  misc_feature 1..174: note = hyper
  source 1..174: mol_type = genomic DNA
ttctcgtcaccttgccggggcagaagccctctccacgccgctctccccattcattcctttatgggaaatgcggagcaaaaggagtgaaagatggcaattatctaattggactattaacaaacagtcctctgagtgcggcggtctggcgtggctcctgggcgggggaagggccgt

SEQ ID NO: 33398 - DNA, 34 bp, Homo sapiens
  misc_feature 1..34: note = chr10:118899284-118899318
  misc_feature 1..34: note = hyper
  source 1..34: mol_type = genomic DNA
cagcgacgcgcgcaccgtccgcacctcccgcccc

SEQ ID NO: 33399 - DNA, 353 bp, Homo sapiens; identical to SEQ ID NO: 935
  misc_feature 1..353: note = chr10:118899892-118900245
  misc_feature 1..353: note = hyper
  source 1..353: mol_type = genomic DNA

SEQ ID NO: 33400 - DNA, 175 bp, Homo sapiens
  misc_feature 1..175: note = chr10:118900323-118900498
  misc_feature 1..175: note = hyper
  source 1..175: mol_type = genomic DNA
cgcccggtcaaagacctggaagaaagctttttaaaaaataaaaatggcccaacccattacattttcttttaggtagatgggggagctggggggcggggcgggggcagtcagggaacaaacagctgcccttagaaatgacacgccctgtgggcaatggcggcgctgggacgtctgc

SEQ ID NO: 33401 - DNA, 630 bp, Homo sapiens
  misc_feature 1..630: note = chr10:118922178-118922808
  misc_feature 1..630: note = hyper
  source 1..630: mol_type = genomic DNA
gttccaaatccaccccgtatcaatttgccttctagaagcggcaggataagcacacgggtttgggcagtgctcacattttgggtttattggcttgatggggttgtttggggcgctctcagttacaaactgcagaagagtgggggcgggggacaggatggggaggaaagggtgggcgaaggagccgagagtaagacaagccgaagggtggaaactgcgggagggagaggaaacgccgaaggcgatgtagagtcctgcgagggaccgggagaggtagggagggatccgagccgcagtcctgagggagagcgaccgcgcgccccgcagccgagctgggtcccttcgccccgcccggaatcccggcccccgcccgccccacgcaagtccccgtgccccctccgggaggtgggagtcgccgggactctgcgctccgccagcctccgtctgctggccgggtccgggatccgcacccggagaggctgaaccgaggctgaaccgaggcggacgcagccccgggtcggtggctcgcctggccgggtggggtgggagcgattttctggcggtggcgtttgcaggaggggaggagacagcgccacccagggcctccccgagcactgccggccaggccgggct

SEQ ID NO: 33402 - DNA, 526 bp, Homo sapiens
  misc_feature 1..526: note = chr10:118923049-118923575
  misc_feature 1..526: note = hyper
  source 1..526: mol_type = genomic DNA
cgacggctggggacgcggagaaccctctccgagctggggtccccgcctgctgggcaacctcacctcaacgtctggcctggcctggggccgcttggactcggcagcggctgcactcctacagagcccagacgcgccttctcgctttttcctttctgggccggggccctaaactcccggaactcgccgcaagaggagcgttgaaaacaaaagggacagcccaagctgtcccgcccgctgcgcccgaggagcatccccttggcgctgcaggctgtcgcctcccccagcacctggcggggcgggtgccaggctgggcctctagacggtttcaccgctgcttatcatttctccttcattttgcaggggcaggggagctgcccctcccttcggagaaaggccgcgcctgcacccaaaggtaaccctcgggtgaccccgggagcggggctgtctggccttggtgcgagaccccgggcggggggtcagaggtttctgttgcatcagagaaacacggcagcgtcaaaaagaaaaa

SEQ ID NO: 33403 - DNA, 1627 bp, Homo sapiens
  misc_feature 1..1627: note = chr10:118924431-118926058
  misc_feature 1..1627: note = hyper
  source 1..1627: mol_type = genomic DNA
tttcaaattacataacggtggtttatatgttcttcctctgcgctcacagaaagcaattttaaagtgtgaattcttcaaagaacgggcaaagcattcacacacagacatgcgtttttattttatgtattgcaaagcgctatgagagagagagagagaaaccaaaaacaaaaatcccagcaaaaggaggccgagtccaaagagaatatgtccggtttctatttcaccaagctcctggactcacatttggccccggagccgagtgctcggtctctttccccgggacgggacagggagtggagttcctagccccttgggtgggaaaagccccgcgcacgtcaccgggtcccgtctgctcactgcttctgcatattttaagcctggacacagcctcctttaggatagaaaggcatttcccaaacaacaccgattctgggggtgtagtgggcctggcgctgggtcctggagagaaggttcagccccccttctcatccctgtactttggggatggctcgtacttggacaggggtgggcctccgccttctccgccttctatcggacctttcttcggatggatttctacgtaaactcggaaggcgatcaaatgcaggcggccaacctccagcgcttttttttttcctctcaaaggcggcgcctgcatttttgggggctccagcccaggctgagaaagtcccctcaaacctctactctgaggttgctcacacggcctgcaaaaacccgacggggcaccccgccaccccaccttacgtttccctagggccaagtcagtggtcaaaaaccaacccggtggtagctgcctttaccaaggaaagacagccaggacgcccgcaccgacggcaacgcgcggacagagaggaccgtgccctctttcgcatgttacggggcgagggggctgttggcgtcaggagcgccctgggaggaacttcgtagcggattcgagagacagagggaattcagcaaacttgctgccccgggctgccggctggagcccggcagattcgctgcgcagcactgccccctggtatccagcgccgaaagtgcccccctccgcagctgcaaggctcctccctgggctgcgcgggacagattttttctcctttcctggctacacgcctaacagagaagctatcccgagggacctcaagaagtccccccaagccgtactcaaaagcctttctccctcctcctcaagcgctcacttccccaaagaggacccggacccctgactgcctgagccaggtccccagcatggtccgcaacccttctcgactccggcatccacctccaggctgacgtctacccgggagggggctggggacccaaggagacttcgactacaggcccaggcgaacggaaggaagaggcttgcgttcagagagacacgtttggagctgggactgttcattctttaaggaacaccagcttccagggcatctttcgttggcaccttggctttccagagaagaaaggaagtgggtatcagggccagcccctcctcgcaccccaggctggagaggtgccgaggtgcttagtcactcagtccaagggcacctgagagatgggggcaaacttggcaggagcttgagcacggaggcgtgatccgcggggg

SEQ ID NO: 33404 - DNA, 557 bp, Homo sapiens
  misc_feature 1..557: note = chr10:118927006-118927563
  misc_feature 1..557: note = hyper
  source 1..557: mol_type = genomic DNA
agagagccaagctctcgcccttcggtttccattcacgctaccctctctgagccgcaattctctctcctgcgttggcactggcagaagttgagacacgctcccaggaatcgcgggccgtggcgcgtacttccacgcaccccagctagttccagagactcagcttgttctgagatcctcttgtcgagcccccttggtcccggcgcccggcctgtgtggtgctcagatcagacttatccacccgagcaccacgcagaccagcgcctggaccaaggtcccgggaaggaagccctcctccccttctcctgtggcttagctcagcgatcagggaggagccagttaagaagtcacagtcgaagccatgactgctgtgtcccggggaggcagtggaaggcgaggagcacggagcggggataccgccggacaacccctccccgccgccccgtcggcgtcctcgctgcgcaggggctcccttgctgccccaatctaaaaggaagccgtcgcggcccagggcacggtaactaaaaggccgtcggggagggagacgggaatgagtgggc

SEQ ID NO: 33405 - DNA, 40 bp, Homo sapiens
  misc_feature 1..40: note = chr10:118927999-118928039
  misc_feature 1..40: note = hyper
  source 1..40: mol_type = genomic DNA
cgcgtggctgtccggagcccctccacgttccccagcagca

SEQ ID NO: 33406 - DNA, 160 bp, Homo sapiens
  misc_feature 1..160: note = chr10:118928364-118928524
  misc_feature 1..160: note = hyper
  source 1..160: mol_type = genomic DNA
tcacacctgtgtccccgatgccatctgcccacgtctgtgtgtgaagcaaaccccgctggcagacgggatggagagagatggctcctccaaaccagaattaggaggaaaaccccgctgagggcgtttcaaaaacccaacaggcgagcggggaaacctgcat

SEQ ID NO: 33407 - DNA, 113 bp, Homo sapiens; identical to SEQ ID NO: 10555
  misc_feature 1..113: note = chr10:119000479-119000592
  misc_feature 1..113: note = hyper
  source 1..113: mol_type = genomic DNA

SEQ ID NO: 33408 - DNA, 466 bp, Homo sapiens
  misc_feature 1..466: note = chr10:119000689-119001155
  misc_feature 1..466: note = hyper
  source 1..466: mol_type = genomic DNA
cgggcacggaggacccgggcaggcatcgcaagcgaccccgaggtaacacggccccggttccctgctcgcagggcgcggtgccggaggggagcgggcccgggggaggcagggaggcagggaggcccccagagctacgcgggcggggctgcggggaccccggggcagccggggcgcagggcgcagggcgcaaggtgcacggggccgagcgtgcagtttgggaggtggcacagttgggggcggcggggatcagggcagcgtcctgggggttctaggttgggtctccagattgggtccccgacggcgctcgcgggcgctctttccagggagcgcgggctctcgtggggacgcgctcgaggcaggtgagccgaggctggggcgcccgggggtgtccccggatgccggtgcgcgcggctccctgacccgcccttccgcggcctgggggacgggagaatggggggtccacggc

SEQ ID NO: 33409 - DNA, 200 bp, Homo sapiens; identical to SEQ ID NO: 3656
  misc_feature 1..200: note = chr10:119001328-119001528
  misc_feature 1..200: note = hyper
  source 1..200: mol_type = genomic DNA

SEQ ID NO: 33410 - DNA, 535 bp, Homo sapiens
  misc_feature 1..535: note = chr10:119294363-119294898
  misc_feature 1..535: note = hyper
  source 1..535: mol_type = genomic DNA
ccctcgggcctcactcgcggtgtctcctccagacgccaggggcaggccacgaagccgagggctccgcgtggccgtgggagaagcggggtgcacggagccttcccgcgcccagacgccgaggggatgcaaacaggggagccgggcctggtatggccaacctccaggatcgaggggccccagaatgtgcgtgtggccgggggcgggggcagctgcgggggccagaactagagtattccttcgctctcccctgggggccgggcccccacgagttgcagcagagcccgtctgtaattagggcctcctggtccggcaaagctgcggctgctcccagagagagttggggtcttctcagggcccgcgatgggggagtggtcgtggtcagacccccgtgagccccttcggaaggtcccagtccctgtccattcttctgtcccgcagctctctccgcgcaggcggggcagagccggggaagaagacgctggacgaggggtcttggggccgcctcgctggctgcggttggaagcacccgttttcc

SEQ ID NO: 33411 - DNA, 259 bp, Homo sapiens
  misc_feature 1..259: note = chr10:119294908-119295167
  misc_feature 1..259: note = hyper
  source 1..259: mol_type = genomic DNA
cgcaggcgctgctctgtggccaccagcagaggtttcccggccgctgtgagtcgcccacgcgagcgacgtggggatacggggcgcacggagtctcagctgccgccacgcagcgcttgccctgcccgagcttcggctcactggcagcggcgaggccaccgaccaccctccgccttccagtcctaaactcggggctggagaccgcaggagctaaaccaggaagaagaaagagggcagggcctgaggccgggaagagcggccc

SEQ ID NO: 33412 - DNA, 933 bp, Homo sapiens
  misc_feature 1..933: note = chr10:119296755-119297688
  misc_feature 1..933: note = hyper
  source 1..933: mol_type = genomic DNA
cgggcgtcttcagccagccgcgagggggcgcggatctgagagagtcgcaccccgggaccccagctcttcctactccaccccaggcagggcccgcgcaggccgtccaaggcctgttctctgaaccacctgggttgggccgcgaaatatgggacctcaggcatggaattgtggctgcacaggtgatcacggcttcctagtccttcttagagcagaacctgtcccactccagcccacctctgcgcccccttcggaaggaagcctactggagctggaattccagcgtgggtggcgaactctcaagccaagagctggagctgatggaggcaggagggacgcacttccaagccatccgggctcctccgtagccagtgagcctcctttaacccctccactggcctggatgacggcctaggcgagactttggcagtgtggcgcgaccccagcgctcccccgccctcgggctcgggggcgcggtgggtaccgcgcccgcgcccggccctcgccactaggcgccgctgcgctcacgccgatcggggccccgggtcgccgcgcccgcctggcgagaggcctctggggaagacgccagaaagggatttgtcgtaataatttttaaaaaatgtttttagggcattaattatacttttcgttttctcaccgccaccctgcgcgttcggagaggccggcgtgactggggatctcagtgggttggaggaattcttaacgcccccgaggcctttccaactcgggacaccattctcgcgcctcgggccgggaaagggctcgcccttcacgggcgtcggtgcggtccgcggcgagccgcgggagcacagggcgggctcagcattctggttcaacgtgaggaccagaacctcggcgatcagggaccaggacgtggcagagtgcagcgggtagcttcgacggcacaaggccatg

SEQ ID NO: 33413 - DNA, 505 bp, Homo sapiens
  misc_feature 1..505: note = chr10:119300923-119301428
  misc_feature 1..505: note = hyper
  source 1..505: mol_type = genomic DNA
tgatcataattatgccgccgcgcgagccaatggggacgagggaactcggtcctaaaatcatcccaaaaccgaaggcgagctcgaaaatgcggacacggcccgggaccggagatgcgatccgtagtcgttagttgcactgggtttgcacagcaaccaccacccccccaccaaccccgggacaacagatggcataataataataatagaaataataataataaaataatatcatctataataataataacattgaccacactgacaaaaataattacgacggaaccttaatagtacagtagcaccatatcgggctctcccctgaccttggactgccggtcccagatattccagaaggaattgttttggggaaggaggtgagcaccctcccagacagaaaacgctagagaccgtggggcgagagagggagagagttggaagcccactgctccggcggggtcggcagctcccggtctcaactcgcaaacgaacgagccgggtcaagaat

SEQ ID NO: 33414 - DNA, 96 bp, Homo sapiens
  misc_feature 1..96: note = chr10:119301759-119301855
  misc_feature 1..96: note = hyper
  source 1..96: mol_type = genomic DNA
cggcgccggccagggactctgcagggaccggggtgccccggagggagtggtgctggtggaggaggaggcggtggctgagggggagtaggtggggaa

SEQ ID NO: 33415 - DNA, 32 bp, Homo sapiens
  misc_feature 1..32: note = chr10:119301915-119301947
  misc_feature 1..32: note = hyper
  source 1..32: mol_type = genomic DNA
ggaggaagaggaggaggcgaaggaggaggaga

SEQ ID NO: 33416 - DNA, 185 bp, Homo sapiens
  misc_feature 1..185: note = chr10:119302876-119303061
  misc_feature 1..185: note = hyper
  source 1..185: mol_type = genomic DNA
cgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctgg

SEQ ID NO: 33417 - DNA, 409 bp, Homo sapiens; identical to SEQ ID NO: 10566
  misc_feature 1..409: note = chr10:119303312-119303721
  misc_feature 1..409: note = hyper
  source 1..409: mol_type = genomic DNA

SEQ ID NO: 33418 - DNA, 30 bp, Homo sapiens
  misc_feature 1..30: note = chr10:119304074-119304104
  misc_feature 1..30: note = hyper
  source 1..30: mol_type = genomic DNA
acctccggcggcagccgatcaatactccgc

SEQ ID NO: 33419 - DNA, 40 bp, Homo sapiens
  misc_feature 1..40: note = chr10:119304439-119304479
  misc_feature 1..40: note = hyper
  source 1..40: mol_type = genomic DNA
tacagactgtcctggcggtgtctgcaagtcggtaaccccc

SEQ ID NO: 33420 - DNA, 40 bp, Homo sapiens
  misc_feature 1..40: note = chr10:119304501-119304541
  misc_feature 1..40: note = hyper
  source 1..40: mol_type = genomic DNA
cgtttctcttctagttctcgggagccgggagccccggagc

SEQ ID NO: 33421 - DNA, 41 bp, Homo sapiens
  misc_feature 1..41: note = chr10:119304788-119304829
  misc_feature 1..41: note = hyper
  source 1..41: mol_type = genomic DNA
cctggccaggctctgcggctccctcccctgcctccagcgcc

SEQ ID NO: 33422 - DNA, 136 bp, Homo sapiens
  misc_feature 1..136: note = chr10:119304850-119304986
  misc_feature 1..136: note = hyper
  source 1..136: mol_type = genomic DNA
cgcggcgccagggcggctgcggagccggccgaggtcaggagcctggggactggctcctctgcgacagcggctggttgggtgccgcaccggtggagacccggcgttccgggccgggcagctgagcaggcgttccctt

SEQ ID NO: 33423 - DNA, 48 bp, Homo sapiens; identical to SEQ ID NO: 10569
  misc_feature 1..48: note = chr10:119305061-119305109
  misc_feature 1..48: note = hyper
  source 1..48: mol_type = genomic DNA

SEQ ID NO: 33424 - DNA, 47 bp, Homo sapiens
  misc_feature 1..47: note = chr10:119307022-119307069
  misc_feature 1..47: note = hyper
  source 1..47: mol_type = genomic DNA
caggcaaaccctgatcgcctacccagggcccccgccacgaagaggag

SEQ ID NO: 33425 - DNA, 71 bp, Homo sapiens
  misc_feature 1..71: note = chr10:119311647-119311718
  misc_feature 1..71: note = hyper
  source 1..71: mol_type = genomic DNA
cctgagagggtcaaacggaatctaccaagcgcgtgtgccgcggctacgttctcctgcgaagtacacatggg

SEQ ID NO: 33426 - DNA, 30 bp, Homo sapiens
  misc_feature 1..30: note = chr10:119312507-119312537
  misc_feature 1..30: note = hyper
  source 1..30: mol_type = genomic DNA
agatgggggtggcctcggtgtgtgtggctt

SEQ ID NO: 33427 - DNA, 368 bp, Homo sapiens
  misc_feature 1..368: note = chr10:119312751-119313119
  misc_feature 1..368: note = hyper
  source 1..368: mol_type = genomic DNA
tattccagcaatcagcgctggaattactggggcgccgcctagaagcaaccgccggcggggcggcagaggatgccggcctccagcgtcgggggaccgcgcccgaaagccgggctgctttgtggggcctctcgcgcctcgcccgcagcttccggcccgcgccctccgctcgaccgccgattttctcgccccagccagccccgtagccagaggaaagtgggagttttgagaaccctctgaccccagccgtgacccctctccgggaggtggcttctcccgcaggacccggtgcgccagaaaactctaggcggcgccacgcttggaagcgcaaggtccattcatcagccgcgccccagcgtctaattggcctt

SEQ ID NO: 33428 - DNA, 164 bp, Homo sapiens
  misc_feature 1..164: note = chr10:119313340-119313504
  misc_feature 1..164: note = hyper
  source 1..164: mol_type = genomic DNA
cctcccggctgctaacgccccaggcttcgcccctgcccccacctccacctgcagaccgagccctccccatctctccacaccctcaggatttcagacccgccttcctgcctctcctaagtacccatcccaggcgctggccttgtggctcggttccgctcacgtcc

SEQ ID NO: 33429 - DNA, 15 bp, Homo sapiens
  misc_feature 1..15: note = chr10:119313528-119313543
  misc_feature 1..15: note = hyper
  source 1..15: mol_type = genomic DNA
cgagttcattagtcg

SEQ ID NO: 33430 - DNA, 42 bp, Homo sapiens
  misc_feature 1..42: note = chr10:119494127-119494169
  misc_feature 1..42: note = hyper
  source 1..42: mol_type = genomic DNA
ctttcaagagctctgcgattacaggctcgttttatgcaaaac

SEQ ID NO: 33431 - DNA, 69 bp, Homo sapiens
  misc_feature 1..69: note = chr10:119494374-119494443
  misc_feature 1..69: note = hyper
  source 1..69: mol_type = genomic DNA
taggaagcctagggtcgccgatgttccaggatggaatgttctggtgtcaccgtgcgggggggtgggggg

SEQ ID NO: 33432 - DNA, 208 bp, Homo sapiens
  misc_feature 1..208: note = chr10:119494848-119495056
  misc_feature 1..208: note = hyper
  source 1..208: mol_type = genomic DNA
cgggagaagttcaggtgggacaggagacacgggggtgaggagatctttgagagggccggccgggaaagtgggggtcgcctgtggctgagagggccgcatgccgaaggtcccgaccccaggctcacgacaggcagcctggcacgcaggaaggggctttgggatagaacgtagcacctggctgagtgcttaacaacgattgaactgacct

SEQ ID NO: 33433 - DNA, 487 bp, Homo sapiens
  misc_feature 1..487: note = chr10:120353831-120354318
  misc_feature 1..487: note = hyper
  source 1..487: mol_type = genomic DNA
cgatggcgtgggggtcgaggtcccgcagcaggttgaagacgtgcagcggcagccagcagacggcgaacaccaccacgatcaccaccagcaagcagaaggtgcgccggcgccgagcgcggtcccagtcggcctggctctgggtcacgcagcccggcaccacgcggttgcggagcttcactgacacccggacgtaagacaggaggatgaccagcagagggagcaggtaggtgaccagcagcagcccccaggcgtagagctggcgctggcgctcctgggagccccagaactcctcgcagaggcgcacgtcgtgcggcttgagctccacgtgataggtgtgcacggcggcgggcagcgccagcaccgcggacagcgcccagatggccagcacagcgtaggcgctgaggcgcagcgagatgcgccgcctcagcgggtgcaccagcacgacgtagcggtccactgcgatggtggtgagcgtgaacaccgacac

SEQ ID NO: 33434 - DNA, 166 bp, Homo sapiens
  misc_feature 1..166: note = chr10:120355260-120355426
  misc_feature 1..166: note = hyper
  source 1..166: mol_type = genomic DNA
gcgctctgccatgctcggtgcttagagaactagtgaagaggacagtgtggggaggatggaatccgaaacgggaggaggggccggcaaacctggccagagcagcgaagaggacgaatctctactgcaggagcttgcacggcccctggagggtcagggtccggaggag

SEQ ID NO: 33435 - DNA, 153 bp, Homo sapiens
  misc_feature 1..153: note = chr10:120355461-120355614
  misc_feature 1..153: note = hyper
  source 1..153: mol_type = genomic DNA
cgtcaggctatcgggaggagccggtgcagtcttaggagggaaggagcggggaaggaagtagcggtgggagattgcaatgcagctgggggcttgagagaggcacgactgacccgttcttaaaggctggatcctgcctagcggccaggttgcgga

SEQ ID NO: 33436 - DNA, 299 bp, Homo sapiens
  misc_feature 1..299: note = chr10:121301494-121301793
  misc_feature 1..299: note = hyper
  source 1..299: mol_type = genomic DNA
gctggcccaaagtgacggccaaggcgaatccttcgtaacgtcagaacttcgctggctcggaccgcagaagtgcccttctccatcctggggttccgccaccctcgcgatcccaccttttggctcctcgcggcagaagcgaaggcccccgacgccccaggcccaggggcccagtcggatgcccgggtccagccgtgctcccccgggcgctcggcatccttccacccacgcccgcagcggaggcggagagcgtcacggagggagaagcccgcgcgccgttccgctttcggaatctggagccc

SEQ ID NO: 33437 - DNA, 166 bp, Homo sapiens
  misc_feature 1..166: note = chr10:122216112-122216278
  misc_feature 1..166: note = hyper
  source 1..166: mol_type = genomic DNA
ctcctgagagcaaagcgaagcccgcgagtgatctctggggaacttcctagaaaaaagaaagaatttcaggttcgaacggtgtagggagggccgaacacgggagcaaggttggccagggctgccctgagccctggagaatccccagagcgatcgtccactacatgcc

SEQ ID NO: 33438 - DNA, 272 bp, Homo sapiens
  misc_feature 1..272: note = chr10:122216485-122216757
  misc_feature 1..272: note = hyper
  source 1..272: mol_type = genomic DNA
cgcgggtgcccggcgcgggcccaggaggcggaggcggctcctggggagagggatccgggagtccctgaggcggccccggctccgcactaggaggcggggtccgcagtatcgccagcggccggcgcggcttcccggagccccggagcccgaggcgcgaggtttaggctgagccctccccggcgcctgcccccgcccggcgcccgcctccgcccccgcccgcggcctggagcgcgcctccctcgcctcccagggtctggcgagccggcgccggc

SEQ ID NO: 33439 - DNA, 42 bp, Homo sapiens; identical to SEQ ID NO: 10578
  misc_feature 1..42: note = chr10:122216793-122216835
  misc_feature 1..42: note = hyper
  source 1..42: mol_type = genomic DNA

SEQ ID NO: 33440 - DNA, 328 bp, Homo sapiens
  misc_feature 1..328: note = chr10:122217053-122217381
  misc_feature 1..328: note = hyper
  source 1..328: mol_type = genomic DNA
tcctgggaccctaggcgcggagcgaccaccgcgcgccgaggctgagacctgctcccgggtctcaccgggcccgcgcctgtcgccagccccgcaccacctgcccgggggatccagggctgcacctctaaacagggacgcgcaccctggcccgtgccctcgggaagtttctccttctgtgtgatctttgaggcccacgttggaagtctttacccctggccccgtctccgattcctccccgctgtgcccagggccagactccttccgtgtccctggctttagcgcccgcggtcctggcgagcgttttcccagcgggcgtttgcggcgcttc

SEQ ID NO: 33441 - DNA, 219 bp, Homo sapiens
  misc_feature 1..219: note = chr10:122708495-122708714
  misc_feature 1..219: note = hyper
  source 1..219: mol_type = genomic DNA
atgatcctaaagggacgcagtggtcccgcccatcgccgcctctacagggagggagccgcggccccgagctggccacgcgatggcgctgtgcacccggccgcggagcccctgcacgtccggctcccgctcgcgctctcggctcgagctccggactccaggctcggagcaggggttcgggctacggttcccggctccgagggaccgcggggctctctgcct

SEQ ID NO: 33442 - DNA, 352 bp, Homo sapiens
  misc_feature 1..352: note = chr10:122738898-122739250
  misc_feature 1..352: note = hyper
  source 1..352: mol_type = genomic DNA
cttctcaaactactgcgcacacaagtcgcctagggaccgaattaacgtgcagccctgatgcagccgcctgagacccgcctttgcagcagcctgccaggaggtgcggatgctgccggcgcctggaccgcgcgttgagcagtgcaggtgaacagctcgcctaacgcacaagccacgcccacaccctttctacacgctttctcgttcacttctcattgcaactccttccgccgcgtggacaggttcagcactctcggagtcgatgtcattattcgccatcgacgcgaacctcggcaaagagacgggtcttaccggtctccgaatgttctcaggccctaagcgcgcagccccgcac

SEQ ID NO: 33443 - DNA, 118 bp, Homo sapiens
  misc_feature 1..118: note = chr10:123356872-123356990
  misc_feature 1..118: note = hyper
  source 1..118: mol_type = genomic DNA
gccccaggcgcactgcgctccctccagcgccgacggcggctgcgggcgaggggcgcccaggcaccggagccgtcgcctccccagcagtgccacccctggccatcgccacccctacggg

SEQ ID NO: 33444 - DNA, 30 bp, Homo sapiens
  misc_feature 1..30: note = chr10:123358301-123358331
  misc_feature 1..30: note = hyper
  source 1..30: mol_type = genomic DNA
tagaaaacaaatgaccgaaggctctaaccc

SEQ ID NO: 33445 - DNA, 34 bp, Homo sapiens
  misc_feature 1..34: note = chr10:123873006-123873040
  misc_feature 1..34: note = hyper
  source 1..34: mol_type = genomic DNA
gcccgtggttcggggcgcgcgccagtggctggga

SEQ ID NO: 33446 - DNA, 38 bp, Homo sapiens; identical to SEQ ID NO: 939
  misc_feature 1..38: note = chr10:123922645-123922683
  misc_feature 1..38: note = hyper
  source 1..38: mol_type = genomic DNA

SEQ ID NO: 33447 - DNA, 29 bp, Homo sapiens
  misc_feature 1..29: note = chr10:123923517-123923546
  misc_feature 1..29: note = hyper
  source 1..29: mol_type = genomic DNA
cgcccgggccgccccgagtctcccgggga

SEQ ID NO: 33448 - DNA, 46 bp, Homo sapiens
  misc_feature 1..46: note = chr10:124221003-124221049
  misc_feature 1..46: note = hyper
  source 1..46: mol_type = genomic DNA
tgcccgtccccaaggcggctcgtcaccgctgcgaggccaatgggct

SEQ ID NO: 33449 - DNA, 206 bp, Homo sapiens
  misc_feature 1..206: note = chr10:124221715-124221921
  misc_feature 1..206: note = hyper
  source 1..206: mol_type = genomic DNA
caggttgaggggcagcgaagcgttgtggggtggccagggcaactctcggggacaggcaggtgggccccggggtggcggatttccgcgggctgcctcggaaccgagcttcgcgcccagcccggggccggttctgcgcccagacgatgccagtacgcccggcctgcactctggggctcgagacgccgggcgaccggccatggagtgcc

SEQ ID NO: 33450 - DNA, 327 bp, Homo sapiens
  misc_feature 1..327: note = chr10:124639199-124639526
  misc_feature 1..327: note = hyper
  source 1..327: mol_type = genomic DNA
tccagttggcttatgcgcatgcgtttctctggtgcaggttctcaccaaatccagaagcggcgggcatttgaaatgatgtaagccgggagtcgctctgcctgcccgtttctgcgctgcactggccgacacttaagcactggaagagaggcctggcaggaggcggcgcagtggacacgcggtccgaggacgggggcctcacccgccgccccacgcttgcctcttcctgggatgccgcaggcggggccctaactcacagcctcctcacccgggctcgtgtctgcgcccgcgacttcgactgggaggagcttctggcgccacctgcgccac

SEQ ID NO: 33451 - DNA, 30 bp, Homo sapiens
  misc_feature 1..30: note = chr10:124892329-124892359
  misc_feature 1..30: note = hyper
  source 1..30: mol_type = genomic DNA
ccctccttccctccccgagtccttcctgga

SEQ ID NO: 33452 - DNA, 73 bp, Homo sapiens
  misc_feature 1..73: note = chr10:124892950-124893023
  misc_feature 1..73: note = hyper
  source 1..73: mol_type = genomic DNA
gggaggggagtcaaccggagaacttggggcgacaaccggaaagccgggatccggtagccgcacagcagggatg

SEQ ID NO: 33453 - DNA, 147 bp, Homo sapiens
  misc_feature 1..147: note = chr10:124893246-124893393
  misc_feature 1..147: note = hyper
  source 1..147: mol_type = genomic DNA
ctctccacgcatactcggccgcgtggcaggctgtgtgcaggcggtgcccacccaaccctcatagacctacgtgcatcgagctatttctgcggttgggggaaaatgacctctgggtatccagcagcgattgggcgacctaggcccagt

SEQ ID NO: 33454 - DNA, 1013 bp, Homo sapiens; identical to SEQ ID NO: 3661
  misc_feature 1..1013: note = chr10:124893594-124894607
  misc_feature 1..1013: note = hyper
  source 1..1013: mol_type = genomic DNA

SEQ ID NO: 33455 - DNA, 826 bp, Homo sapiens
  misc_feature 1..826: note = chr10:124894870-124895696
  misc_feature 1..826: note = hyper
  source 1..826: mol_type = genomic DNA
gggctcgcggccgttagtgcgcttcggccaagggcgccgcctgctccgcgtccctcgctcgcctcctgcgctcgcaggagcgctccgagtgcctctttagcgggagccaatatccttttgtgctaataggcttgtcctcatttgctgcctaattggactatataaagccaataacgggcgggctcttatagcccgaagccaaagcgccaaaatccgagggaaggcgaggagggggcggtggcggaggcggctgcggggccggggctcggctgagccttcgcctgcctaatcccatttgccattgtacgcgcccaatcgccgtatactccccgcatttaacttggatgacattttgatttcatcattagcatccggcgccggattgacgcagcctcgagccggggactgctcttgctgcctcctccgcgggagccgcagccgcagccgagccgcctcgatccctcggtgccgcggcagggccgctccccgcccctccgcacccctccctcatgcgagcccgcccgtctgggtcctcactccgccctcccgccgttggatttgcgcccggggcggcccccgactttgcgccccgtagttgagttccgtttatggtctgatttccggcctctcgcctgctcgccccgccgcccgcctgtcccgctccctccctcccggggacccggaggagaggggaccatgccggaacccgggccggacgctgccggcaccgccagcgcacagccccaaccgccgccgccccccccacccgctcccaaggagtccccgttctccatcaagaacctgctcaacggagaccaccaccggc

SEQ ID NO: 33456 - DNA, 701 bp, Homo sapiens
  misc_feature 1..701: note = chr10:124895832-124896533
  misc_feature 1..701: note = hyper
  source 1..701: mol_type = genomic DNA
cgacctggctttccctcgctttgagatcccggcgcagaggtttgccctgcccgcgcactacctggagcgctccccagcctggtggtacccctacaccctgacccccgccggcggccacctcccgcgacctgaaggtaccgacctctctttgaactttcgttgtccccctgcgcgcccgccccgtccccgccccgcgctgcttccctccgcagttctgggaccccagcacccgcaaaccctctgctcggtcagtttttttcggcccctagcctgccctcgcgctgggttgcgctgcccgttaatccaatcccacttggtgagaaaagaagtggaattggagccccgggcacggtgcttcccgggaaaagtggcctcgggcgtgaatagggaggcttcggacggccggggcttgggacacggcctggaaggagggggtgattccaatgcgcctaagccgaaagggaaccgttctgccggcccctggcgaggaagctgagggaatggaaggaggtggccgcgctaccaccatctgcttgcctgtcctcgggaggagggggatcccaggactcggcgtcccttctctggcccagccgagaaggaggcagcccgcgggaatggtgaggcctcatggcctgggacctggaggccggcgcgggttgagcctgccgtccccaggcgccgggcctcgctcaaggctgtgt

SEQ ID NO: 33457 - DNA, 767 bp, Homo sapiens
  misc_feature 1..767: note = chr10:124896937-124897704
  misc_feature 1..767: note = hyper
  source 1..767: mol_type = genomic DNA
ggagcgagccggcctggccgcgtccctgcacctcaccgagacgcaggtcaagatctggttccagaaccgccgcaacaagtggaagcggcagctggcggcggagctggaggcggccaacctgagccatgccgcggcgcagcgcatcgtgcgggtgcccatcctctaccacgagaactcggcggccgagggcgcggcggctgcagccgcgggggccccggtgccagtcagccagccgctgctcaccttcccgcaccccgtctactactcgcacccggtggtctcttccgtgccgctgctacggccggtctgaggccccagaggggtgggggagggagcgcccggcctccttgtccggaccccggaggagactgggccgggccgagggcgccgagaagtccagcggccttcaggaactggggcttgggcgcgcagcctctgcttcccctcccccagtcggtagcattttgtaagtatttgcaatgcattttcgtgcaattcatccctaatggattggaggcgcttcccctcttacttttggtttttggcttatattaagagaaagcaggaacaagacaaaattttcgggtcagagatttcggccgatagtttttgtaaaatgtgcagccctcccttccaaatttccattgcgcggtggctttttggttttatttttatagaaggaaaataagcgcaaaacctaaatccctctagtttattcttttctgcttttttttttttttccgagacggaatcttgctctatctatt

SEQ ID NO: 33458 - DNA, 29 bp, Homo sapiens
  misc_feature 1..29: note = chr10:124897944-124897973
  misc_feature 1..29: note = hyper
  source 1..29: mol_type = genomic DNA
tgagccactgcgcccggcctagtttattc

SEQ ID NO: 33459 - DNA, 114 bp, Homo sapiens; identical to SEQ ID NO: 3667
  misc_feature 1..114: note = chr10:124899035-124899149
  misc_feature 1..114: note = hyper
  source 1..114: mol_type = genomic DNA

SEQ ID NO: 33460 - DNA, 247 bp, Homo sapiens
  misc_feature 1..247: note = chr10:124899671-124899918
  misc_feature 1..247: note = hyper
  source 1..247: mol_type = genomic DNA
ttctctttcccctggcgcccaacacctcctgggcggcatctctagatccccgaccctgtcctggcagacgccgagaagcgtagcgctcaccacacccgcgcgctactgggttccaggccgccgcgctcttagtgagcagcctgcggaggcacagcgcgccggaaccgcctggaagggtgggtccgcccgacagaagcaggtgcctgggcgacactcgctggccgggtgtggccgcctgcctttaagc

SEQ ID NO: 33461 - DNA, 30 bp, Homo sapiens
  misc_feature 1..30: note = chr10:124901599-124901629
  misc_feature 1..30: note = hyper
  source 1..30: mol_type = genomic DNA
tggaccgggatgcctcgaagtccctcctca

SEQ ID NO: 33462 - DNA, 155 bp, Homo sapiens
  misc_feature 1..155: note = chr10:124901892-124902047
  misc_feature 1..155: note = hyper
  source 1..155: mol_type = genomic DNA
ctgcccccccaccaccgggcgctcattctgagccgcgacgccccctcaacaggctcccggcaccgcagagccagaggccacgcggtgagaaccccagtgcgtgcgctcttcttgtgtgagaggccggaggtagagttgggagaaagaggagccgg

SEQ ID NO: 33463 - DNA, 431 bp, Homo sapiens; identical to SEQ ID NO: 943
  misc_feature 1..431: note = chr10:124902138-124902569
  misc_feature 1..431: note = hyper
  source 1..431: mol_type = genomic DNA

SEQ ID NO: 33464 - DNA, 721 bp, Homo sapiens
  misc_feature 1..721: note = chr10:124902607-124903328
  misc_feature 1..721: note = hyper
  source 1..721: mol_type = genomic DNA
cgccctctcgctgtcccccaccccctaacccgggctttgaggtgtgagcgatcccttgcctctgggcctaggactctggaagtgtgcacggccgttgtgcagggtggatggtgttgaccttttgacctgaaaacagttgggggctggggagcggaggaaggatggcggaagagaggaaagagccacgagaacaactaggcgggatgtacttttgagccctgccgggtgtctccgatcggagtctggggttgagatttgggctgcacttgtccccggtgtgtctctccggcggagtaccctgaaggtgcacgaggtggggagcataggctgaggtgggtaatcgggtcctggatagaaacacaaccctcgtcctcactggggcccatgtatgcgcctgggattcctccccacccttccatttccaggacccctaagggtatcactccagcgacggggcggttctggagacccgagggaagggatagctggagactgcagcgcgccttctccgagagtcccctggaggtgcgcatgagttgtactagcgcagatctcttccttggctgctgctcctggcgatgcatctccgggggaaacttcccaaagtctgagttgccggggttccaaaaggatccctttgggtttaggcctgggagaggtatagagccagcgagagagcgcgttgcgcctatcactgaggcaggagcggtgaggtggagtc

SEQ ID NO: 33465 - DNA, 30 bp, Homo sapiens
  misc_feature 1..30: note = chr10:124904318-124904348
  misc_feature 1..30: note = hyper
  source 1..30: mol_type = genomic DNA
agggagacagggggtcgatcccaaagatgc

SEQ ID NO: 33466 - DNA, 582 bp, Homo sapiens
  misc_feature 1..582: note = chr10:124904595-124905177
  misc_feature 1..582: note = hyper
  source 1..582: mol_type = genomic DNA
tatgctagaaaggggcggcaaggaaggttgtttcttgtccctcccgtccttgcggtgtgacggctataggtgctggaggggcgggaggtccctcgggctatcaatcgaggggagctcaggggaactgcagtcagtcaggctgcagagctgggtctccaccacagccttccttgccccagccccgtgcccaccaccatctcttccctggtaaagtgcacgcactagtaggagctcagtgaacgtttgctgaatgaatgtgtgagtgtgcgcaggcgtttatgcaagtgccttcatgcgaattaatgcgtcctttgccgggtgtggcagcagaggaagtgcctcggtgaagatcagaccctcgaagcgattagagggacgggacagaggaaatacaaggcaagatggatctttttgacttcccaaactatccctaggggaaggagagatagggacgcaaggcttcataacttccttgtttagagtccgcaagccaggcttcttgcaagggtcgactccccagtctctcactgtttcagggcctgggagttgcttttccgaggcccacttcgaggtcccctgatc

SEQ ID NO: 33467 - DNA, 30 bp, Homo sapiens
  misc_feature 1..30: note = chr10:124905596-124905626
  misc_feature 1..30: note = hyper
  source 1..30: mol_type = genomic DNA
ctggccagttcccctcggggctgccttgac

SEQ ID NO: 33468 - DNA, 15 bp, Homo sapiens
  misc_feature 1..15: note = chr10:124905865-124905880
  misc_feature 1..15: note = hyper
  source 1..15: mol_type = genomic DNA
atttgtaatgtgtct

SEQ ID NO: 33469 - DNA, 145 bp, Homo sapiens
  misc_feature 1..145: note = chr10:124905919-124906064
  misc_feature 1..145: note = hyper
  source 1..145: mol_type = genomic DNA
cggaggccggcacctgcccctcgctggcctcccgggccgctgcgcgcaccccctggcccccgccccctcgcctgcccctgccccggctgcgcggccgactcctaatcaattagcccattaacgagcccctcgaggagttaagtag

SEQ ID NO: 33470 - DNA, 115 bp, Homo sapiens
  misc_feature 1..115: note = chr10:124906829-124906944
  misc_feature 1..115: note = hyper
  source 1..115: mol_type = genomic DNA
ggagtacctactatgcgctgctagtgcttcgaggcttttaatccctacctgaggcaatccgagaagttattttcaactatgagggcagagaggctttaatcggcatgagttgtgc

SEQ ID NO: 33471 - DNA, 1027 bp, Homo sapiens
  misc_feature 1..1027: note = chr10:124907268-124908295
  misc_feature 1..1027: note = hyper
  source 1..1027: mol_type = genomic DNA
caagcccctgggaggcgcggagacccgtcgcctgcggaggcgtcgagccactccagctccgagtcccgcaccgcccctgcctctggagagaagggtccaaggggtccaaggagtcggagttgccgcagccgccaggaacccgggctagaatctgcagctgctttcagccctggctgcccctggttagacgccgctgatgcccgccaggccctcggcgcgctctgggggcgcaccggtgctgtgtgcctggccggagcgttttgaaattttccggggccgctcggcggcgctgcgattggccgcgttcgggtaacctctatgcaaatgaggccgcgccgcctccgcgccgccggagacccggcgagttggcgggcgaggaaggggcatttgcaccggggctgggcgggcgcacccagagccaggcgggcaggaacccctgcgcagccatccggtgcctgcatgtccctggcgcggaagggacgcctcaccagcctcggcgccccctccccctagatttcctccccgcccctccccactgcctgcctgctgcaccaccttccacccagatcacccagatcgtctctaaagggagttcttggtttccttcgatttcttatgaacccaggatgggcagcaaagaagatgcgggcaaggggtgtccggcggccggtggcgtctccagcttcaccatccagtccatcctgggcgggggcccctcggaggcaccgcgggagcccgtcggctggccagccaggaagcgcagcctgtccgtgtcctcggaggaggaggagccggacgacggctggaaggcgcccgcctgcttctgcccagaccagcacggccctaaggagcagggccccaagcaccatccccccatcccttttccttgcctgggtaaggatcgcacgtcgccagtgtggcagcgagcgagcgcgaggggagggaggctgagcgccccgccaagactcccgcgccgggccccctctggccagagctgcggcagccgggggttcgggaccgcggggag

SEQ ID NO: 33472 - DNA, 211 bp, Homo sapiens
  misc_feature 1..211: note = chr10:124908904-124909115
  misc_feature 1..211: note = hyper
  source 1..211: mol_type = genomic DNA
gtcgcttttaaaggacggggtgctgggtttggggggccagtgagagggataagaggaggggattggtaaggtgggaccaaggctgcaggcgcttgccaaccgcttggtcccagggagagctggcggtctccgaggctccccaaccaactccatggcctttctgtctgttctcgctcctcaggtacccccaagggcagcggaggctcgggcc

SEQ ID NO: 33473 - DNA, 286 bp, Homo sapiens
  misc_feature 1..286: note = chr10:124909252-124909538
  misc_feature 1..286: note = hyper
  source 1..286: mol_type = genomic DNA
ggcgcggccaagaagaagacgcgcaccgtcttttcgcgcagccaggtgtaccagctcgagtccaccttcgacatgaagcgctacctgagcagctcggagcgcgcctgcctcgcctccagcctgcagctcacggagacccaggtaaagacttggttccagaaccgccgcaacaagtggaagcggcagctctcggctgagctggaggcggccaacatggcgcacgcgtcggcgcagactctggtgagcatgccgctggtgttccgggacagttcgctgctgcgcgtgc

SEQ ID NO: 33474 - DNA, 92 bp, Homo sapiens
  misc_feature 1..92: note = chr10:124910363-124910455
  misc_feature 1..92: note = hyper
  source 1..92: mol_type = genomic DNA
gtggctggagctgcccgcccactctccctcctaacgcccagaatcgtcgcgcgggctggggcgcaccccggctggaatccagctcaagagtc

SEQ ID NO: 33475 - DNA, 515 bp, Homo sapiens
  misc_feature 1..515: note = chr10:124910708-124911223
  misc_feature 1..515: note = hyper
  source 1..515: mol_type = genomic DNA
cgctgcgcccagctacccggccggtggcagagttatgtgtctcgcgcggagagggaactgggcgcggtgaggcagttctgcggctcaggagagatccgaggcccgggaccaggcaaagaaggtgagggaggcaaaggcgcttccctacactcttttgttgttaatagtttgcattggttcagcgtgtggctggatcaccggctagcacgcggccgcttgctctgaatggaaccttgacgcgcggcgggggcgcccacggacttcctcgccctgacacctgcggccgcgcaggggctgggagggcgctgcaccgagagaatagccgcgggagtatcatgcaaattgcagattctcgctcccaatagattgcagccacctgttcttggcaaaacctcggaaaaggaagcctgagcttggaggaagccggtggttcagcaccacctggggcgagctcctccggcctctggctgggcagagcggatgcaaaggagcctggagtccgcagcgctgaggcc

SEQ ID NO: 33476 - DNA, 97 bp, Homo sapiens
  misc_feature 1..97: note = chr10:125425515-125425612
  misc_feature 1..97: note = hyper
  source 1..97: mol_type = genomic DNA
agcggagacagagctcgcgggcatggggtgagagcgggaggaagcagaggcagaggcggagcaggggcgcaggtgcctgcaacccaggatcccgggg

SEQ ID NO: 33477 - DNA, 259 bp, Homo sapiens
  misc_feature 1..259: note = chr10:125425689-125425948
  misc_feature 1..259: note = hyper
  source 1..259: mol_type = genomic DNA
cgcgccaggtgcctgcccgtgaggcggcgcggggctcccgggtggctgcgcgcccagacgcctgcccgggaggccgcctgaggctccggggtggccgcgcgccctcctgggagccatggcggctggggccggtggtcgccgggcggcggcggcgccgaggggctgagccggccgcgggcagcgccatggcggcgccgggttgcggaccctgagcgccggcgcggggcgcgcaccatgaactcgtgggacgcgggcctgg

SEQ ID NO: 33478 - DNA, 414 bp, Homo sapiens
  misc_feature 1..414: note = chr10:125650749-125651163
  misc_feature 1..414: note = hyper
  source 1..414: mol_type = genomic DNA
caacagggagattcccgggactggcccatcccagacacacacaatgggagaagccagttgtcccctggaggcgcgcaaccaccggcgccccctcgggctgcccagcgcagaaagttccttacctggtggaggcggctccggagccgacttctccctcttgggagctttcttgggcttggtggccctcttgggcggcctgggctcctgcgggcgccgctcccactcctccccgggccccgcaggcagcggcggagagaaggtctcgagctcgggctccgggcgcgcgtagtagggctcccggctccagatctcctgcccgtaataatcagggtcctcgagggctgcgccctgggctccgaccccggccagggtcactgccaggagcaccagggccagcgctggggtagcggtccc

SEQ ID NO: 33479 - DNA, 88 bp, Homo sapiens; identical to SEQ ID NO: 3676
  misc_feature 1..88: note = chr10:125651372-125651460
  misc_feature 1..88: note = hyper
  source 1..88: mol_type = genomic DNA

SEQ ID NO: 33480 - DNA, 30 bp, Homo sapiens
  misc_feature 1..30: note = chr10:125732174-125732204
  misc_feature 1..30: note = hyper
  source 1..30: mol_type = genomic DNA
aggtgagcggcagggcggggatggagggac

SEQ ID NO: 33481 - DNA, 372 bp, Homo sapiens
  misc_feature 1..372: note = chr10:125851165-125851537
  misc_feature 1..372: note = hyper
  source 1..372: mol_type = genomic DNA
gccacacttcattcccgagaactcggtacaattaacttaaccaacgtgaacaaggcgaaggcgcccagctgtcacagcggctccgcgcacgcaggcagacgaagaagggcccccgcccccaggagctggtcccagcctccagcctggcagcctccttcgaagacttccctacactgggcgcggacctccagccgccagcagccggcaacccagccccagccttcctcctctatacccgccgtcccagccgcgccggccggccccgggcgcagggcgggcgggaacgtgggcacccggacagcgacggggaggtcaagcagctgtgcccaggacccgggcggctccgaagcctcaacacgcacacactcgcgc

SEQ ID NO: 33482 - DNA, 303 bp, Homo sapiens
  misc_feature 1..303: note = chr10:125852195-125852498
  misc_feature 1..303: note = hyper
  source 1..303: mol_type = genomic DNA
ccggggagagagtggcggatgcccacttacctgccccgggccgcgcctggaaacttccccaaagtgcgataggggtgtgggggcggagcgcaaggctggggggaatccccgtcccctaccgccaaacgacgcgcgctcacaccgtgaaagcactggtctgtccgtcggtcggtcccccgcctgcggctcccagagctgggcggtgcaggggcgccccgattccgactactgggctccttctcccggacagcccgccggtgcgttccacgcggcttgcgccccccgccggcctccggctatcca

SEQ ID NO: 33483 - DNA, 506 bp, Homo sapiens
  misc_feature 1..506: note = chr10:125852540-125853046
  misc_feature 1..506: note = hyper
  source 1..506: mol_type = genomic DNA
cggccgcgtcctctctgcgagggagggggcgtgtgtcgccgctgggtaacccttcccgcggggtcctcaagcgcgcagggcgcccggagcgcggccaggaccaatggcgaagggactcctcccgctggggatcgctgaagcctcggggaggccgggccaaggagcccggggcccaaacctgcctcggctcgtcgagctcgcaagttcattgtctgcctgggccgccgccgccaccgccaccgccaccaccgcgccgggagcgccgcggggagtgaggctgcgcgccgcctccgccggcccggactccctacgcccagccccggccgccgccggcgctgcctggcccgaacccgcggaggggcgccggagccccgagcccagggccagacctcctaccgccgctcctcgccgaccccacctcggcgtctggcacctaacttgtacctgagaagcctgagtccagcccgggagcctctgcggctccggctccgcgggagcgcgcccag

SEQ ID NO: 33484 - DNA, 140 bp, Homo sapiens
  misc_feature 1..140: note = chr10:125853707-125853847
  misc_feature 1..140: note = hyper
  source 1..140: mol_type = genomic DNA
ggtctggagccagcccgtacattaatattcaaggccacagcgctggtgagttcggcgccctctgttgtatttttgcatcccgggaaggctggcccggctctttggcccggcgtgttttgcttccgcgggggaggtaaagc

SEQ ID NO: 33485 - DNA, 15 bp, Homo sapiens
  misc_feature 1..15: note = chr10:126135816-126135831
  misc_feature 1..15: note = hyper
  source 1..15: mol_type = genomic DNA
ggacactttgaagga

SEQ ID NO: 33486 - DNA, 846 bp, Homo sapiens
  misc_feature 1..846: note = chr10:126135877-126136723
  misc_feature 1..846: note = hyper
  source 1..846: mol_type = genomic DNA
cgcggcgggcaggggtgcgctgacacccgcgcacctgcacccccggtggaggagccgagggcacacgacgatgccaatccctcgtgaatcccgcgaaagaggggccagggggctccggattcatagacgcggggcgtagaagggggtcaggtaggaaggcccaaggaacggcgcgaaagggctcccgggggcggcagccgtcagcgggaaggaggcggcggacgggaagaggacattggccgcggagtaggaggggaaagtctggaagtgcagagcgccggtgccgggagggccaggactgccccccgagccgccgccgccgccgccccccgccgcccctggctggggcgcgccaccccccacctgcgccgcgccgtcggcacccgggttctgcttcttccacttggtcctgcgattctggaaccagattttgacctgcgtctcggtgaggctgagagacagcgcgaggttcaggcgctcgcacactgacaggtagcgcgtggcccggaacttgttctccaaggccaccagctgctcgtaggtgaaggcggtgcgcgcgcgccgcggcttggcgcagttgggctccaggcgccggcgcctgggacgcggggagccgggggatcccgggggggacctcacagggccgcccccgccgtcctcgcagggctccccagacgccaatgccccggccggggcgtcaggtgagcgcgctaggcccggcagcaagcgcgcagcccgctcccgcagccgcggcctcctcggatcctccgcatcctcctcctcttccgcctcggaaccctccaggggggacgcctggccggcgcctgggcccgcagcatctagggg

SEQ ID NO: 33487 - DNA, 150 bp, Homo sapiens
  misc_feature 1..150: note = chr10:126137255-126137405
  misc_feature 1..150: note = hyper
  source 1..150: mol_type = genomic DNA
aaggtaagttttaatcgaacaatattaggatcagacagggaaagggggtttgaagtcggtacctgcaagctgcgggcaggagatatgcaggcgccagtaatagaatatcgatcacgagggtgggggaagggagggcggcccctcggagag

SEQ ID NO: 33488 - DNA, 1466 bp, Homo sapiens
  misc_feature 1..1466: note = chr10:126137640-126139106
  misc_feature 1..1466: note = hyper
  source 1..1466: mol_type = genomic DNA
ccttcatcaggtgtccgccagcgttgggagtaattcagaaagggtttcgagaagaaagtaccgaaagcttcccaacactccatccgagccccgcccccagcccagtcccagttaacagttgagtctggggagcttgagcgcctggggcagcccagccccgcaggcgtctccgggtggcacctgacctcgctactcacgaagacccccggcgcaagccttagcgtcagctcccccatccataaaatggaggtgatgttaatgatgctgtccatctctcaggttccgaagttttcatcacctttatcccagcccttagcccaggtcctagcacgtggcaagcgcattaaatgcccgataaatgagtaagcctggcaagacaggcgccaggtaagtttccaccgcgagcatcagaactgtggtgcgggtgagcttggcgggtgagcagggatgcggcaaatccctgccctgtaatgcggggagcctcctctctgcctctatccaagtccgaggcgggggctacacttcgcacccggtcccgtgcgccttctctctgaggaagacgctgttaagggccactcaccgggcccggctgttcccccatacactccgcattgttggggctgaggcctcctggggccggggccgccttgcatcttaccaggggtctccagctgtcggacagggtccctggagctggcatctttccccgcttcgacctccgccaaacttttcctggcttcccggggagccgggcgcacggcagggagcgctgcgcgggtgaatttctgtgggtccaggatgtccaggacagagaaagaaatcttgtggtgggagggagccgccttggccccgccgtcctgccatgccagcatgcccgtcgcccacgggccggcggtcggcggcgcggggttggggatggcgccgctcgggcttgccttcggctgtggcttggcggtagctttccagccaggagccgggtccgcgctgccaagtgaagctggggaggggggcggggaggcggggcggggagagcgccgcggggggctgcgcgccgattggcaccggcgcagcccgggccagcctcgggactatcaggcgctgtgccgcggccgcttgcctgggctcggggaagcctccgcgcgcccggtgcgcgcgaccgcggggacagtgttgtcgtctccgcgcgcctccgcccaaccctctgggactctccgagggcgcgagggaggcttccatcccggggatccctcaccccgacacacacacctctgtgacttgagtttgttccctttctccggtgcacccgccttagacttggggatgcaactgaggccaggactgcttactcccaggcaatgctcagcgcatctccttccccgccagtgaattactgtaatagcttcagacccggttacctcggaggtaaaatccctcacgttctcacagtttagcgttcacaaagccct

SEQ ID NO: 33489 - DNA, 338 bp, Homo sapiens
  misc_feature 1..338: note = chr10:128075686-128076024
  misc_feature 1..338: note = hyper
  source 1..338: mol_type = genomic DNA
gaacttgagagcttgcggccaagggaagtcgttcatcggtggaccgacagcgccccgggcggcagaaagaaggcggcggcggcggagacccggggaagttgccggatttttaaaaaggcacctgctgggtgagtcctcactgtgcaaacgggagccacaggtgcccgattttaaggggctacaactcgggaaaacctaagtctgtaaaactaagtacgttaaactaagtaagttctcgctgtgcaccaagttgatgggggcgattatttacggcggagaaactgagtggaggaaggagggagaattccgctaaagtttgcctgcgactgacagctagg

SEQ ID NO: 33490 - DNA, 268 bp, Homo sapiens
  misc_feature 1..268: note = chr10:128076347-128076615
  misc_feature 1..268: note = hyper
  source 1..268: mol_type = genomic DNA
ccaagagggtgaggacgggggagcggtcccgaggctgtgccctccggggcaggtactggctcctgtggggctgcgggccaagtgtcgcccttccccaaggaattggcacctggggggggggggtcggtctcgccgcgctggaagcgcaagccccggggctccggagatgcgccggggcgcgtcgcccctcggggcagccctggacctcggcgcgcccaggcgcagcgtgcggtgccctcggcggggcgggcagcgagccgccctagtt

SEQ ID NO: 33491 - DNA, 301 bp, Homo sapiens
  misc_feature 1..301: note = chr10:128076940-128077241
  misc_feature 1..301: note = hyper
  source 1..301: mol_type = genomic DNA
cgttctggcacaagccagccttgaccgttgcaataaatgagcaaactgtccgagttggcccggggactaggaagagcgttagtgagagaaggcaggcctgtgaaatggatccacggccagcagtcaccgttcttattaccgcggaacaaattattgtctcccccgcacccccgccagttggcggcgtcccgcgggtcctagagaccgctcgggtccccccgccagggtcccgccccgagccgcggctcgctcacccccgagggtgggcggctcagacgtggctcagtggcgtccgggcgcc

SEQ ID NO: 33492 - DNA, 32 bp, Homo sapiens
  misc_feature 1..32: note = chr10:128993490-128993522
  misc_feature 1..32: note = hyper
  source 1..32: mol_type = genomic DNA
ctccaggagctgccccgaccccgggctgcccg

SEQ ID NO: 33493 - DNA, 147 bp, Homo sapiens
  misc_feature 1..147: note = chr10:128993580-128993727
  misc_feature 1..147: note = hyper
  source 1..147: mol_type = genomic DNA
cgttggttggtttcccacgcctgtcccggtctgactcgggctgccaggcaccgggaagccccgcggcgccgaccccaacccgcagccccgggaaggtgccaaccccagcgagtggaggagacgagcatttcacgtgggcatctgcct

SEQ ID NO: 33494 - DNA, 483 bp, Homo sapiens
  misc_feature 1..483: note = chr10:128993945-128994428
  misc_feature 1..483: note = hyper
  source 1..483: mol_type = genomic DNA
gtctggaacccacatcgcagaggcgcagccccgctcctccctgacgtcgccaaagttgccagacgcccctcagcgacccggtcgcgccagatgcagttgcataaccttgccccccacctgcgaccgcaccgggtccgctcccggctgcaccggggtgtcccggccccgggagccgccgagtttccggccaagccggtttggggccgagtgtgtgcgcccgaatcggggtcggcgcccgtcccagcggtgctctgcccgcggccaagtacgacgggcgcgggggcgcgggaggagggcacgcggggctccgcttaccttccgctgcttacagataagtcgaggtcgatgcagcgcctggctcgggcatgtctcgctgcggaccctggcaagcctggggcggcacggagcactccggacagggcatccgcggccagactcgccgcgctcacgcggaggaagcctcggctccggggacttggcccg

SEQ ID NO: 33495 - DNA, 82 bp, Homo sapiens
  misc_feature 1..82: note = chr10:128994727-128994809
  misc_feature 1..82: note = hyper
  source 1..82: mol_type = genomic DNA
gagggaagtcctttccgctgctccaggtcccagctactccgcggagccgggcggccagaggcgagggcgccccaagccgcgc

SEQ ID NO: 33496 - DNA, 393 bp, Homo sapiens
  misc_feature 1..393: note = chr10:129535054-129535447
  misc_feature 1..393: note = hyper
  source 1..393: mol_type = genomic DNA
tggggcgagatgtcccgagccgagcaaaggggccgcgcattggacggggctcccaagccacagccctgggggccttgaggagtcgtggtacggtccagggcagtcggggctgcggggcccgtgaagccagacgaggctacggacttagggtccctgcaaccaagaccgcgagcgactgtggactcgggacggatcgcacaaaggaggaagggggaatcagaggggcgtccggtccaggacgtgtcaggcctgggcggggcggaaaactgacaccagggcgaggacaaggatttcgctcctccagggctgccaggggaggggctcgccaccgtcactctccatgggctctggccccgacggtgtttaaagggcggagggctgggccgggctggt

SEQ ID NO: 33497 - DNA, 69 bp, Homo sapiens
  misc_feature 1..69: note = chr10:129535695-129535764
  misc_feature 1..69: note = hyper
  source 1..69: mol_type = genomic DNA
cgcttcgggtcccgggcctgcgccgccctacgcggccccgagctacggggctcccggcccgctcctcgg

SEQ ID NO: 33498 - DNA, 184 bp, Homo sapiens
  misc_feature 1..184: note = chr10:129536040-129536224
  misc_feature 1..184: note = hyper
  source 1..184: mol_type = genomic DNA
cgacccaggtaacagcggcgcgccggctcgctccgtccaggactccccatcttcccgccgggccgcgggcactccgggggtgggagcaccttagacaacctaatttctccctgcgcggttggggatacccggggaggagggagaaggggaagaagtgcttgggcatggacaggttctcagacag

SEQ ID NO: 33499 - DNA, 52 bp, Homo sapiens
  misc_feature 1..52: note = chr10:129536258-129536310
  misc_feature 1..52: note = hyper
  source 1..52: mol_type = genomic DNA
cggcggtcccggggctctcaatctctgtgcgctccttcggaggaagaagcgg

SEQ ID NO: 33500 - DNA, 197 bp, Homo sapiens
  misc_feature 1..197: note = chr10:129947985-129948182
  misc_feature 1..197: note = hyper
  source 1..197: mol_type = genomic DNA
ggatcaggtcaccttcgcaggcccagactccaccgtcagctgccgccgacggagcccacagaggaggctcgggcgcccgcgccccctgcgcagcggcccctccgcagcggccccagcccgcgtccccgcagcgccccttccgaagcgccccctccgaagcgcccacagcccgcgttcccgcccgcaccccagcccgc

SEQ ID NO: 33501 - DNA, 30 bp, Homo sapiens
  misc_feature 1..30: note = chr10:129948725-129948755
  misc_feature 1..30: note = hyper
  source 1..30: mol_type = genomic DNA
acgttgtgggacaaacgcctttcaactgtt

SEQ ID NO: 33502 - DNA, 379 bp, Homo sapiens
  misc_feature 1..379: note = chr10:130008498-130008877
  misc_feature 1..379: note = hyper
  source 1..379: mol_type = genomic DNA
cacagtaatcagaggcggcctttacaaatagattgcatttgaccttgttggtttgatggacgggagtggagtccggccgcggacggcgtcccttccagggccggccgccagagggcgagcgcgccttcccgggcggggcggggacgggacggggacggggaggggacgggacggggacggggaggggacggggacacggacacgggaggcttccgctcgcccgcgggtggcgtctctgctcccactagagcgggccaggcctctgggttccgtttctcaagcacacagggagggtggccgcgggccaggggcggccgcgagactccacgtccacgtcccgggcagtccctccggaggttgggccgcgcggcccggggag

SEQ ID NO: 33503 - DNA, 283 bp, Homo sapiens
  misc_feature 1..283: note = chr10:130008906-130009189
  misc_feature 1..283: note = hyper
  source 1..283: mol_type = genomic DNA
cggggcctttaggcgcccccgtttcctcgtcagtggggggcgcggtgccgcttctccgcgggctaaactgctgaggaaggggcgagttcctgcggcccctgcctgtcccggccacgccccacctccgccccgccgcgttgcgcgttcccgcggggccccgggcacccctggggccccggggatctctgacgcccccttccctccaacccccgctgcgatcccacaggtggggtgaacagcgcccctgctgtcccacggggcgtcttcgcgggtgatgcccaca

SEQ ID NO: 33504 - DNA, 150 bp, Homo sapiens
  misc_feature 1..150: note = chr10:130085049-130085199
  misc_feature 1..150: note = hyper
  source 1..150: mol_type = genomic DNA
acgcagggtgcaacccggacgcgcccccgggggaagcccgcgacgcagcagccacacccccagcctgcactggcgcccaccccatgacttcgccttcgcggtcgcgggcagggagcgcgcgtttccatcggttgattagaagcgggagtc

SEQ ID NO: 33505 - DNA, 76 bp, Homo sapiens; identical to SEQ ID NO: 947
  misc_feature 1..76: note = chr10:130085200-130085276
  misc_feature 1..76: note = hyper
  source 1..76: mol_type = genomic DNA

SEQ ID NO: 33506 - DNA, 83 bp, Homo sapiens
  misc_feature 1..83: note = chr10:130085355-130085438
  misc_feature 1..83: note = hyper
  source 1..83: mol_type = genomic DNA
cgcacgggtccccgggccgcggcgcgctccccgccacgccgcacatcaaggcccggccggccggcgggcgccttcattagcag

SEQ ID NO: 33507 - DNA, 115 bp, Homo sapiens
  misc_feature 1..115: note = chr10:130338811-130338926
  misc_feature 1..115: note = hyper
  source 1..115: mol_type = genomic DNA
tgggcccccagctcacgatgcccgctaggagccggcgccggggcgccccaaggctgcctccccccgcagcgctgcgcagtgcgccctggtgggatggggacgctgcacccctgaa

SEQ ID NO: 33508 - DNA, 30 bp, Homo sapiens
  misc_feature 1..30: note = chr10:130339387-130339417
  misc_feature 1..30: note = hyper
  source 1..30: mol_type = genomic DNA
aggacctcgttttagcggattttttccttt

SEQ ID NO: 33509 - DNA, 56 bp, Homo sapiens
  misc_feature 1..56: note = chr10:130339734-130339790
  misc_feature 1..56: note = hyper
  source 1..56: mol_type = genomic DNA
tgccggggatttcctcgggtgttggggaaacaagacgtgctcgcctaacaaagact

SEQ ID NO: 33510 - DNA, 30 bp, Homo sapiens
  misc_feature 1..30: note = chr10:130830055-130830085
  misc_feature 1..30: note = hyper
  source 1..30: mol_type = genomic DNA
tatactgtagcaaagcgatggtggaagagg

SEQ ID NO: 33511 - DNA, 38 bp, Homo sapiens
  misc_feature 1..38: note = chr10:131265287-131265325
  misc_feature 1..38: note = hyper
  source 1..38: mol_type = genomic DNA
gggcatgcgccgacccggtcgggcgggaacaccccgcc

SEQ ID NO: 33512 - skipped

SEQ ID NO: 33513 - DNA, 136 bp, Homo sapiens
  misc_feature 1..136: note = chr10:131757717-131757853
  misc_feature 1..136: note = hyper
  source 1..136: mol_type = genomic DNA
agaggccgatcagaacgccccgaggctaaagaagcagggaaggatggtcgcggcgcaggagcagtttgccaagggccgagggccgcgcccgccctgccctgcgcgctcccccggctctagcaagtctggcgccccg

SEQ ID NO: 33514 - DNA, 46 bp, Homo sapiens
  misc_feature 1..46: note = chr10:131758276-131758322
  misc_feature 1..46: note = hyper
  source 1..46: mol_type = genomic DNA
cgcgctcagcccggctccgccgctgggaacccgagctggggatcgg

SEQ ID NO: 33515 - DNA, 2203 bp, Homo sapiens
  misc_feature 1..2203: note = chr10:131761134-131763337
  misc_feature 1..2203: note = hyper
  source 1..2203: mol_type = genomic DNA
atgtcctttcaccagcgcagaaaaggagagccagccgctgcaggggcggcgagcacgcagcaggcacttaccgttgctgtacaataactggagtttatagtggatgccgttgttggttttctcgttgtttggctcctgaaagtaacgataaataattgcatttagtgcgatcggtgtcaggcgcggccaccacgctcggtccccctccgcgaccgaggctctcggcctcacacatggcaggattcctagctcgaagcagcgcggtgatgtcactttcctgctggaagcccagcgttctcctcgccccgagtaagtccgagggcgcagagaagttgcccagccctcggcggtcccgggcggccgcacgtggcggcggcggggtggcctggcggagccgagcccgccgcctaggggggcactcgaacccccgcgcaccggcaccgcctgcctcccgcttctagaaagagagagggtgtgatcgtgtgtttgcacttactttctctttctccacaaagtccacaaaagcggtcctttcaatctccaccggctgcccctgcctatcgtagagcgccagcacgaagtggaagaaattggatttccggaggttggaaggcggctgcttctcgaagtgcgcccgcgccagccccacgccgctgcgggaggaaagagacagcggcccggtgaggagcgcggcgccggccggcggagggggccgggccgggccggggccggggccagggcgcgcgggggcggccggtacgtacctctgggcggccgtgttggcgtccaccacgcccgccgtgtgcatccacgagcgcaccgggttcatgccgctgcccagcggctcctccttcatggtcgtccccccgcgcggaatattctcctgaatcccaaacatgaaaactgctggcggcggccgcagctcccggccgaaagcgtttcctcgagcagcggcgctcggggcttggcggcaggcggctgccctggccgccctcgccctgctcggcgcctgcggtccggccccgccgccggcttcagcccgtcccgggcaggcgcgacatacaccagcggccgggcgctccggacggccaggggcgcggaggcggctccaccggcggcggcggcgcttcgaaggagcaggacgcggtggccgcggcggcgcttgttgttgttgttgtttgcaggcgcgctcaacgtggtgtcatcctagccaggcggcgtccgcggctgcaggacactgcgggatcgcccgcttctggcgcggcccgcctgctccaaagacaaataaacggggcagtgagtgctgcggcgcagtcccgggcgcaggcggggcgcggcggggcctggagcggcgcgcgcagcggacggaggcgcacaaaactcagccctctctccccgaggaatggaccctttcccgggagccaaaactcgaagcccccgggagcggcgctgtcagagggtgacgtcggggggcggtgcctgcgccatatatgggagcggccgcccctcgccgcgcccctcgccgccgccgccgccgcgctcgccgactgactgcctgacggcgccgcgagccggcccgagccccgcgagccccgcgagccccgccgccgccgagcgccaccgagcgccgccgccgccccccgccacgcaccgcggctcctcgcgtccagccgcggccaaggaagttactactcgcccaaataaatcttgaaaagaaacaaacgcagccactgcacaattgcagtttggccccttaatacctccctgcaaaacctgccacacagtcgaacacgatgggcggggcggggggctgtaaaatgctgaggcgccccaagttgcccagatgcatgcaataaatgcaaggggctgcagcttgtcctggggccgcccgaaggagaagtgggaagaggcaggtcgaccgcagggagggcgccggagggaggagcgggcaacggactgggaggaggggtgcccagggctccccggccaaggctggacgcgcagctcagcctgatttctaagcagacctaaggctgctgcagggccggccggtcccggtctgagccccgccaggtaccccaagcttcctaccccggcggaggccgccgagtgccgggcagggaatcacgtcggaggcagggtctgccagatgctccctctcccccggtggccgcggcagaccccggcccctggcctgttctta

SEQ ID NO: 33516 - DNA, 292 bp, Homo sapiens
  misc_feature 1..292: note = chr10:131763632-131763924
  misc_feature 1..292: note = hyper
  source 1..292: mol_type = genomic DNA
gggactccgcgcccaggagcgcggcccgcccaaaggacgtctgcgcgacacggagcagagacccaggggacgaccaggaactgtcctaggcacttccctgccaagagaaatcaggcccttttgattaaaagaaaaaaaaaaaaaagattgcagggcgcaagtgtgttgcagggcagcctcctcccgccgggtctggggcagcactcccttttcccgtgaattggcagcgtgtgtacgttaatattttaattaatcgggaaagtcgaagtccgattcacgttgtctggggacc

SEQ ID NO: 33517 - DNA, 243 bp, Homo sapiens
  misc_feature 1..243: note = chr10:131768685-131768928
  misc_feature 1..243: note = hyper
  source 1..243: mol_type = genomic DNA
cttctggaagctaaccgcgcacaaaagtttgccaataaaattctagtttgaaaccgcggtttgccaacacgagtaaaggaagttggggtggtggagagctacagtgggcacggacggaaagggtggccacggtcaccgatgtactaatgtcctcctcctcggctacccgatctcactccttcacagcaccttaacagagtgtatacacccgttctggtgcgcaaaagtggggcgatgggtgcc

SEQ ID NO: 33518 - DNA, 100 bp, Homo sapiens
  misc_feature 1..100: note = chr10:131768929-131769029
  misc_feature 1..100: note = hyper
  source 1..100: mol_type = genomic DNA
gcggccgggccggggagtccgtccgggtaattaactcagctccggcgactgcgacgatgaggccgggagggaaggaagagcataccgctcttggacagaa

SEQ ID NO: 33519 - DNA, 848 bp, Homo sapiens
  misc_feature 1..848: note = chr10:131769428-131770276
  misc_feature 1..848: note = hyper
  source 1..848: mol_type = genomic DNA
tgctgggcggcaaggcggcccagggcatagctaggggccatgtagaaataaaaacagataaagaaaagaagaaagaaagaaaccggcttctcttctagactattaataagcaatttgtcccgctgaaatttacattgcaaagcggagggcgccggcagccgtggcggcgggcctggcgcgggctccgggggtgcgtcggcgcgggggcggggggggtcctccggccatccgggccgccctcgggggcgatccaccggcggctttgaactcggtgtccttgccgccgtgccgccgaccctcgcccgcacacgcgcgcatctgcacgccagggccccgcctgggctgcgcacccggaggccgggactggcgctgcgctagcgccacccgggctgagctgcagccttttgtggggggggcgggaatccctccgctcccagtgacgccttggactcgcggacccccatccgccccaaacgactgcccaggccttaaattaaaaatggcaacaataagcttaatttttttttcctccttagccgcgccgccccggtccaagtctaccgcaagcgtggagccccgagcgccgcgcccccgccggctctcccgcccgcgcgccgcccgacggagccgcggatcccgggcctagcgtggggccagggcgccatctacgggcgccgcgcggctccgggcggccgccgcctcctccctctcagcgtccagagcccgctcctcctcccgccgccgccgccctcgccccgcgccgcctgccacttatcacaattacccgacgctcccgtgccattttgcttatgaaacactgattgctagttatgcggacttttaagcac

SEQ ID NO: 33520 - DNA, 491 bp, Homo sapiens; identical to SEQ ID NO: 10635
  misc_feature 1..491: note = chr10:131770603-131771094
  misc_feature 1..491: note = hyper
  source 1..491: mol_type = genomic DNA

SEQ ID NO: 33521 - DNA, 21 bp, Homo sapiens
  misc_feature 1..21: note = chr10:131771281-131771302
  misc_feature 1..21: note = hyper
  source 1..21: mol_type = genomic DNA
gggagagcccacgggcccggc

SEQ ID NO: 33522 - DNA, 137 bp, Homo sapiens
  misc_feature 1..137: note = chr10:133109124-133109261
  misc_feature 1..137: note = hyper
  source 1..137: mol_type = genomic DNA
agctgaaacagctatcgatttccagcttgctttcaagtctggcagagactgtgaaagtcctaacttctccgcgatgtcagccacggcccgcggcggtcacggagccacttcagcacctcgcgatggacagtgacccc

SEQ ID NO: 33523 - DNA, 121 bp, Homo sapiens; identical to SEQ ID NO: 3684
  misc_feature 1..121: note = chr10:133110064-133110185
  misc_feature 1..121: note = hyper
  source 1..121: mol_type = genomic DNA

SEQ ID NO: 33524 - DNA, 322 bp, Homo sapiens
  misc_feature 1..322: note = chr10:133110553-133110875
  misc_feature 1..322: note = hyper
  source 1..322: mol_type = genomic DNA
cgggtcccctggcccggaagttgagccgcgggtgcctggtctgaagttccgcgccccacagtggcccgcgggcctcggcggctcctgccctacgccctccaaggcaccaggcaggtggccccagggcctttgcccacgacaccccctgggtggggcaggaccacccctctgtgaattcgtcctggatgcccccaggcacagtctgtactcctccctcccccagcacacgcggcctctgacgctgcacgccgagcttcctgggacccaggacgaaccgggctccaaggaccctcgctccgcccggaccacacgcaggcagcgc

SEQ ID NO: 33525 - DNA, 515 bp, Homo sapiens
  misc_feature 1..515: note = chr10:133794727-133795242
  misc_feature 1..515: note = hyper
  source 1..515: mol_type = genomic DNA
gccatattttaaaaacgctgtaaccccctcccatctccgcgttcacccttgaggaaatcctaacagtcaccatggatataaacattaataacaaaattaaagctcataacaggccacttgccacgccttggtgtttggtcattaaaaccaatactggtctgaactacagaccgcggagggcaacgtggactttgaggctgttcggtccaactgcgagacgcagattcacctccaggtggaattctagctcgcgcggagctggagaatcggggctttcccgtgcggtccgacccgggtccaagccaacccccgcccgagtggcgaggccgcgaaccccgggcagtacgcggggtccccacgccccgggctccgcatgcccgcaggaggggtgggtacggaaggggaggatggcgcagcctcgcccggcccgcgatgccccctaggcctccccggcaacctccccttggcgccctcttggccttccccaggcttcccccccgcgccccctcggctcc

SEQ ID NO: 33526 - DNA, 572 bp, Homo sapiens; identical to SEQ ID NO: 10641
  misc_feature 1..572: note = chr10:133795312-133795884
  misc_feature 1..572: note = hyper
  source 1..572: mol_type = genomic DNA

SEQ ID NO: 33527 - DNA, 84 bp, Homo sapiens; identical to SEQ ID NO: 10642
  misc_feature 1..84: note = chr10:133795975-133796059
  misc_feature 1..84: note = hyper
  source 1..84: mol_type = genomic DNA

SEQ ID NO: 33528 - DNA, 474 bp, Homo sapiens
  misc_feature 1..474: note = chr10:133849661-133850135
  misc_feature 1..474: note = hyper
  source 1..474: mol_type = genomic DNA
cctgaagtcccagcccggagcacgcggccgtggtgagctgcgatcccaggccccggcgcagcgctgagactgtggctctcaatccgcagcagctgcttcatctgctcaatgccagactccaaaaagcatttctctcgcaacaggccaggggaggcagcgttcggggatgggacgccaagagttaagggtgaggccgcacgcgtgcagctcccccgtgctgcgcatggcgctgggatcggcctgagcggcgggtgagtccctctaagccggcggcgcccggtgcccggctccctacgcgcgccccgcggcccccgggctattttcagccacgccgagccctgttttaggagcttgcacagcggctccgcggagaccgggactgcgtgggggaggatcgcggcgggggccgtcgccgagcaaggagcgcggccgcggggaccgcccgggagtgggggcggcggggcgggccgggtt

SEQ ID NO: 33529 - DNA, 683 bp, Homo sapiens
  misc_feature 1..683: note = chr10:133850156-133850839
  misc_feature 1..683: note = hyper
  source 1..683: mol_type = genomic DNA
cggtgacgcgcgcccccgcccgccgcctctgccatggccgatccggtccgtcggacgccgcccagagtcgctcgcggggagcctcggtgagcagcggccggggtggggccgcgaccgggggccgggcctctgcgctgcgtctggcacggtgcgtccgggacgcgggcgccctggcggccgtggggcgggcggggggcgacgtcccgagggagggggtcccgcggcagagacgcccctgtctggggcggggtcctccttgcctctcccggcggtccccccgtgggcgggtcctctccacggcaccccctgccctgcacaggcctcggcgctggcgtgacgcggccgctgggtggggcccgcgcaggtgctgggccagggctggggacccgcatctccgtgtctccgactgtgcctcccgcggaaaggggcgccgtgcgattatttttatgttggtgtctggtttttaaatttcacagcccccatttcagggatggccagcgtggccgtgggatgctgacgatacgggaagccagagaataaaggctttggtggaggtcgggaggaggcgccggcctggacagttttcctagaaaatattctctgcgtgtacccgcgaccttgcctctcgtggaaagccgctgggagttggagcggctccctcctgcccccgtctgaggtctggc

SEQ ID NO: 33530 - DNA, 206 bp, Homo sapiens
  misc_feature 1..206: note = chr10:133999847-134000053
  misc_feature 1..206: note = hyper
  source 1..206: mol_type = genomic DNA
tctctctgtcctattcgggcccctcctgccctccgtctctcgcggccagcgtggaacagcctcgcggggtcacagcctggcgctcggaccctggcccgggtcatctgcgaaggagccggctttggccaaggtgccttcctggacgggtgtggttcccagagcgtcgcggcccggggttgactggctcggaatcccggggccttggg

SEQ ID NO: 33531 - DNA, 16 bp, Homo sapiens
  misc_feature 1..16: note = chr10:134000108-134000124
  misc_feature 1..16: note = hyper
  source 1..16: mol_type = genomic DNA
cggggcctggcaggac

SEQ ID NO: 33532 - DNA, 57 bp, Homo sapiens
  misc_feature 1..57: note = chr10:134000125-134000182
  misc_feature 1..57: note = hyper
  source 1..57: mol_type = genomic DNA
tggccggactctctccctcgcctccccggggtgcaaaccccgcgcacatcagctgga

SEQ ID NO: 33533 - DNA, 211 bp, Homo sapiens
  misc_feature 1..211: note = chr10:134000529-134000740
  misc_feature 1..211: note = hyper
  source 1..211: mol_type = genomic DNA
cgcttgtgccgcccctaccagagacccccaggagcaggatgtccttccagggcaagaaaagcatcccccggatcacggtgagcccggtcccgcttcgcccggcgccccctgcccgccgcccggagtggggcctggacgccgggcggaccctcctggtcttgtgcgtgggtggggggtccctgcctttgcgtctggtccctgtcctggcgcc

SEQ ID NO: 33534 - DNA, 99 bp, Homo sapiens
  misc_feature 1..99: note = chr10:134000798-134000897
  misc_feature 1..99: note = hyper
  source 1..99: mol_type = genomic DNA
cgcagacccccttaaggagcggggcgcccaggcccggcccggcccggccctgcccggccctgccgggccctgccgggccctgcccggccttgcccggcc

SEQ ID NO: 33535 - DNA, 286 bp, Homo sapiens
  misc_feature 1..286: note = chr10:134001139-134001425
  misc_feature 1..286: note = hyper
  source 1..286: mol_type = genomic DNA
cgatttagccccggccgctctggccggagtccctggtggccccgaacccttccagtaacctgggttcagcgactccaaggaaagcgagcggtcaagggccactggccgggaaccctggcagcccctgaaccttcgagagcagagacccctccccaacacccacacgcaccggcgcgggaggtcccgctctgccagaaacaaagcctccccgctcgggcggggggagatgggggtgggaggaaggaggcttcgggacccggcaggacctgggcgggggagtccatgg

SEQ ID NO: 33536 - DNA, 254 bp, Homo sapiens
  misc_feature 1..254: note = chr10:134120760-134121014
  misc_feature 1..254: note = hyper
  source 1..254: mol_type = genomic DNA
aaagcagggctgccacgggcggtgggcggaggcgcgcgcaagcccggagacgccacagccgcgggggaccctcgccccgagggcccgggcccagcctgctcctcctgcggcgccgccactagaaacggaggacgcgggcgggcgcccagaactcgcgtggggccgcagccacccggcgcgagcttctccggaagccggggcgccccgggaagccgtcccggacaccgggggaacccctgcgggaaaaagccgcc

SEQ ID NO: 33537 - DNA, 42 bp, Homo sapiens
  misc_feature 1..42: note = chr10:134122233-134122275
  misc_feature 1..42: note = hyper
  source 1..42: mol_type = genomic DNA
ccccttgtccagatgcgacaggggcctcggcactcggcgtat

SEQ ID NO: 33538 - skipped

SEQ ID NO: 33539 - DNA, 109 bp, Homo sapiens
  misc_feature 1..109: note = chr10:134598367-134598476
  misc_feature 1..109: note = hyper
  source 1..109: mol_type = genomic DNA
ggggccgcccccggattctgcaaaaatagattcgcccccaccccgcgggtcctcacaaggcgtcccccgcgccgccgccgcacgggctgaccagcgccaagttcgaggg

SEQ ID NO: 33540 - DNA, 115 bp, Homo sapiens
  misc_feature 1..115: note = chr10:134599431-134599546
  misc_feature 1..115: note = hyper
  source 1..115: mol_type = genomic DNA
gcccgggcggttagtgtccatgggcgccgccgccgccggcccgggctcccatccgggccccgccgccgccgcccctgcccgccggcccgggaagtttgcgcgcggcccgggcggg

SEQ ID NO: 33541 - DNA, 83 bp, Homo sapiens
  misc_feature 1..83: note = chr10:134599708-134599791
  misc_feature 1..83: note = hyper
  source 1..83: mol_type = genomic DNA
gctgattggctgcggaccccgcggtccggccattggccggcgccccccccccgcccgcgcgcccccgccggccgcgcactcca

SEQ ID NO: 33542 - DNA, 22 bp, Homo sapiens
  misc_feature 1..22: note = chr10:134599995-134600017
  misc_feature 1..22: note = hyper
  source 1..22: mol_type = genomic DNA
ctcggggaagagtcccggcccg

SEQ ID NO: 33543 - DNA, 848 bp, Homo sapiens
  misc_feature 1..848: note = chr10:134600037-134600885
  misc_feature 1..848: note = hyper
  source 1..848: mol_type = genomic DNA
cgccgcccgtggctggggtgggtgtgagcggcagcggacgccggcggggaacgcgctccgggcaggtcggggccacaggagggcggaggacgcgggcctcgagtccacggaatccacgggcctcacggccgggcgaggctcgcacggagctgcctctggtttcgccgacacgcggccggcgcggtggaggagtgaggcaggcgggagcggggcggggaggcgggtcccgggaccacacgcgcggctcggcacttccccgtcatcggcctccaggtctcccgctgggggtcccccaggatgtgacctgggcccacgacttcgcccacgggccgcctctcgcgaatccccggccgggagaacagagaccaggacggcctcagcgcggaagccctgtccagggcccgaacgtgggtgcgggctgggggcgcagcggcagaaacgcggccttagacgcgcgcggggggccggtgtcccccccgcccccacggcaccgggagccgctcgctcatccatcccgcagaccgggcggtgagatgactccgagccccgcgcacggcggccgcgagcaaacgctccgacgtctgtggtgacgtctcgtattgatttagggacacggggcggctgtggctgtggcccacggctcgtggggagcccgagtctgtgcgcagggaacgccgctgcgtggcctctctcgggcctgtgccgcggaggaaggcggcgcccggggttcggggccggggtctcacgtccgccccctcgcccccctccagcgtccgttttcgttttgtgcaggtcgaggcggggacttggcgccgtcggccgctcctggatggcggcttggaaaagcc

SEQ ID NO: 33544 - DNA, 30 bp, Homo sapiens
  misc_feature 1..30: note = chr10:134601246-134601276
  misc_feature 1..30: note = hyper
  source 1..30: mol_type = genomic DNA
ctctgagctgagacgcgggaactgcggggc

SEQ ID NO: 33545 - DNA, 160 bp, Homo sapiens; identical to SEQ ID NO: 10654
  misc_feature 1..160: note = chr10:134601556-134601716
  misc_feature 1..160: note = hyper
  source 1..160: mol_type = genomic DNA

SEQ ID NO: 33546 - DNA, 63 bp, Homo sapiens
  misc_feature 1..63: note = chr10:134602327-134602390
  misc_feature 1..63: note = hyper
  source 1..63: mol_type = genomic DNA
gcgtctgcaggggagcgggcgacggggaggacggcgggggtgtcggcccggaaggagagccgg

SEQ ID NO: 33547 - DNA, 85 bp, Homo sapiens
  misc_feature 1..85: note = chr10:134676528-134676613
  misc_feature 1..85: note = hyper
  source 1..85: mol_type = genomic DNA
gtccctgcaaaacagcggctgcaggaaggagggtggcgaacccacgttcgcgggagtccagcacccatcacgtctgtcctgggtc

SEQ ID NO: 33548 - DNA, 46 bp, Homo sapiens
  misc_feature 1..46: note = chr10:134755978-134756024
  misc_feature 1..46: note = hyper
  source 1..46: mol_type = genomic DNA
ccaggtccatggcgccggcgccctgctcgtccgctctctccggggt

SEQ ID NO: 33549 - DNA, 111 bp, Homo sapiens
  misc_feature 1..111: note = chr10:134901183-134901294
  misc_feature 1..111: note = hyper
  source 1..111: mol_type = genomic DNA
ggaataacacagggtcgtgcagtccgcccggcggcgttttcgggcgagggtctggtgctggggagcgagcgcggagcgaggtgtctctttaaatacgctctgcagtgtgac

SEQ ID NO: 33550 - DNA, 410 bp, Homo sapiens
  misc_feature 1..410: note = chr10:134901295-134901705
  misc_feature 1..410: note = hyper
  source 1..410: mol_type = genomic DNA
gcggccgcccggctggaagagccatccccaccctgcggcaggagcccgcccgccgccatcgcccgccccggtccccatggttacgcgcctgcctccggccccgggtccccgctgtcgccgcgggaggtgcgcgcagaggcggcggcgctgctggccgggctgggccgctcgtgcgcggggctgtgactcaccggccggcgccgcagccccgcaatctgttgataactcggtcccagctcggccgctgccctcgcgaatggagagcgggtccccggcggggggagcgcagcgcgtctgtctccgggagcgcggcccggccgccccggcagccgcttcggccacagcaggtgggaaggacgcgcgggtctgggcggcgggagggacgcgcggggccgcggctcggcagaaaa

SEQ ID NO: 33551 - DNA, 183 bp, Homo sapiens
  misc_feature 1..183: note = chr10:134901942-134902125
  misc_feature 1..183: note = hyper
  source 1..183: mol_type = genomic DNA
ggttgagtttggctccggagccgggagtggggcgcagattgatttttaaatatggagaaggagacgcatctgccgctggcgcgttcggtccgagccccccaccggtccccaccggcaccgcctccgccagccccaggcgcagcccccaggccgcccgcggaggggagggagcgacaggggccg

SEQ ID NO: 33552 - DNA, 25 bp, Homo sapiens
  misc_feature 1..25: note = chr10:134902187-134902212
  misc_feature 1..25: note = hyper
  source 1..25: mol_type = genomic DNA
cgctgaccgccgctgtcttcacaga

SEQ ID NO: 33553 - DNA, 61 bp, Homo sapiens
  misc_feature 1..61: note = chr10:134973919-134973980
  misc_feature 1..61: note = hyper
  source 1..61: mol_type = genomic DNA
ccagcccagcccagccggaggccccgggggcggtgcgcggcgcggccgcaggatgcaggcc

SEQ ID NO: 33554 - DNA, 48 bp, Homo sapiens
  misc_feature 1..48: note = chr10:134974224-134974272
  misc_feature 1..48: note = hyper
  source 1..48: mol_type = genomic DNA
gttaggattttcacccggaggggacagcacccccgaatgcgcacggga

SEQ ID NO: 33555 - DNA, 96 bp, Homo sapiens
  misc_feature 1..96: note = chr10:134974307-134974403
  misc_feature 1..96: note = hyper
  source 1..96: mol_type = genomic DNA
cgcggtagctcctggtggaaaccctggcgggacagtgtgggggcagcaaggaggacggaggggggtctgcttactccctgccgggccccaggaggc

SEQ ID NO: 33556 - DNA, 462 bp, Homo sapiens
  misc_feature 1..462: note = chr10:135043164-135043626
  misc_feature 1..462: note = hyper
  source 1..462: mol_type = genomic DNA
tgctggctgcagacgcgctgcagatggaagaagttcagattttaaaagctacttctgcgagcgcgtgaattccgacacccattcccgcggctggcgtggcttctcctcggacccatcccctggcctggcgactccccctgggacccgggtcggtcctccggacccctcgcgtgcaggtgctgagcccgggcgggggcggcgggggcgggggcagcactgggggccggacaagggggcgccagcgccttccggagcgggaggggctccgcacacacctcgacgggggcgggggtaggctcggcacaggctaaaaacgagcggagccgccggggcttaggcatcgcggcacctccgttgaacgggtctaagaacagaactcctgaggaccctccgtttccaaccgaagccagtctttgctctgcgtcttcccggccgcagcgccaggaccgaccccttaggacc

SEQ ID NO: 33557 - DNA, 565 bp, Homo sapiens
  misc_feature 1..565: note = chr10:135043826-135044391
  misc_feature 1..565: note = hyper
  source 1..565: mol_type = genomic DNA
cgccccccgcgccgccctcgcccgccagccccgaccccgagccgcggacacccggagacgccccggggaccccgccccggaggcccgcctcgcccagcgcgctgggggaactcgggttgccggtgtccccgggctcggcgcagcgcacgccctggagcgcccgggagacggagctgctgctggggacgctgctgcaaccggccgtgtggcgcgcgctgctcctggaccgccgccaggccctgcccacctaccgccgcgtgtcggccgcgctggcccagcagcaggtgcgccgcacccccgcgcagtgccgccgccgctacaagttccttaaagacaagtttcgcgaggcgcacggccagccgcccgggcccttcgacgagcagatccggaagctcatggggctgctgggcgacaacgggcgcaaacggcctcgccgccgctccccggggtccgggcgcccccagcgcgcccgccgcccggtccccaacgcgcacgcgccggctcccagcgaaccaggtaggcgggggactggggggccaggtggggccgaggactgcggaggaac

SEQ ID NO: 33558 - DNA, 192 bp, Homo sapiens
  misc_feature 1..192: note = chr10:135044554-135044746
  misc_feature 1..192: note = hyper
  source 1..192: mol_type = genomic DNA
cggacgcctcccccgcccccggctccccgccagctcccgccccgaccgccctcgccacctgcatccccgaggaccgcgcgcccgtccgcggccccgggtccccgccgccacccccggcccgcgaagaccccgactcgccgcccggccgccccgaggactgcgcgccccctccggccgcgcccccgtcgctga

SEQ ID NO: 33559 - DNA, 414 bp, Homo sapiens
  misc_feature 1..414: note = chr10:135048874-135049288
  misc_feature 1..414: note = hyper
  source 1..414: mol_type = genomic DNA
ggggggagcgcgtttcggggactagctggactccgggctgtgcgtgggggcggtgctgtcggcctgggagtgacgcgggacttcctgcccagcgcaacccggcctggcccccgagggtgggggacagggcgacgcccgcggggaccacgctctggggcgtgcggggcgcaattcacggggctgggctgccccaggggctgggaggaaggaggcaggggggcgcccaagtctcctacccatggcagcgcatcagggcgcgtcccagagccgggggtggacggaggcttggaggcggaggctttggggacccccaagcctgggctagagcagcctcggcgggctctagagggagggtggagggaggggcccgggctgcaggaggcggggaggcctgagccacggtggtggggccgc

SEQ ID NO: 33560 - DNA, 628 bp, Homo sapiens
  misc_feature 1..628: note = chr10:135049727-135050355
  misc_feature 1..628: note = hyper
  source 1..628: mol_type = genomic DNA
aggcatctgggccctcgctgcccctggccgggacacactgccggtcctgtgcagtggctcaaagcccctctaccgggggtgacccggtctctccggagatgaagtgcagcgggggtctaggccggcttcctggccccccacccctcctggctttacccccgaggccacgtccaaagcccccagcgccccacccccgccagcctcccccttgagggcccagtgacctaactgggccggcagggtccgaggaagaccagggtcagcggcggcacggtccgttccgcgacccctctcctgtgaccccaggtaggccgccgatcggttcccggctgaggtcccgccccagcgcccgcctcccgggctccaacctctttgctcagcccgggaggctcggctggctggggcgggcgtaaccgtggggcgaggcccgccggtctttctgatttccgcgggcggcgtgggcgctgaggcagccgcggtcaggacctggccgggagtcggggctgctccgtggaccccgcgtctgcgccgaaaccccgcatggcttcgggggccggacctgcgcctccgcctaactccggccgccggagacgccgtgcggaccccaagccagtgcgcggaagacacc

SEQ ID NO: 33561 - DNA, 511 bp, Homo sapiens
  misc_feature 1..511: note = chr10:135050356-135050867
  misc_feature 1..511: note = hyper
  source 1..511: mol_type = genomic DNA
tcctaccctcggcatggctgcctcccacccggtcacgtcggtccccgcgccccacgccgacgcgcaggcgacccggggacgcggagacgcagacagctcgggactcaggttcgtgggagcagcggccgcgcgtggctatgaccgtcccgggggcccgtgctcagggcgtccccgtgaggtttgggcgccacagtcaccggcggctctgcccgcgccctggccacagtggggacagcctggcttggcggggacgcaccagtcccgccgccgacgcggagttcctaccccgccgtgcgaggcagtggctccggcccttccagctcgggatggagtcagggagccgcccgcgcccgaatgcagaggctcctgcgatggccccggagtgagtcccccagaggagccggattagggctggaggcggccgagtcccccgagaggcccctcccgacattcccgcccccgcgcgccgctccccgggtcctccgcgtctctttcccgggaaagcctccct

SEQ ID NO: 33562 - DNA, 732 bp, Homo sapiens
  misc_feature 1..732: note = chr10:135138920-135139652
  misc_feature 1..732: note = hyper
  source 1..732: mol_type = genomic DNA
gaagcctccggtggacgtgaaatctttacttagagaaaagcgacagagtcagagacccacgggggcggggctgcagcgagggcgcctggggacacgaacacggcggagagcatcgggagacgcgctggtcacaggagctggcggaggacgctgcggagacagagcccgagggttgagagcggcgacgcggccaggggctccccgcggaccccgcgtcacccggcgggctcggattcgcaacccccaaccccgaggttctggcgggccgggtcggagggaagaggaagggaagggtggcgggggtctttggctcagaagcggtggcgggaggccaggaagagacctgggcagagccggccggagccccgcggcgcgcacctaccccgggccgggctgcggggctggagacgtcactgcgcgggcgggggcgccgcgctcccggccgccttccgcgccgcctccttctccgccttggccgacggcttcccggggggttcggtggccgccgccgccgccccagcctgggtgggccccttgcgctcctccttggctgcgcggtagccgtccccccaggccgccggcgtctccgtgccgtgcttgcggctcagcgggtaggccccgatggccgccaggatgctgcggtggcgctcggggtccatctccgtgtagtacatctccagggtcagcggcgtgcagatcttgtgctgcgggaggggccgggtcagggtcggt

SEQ ID NO: 33563 - DNA, 243 bp, Homo sapiens
  misc_feature 1..243: note = chr10:135148859-135149102
  misc_feature 1..243: note = hyper
  source 1..243: mol_type = genomic DNA
ctccgcccgaacccccgctcgggcaggacccccgccaggaggagctgcgcttgaggggtccccttcgagccaaacttcaaatccaactcctcggacggccaatttacgtcatcgcgggtttccatggcaacgcagacaggcccgagacgcgtcttcaggaagaaaaagccattgggggcccactggagcctcgcttctggttccgggcccagcgccccgggcggaatgcggggttggaaaggg

SEQ ID NO: 33564 - DNA, 176 bp, Homo sapiens
  misc_feature 1..176: note = chr10:135150325-135150501
  misc_feature 1..176: note = hyper
  source 1..176: mol_type = genomic DNA
gaaatagctcacaggcggctccactggcagctgctgcaggacgcggtcggggaggacgacgatgcggatgtggatgcggaggatgcggttccagacgcttcgcggccgggcggggcgggggctgcagctgcgagaccgaggctgtggtcgccatggaaacgcggctagaggcgggg

SEQ ID NO: 33565 - DNA, 100 bp, Homo sapiens
  misc_feature 1..100: note = chr10:135170736-135170836
  misc_feature 1..100: note = hyper
  source 1..100: mol_type = genomic DNA
cgggaagttcaagtccgcaagaactaaacagccgggaggacagcccgtgtcggcacctatccctgccctcggggtcggcgccgcccgtcctcccacccag

SEQ ID NO: 33566 - DNA, 345 bp, Homo sapiens
  misc_feature 1..345: note = chr10:135236927-135237272
  misc_feature 1..345: note = hyper
  source 1..345: mol_type = genomic DNA
gcccgccgccaggcccgcggccgctcccgccgccgccccggctgccgccccggcggcagccacgcgcagggaggagcccggggcaccgtagcgctgcgccggcctcacgcgcaccctcgaggccccgcgcgcacccccgcggacccctccccgggcactgccccgcgcacctccgcggccgcccttggctgcgccgctgtcgcagaggaaggcggccgccagtagcagagcccagcacgttgcgggtgcccagttcatcttcgtggggctaaacctgcgggaagagagggaaagggcccttagtttccatggagatcgggtgcccaggggcggagggctcaaggc

SEQ ID NO: 33567 - DNA, 32 bp, Homo sapiens
  misc_feature 1..32: note = chr11:279473-279505
  misc_feature 1..32: note = hyper
  source 1..32: mol_type = genomic DNA
ggacgccgtggacctcgcggagcagctggccc

SEQ ID NO: 33568 - DNA, 90 bp, Homo sapiens
  misc_feature 1..90: note = chr11:280129-280219
  misc_feature 1..90: note = hyper
  source 1..90: mol_type = genomic DNA
ggtgaaggagaggaacgcccgctccgtgaagatcaccaagcgcttcaccaagctgctcatcgcgcccgagagcgccgccccggaggaggc

SEQ ID NO: 33569 - DNA, 56 bp, Homo sapiens
  misc_feature 1..56: note = chr11:308110-308166
  misc_feature 1..56: note = hyper
  source 1..56: mol_type = genomic DNA
aaactgttgagaaaacggaactactggggaaagggagggctcactgagaaccatcc

SEQ ID NO: 33570 - DNA, 32 bp, Homo sapiens
  misc_feature 1..32: note = chr11:308230-308262
  misc_feature 1..32: note = hyper
  source 1..32: mol_type = genomic DNA
cggccagcctcccaactacgagatgctcaagg

SEQ ID NO: 33571 - DNA, 31 bp, Homo sapiens
  misc_feature 1..31: note = chr11:308322-308353
  misc_feature 1..31: note = hyper
  source 1..31: mol_type = genomic DNA
tgatccacatccgcagcgagacctccgtgcc

SEQ ID NO: 33572 - DNA, 44 bp, Homo sapiens
  misc_feature 1..44: note = chr11:327148-327192
  misc_feature 1..44: note = hyper
  source 1..44: mol_type = genomic DNA
agcagaatgaggtgacgtcactgggtcagcggctcctgtggcat

SEQ ID NO: 33573 - DNA, 35 bp, Homo sapiens
  misc_feature 1..35: note = chr11:369448-369483
  misc_feature 1..35: note = hyper
  source 1..35: mol_type = genomic DNA
ccccgcggcctggctcggtccgattggttccgcgc

SEQ ID NO: 33574 - DNA, 43 bp, Homo sapiens
  misc_feature 1..43: note = chr11:370169-370212
  misc_feature 1..43: note = hyper
  source 1..43: mol_type = genomic DNA
tcggctcggcccggacgctcgatgacgtcggcagtgacgcgcg

SEQ ID NO: 33575 - DNA, 320 bp, Homo sapiens
  misc_feature 1..320: note = chr11:406722-407042
  misc_feature 1..320: note = hyper
  source 1..320: mol_type = genomic DNA
ggcccattcacaaagcgtggtgccgcagagctccccacggaggggtcccagcctggagcccgggcaccgcccatctctaacccgccgctagccccggaccctcccgcgcctgctccgcaccacggagccgggcctccagagcagcaaggtcaccaggtggcggtgctggcgcagcaggcggagcgccgggtgcgcggggtcgcgcctctggccctcgaaggtgatgaagatgggtctgcgggtgagctccagcagccggcacaggccctccctgcggggcgggaccgtcaggggggtgggtgctacgctggggcccaccc

SEQ ID NO: 33576 - DNA, 30 bp, Homo sapiens; identical to SEQ ID NO: 10670
  misc_feature 1..30: note = chr11:407401-407431
  misc_feature 1..30: note = hyper
  source 1..30: mol_type = genomic DNA

SEQ ID NO: 33577 - DNA, 66 bp, Homo sapiens
  misc_feature 1..66: note = chr11:507716-507782
  misc_feature 1..66: note = hyper
  source 1..66: mol_type = genomic DNA
ggtcgcgactctaggcgaccttggtagaggggctcgtttgcgccgagctcgcgacccccgagggag

SEQ ID NO: 33578 - skipped

SEQ ID NO: 33579 - DNA, 70 bp, Homo sapiens
  misc_feature 1..70: note = chr11:537026-537096
  misc_feature 1..70: note = hyper
  source 1..70: mol_type = genomic DNA
cggtgtgtgtttcctggtcctcgggggcgcttcccccggtgcttccttttgccgtcggcctcacttccaa

SEQ ID NO: 33580 - DNA, 27 bp, Homo sapiens
  misc_feature 1..27: note = chr11:637237-637264
  misc_feature 1..27: note = hyper
  source 1..27: mol_type = genomic DNA
aggggagggactccccggcttgcgacc

SEQ ID NO: 33581 - DNA, 137 bp, Homo sapiens
  misc_feature 1..137: note = chr11:637349-637486
  misc_feature 1..137: note = hyper
  source 1..137: mol_type = genomic DNA
cgcgggccggccgcgggggcatctgcgggggcatctgcggggctggctgggcagggcgcggcggcgctggtggggggcgtgctgctcatcggcgcggtgctcgcggggaactcgctcgtgtgcgtgagcgtggccac

SEQ ID NO: 33582 - DNA, 203 bp, Homo sapiens
  misc_feature 1..203: note = chr11:726307-726510
  misc_feature 1..203: note = hyper
  source 1..203: mol_type = genomic DNA
catgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggtgagcgggggcgggggatgagctgg

SEQ ID NO: 33583 - DNA, 250 bp, Homo sapiens
  misc_feature 1..250: note = chr11:1410104-1410354
  misc_feature 1..250: note = hyper
  source 1..250: mol_type = genomic DNA
acctgaaagaggggtcggtagcaagggccgggaggcgccagggcgctgcggccggatcccaggtgagttccttgactccgcgccgcgcaggtcactgtggcataactgggaaaaccgccgcttctccctcgggagcggaggcggagggccacgtcctccctgggggtgcacaatctctgcttggacaacgcccgcgtgcagtagccccacagactcccatgcagcccccccgccacgtgtgccgcatccg

SEQ ID NO: 33584 - DNA, 34 bp, Homo sapiens; identical to SEQ ID NO: 10675
  misc_feature 1..34: note = chr11:1411655-1411689
  misc_feature 1..34: note = hyper
  source 1..34: mol_type = genomic DNA

SEQ ID NO: 33585 - DNA, 452 bp, Homo sapiens
  misc_feature 1..452: note = chr11:1411907-1412359
  misc_feature 1..452: note = hyper
  source 1..452: mol_type = genomic DNA
ccgggccgcattgtgcgccccagcgaccgggcccattgtgccgcgggaggagggggccgcgcgggcgcccatctgccgtctgccgcggccgcgctaataggcgtgctgcccgagcagctgcgcccccggcgggactcccacctccgcgcgccggccaccggggcctccgggcaggcccgatctccctccgcggtgggggcgggagagtgcggggacctgcagagggctggacagcgccttgcgctgctccggctcgggctcgggcgggcggagcgtctgtgacctgcattcccacggggcagggagaggccattggtgctgggaccagaagtgcgtgggacctgacccgtggagcagccccgcggcctgccggtggagggggcttcccggtggggcctggctgtcattctagggaacaggccgggtccctgcggggccgaacccaggccaga

SEQ ID NO: 33586 - DNA, 426 bp, Homo sapiens
  misc_feature 1..426: note = chr11:1770262-1770688
  misc_feature 1..426: note = hyper
  source 1..426: mol_type = genomic DNA
cgcgcggccggaccccctgagcctcggtgcgcgcgtccttccgccgtcccgcgggccgctgtctgtccactgatccgcctcccagcggcccaaccttgagggggtggggagcgcgcggggctcggcggcggcgccgctgcctcccccgccgcctgcgctccctccgcagcgccagaccggccgcgcggctgcagcccagagcctgactcacggcggcagcgggcacagccacctccccgcctccgcctcctcctgccaggagggtgggggcctcggaagccgcgaccctggggagttgcaaggtcccgcagggatgggacccctacagcccccgaccagggtgtccgcgccacctccatctccccggacccactgcgtcttcctccccaccccacccggccccatccctctcgcggagcccccagc

SEQ ID NO: 33587 - DNA, 52 bp, Homo sapiens
  misc_feature 1..52: note = chr11:2291148-2291200
  misc_feature 1..52: note = hyper
  source 1..52: mol_type = genomic DNA
cggggtggtccctggcggcccgcggggcgcagacggccgcacggcctgcggc

SEQ ID NO: 33588 - DNA, 74 bp, Homo sapiens
  misc_feature 1..74: note = chr11:2291420-2291494
  misc_feature 1..74: note = hyper
  source 1..74: mol_type = genomic DNA
cgcctccggtctctgcggtggccggtcgccgccgccggctgcagcgcaacagttccggggacgcgggtctccgc

SEQ ID NO: 33589 - DNA, 74 bp, Homo sapiens
  misc_feature 1..74: note = chr11:2291984-2292058
  misc_feature 1..74: note = hyper
  source 1..74: mol_type = genomic DNA
ccctagcccatcccccggacgcagtccacagatccccagtgcgcccaactggcgaaatctgcgagttcccggtg

SEQ ID NO: 33590 - DNA, 255 bp, Homo sapiens; identical to SEQ ID NO: 10680
  misc_feature 1..255: note = chr11:2292105-2292360
  misc_feature 1..255: note = hyper
  source 1..255: mol_type = genomic DNA

SEQ ID NO: 33591 - DNA, 374 bp, Homo sapiens
  misc_feature 1..374: note = chr11:2292391-2292765
  misc_feature 1..374: note = hyper
  source 1..374: mol_type = genomic DNA
cgcccggccccattgaggaagcgcgtacgcgtggcgcgtggctcacggggagcatcgctaacaaagctgggttcctgctgggccccgccctgctcctcgcccccgcgactgggctgggcgcgctgtcccctagcgcagctatgtcccgagcgcgcccccacctgtgcgttaatctactgggaatgggggtggactgcgccttacctggggcggggtggggcttaaggagtggtcgagactgaggcggggtgggaggttcaggttcccggggcgccttccccaacccgccccgctttccccgtccctccacgcgcaccctgcctgtggtttccgtgcgcccccggcctgagggctctgggcggcaccttaacccg

SEQ ID NO: 33592 - DNA, 107 bp, Homo sapiens
  misc_feature 1..107: note = chr11:2398287-2398394
  misc_feature 1..107: note = hyper
  source 1..107: mol_type = genomic DNA
acccccttgggggctcggagcgcgacagcagcttggggacgcctcccgcgcccagcacggtgcacctgggccctgaggtcctggccgaaacgcgccaagttgggggt

SEQ ID NO: 33593 - skipped

SEQ ID NO: 33594 - DNA, 59 bp, Homo sapiens
  misc_feature 1..59: note = chr11:2465461-2465520
  misc_feature 1..59: note = hyper
  source 1..59: mol_type = genomic DNA
cgcagctcgcgcgcctgggcacccgggggcgctcacagtgatcgcggggccagcacacc

SEQ ID NO: 33595 - DNA, 150 bp, Homo sapiens
  misc_feature 1..150: note = chr11:2466681-2466831
  misc_feature 1..150: note = hyper
  source 1..150: mol_type = genomic DNA
cggctggaaatgcttcgtttaccacttcgccgtgtgagtatcgccaccggcgacggccggcacgaaggtgcttcctgagagctggtgtgggggagctctgtcccagcgccacctgccccgtcggagctgcgaccccggagcagaggaggg

SEQ ID NO: 33596 - DNA, 30 bp, Homo sapiens
  misc_feature 1..30: note = chr11:2554518-2554548
  misc_feature 1..30: note = hyper
  source 1..30: mol_type = genomic DNA
ctgaaaaagccatttcgggaggaatctggt

SEQ ID NO: 33597 - DNA, 394 bp, Homo sapiens
  misc_feature 1..394: note = chr11:2883606-2884000
  misc_feature 1..394: note = hyper
  source 1..394: mol_type = genomic DNA
cgacccccagaccttcggggtgcccagtccgagcctgggccgctaggggccgcgggcctggcgggcggggcgggggccggggtcgggggtccggcgagctttaatgcgcgcacaaagcctcatttgcaggtcaatgccgcggcacactcgcctctcccctcgcccggcgccctttgtccggccgcgcccgctcctcgcgccagatggccgcggaaatgctaatttcgggcgcccctgcccccccacccccgcgtttaattgcgcctttgcagatgggccgcgagtgtgcgcttcatgcagatgagcgcggcctcgccgccttcctcggacctccgggagccgcggccgggcgtgctggggccgagggcagggagggggccgctgtccctccact

SEQ ID NO: 33598 - DNA, 49 bp, Homo sapiens
  misc_feature 1..49: note = chr11:2905392-2905441
  misc_feature 1..49: note = hyper
  source 1..49: mol_type = genomic DNA
agggcggggccggcccggagacccgagagggggccgggagagggcgcgg

SEQ ID NO: 33599 - DNA, 145 bp, Homo sapiens
  misc_feature 1..145: note = chr11:2905874-2906019
  misc_feature 1..145: note = hyper
  source 1..145: mol_type = genomic DNA
cggggcggggccgtgcggggctcaccggagatcagaggcccggacagcttcttgatcgccgcgccgttggcgctggcggccgcggtgccggccgcgggacgtcccgaaatccccgagtgcagctggtcagcgagaggctcctggc

SEQ ID NO: 33600 - DNA, 258 bp, Homo sapiens
  misc_feature 1..258: note = chr11:2906322-2906580
  misc_feature 1..258: note = hyper
  source 1..258: mol_type = genomic DNA
gcgcctcctcgaggccgtcgagggactcagcggccggctcgaggggcgggctgacagccaccgcgaccgcgacgggccgcggcgccagcagcaggcggcagcgccccacctgcaccgtctcgcggtagaacgcgggcaccgagtcgctgtccacttcggtccactgcaggcgtccagggccccgcagcggcatgtcctgctggaagtcgtaatcccagcggttctggtcctcggcgttcagctcggccaggcgggcct

SEQ ID NO: 33601 - DNA, 49 bp, Homo sapiens
  misc_feature 1..49: note = chr11:3224699-3224748
  misc_feature 1..49: note = hyper
  source 1..49: mol_type = genomic DNA
gctctgctgcctgtccgggtgccggaggcacgaccgctcccctccaggc

SEQ ID NO: 33602 - DNA, 258 bp, Homo sapiens
  misc_feature 1..258: note = chr11:6280415-6280673
  misc_feature 1..258: note = hyper
  source 1..258: mol_type = genomic DNA
aggagatggagggtgcggagacagatgcaggagctaccccaggcccgcagcgaggagctgcagggaactacggtagcaatagtgtcacggtcactgcggccactgcaacacagtacggtaaatgcggctctaggctcagactaaagcatccgcgcctcagcaggtgacgcacgcagacctggtctccaacgccacctccacgttccctgatacaccagagaaagatgctggatccgtggcagccgtctctacccaacc

SEQ ID NO: 33603 - DNA, 61 bp, Homo sapiens
  misc_feature 1..61: note = chr11:6281259-6281320
  misc_feature 1..61: note = hyper
  source 1..61: mol_type = genomic DNA
gggcaacctcagctgcgagccccctcgcattcgcggagccgggacacgaggtgggtgcctc

SEQ ID NO: 33604 - DNA, 15 bp, Homo sapiens
  misc_feature 1..15: note = chr11:6676538-6676553
  misc_feature 1..15: note = hyper
  source 1..15: mol_type = genomic DNA
cgcaccccacacccc

SEQ ID NO: 33605 - DNA, 203 bp, Homo sapiens
  misc_feature 1..203: note = chr11:6676627-6676830
  misc_feature 1..203: note = hyper
  source 1..203: mol_type = genomic DNA
cgctcacgttcacgcccgcccgggtcccgcaggcccaggccccccctcccccattgtctccggctcagaacaaagcccccggctccgccgccgctgccgcagcccaggggaggccggcgggcagggcgggcgcggccagacgggccgggcgggcgcgggcactgacctccgcgcgacgcgggctccctcgcccggtgctgggg

SEQ ID NO: 33606 - DNA, 109 bp, Homo sapiens
  misc_feature 1..109: note = chr11:6677219-6677328
  misc_feature 1..109: note = hyper
  source 1..109: mol_type = genomic DNA
ccccggctccggatccggccccagcgccgcgccgcgcccccgtcccggttcccttcccttctccccgtcacttctcccgtcctctcctcccattcggttctctacgccc

SEQ ID NO: 33607 - DNA, 673 bp, Homo sapiens
  misc_feature 1..673: note = chr11:6947606-6948279
  misc_feature 1..673: note = hyper
  source 1..673: mol_type = genomic DNA
gttccaagtgtgcggcgtgggcggggcctgcagaaagggacggggcctgcagaaagggacggggctggcaaaggcctggtctacctcaccgatccgggtcgcgggggctcctagggggttccttccacagctggtgcgcgtgcgcaagagtgcgtcgaggttgttccgcggcaatttatgaaactcggagccggcagtgagttgagggttcggcgaggtcagggattcctagttgcagcgtgattaccaacgccagctcccttcactgtccaagacagcgattccgcggctcctctgagaactggcgcttgtgagtgactgaacgggccactggagaggagcggtgctcacgggtatcgttctcgtcagcgggcggtggggacgcggggtcttggaattgggaatcacgcttgagggcgtccatgcggaacgtgcagcttacctcagcttgcttgcagttacccagtttccacgctgccctccaaggtctgtgccggaaaacctggaggagggcgcgagctgacgggagggatggaaacgtgggctgcggaagtaagacaagcgttgagagcagcgacagagggcgagggggtgggcggcgggacggctggggtcaggatccagctccgctaaagcaaggatttaaccacactcctgtcgcctcttccactct

SEQ ID NO: 33608 - DNA, 66 bp, Homo sapiens
  misc_feature 1..66: note = chr11:7273082-7273148
  misc_feature 1..66: note = hyper
  source 1..66: mol_type = genomic DNA
ggccccgccccccggcggccgcgagtagcgggcggagcgcaagcagagaggcgctctgggctgtgc

SEQ ID NO: 33609 - DNA, 111 bp, Homo sapiens
  misc_feature 1..111: note = chr11:7273149-7273260
  misc_feature 1..111: note = hyper
  source 1..111: mol_type = genomic DNA
gcaccgcctctcctcggtgtctggggagggacggagggaccgggcgggagagagagaaagcctgaccgaccggctggcgaagagctgcatgcaaccggtgggaggccgggc

SEQ ID NO: 33610 - DNA, 220 bp, Homo sapiens
  misc_feature 1..220: note = chr11:7273679-7273899
  misc_feature 1..220: note = hyper
  source 1..220: mol_type = genomic DNA
cgagccaggagagtgatcaagaaccagcgcactgtggcctgatgctgtaaccaggcggggacccgggcggtggctactgcacggaggccgactccgggtcggctagggcagggttggagggaccacgcccgccacctgcgctcccatcgccaaggctcctgggggcggctccctagctccgagctacgctctccacttcccgggctatctgcactcagag

SEQ ID NO: 33611 - DNA, 173 bp, Homo sapiens
  misc_feature 1..173: note = chr11:7274075-7274248
  misc_feature 1..173: note = hyper
  source 1..173: mol_type = genomic DNA
cgcgatccggcgttgggccggggacagggtgcttctggccttgggcagacgggcctgaacccgttcccggcgggtcgcacggcatggaggtggcctgggcctgggcgctaggctcgaccagcgactaccgccggccacgatggggttcgtagactcgtcggtcctggcttgtg

SEQ ID NO: 33612 - DNA, 126 bp, Homo sapiens
  misc_feature 1..126: note = chr11:8040298-8040424
  misc_feature 1..126: note = hyper
  source 1..126: mol_type = genomic DNA
ctggggaagaagggacggggagacggcgggaatctaggaaattgggggatggctatttccattcctgagaaggggggaacttgattgtgggaggttggctgaagactcccacgccggaaaggaggg

SEQ ID NO: 33613 - DNA, 108 bp, Homo sapiens
  misc_feature 1..108: note = chr11:8040668-8040776
  misc_feature 1..108: note = hyper
  source 1..108: mol_type = genomic DNA
acgggcccgggtccccgcagtcgcgcgtccccgccattggcagagccggagggggtcaccccccggggggcgaatggtacagtcctccgcccgcgcctcggccgggcc

SEQ ID NO: 33614 - DNA, 100 bp, Homo sapiens
  misc_feature 1..100: note = chr11:8040960-8041060
  misc_feature 1..100: note = hyper
  source 1..100: mol_type = genomic DNA
cgggagaagcgggcctccgggggctaggactggcgcgagcgcccgacccccagggtgggcttgggcacccggaccctcgggcatccgggacccagagcct

SEQ ID NO: 33615 - DNA, 67 bp, Homo sapiens; identical to SEQ ID NO: 10692
  misc_feature 1..67: note = chr11:8041504-8041571
  misc_feature 1..67: note = hyper
  source 1..67: mol_type = genomic DNA

SEQ ID NO: 33616 - DNA, 428 bp, Homo sapiens
  misc_feature 1..428: note = chr11:8102616-8103044
  misc_feature 1..428: note = hyper
  source 1..428: mol_type = genomic DNA
gcatggagcgtggatcgcgacgatttcgggggagggggcaagggcgctccgcaggccctgagccggccggggggtggggtctctgcggggcggggcggggcggggcgagggagaaggggcaggccgccgctgccacgcagtactcccgccttggcgccagaggggcgcgggacggtgcggtcggcctccccgcctccacgcgcgcgcacgacccgcgcactcccggagcttcgcccatctcgcctcgccgcgccgcgcaggcagccgctcgcagagccagcagccggggccctggcgtgcagcgcgggcctcggcggggcccagcgccccggcccgggaggatgcggcccggggcggcccgggagctgagcagggcccccgcgccggcccctccgggccccggcctccagagccgcagccaccgcccc

SEQ ID NO: 33617 - DNA, 794 bp, Homo sapiens; identical to SEQ ID NO: 3689
  misc_feature 1..794: note = chr11:8189946-8190740
  misc_feature 1..794: note = hyper
  source 1..794: mol_type = genomic DNA

SEQ ID NO: 33618 - DNA, 56 bp, Homo sapiens
  misc_feature 1..56: note = chr11:8284256-8284312
  misc_feature 1..56: note = hyper
  source 1..56: mol_type = genomic DNA
gagacagggagctagcgggccggcacaagaggcggctctctttctcaccgagtcac

SEQ ID NO: 33619 - DNA, 13 bp, Homo sapiens
  misc_feature 1..13: note = chr11:8284313-8284326
  misc_feature 1..13: note = hyper
  source 1..13: mol_type = genomic DNA
ctcatgcagatgt

SEQ ID NO: 33620 - DNA, 369 bp, Homo sapiens
  misc_feature 1..369: note = chr11:8284592-8284961
  misc_feature 1..369: note = hyper
  source 1..369: mol_type = genomic DNA
ccgcggcgcagcacacggccagtgcacagctcctcggctcgcggccgggacccggggggcgtgcggccccgggcgcgtgcagcccggggctcgacctcctccccccgcaagttccgcccggctgtcccccggtacttccccccgccccagccccggcccccagcgcgccgcccgccccgcaatccccgcacagcccagcaggtgtgcgcccgtgtccccgcgtgtgtgtgcctgcgcgccgcggcagggggcgagggggtgaggggcgtcgagaccccggcccgccacctaccgtcctccttgtccagcaccatcatctcgggcgctccgtgtccagccgcagctaggctcggccgggagaagggcgcc

SEQ ID NO: 33621 - DNA, 245 bp, Homo sapiens; identical to SEQ ID NO: 10698
  misc_feature 1..245: note = chr11:8289527-8289772
  misc_feature 1..245: note = hyper
  source 1..245: mol_type = genomic DNA

SEQ ID NO: 33622 - DNA, 366 bp, Homo sapiens
  misc_feature 1..366: note = chr11:8290057-8290423
  misc_feature 1..366: note = hyper
  source 1..366: mol_type = genomic DNA
cgccgccggccgcctgcgctgctcccgccggccccgcgcgggcgccgagtccggagagccgcgaccgccgacgggggcagacggaccggagtccggagcgcagccccgcgggcagggagcgcaggaggagggactggggggaaggcgcgggggcgagacggccaggccgggatcgcgggagcctcgcgagcagcagctgcccgggccgggccgcagccggagcctgagccgcgcgcgcgtccttcctccgcgccggccgtactcgcctcagcagagtgaaggctgcatttcccagggcccctcagattcccctgttaattaaatcaattcattatgctcagatctgattagcggcccttccccccc

SEQ ID NO: 33623 - DNA, 130 bp, Homo sapiens
  misc_feature 1..130: note = chr11:8615288-8615418
  misc_feature 1..130: note = hyper
  source 1..130: mol_type = genomic DNA
accccacagtaagttcgcttctaaactttcaaaaagtttcacgtcccaagatggggtgaaggtgagacggtggagatgaaccggggcagacagagaccaccccaaataccggacccgggggaaatggggt

SEQ ID NO: 33624 - DNA, 125 bp, Homo sapiens
  misc_feature 1..125: note = chr11:8615762-8615887
  misc_feature 1..125: note = hyper
  source 1..125: mol_type = genomic DNA
gaggacaaacagcggcggcgggtgcaaagccccttctccaagccgcggggttggccgggaggtgccggctgcacaacggcgcccacgtgacccaggtgcagccccaggcgcgcccaagggcagct

SEQ ID NO: 33625 - DNA, 1268 bp, Homo sapiens
  misc_feature 1..1268: note = chr11:9025080-9026348
  misc_feature 1..1268: note = hyper
  source 1..1268: mol_type = genomic DNA
gggaggaggcacagccgaggggagcgcaagctagaaaagctacgacggaatccccaccgaaaccgcagcaggggtactggaaggggaggaatccgcgacgcagcgaccgcgagccaagggcagcggcgggccgggccgtgactcagtgaaagccgcaacggccgggcctcggaaaacggcgggcgcgaagccgccggggccggggcgagaacggcggcgggggctcaccatgtccttggacgagcccagcttcttgaggccgtccaggggcagcaggtcggcggagtccttgtggatgaactgcaccgcctgcttcatccggcgctgctgtcgcagtgacgccgcctcccgcatgtcggtctccttgcggccgccctcagtgaggagccctgagtaaaacatcgctgaggcgccggcggcccggtagcccacagccccccggcagcctcagcctcgagctcctccagcgccgcaagggccccgagccgcgccttttatagccgagcgtgacgtcgcggggagcagccagtgcgcgcgcggggggcggggccggcacagagtccacgccccgcgcggctccctcgcgtcccgcgtcccgcgtcccgcgtcccctgctcacccggtggcaaagccggcgaggaggcggcggcgctggtggggactgacccggcagtccgagaatccaccgcggccttttcacccaaccgccccctcctgcgtgggggccccgcatcccctggactggcgtgggctctggggcccgatgccctggcagccccggccatctctgccgctggccgcgggtacctgctcacctgtccacgccgtggccgacccggggatcaccgacagccgggccatgcctcgagtcccgccgcccgcgccgctgctcggcttctcagaaacgcacctccacgccgccagccggggctccagggtccaccgcccgggcccggaggactggcgactccctccgaggttgggagcgctccggatttctccaacttcaggtcggtccccacccaccgggccacgtgactggggagggggcagccggtgcaggcgtgtggaggaggctttcgggacctcctcccccgggcaccctctgcctgcagcccggcacccggcccgcgtttccgagccgggggagcaggtgcagtcggaagcccgcgggtgggcgtggggcgggggagtggcgagggtcccccgcctccgcgggagcgcacgcggctgcgagccctacacctgctctccgaccaaagaagcac

SEQ ID NO: 33626 - DNA, 140 bp, Homo sapiens; identical to SEQ ID NO: 3690
  misc_feature 1..140: note = chr11:9112446-9112586
  misc_feature 1..140: note = hyper
  source 1..140: mol_type = genomic DNA

SEQ ID NO: 33627 - DNA, 681 bp, Homo sapiens
  misc_feature 1..681: note = chr11:9112639-9113320
  misc_feature 1..681: note = hyper
  source 1..681: mol_type = genomic DNA
cgcaccctcctgcctgctcgccggcgacggtctgactagcaggcgctctggaggcatccggaccggggcgggaaccgtcagcagctccgggtccgaggccgggccgaaggactcagggccccagcggtcgtggcgccttggcccggccggcgggtgaggtcccggggggagcagaggcccccgcggagctgcagccgccagccccgagccccgcgcgcccggctctggactccgccggggacctaaacactcttcctggccctgcctgctgtgccaggtgcgcccccgcggccggacactcaccctcctgcggccccgcggcacggccccgacccggcgggacggcccccgccagcagcagcagtggcggcagcagcagcagcagcagcagcaccgcccaggccgccccgggacggttgcggcccgcgacccccatggatggctcagcggttgcgggcagaggcggcggagtgcgggcggtggcggcggcggcgcggggaggtgtgcgcggacgccctgcccgctgccgctgccacccccggcccggccccgcccgccccccgagccccggcctcattttcacacggtccctcccgggccggggcgggaagcgcaggcgggagcagtgccgccccgcccggcctcctcccgtcccctccccggcctcgggtggagggggcg

SEQ ID NO: 33628 - DNA, 64 bp, Homo sapiens
  misc_feature 1..64: note = chr11:10472083-10472147
  misc_feature 1..64: note = hyper
  source 1..64: mol_type = genomic DNA
agcggtgtggaagcccggcggggccagcgcagttgaggtctggggagcccggctggcatctgct

SEQ ID NO: 33629 - DNA, 60 bp, Homo sapiens
  misc_feature 1..60: note = chr11:10472462-10472522
  misc_feature 1..60: note = hyper
  source 1..60: mol_type = genomic DNA
gccgggccctggccccggctggcctcagtgcccagcagccccgctccgctctgcccagcg

SEQ ID NO: 33630 - DNA, 46 bp, Homo sapiens
  misc_feature 1..46: note = chr11:10472557-10472603
  misc_feature 1..46: note = hyper
  source 1..46: mol_type = genomic DNA
cggccggcggcatggccctgtcgtccgaacccggtgagtgcgcgcg

SEQ ID NO: 33631 - DNA, 66 bp, Homo sapiens
  misc_feature 1..66: note = chr11:11642602-11642668
  misc_feature 1..66: note = hyper
  source 1..66: mol_type = genomic DNA
cagcccagagtcacacgcacatttggacacgtgcgcagcgcgcccccataccgccagctagctgca

SEQ ID NO: 33632 - DNA, 96 bp, Homo sapiens
  misc_feature 1..96: note = chr11:11643016-11643112
  misc_feature 1..96: note = hyper
  source 1..96: mol_type = genomic DNA
gcacatacacgctggcgatgtagttggtgacccagcccacgtagagcaggcagatgatgttagtcatgccgctcaggatcacgcaagtggacacca

SEQ ID NO: 33633 - DNA, 362 bp, Homo sapiens
  misc_feature 1..362: note = chr11:12029910-12030272
  misc_feature 1..362: note = hyper
  source 1..362: mol_type = genomic DNA
acccacctcttccaccgcgctgcgcaatttgtgctgcgtgtcctccatcagttcctcaacctcgcggaacatctcattgagggtggcctcctcctgcgggtagctgagagccgggccgggcttgactggagccgaggtcgccgtcggagcgggcgcgggggccgtggggaccgccgccgccagcagcaggcacagcagggtggccccaagccgctgcatctccgctctgcgcccgcagccgccgcctgtgtgtcccggaacgcgatcagaggcgcgcggaccacccccctcgctgggcccgccgccccgccccgttccgccccgccgcccgcccctggcgcccctctttcccgcacccgccc

SEQ ID NO: 33634 - DNA, 288 bp, Homo sapiens
  misc_feature 1..288: note = chr11:12030273-12030561
  misc_feature 1..288: note = hyper
  source 1..288: mol_type = genomic DNA
gagacgggaggaaaccgaggcccctgaaaacgcagctcccctacacccgaaaagacgcgaccccacccgctccagcccgagccccgatcgccccaggaccccgcacccccatcctcgagcacaagctgagctctgctcctcacctgtgatgctggagccctcgccagagcaaccgaacccggatcctctacgctaatagctcccaagccccagctcacctagactctgtccccggttcaaaccctagcccctcctcgaccaggtcagagtgcccgacccccacttcca

SEQ ID NO: 33635 - DNA, 74 bp, Homo sapiens
  misc_feature 1..74: note = chr11:12030834-12030908
  misc_feature 1..74: note = hyper
  source 1..74: mol_type = genomic DNA
gagcgcggcggggtgcggcagcgccggtacccgagggagcccgcaagacgcgccccgcccgcccaccaggctcc

SEQ ID NO: 33636 - DNA, 60 bp, Homo sapiens
  misc_feature 1..60: note = chr11:12132499-12132559
  misc_feature 1..60: note = hyper
  source 1..60: mol_type = genomic DNA
ataaaagcctcccaccggcacgccgaactacctcttactccgctccgcaacacccaaacc

SEQ ID NO: 33637 - DNA, 30 bp, Homo sapiens
  misc_feature 1..30: note = chr11:12398995-12399025
  misc_feature 1..30: note = hyper
  source 1..30: mol_type = genomic DNA
ttccagggcagagggcggcgcgagggaggg

SEQ ID NO: 33638 - DNA, 92 bp, Homo sapiens
  misc_feature 1..92: note = chr11:12399277-12399369
  misc_feature 1..92: note = hyper
  source 1..92: mol_type = genomic DNA
cttcttggggaaactcggagggaccctggcccggaggaagaaagccaaggagggtgagtgcggccaggccggccgggcgggcggtaggagcc

SEQ ID NO: 33639 - DNA, 15 bp, Homo sapiens
  misc_feature 1..15: note = chr11:12695481-12695496
  misc_feature 1..15: note = hyper
  source 1..15: mol_type = genomic DNA
acacttgcagacttc

SEQ ID NO: 33640 - DNA, 258 bp, Homo sapiens
  misc_feature 1..258: note = chr11:12695888-12696146
  misc_feature 1..258: note = hyper
  source 1..258: mol_type = genomic DNA
cggcaggccgcatgacgtcaccgaggccccacccctccggagcgagttcggtcctggcgttcatttcattcctgtcctcattccgaacattcttagcatcgctcgcgccgcgccgcgccgcctgagccgagccgagcctctgctgccgccgccgcggccccgccgcccgccgcgggcgcccaccaagcactttgcagactcgcttccaccctgcgggccattccgcgcggcggggcccgggcccggggcggccgcgtc

SEQ ID NO: 33641 - DNA, 48 bp, Homo sapiens
  misc_feature 1..48: note = chr11:12696640-12696688
  misc_feature 1..48: note = hyper
  source 1..48: mol_type = genomic DNA
cggcccccggccggccgcgccgcgccccccgcgcgccccctctcccgc

SEQ ID NO: 33642 - DNA, 30 bp, Homo sapiens
  misc_feature 1..30: note = chr11:12715647-12715677
  misc_feature 1..30: note = hyper
  source 1..30: mol_type = genomic DNA
gcggcaggctgagtccggggaagtgcccca

SEQ ID NO: 33643 - DNA, 173 bp, Homo sapiens
  misc_feature 1..173: note = chr11:13030315-13030488
  misc_feature 1..173: note = hyper
  source 1..173: mol_type = genomic DNA
gactgggaggccttccgctttagaggcagcgcttatagcgctagctggtcgtggaatgcgattacagcgtctccattggagaccgctgagtgcctcggtttccctgtctgtgcaaagtgcactccccagacgccgctgcctcgagggaccaggaaatgcgtctgggggcgcca

SEQ ID NO: 33644 - DNA, 380 bp, Homo sapiens
  misc_feature 1..380: note = chr11:13031244-13031624
  misc_feature 1..380: note = hyper
  source 1..380: mol_type = genomic DNA
ggcggcgacggagacagcggcggagccggcggctggggtcggccggcgacccgcatggcccgggagagctgcccgaacccccgaacgaggacgacgaggacgacgacgaggcgctgccgcagggcatgctgtgcgggcccccgcagtgctattgcatcgtggagaagtggcgcggctttgagcgcatcctccccaacaagacgcgcatcttgcgcctctgggctgcctggggcgaagagcaagagaatgtgcgcttcgtgctagtgcgcagcgaggcatcgctgcctaacgccggcccccgcagcgccgaggcgcgcgtagtgctgagccgagagcgcccctgtccggcccgcggggccccggcgcggcccagcctggcc

SEQ ID NO: 33645 - DNA, 15 bp, Homo sapiens
  misc_feature 1..15: note = chr11:13032000-13032015
  misc_feature 1..15: note = hyper
  source 1..15: mol_type = genomic DNA
agccagaagaggtgg

SEQ ID NO: 33646 - DNA, 219 bp, Homo sapiens
  misc_feature 1..219: note = chr11:13032093-13032312
  misc_feature 1..219: note = hyper
  source 1..219: mol_type = genomic DNA
ggcgctgcgacgacttgctgcggcttcaggagcaacgggttcagcaggaggagttgctggagcgcctttcagccgagattcaggaggaactcaaccagaggtggatgcgacggcgccaggaggagctggcggcgcgggaggagcccctggagcccgacggtggccccgacggcgagctgctgctggagcaggaacgggtcaggacgcagctcagtacca

SEQ ID NO: 33647 - DNA, 83 bp, Homo sapiens
  misc_feature 1..83: note = chr11:13032656-13032739
  misc_feature 1..83: note = hyper
  source 1..83: mol_type = genomic DNA
gcggggggcggggggcgggaacagggggattcttttttcttgcagaatgcagtgggccagccggctcgcggacttgaaaccag

SEQ ID NO: 33648 - DNA, 216 bp, Homo sapiens
  misc_feature 1..216: note = chr11:13300474-13300690
  misc_feature 1..216: note = hyper
  source 1..216: mol_type = genomic DNA
gcctccccgaggggtcgcgagagccggcagcggggtgagctcaggtgcccgccggcaggagctggggagggaaggggagtgctggacaccggcgcctgctgtcaagttctcgccggccggtgagagacccgctgccgccgcgcaccccgcacctcctgacccctctcccctctccgcctcggccccttcccggtcacctagcgttgttttggcgct

SEQ ID NO: 33649 - DNA, 30 bp, Homo sapiens
  misc_feature 1..30: note = chr11:14665073-14665103
  misc_feature 1..30: note = hyper
  source 1..30: mol_type = genomic DNA
cttctctttcagtcccggtgggtcttcgga

SEQ ID NO: 33650 - DNA, 407 bp, Homo sapiens
  misc_feature 1..407: note = chr11:15136049-15136456
  misc_feature 1..407: note = hyper
  source 1..407: mol_type = genomic DNA
caagggaaacgatcgcggcacattcccttcccctctccagatgttggcatgcggggcaccttgtgggcgaccccgcctggacggcttcgcggctcccgggcgatcaccctggtgcctgccgcctggcccgggggagcccggtctctaattaggcctgaccgcgtccccattccagcgctcctgcagatgggagggagggccatgtttccccccccaggggcaccgaaatagcctcgtagtcccgcggagacagcaggcagccgtggctgacgcgggaccaaggcttggcagggagcgcgctgctgtggaaggtccttgggaggctgcgaccgcctcggagagggcgggcgggggagaacggggcggggggtggggcgggggccaggggcggcctctcgggctgggcc

SEQ ID NO: 33651 - DNA, 101 bp, Homo sapiens
  misc_feature 1..101: note = chr11:15136457-15136558
  misc_feature 1..101: note = hyper
  source 1..101: mol_type = genomic DNA
gcagagcggccactttgcgcgcggcctctggagctccagctgcgccccgccaccactggccgctcgcactaccagcctgtctcgcacgctaagtaagtaga

SEQ ID NO: 33652 - DNA, 206 bp, Homo sapiens
  misc_feature 1..206: note = chr11:16625964-16626170
  misc_feature 1..206: note = hyper
  source 1..206: mol_type = genomic DNA
gaagaccctagtgggcgggagtagaggggccctctctcatctctactcccccgggttgctggctgggccgtgcagccagggccaaagcccggccgcaggagtacgcggctagcaccggcgcccgggacgcggacgtcatccgagcgcccattgacagtacagcgggaggtccggagcccagcccagtttgccgcaaggacggcttc

SEQ ID NO: 33653 - DNA, 44 bp, Homo sapiens
  misc_feature 1..44: note = chr11:16628305-16628349
  misc_feature 1..44: note = hyper
  source 1..44: mol_type = genomic DNA
tgccttaatgtcctacgcacagttatctacggctacaacatgtg

SEQ ID NO: 33654 - DNA, 30 bp, Homo sapiens
  misc_feature 1..30: note = chr11:16628881-16628911
  misc_feature 1..30: note = hyper
  source 1..30: mol_type = genomic DNA
tcccggttacctgggcgggctccaggatgg

SEQ ID NO: 33655 - DNA, 156 bp, Homo sapiens
  misc_feature 1..156: note = chr11:16629373-16629529
  misc_feature 1..156: note = hyper
  source 1..156: mol_type = genomic DNA
agatgagacaagaggcgagggaggcagcgagccaggcagagaagctgggagggaggagggcgggccgggggaagaaggaggggagagcgggaggcaaaggcaagagagagccgcaaagagagaggagggcagagacatcggcgagaccagaggttg

SEQ ID NO: 33656 - DNA, 157 bp, Homo sapiens
  misc_feature 1..157: note = chr11:16632513-16632670
  misc_feature 1..157: note = hyper
  source 1..157: mol_type = genomic DNA
cgcaagaaccccgggcgctgagctccggggaacctgggagggaaggaggggcgagcgggtggggctgacttacctgcccgcagcagtcgctgcctctgtgttgtccgaatgtccctgcgcaccgcaaccagcaaaggcaattcggctttgctaactt

SEQ ID NO: 33657 - DNA, 178 bp, Homo sapiens
  misc_feature 1..178: note = chr11:16634274-16634452
  misc_feature 1..178: note = hyper
  source 1..178: mol_type = genomic DNA
tccatttctcccccacgtcaccctcctccattcccctctaatgagacgcggatcaccctccactctcaccgacactgcagctctgcacaagggcagctggaatctgggaaccttacctgcagcaccaatacctaagagaaatcgcgcttccctgacactaacacgccatgccatcccc

SEQ ID NO: 33658 - DNA, 132 bp, Homo sapiens
  misc_feature 1..132: note = chr11:16635795-16635927
  misc_feature 1..132: note = hyper
  source 1..132: mol_type = genomic DNA
gctcagagctgactccgtactccctgggactcatctcccgcttcctctccaccttcggaacagtagacaaagggactcagggacgcggccagacccaaggtcacaaacggaggtctccgagacgagaattgc

SEQ ID NO: 33659 - DNA, 73 bp, Homo sapiens
  misc_feature 1..73: note = chr11:17497448-17497521
  misc_feature 1..73: note = hyper
  source 1..73: mol_type = genomic DNA
ctcagtggagaggcacgcacgattgtcccggccgtggcgcccaactttgcaagcaagggcgccggggtcgctg

SEQ ID NO: 33660 - DNA, 116 bp, Homo sapiens; identical to SEQ ID NO: 3695
  misc_feature 1..116: note = chr11:17497545-17497661
  misc_feature 1..116: note = hyper
  source 1..116: mol_type = genomic DNA

SEQ ID NO: 33661 - DNA, 230 bp, Homo sapiens
  misc_feature 1..230: note = chr11:17497951-17498181
  misc_feature 1..230: note = hyper
  source 1..230: mol_type = genomic DNA
gtccgctgtgtttggcgcgggatcgggggcaccgggggagtgaagggatgagctggtgtgcgagtgcggggaccggcgggcaggacacagggcaggggaccccgggaacgaggcggacggcggtcgcgggccggaaggggacgccgagcggtgcggcgcgcagcgcctcctcctccctccctgctctcccgtcccctcctccgcggctcgctgcgcgcactcaccaatga

SEQ ID NO: 33662 - DNA, 93 bp, Homo sapiens
  misc_feature 1..93: note = chr11:17565890-17565983
  misc_feature 1..93: note = hyper
  source 1..93: mol_type = genomic DNA
gttccttcgggtgcccggctgccaggagctggaaagagccgcgaccgcgaccgggccagccgccctcggagctgggggcggggcctgagcgcg

SEQ ID NO: 33663 - DNA, 440 bp, Homo sapiens
  misc_feature 1..440: note = chr11:17717334-17717774
  misc_feature 1..440: note = hyper
  source 1..440: mol_type = genomic DNA
cacagggtcagtgggcggggagggactggagagcgctgggcagggcgaggaggtgggagccgcgctagagcgtggggaggggacccgcagtgggcgcgcggccttagagaggggccagggccggggccggggccgggccggggctgcggtgaggggaggcgcgtggccggccgcccccagctgtggcgtcgttcaggcccggcttagcggtgccggggcgagggattaggggcagtggccgcacctggcggggcggccgcagggctaatgctgtgtgaccgccgcggccccgcccgacaactggcttcatcccgccctggaggcctgtgggctcgttagccccgccggcgtgtgcgcggggtgcggctgcgggcggcgagtgcacgtgtgccgcggggggccctgccgctggcgctgacggccaccggctgcgcccagct

SEQ ID NO: 33664 - DNA, 176 bp, Homo sapiens
  misc_feature 1..176: note = chr11:17740414-17740590
  misc_feature 1..176: note = hyper
  source 1..176: mol_type = genomic DNA
agctgggtttctaagcgtctagggaagaaggactgggcccacgacctgctgagcaactcccaggtcggggactggcggaatatcagagcctctacgacccgtttgtctcgggctcgcccacttcaactctcggggtctctccgcctgttgttgcactcgtgcgtttctctgcccct

SEQ ID NO: 33665 - DNA, 327 bp, Homo sapiens
  misc_feature 1..327: note = chr11:17740835-17741162
  misc_feature 1..327: note = hyper
  source 1..327: mol_type = genomic DNA
gaggtttggaaagggcgtgccggagagccaagtgcagccgcctagggctgccggtcgctccctccctccctgcccggtaggggacctagcgcgcacgccagtgtggaggggcgggctggctggccagtctgcgggcccctgcggccaccccggggacccccccaagccccgccccgcagtgttcctattggcctcggactccccctcccccagctgcccgcctgggctccggggcgtttaggctactacggataaatagcccagggcgcctggcgagaagctaggggtgaggaagccctggggcgctgccgccgctttccttaacca

SEQ ID NO: 33666 - DNA, 41 bp, Homo sapiens
  misc_feature 1..41: note = chr11:17741528-17741569
  misc_feature 1..41: note = hyper
  source 1..41: mol_type = genomic DNA
cggcggtgcacccggccccgggcgcacgtgaggacgagcat

SEQ ID NO: 33667 - DNA, 84 bp, Homo sapiens; identical to SEQ ID NO: 949
  misc_feature 1..84: note = chr11:17741806-17741890
  misc_feature 1..84: note = hyper
  source 1..84: mol_type = genomic DNA

SEQ ID NO: 33668 - DNA, 532 bp, Homo sapiens
  misc_feature 1..532: note = chr11:17741952-17742484
  misc_feature 1..532: note = hyper
  source 1..532: mol_type = genomic DNA
cggcatggtaaggccgggaccccaggaagtgaggaagttagggcggcgctcgggatatcagggacgcgtttccgagggcggggagctggccttgcgggaggtttgggccaggatccttcccgagagagaggacccccttgtcctgggcagctgtcactggggtagcctgttttggaagtgtgcgggcaagcgttcgagctgccccattgggggcgctattagaacactgcagcgcgaacgtgaagatctttttctctacttatccctacttccaaaatgtaaatttgcgccccttggtgactgtccgcccttggtttggccctgcatgttgcagacctcatctcctacccacccgtaattacccccccaaccaggacaggtctgggcccggaactagagccttaggctagagttagggagggggcggctacaggaattggtgttcgggcctcgagccgtcccgcgggcctgactcagtcgcccttgctgtttgcagatggactacagcggccccccgagcggcgcccggcgg

SEQ ID NO: 33669 - DNA, 50 bp, Homo sapiens
  misc_feature 1..50: note = chr11:17743742-17743792
  misc_feature 1..50: note = hyper
  source 1..50: mol_type = genomic DNA
ccagctgtccctcagcgacgcctgtaggcggcaggcggattgcaaggagg

SEQ ID NO: 33670 - DNA, 49 bp, Homo sapiens
  misc_feature 1..49: note = chr11:17756617-17756666
  misc_feature 1..49: note = hyper
  source 1..49: mol_type = genomic DNA
acccccgcctggccccgtgcagctccgcgaccgccgggagctgtccctt

SEQ ID NO: 33671 - DNA, 86 bp, Homo sapiens
  misc_feature 1..86: note = chr11:17756886-17756972
  misc_feature 1..86: note = hyper
  source 1..86: mol_type = genomic DNA
agagagggagggggccggagcccgccctgcgtcccgagctgcagcccggccacgcagggaggaaggcaggcggcatccatctcccc

SEQ ID NO: 33672 - DNA, 15 bp, Homo sapiens
  misc_feature 1..15: note = chr11:17756993-17757008
  misc_feature 1..15: note = hyper
  source 1..15: mol_type = genomic DNA
cgaccacctcacaga

SEQ ID NO: 33673 - DNA, 77 bp, Homo sapiens
  misc_feature 1..77: note = chr11:17757704-17757781
  misc_feature 1..77: note = hyper
  source 1..77: mol_type = genomic DNA
tgacgagttcttcttcgaccgccaccccggcgtcttcgcgcacatcctgaactactaccgcacgggcaagctgcact

SEQ ID NO: 33674 - DNA, 494 bp, Homo sapiens
  misc_feature 1..494: note = chr11:18742646-18743140
  misc_feature 1..494: note = hyper
  source 1..494: mol_type = genomic DNA
ttcagctgaagagcccggagcccctgaccctcacccctactctacggcgagtccctccggcacctcgccacccacaatggtcccgccctccatggctacgcccaccgtcttggtcccgcgttccttttggctcactcgccttgtggacacgccccttcgcttccattgcgtcccgccccgccacgttctggctctgcccctgctctgctctgccccgggggtactttgggtcctctgctcattccggcaatatcccggttcctgactcggcctctcttatcctgccgcgcctctcgggcaatgacagctgcttttcccactgcccggctctcgggccgccgttaaggctctcatcggtgagaagactggcggcccgccctgggggtccctgcctctggccttctcggtaactggacttgggcttggcccccgcaccttcagcacgtgttccttgttaatgctgtcgtagaatatcttggcggactccttgatgg

SEQ ID NO: 33675 - DNA, 609 bp, Homo sapiens
  misc_feature 1..609: note = chr11:18812557-18813166
  misc_feature 1..609: note = hyper
  source 1..609: mol_type = genomic DNA
gctgggggaggggagcgcgctaagcttgtattctaggggagggtgggacgcgggaggctaaagctaaagggtcggtggaggcgaagcaatgggaaggctgggagccgcgctttagaggccagaaggctagcggcgatttccaatctccctcaggggcttcaggctccggagaggcgatgcagcccagagccgcgcaccagcctccgccggccgcagaggctcagaccccaaaccactatcccgattcctccccggaaccgcgcacgggcttcgtggggagtggctgccgctccctcccggctaccaagcgacaagccccctcctctgcatgggggacccctcccccagcatgcgggcgcccagagccccacgggggcgtggcgggggcgggcgccggctcctcggccgggagggctggagaaggtgtcagttgcggggccgcccgaaggagggacccgcgccctccaccttccggctccgcacacaaaggcgcagacggaggcgccgcacttaccggccagagcgggctccgggcgccggcgagcaggcgggcaggctggcgggaggatgcgcgcgcgagtgtgcgtgtgtctgcgtgtgtccctgctt

SEQ ID NO: 33676 - DNA, 167 bp, Homo sapiens
  misc_feature 1..167: note = chr11:18813376-18813543
  misc_feature 1..167: note = hyper
  source 1..167: mol_type = genomic DNA
ccccagccccggctccgccccgcccccgggcgggcttccgccgctcgccgggaattgcgcagggctggcggggcgggggaccgggagagcggcctgctcccggggcacgaagggggccggatcacagacccttaacccctgacctcatctcaggtgcctccctctcc

SEQ ID NO: 33677 - DNA, 442 bp, Homo sapiens
  misc_feature 1..442: note = chr11:18813609-18814051
  misc_feature 1..442: note = hyper
  source 1..442: mol_type = genomic DNA
cggaggagtgggagcagcgcatccatttcattcatgattttttctcctcttgggagccccgggtcgggccgcgcggctacggcaactgccagagggaccccggcagggccgtgcgcgctgaacctgggacgggacagacaggcagacagaaggagtaggggccagcgagacaaagggggcagagttgggggagggagtcggctcattgggggcatgccgtggcgctccccgcatgttgccaacacctgcgcaagtggagcggccccatactagggcgcatgcaataccaggtgccgaggactcgttctaggacgctgaggaggcgtcctttttcccagttctccctgttcagcctctggggagctagagcgagtggacagcccctccctccactgagtcttgccctcctgacgtgcggcgcggggcacgcacctgttttggt

SEQ ID NO: 33678 - DNA, 30 bp, Homo sapiens
  misc_feature 1..30: note = chr11:19263461-19263491
  misc_feature 1..30: note = hyper
  source 1..30: mol_type = genomic DNA
cgccctgcgattccccgcttggggctatct

SEQ ID NO: 33679 - DNA, 30 bp, Homo sapiens
  misc_feature 1..30: note = chr11:19263848-19263878
  misc_feature 1..30: note = hyper
  source 1..30: mol_type = genomic DNA
gagccctagcagggtcggggagacacttcg

SEQ ID NO: 33680 - DNA, 437 bp, Homo sapiens
  misc_feature 1..437: note = chr11:19366698-19367135
  misc_feature 1..437: note = hyper
  source 1..437: mol_type = genomic DNA
gcactggttggctggcgggagggaggaggaggcggtttcccgggtaacgggagggcaaggagcggctgcagcggcagcggccgcggctgagaagcgcgggccggagtgcagtgcgagaccggctggaggaggcggctccgcgaagccggtgtgggcgcaggtaggaaccccctatgctgcctcccccaggtcgggtctggctggactgcccggcggcgggaccggcctgggaaagtttgcggtgcaactgggtgggcaaggaggagaggacttggggatgctctgtgctgagctccggggtccagagcagggtggggactgccgttggggagagggccggcccctcattgagaggctcgggggccacacctctgctgcgggactctgaccgagggccagggcctctcaagccacccggccgcagcatagataccggg

SEQ ID NO: 33681 - DNA, 92 bp, Homo sapiens; identical to SEQ ID NO: 10731
  misc_feature 1..92: note = chr11:19367267-19367359
  misc_feature 1..92: note = hyper
  source 1..92: mol_type = genomic DNA

SEQ ID NO: 33682 - DNA, 91 bp, Homo sapiens
  misc_feature 1..91: note = chr11:19367846-19367937
  misc_feature 1..91: note = hyper
  source 1..91: mol_type = genomic DNA
gcctgtctgtccatacgtgtgtatgtgttggtgggggtggtgtaggtggatcggatccgagccaagccgggggcaactaggccaggcctgc

SEQ ID NO: 33683 - DNA, 39 bp, Homo sapiens; identical to SEQ ID NO: 10733
  misc_feature 1..39: note = chr11:19367938-19367977
  misc_feature 1..39: note = hyper
  source 1..39: mol_type = genomic DNA

SEQ ID NO: 33684 - DNA, 120 bp, Homo sapiens
  misc_feature 1..120: note = chr11:19368011-19368131
  misc_feature 1..120: note = hyper
  source 1..120: mol_type = genomic DNA
cgcccgagcactgggagccgcggtgcctcccgggtgtgcgctccgctgagccggctcctttcttgcctgcaaagggactcaggcggcggcggtggcagcccgcgtcgcccagctggggcc

SEQ ID NO: 33685 - DNA, 90 bp, Homo sapiens
  misc_feature 1..90: note = chr11:19734976-19735066
  misc_feature 1..90: note = hyper
  source 1..90: mol_type = genomic DNA
aggtgtgagacccggcggcagcatccgtccaggtgggacccgctgagcgccgtggccagtcccccattcccatcccggcaccccaaaggc

SEQ ID NO: 33686 - DNA, 30 bp, Homo sapiens; identical to SEQ ID NO: 10734
  misc_feature 1..30: note = chr11:19735404-19735434
  misc_feature 1..30: note = hyper
  source 1..30: mol_type = genomic DNA

SEQ ID NO: 33687 - DNA, 30 bp, Homo sapiens
  misc_feature 1..30: note = chr11:19735730-19735760
  misc_feature 1..30: note = hyper
  source 1..30: mol_type = genomic DNA
ctgggatggcgggcacgtctgcagcatctt

SEQ ID NO: 33688 - DNA, 192 bp, Homo sapiens; identical to SEQ ID NO: 10735
  misc_feature 1..192: note = chr11:20153699-20153891
  misc_feature 1..192: note = hyper
  source 1..192: mol_type = genomic DNA

SEQ ID NO: 33689 - DNA, 90 bp, Homo sapiens
  misc_feature 1..90: note = chr11:20154109-20154199
  misc_feature 1..90: note = hyper
  source 1..90: mol_type = genomic DNA
accttttattggagacgaggcgaacctgggcttagggcgccacctagagccaaaaaagaggaagcgacctggccgcgaagcttcgctagg

SEQ ID NO: 33690 - DNA, 145 bp, Homo sapiens
  misc_feature 1..145: note = chr11:20177698-20177843
  misc_feature 1..145: note = hyper
  source 1..145: mol_type = genomic DNA
tggaccccacctcttcgatttcaaagcacttaaaaatagtactctggcgtgcgagcggcttctaggacacggtgatttcctcctgttcctcgccctcctcttcctcctcggaatctgagaagtccgaaggtttcccgggactgct

SEQ ID NO: 33691 - DNA, 900 bp, Homo sapiens
  misc_feature 1..900: note = chr11:20178093-20178993
  misc_feature 1..900: note = hyper
  source 1..900: mol_type = genomic DNA
cgtcggttctggaaccagattttcacctggaatgtcccggccggcgagaagaagggagaagcagaggtcagatcaggggctccgggggacgcacgggggcggggagtggagtcgggtgcaggctctgtccttcgggctgtgtcctctccccacccccagaaatgagttccggtggattcccgcattgactccgcccccgcctcagctcgcggttccgtttgcctcatccgctgccaccctgccccgaagggcggggttgggggccggtgaggccgggagagaaggcggggagtcggggtggggagagaagagggctatcctgcggagcttcgagggtagtggcccgtgtactcactccctctctaggcctcggttttcccatctgtacagtgggacctaagccgtttccgaacccttgcaattgacgggtgcgccggggaggggtgaagggcgggggcggggggggtgctgtggaggaaatgcgctcacctgcgagtctttcaggcccagcttggccgccagcttcttgcggtcgggcttgctgatgtacttctgcttctggaacatcttctccagcgccttccgctgcacgtcggagaagactgctcgacgcagcatgccccgccgaggcttcccgcgcgcggccagcggccaggagaaggtcccggggatgggcaccacgctggaggaagctgcagggtggggggaggtggcgagtgagtgggcgtacgccccccagtcccaacacggctctccctggctttttgctctgatcccttcatctctttaaaacgctcctttttctccccctggagaataggccacgaacctacaaacctgcgagagtgaaaggcgctttccgcccaaacaactttccctttcaaccgtgcaaacccggat

SEQ ID NO: 33692 - DNA, 173 bp, Homo sapiens
  misc_feature 1..173: note = chr11:20180320-20180493
  misc_feature 1..173: note = hyper
  source 1..173: mol_type = genomic DNA
tggagggactagggccggtctgtgtgtggctgcccggaggagctgaccaattggtcatggtgctgaaacctttgtggggaatcgtggccaagtgcactgactctgtgggaaaacggcggcgtgaagggatgccaacagctcctcgccgggaagggaaccgcctcaaattggga

SEQ ID NO: 33693 - DNA, 115 bp, Homo sapiens
  misc_feature 1..115: note = chr11:20180711-20180826
  misc_feature 1..115: note = hyper
  source 1..115: mol_type = genomic DNA
cgcaaagaagggggacgagacctacctgggaaataagaagatctgatgaaaggctgaaaagacccttcgaagtagggaaaggcgaaggtcttgggagggacgctctggagcaagg

SEQ ID NO: 33694 - DNA, 459 bp, Homo sapiens
  misc_feature 1..459: note = chr11:20181185-20181644
  misc_feature 1..459: note = hyper
  source 1..459: mol_type = genomic DNA
tgtctcctagaagctcgaaggcagaaacgcagacgtccaggagcgtgcgctcagcgttactgcaccagatgactgcgcacagtctccgactgcgtgtgctcaagttcactccgaggatggggcgagcctggaggcttttcttccccggaattgactggactattctcacattgcctgacgtagggtctcagagttcgtgcgtattgtgtgtgcaccgatgtgtgtgtgggggcccgctcgctagaggaaactgaggccaggatgactccgcgcatgcctagtacctgaatgggcccttagggttctgacctcgcttacctgttctgggccccgaggagaggatggcgttcactccaaacttcagaaacgtcgtctcgctggcaggggagaaggcagtcggcggagagccgccccgtcggctgccgggacccggggagcccaggtccgaggcccccgtgt

SEQ ID NO: 33695 - DNA, 269 bp, Homo sapiens
  misc_feature 1..269: note = chr11:20181724-20181993
  misc_feature 1..269: note = hyper
  source 1..269: mol_type = genomic DNA
cggctgatgcggatcagatcctccaccaggaagctggagtggccggaaaatgccgactgcaaggactggggcagcgtcaaggtgggcgtgggccgcaggaggctagggtacccggcggggggcgcgaggaggccggggaacatcatggtaggcgcgggcgggcgaaataacccttctttcagtggccggagggtaaacgcctcgcttcccgcccctcccgcccccacagtgtcctctctcttgggcttagcaaacgtctccaagtaaca

SEQ ID NO: 33696 - DNA, 69 bp, Homo sapiens
  misc_feature 1..69: note = chr11:20182854-20182923
  misc_feature 1..69: note = hyper
  source 1..69: mol_type = genomic DNA
accttgcgggaggagcggaggagagcggcgctgggctgccgagcggcaggattccgcttgcaaagagct

SEQ ID NO: 33697 - DNA, 30 bp, Homo sapiens; identical to SEQ ID NO: 10743
  misc_feature 1..30: note = chr11:20183391-20183421
  misc_feature 1..30: note = hyper
  source 1..30: mol_type = genomic DNA

SEQ ID NO: 33698 - DNA, 99 bp, Homo sapiens
  misc_feature 1..99: note = chr11:20183674-20183773
  misc_feature 1..99: note = hyper
  source 1..99: mol_type = genomic DNA
gcccagctccagaggcgaattaatgctagaagatgacgtaagtgcggagtttctgagcccaagaccgctcatgctcatgggcagcgggagaaaaccaat

SEQ ID NO: 33699 - DNA, 32 bp, Homo sapiens; identical to SEQ ID NO: 10745
  misc_feature 1..32: note = chr11:20184112-20184144
  misc_feature 1..32: note = hyper
  source 1..32: mol_type = genomic DNA

SEQ ID NO: 33700 - DNA, 987 bp, Homo sapiens
  misc_feature 1..987: note = chr11:20184500-20185487
  misc_feature 1..987: note = hyper
  source 1..987: mol_type = genomic DNA
cctgcttcctggggtcggtctccacagcctcctaaagaattcctaaagcgccaaagaggaaaagtgagggcgggggcgagggggcgagggctggccgcccgtgaaaggaaaaataaatcctaaggaagcaagaaatcggacgaaaggatcttactttaagtgatctccttgaacgcgtcttttcaaactccgcgatagcccaaggagctgcgcggcgcggcggctgcggctaagacctgtgactaatgccatttgacctgagcccatggggttttgtgcgtcctgccattcactgttatgtcgttatcttcaagtttatttcggagaaatcactcgcgttctttgtctcaaggctgagctttctgtctatttctctttcaagagaaaagaagacgggaggggaaaagagagaatcggagtccctggtttggggtttaaggtccttgcctacgctgcgggggaggccgcagcagatccggctggggctccccgggcctaggtggccaaagctgccgaaacctgccttggatagtagaaagagcgtgtcggaacgcactctgggggtttcgttccccccgcgcaggggagagcgagcatgttcctgccccgggcgccgtgcggtcgcagcagcagcgcggccctctccagtgcgagccgtgcctggaatgtctcgggtaagcgaagggccagcaagcgaggcgaaacggacactataaagcagagagtggtgtgagcttccccgccctctgaaaagatggcaagtctccgtttcgggaaggctgcaacgctaaggtcaccctttgcaggcttcggacccccagtcctccatgctccctgccggagcagccaacagagtgagagcgcattttggaaagattggccggatgccgggcggcgacagggaaaagcgcccgacgcctggctttggggtggggggtgtggggagggggggcagggagctaacgggcgaggcgaaggaggagggct

SEQ ID NO: 33701 - DNA, 331 bp, Homo sapiens
  misc_feature 1..331: note = chr11:20229236-20229567
  misc_feature 1..331: note = hyper
  source 1..331: mol_type = genomic DNA
ctaggattacaggcgtgagccccggggccctgccagaaaggaggctttttaccaacaaattttaaaaagaaacaacaaaccaaagaattttgccatggacagtggcaaagtatctgctgtgctgtttctgaccctccataaaaatcatgttcagaaatggtaaaaaggctaacgaagatcaaacaagaagagacagaatcacgggcgaagggggcgcattcagggttttctggacgtcaggaagggaccgcggtggggtgctttagaagtggccggagcccgcacctgcatgcagctcgcgcagaaagcgcctggacgctcccttaggacc

SEQ ID NO: 33702 - DNA, 112 bp, Homo sapiens
  misc_feature 1..112: note = chr11:20230398-20230510
  misc_feature 1..112: note = hyper
  source 1..112: mol_type = genomic DNA
cctagaggccagagccggggtctgcagagacgcaggcactctctgtccccgcgagccccaccactgggttgctgcttttgagccggttgcttcgggccggcagcccttctta

SEQ ID NO: 33703 - DNA, 179 bp, Homo sapiens
  misc_feature 1..179: note = chr11:20618214-20618393
  misc_feature 1..179: note = hyper
  source 1..179: mol_type = genomic DNA
atggatgcggatttacggcctccttggctgcggcgcgctgggcctgattatcactataaacaggcgtccgcggagggcgggggcggaggcccgcgtctagaggacgtgcggctggtcttcttcttcttcttcttctttttttttgtttttgttttttaatactgcggttccatcctctg

SEQ ID NO: 33704 - DNA, 503 bp, Homo sapiens; identical to SEQ ID NO: 953
  misc_feature 1..503: note = chr11:20618422-20618925
  misc_feature 1..503: note = hyper
  source 1..503: mol_type = genomic DNA

SEQ ID NO: 33705 - DNA, 755 bp, Homo sapiens
  misc_feature 1..755: note = chr11:20619219-20619974
  misc_feature 1..755: note = hyper
  source 1..755: mol_type = genomic DNA
cgtcccccaagatgccaagagcctgcggggtgcttctcagcgccagccggaacttgagcaggcacccctgcggaattctcagtcccacccactcagacgaccctcctccagccagagtccaccacagcccaccctaccctcttaaccctcgttcccgacctctccctacgagcgggccccggggagagagcgactgaccctagcgacagcccggcgggaggtggttgggatcttctccagggttcaaaagcgactttctgagccccaatttcctcagctttgcaattggtatagtttctgaaaggccattgctaaatctaaccgagataattcatggatatcccttgcacaatggttgagtattgagatctcaatagacgttagctcaaaactgcaataaaaagcgacctgaaatcctcaaggcgtctcaaaagaaagatctcctcctcctgcccccaccaaaggcaatgcagaccgtgtgtccccagccagctgccctttagaggggctaggcgggaaagccaaccagcggaggcatccaaacactctcgggctctccagaggagcaggagggtgccccttagtgcccccggcgcccgccgcaatctgccactgcagcctacgcctgcggccgcggccgccgcggcattgtcctcccgccgcgtgggacggcccagccgctggcgacggcgcgcaccccgaggcagtgggctgggctgttggcagtagggaagggaaaacgtgctgtctgtggc

SEQ ID NO: 33706 - DNA, 73 bp, Homo sapiens
  misc_feature 1..73: note = chr11:20621580-20621653
  misc_feature 1..73: note = hyper
  source 1..73: mol_type = genomic DNA
aggagttctattctgcgtgtttgtgaaagggggttagacgagaggagtgcggtggaggcgaagataataggat

SEQ ID NO: 33707 - DNA, 157 bp, Homo sapiens
  misc_feature 1..157: note = chr11:20622578-20622735
  misc_feature 1..157: note = hyper
  source 1..157: mol_type = genomic DNA
tctggacctgagttgcgaacgtctccatatctagatacaggtattttaaaagctgttgtgactttgttttgcacgaacttgacattgtgtttgcaggattgcagtgctcccaaggaaatgaataaactgccagccaacagcccggaggcggcggcgg

SEQ ID NO: 33708 - DNA, 139 bp, Homo sapiens
  misc_feature 1..139: note = chr11:20623258-20623397
  misc_feature 1..139: note = hyper
  source 1..139: mol_type = genomic DNA
cgcgagagaggccagccgggccgtggcgggtgcacgtatgctgatggggaaaccggttggcagtgccaggtgatggatgcgggaggcggctttggggcttcggaagctcgcactgcgctggggtcggcagttcagggcg

SEQ ID NO: 33709 - DNA, 30 bp, Homo sapiens
  misc_feature 1..30: note = chr11:20623598-20623628
  misc_feature 1..30: note = hyper
  source 1..30: mol_type = genomic DNA
ttcagaacaaagccacgtggtggtggctgg

SEQ ID NO: 33710 - DNA, 490 bp, Homo sapiens
  misc_feature 1..490: note = chr11:20690388-20690878
  misc_feature 1..490: note = hyper
  source 1..490: mol_type = genomic DNA
accccaaccacagctcgctccgcctcgaggaccccttttctgcacccccacctcagcgccctcttcctgcacccacaaagagagtactcagtcataggggttcaacaggagagaggagacagaaggtacaggcggtgagcagggactcagccatcatccccctcaggtccctccccacccagttgacagagcgaatcccgagtaattgttttccgagggggtccgtgcgcgctcggtggcgccgcctcggtctgggttcccccgaggaaaaatacccacccgcgagggctcggcggcttttcgactcggcggggatgaactgtggcaacttcggcagcccccaccgcggtgcggaagtaaagagggcaacattggcgactgcggctcggaggggctggagcgcgtgaagccgtgggggcgccgtgcgcctcccgctctctcgtttcggccgcaggtcctgggactccgacttcggtgctccgggtgatag

SEQ ID NO: 33711 - DNA, 104 bp, Homo sapiens
  misc_feature 1..104: note = chr11:20690982-20691086
  misc_feature 1..104: note = hyper
  source 1..104: mol_type = genomic DNA
cgcgctcctgcccgggctcccagacgaacgcagccgcagcggggggccgggccccgagccccacgccgccgccgccgcgccagcggtggggggcgggctggggg

SEQ ID NO: 33712 - DNA, 40 bp, Homo sapiens; identical to SEQ ID NO: 956
  misc_feature 1..40: note = chr11:20691121-20691161
  misc_feature 1..40: note = hyper
  source 1..40: mol_type = genomic DNA

SEQ ID NO: 33713 - DNA, 218 bp, Homo sapiens; identical to SEQ ID NO: 957
  misc_feature 1..218: note = chr11:20691162-20691380
  misc_feature 1..218: note = hyper
  source 1..218: mol_type = genomic DNA

SEQ ID NO: 33714 - DNA, 185 bp, Homo sapiens; identical to SEQ ID NO: 958
  misc_feature 1..185: note = chr11:20691431-20691616
  misc_feature 1..185: note = hyper
  source 1..185: mol_type = genomic DNA

SEQ ID NO: 33715 - DNA, 111 bp, Homo sapiens
  misc_feature 1..111: note = chr11:20691747-20691858
  misc_feature 1..111: note = hyper
  source 1..111: mol_type = genomic DNA
cgcagagggagcgcttccggctggcgggcgcggccggggcccgggagggcgcggtgcggcgagggcagagagctgcgggagaaccctgggatcccgcgatctcctcctgtg

SEQ ID NO: 33716 - DNA, 490 bp, Homo sapiens
  misc_feature 1..490: note = chr11:20692076-20692566
  misc_feature 1..490: note = hyper
  source 1..490: mol_type = genomic DNA
ttctgcctccggagacgcagttgtgaggactctcagcgcatcttcttccttctgcttccaccggctcccttgcccaaaagtcccctggggttcggagactggcttgcagccgccttcttcaaagagctagtagtagatgcggggagactggggtgaggtgaggtggggtgagatgtaggaaattggcaaaaatagggcctgtcaactggggggagtgtcggaggtttgcaatcctacccagccatcctccgtacgcgctgcaccccagaatctgtgtggtcattccctttccctttattctcccccctttaccatccttatttccttctttagaggcgtggccttctctctaggccaaagagcaagttcatctggagagggctaagaaggggcgtctgcacttggttggctcaaaagttccctccgcttgcgcccaggcgcccctctttggcagttagcccgctggaagatctagcgtctaggagctttc

SEQ ID NO: 33717 - DNA, 182 bp, Homo sapiens
  misc_feature 1..182: note = chr11:20692775-20692957
  misc_feature 1..182: note = hyper
  source 1..182: mol_type = genomic DNA
tttaaaaccaggacacgctgaaggagtgcgcgcaccccaggaagatcaggacaggcaagactagtgcagagcgtgggctactggctctgagcgcgagagtctggtgctcgtggacatcttacagaggaaccgcagacaggaagaagctaggtagggagggggcaacccgttagtgagttcac

SEQ ID NO: 33718 - DNA, 973 bp, Homo sapiens
  misc_feature 1..973: note = chr11:22214360-22215333
  misc_feature 1..973: note = hyper
  source 1..973: mol_type = genomic DNA
gccggccaacagggccggggggcggcgggtcccgaggagggacgggaggctgcatgtccggaggaggtgcgggaggcggcagagcagggacctggggacggcttgagcggagaggagggggccagcgtggagccagccgggccggggggcggggagatggcggtctccgagggtggggcgccggccggtcttgcggtctggaggcggggaaagaggcgtggaaacagggacgcagcgaaggggaaaggaaagctgccagagggcaggagtggaaaggatcctggcgagcaccgggaggagtggcggctgcgggatcagctgccgagcaggcacagggacaggtgcctggagaagtactgggagagcgcccaggagcgctaccggctgagggtggggaagcgcagggccaagcgcgcgaagcaggttgtgggggaccgggtcgagtggaagtacccgccggagaggaaggccggctggctgtggcgcccagagacggtggagtccgaggaggaggagaaggaggcctgcagaaggaagagcaggcccttagaagtccagcagcagcaactccggcggcccacagtcagattcagcacctgcctcagatctccacgtctgtctcagctgcccctctcctgctgcctctcaggcaccagtgccattaacgagctggcgaagatgggcgacccggatctcctggaagtgttggcggaggaaggtaggaccgcgccaagaggcgtcaagggagagccaggctggctgcctgcacccctccacccgcggcgcagaggccccgggggacgttggcggccctgcggcctgagtcctagggaggttcgctgcgtggcgtgctcagcgcgaaaccgggactgcggggcagagtcccccgcctggggtgagtggggttggtttcggcgccccacagatttctctgctgctcctgcgcgccagggacctgcgacctgtgacccct

SEQ ID NO: 33719 - DNA, 15 bp, Homo sapiens
  misc_feature 1..15: note = chr11:22359403-22359418
  misc_feature 1..15: note = hyper
  source 1..15: mol_type = genomic DNA
tcttttatttactca

SEQ ID NO: 33720 - DNA, 136 bp, Homo sapiens
  misc_feature 1..136: note = chr11:22359746-22359882
  misc_feature 1..136: note = hyper
  source 1..136: mol_type = genomic DNA
ggaaaaggactcaaccgcatctacccaaataccgtggcactgcttgcgctctttgccaccggatcctccccttccaatgagactttctgattgtgtctaccaactctcctattaggaaacccgtgggttgcatgca

SEQ ID NO: 33721 - DNA, 599 bp, Homo sapiens
  misc_feature 1..599: note = chr11:22362533-22363132
  misc_feature 1..599: note = hyper
  source 1..599: mol_type = genomic DNA
tcaacttgctagaaacggaaaaggcagcgcgggtgggaaaggctctctagttgggcccgcctgcagcggagcagctctctggtgctgtgttgcaggaggacaccgcggtagtcagggtaaagccctgctgggcgcgtgtaggagtgggaggcgcctactcaggtgcagaggaggcgctggtaacccctgccctcacaaaatgcagaccctgcagatcctgcaagaaagttaggcccaagcggcctgtgtatctcaatcagagcgcccaggggtggatcccgagatggggactcgctaccttaggcctaaaggtgttaaagttgaagagacgccgccgccgcggccaagggcacctgcagaatgtgagagagcctgggaggtcttgcagcttggtgtcaccccaccaccctaatccccgagggtggggggaggtcgacggccctcctcccaaccccgacgggtcctgaaaaatgggaatgggtcagcatcgggggtacctaagccgccaagtccttgactcgcccctgctctgccgcgcagggtgctggagaagaagcaagacaccggggagacaatcgagctgacggaggatgggaagc

SEQ ID NO: 33722 - DNA, 726 bp, Homo sapiens
  misc_feature 1..726: note = chr11:22364821-22365547
  misc_feature 1..726: note = hyper
  source 1..726: mol_type = genomic DNA
cgtggggatgatccacggttccttcttttggggctacatcatcactcagattccgggaggctacatcgcgtctcggctggcagccaacaggtaatgcgccaggcgggactggggctcggggcgtggtgtttgtttcctccgaaggggcagcagaagctggagcagagacaacagcccagaggggtttgaggactcccgggcgaagtcttctagtcccttgacacaccctctcagggctggagctgctggtgactccttcctgaattagtcgcctaaacgaatgtaggctctctgggaccagcgcacgcggcctccttccctctgctgtggctgaacttgcttttggcgaaataatcgacgtgctgtatggcctgacaggagctgagggcagaccgggagcaggcagagcagggacagtgcgcctgagtgcacaaaggggtgtagaacggcagatgctgcgctctctcctgcactccccgcaggctcccaggctccccgagggtctgacctcctggcaaggcgcctcgaagacctggccccgtcccccgcccagttggtgctctgggtatgaagtatttgtttctaggggggcaggcaccagcgatgcgatttcacctgttaatgagctgcgtaggggcgggcgttgggggagccctcagctgctttcagtggcctcctgccttgctgcggtgtccacaaccaaggtcctagcgccagttcccagaa

SEQ ID NO: 33723 - DNA, 408 bp, Homo sapiens
  misc_feature 1..408: note = chr11:22688123-22688531
  misc_feature 1..408: note = hyper
  source 1..408: mol_type = genomic DNA
tgtcaactgcatttgcgtccaccaaaaaaagtaagcattttacttccgctcggtctatgaggactgatgaaatgtaggaaatctgtttctggcagggagaaaaaatcgttttcccaaacagcactaaaaggagccatcagagaagtatgaagaggggtagtgcggctgtagctgctgccgctgccgccaggctggtggggtgcggggagcggctgctgcaggacctgtgcctggagggggccggccccgagaagctgcaggagcccagcccggagcccaagcgcctctgagagccgccagcagcccagctcgggacgcgggggtgagcacgactggctggcccagttctgcgccaacgccgccgcagcgtgcgcgcaccgcagccggggctcacgggagcccctgcct

SEQ ID NO: 33724 - DNA, 30 bp, Homo sapiens
  misc_feature 1..30: note = chr11:24518383-24518413
  misc_feature 1..30: note = hyper
  source 1..30: mol_type = genomic DNA
catcctggggagcagcgggaataaatgatc

SEQ ID NO: 33725 - DNA, 30 bp, Homo sapiens
  misc_feature 1..30: note = chr11:26353691-26353721
  misc_feature 1..30: note = hyper
  source 1..30: mol_type = genomic DNA
ggctacagcaggtgtcggattgcagtgcgc

SEQ ID NO: 33726 - DNA, 30 bp, Homo sapiens
  misc_feature 1..30: note = chr11:27720990-27721020
  misc_feature 1..30: note = hyper
  source 1..30: mol_type = genomic DNA
atcccaaccactccccgaaagtcaaaactc

SEQ ID NO: 33727 - DNA, 15 bp, Homo sapiens
  misc_feature 1..15: note = chr11:27740193-27740208
  misc_feature 1..15: note = hyper
  source 1..15: mol_type = genomic DNA
gctgcaggcttgctc

SEQ ID NO: 33728 - DNA, 53 bp, Homo sapiens
  misc_feature 1..53: note = chr11:27740933-27740986
  misc_feature 1..53: note = hyper
  source 1..53: mol_type = genomic DNA
tccaccgcctccagccgcccaggccccctcgcccggcccgctctctggctctt

SEQ ID NO: 33729 - DNA, 97 bp, Homo sapiens
  misc_feature 1..97: note = chr11:27743048-27743145
  misc_feature 1..97: note = hyper
  source 1..97: mol_type = genomic DNA
atcatgtgagaagttcggctttgctcagtggatcgcccaccacttggtgtgacttatgaatctaataaccctttgcaatatccgcaagcttaaactc

SEQ ID NO: 33730 - DNA, 274 bp, Homo sapiens
  misc_feature 1..274: note = chr11:27743419-27743693
  misc_feature 1..274: note = hyper
  source 1..274: mol_type = genomic DNA
actcagcctgcacaccgctcccttgcccactacgcaggtcacacctggggctccggcgaagctgaattcggctcgggagatttccctgtcgccaggtaagaaaaccttcgccttgtcaggctagggcgggaagaccgctggggaacttgttgcttatcagcgccggcagactaccgctttaataataataccagaaaagcgcagcagggagggggtggggggcggcaacggcgacgactaacctcgctgtttacgtgaccgactcactgtgact

SEQ ID NO: 33731 - DNA, 660 bp, Homo sapiens
  misc_feature 1..660: note = chr11:27743897-27744557
  misc_feature 1..660: note = hyper
  source 1..660: mol_type = genomic DNA
gtactgatgactaggcgagaggcaccaaggcgagccactagttgcccacaggaacctgtgtaagccgagctctcgagcggctgagttgaatgaagttatgactgcgtttgctctaatgggttatggcttcccaaatgtgagttaacagccccggtgcgcagctaggtcggaaggcgagccgcggagagcggagccgcgggccaaggcagggacgggaggggaggcggcaggttgggcgctccgctgctgctcggtgctgcttccccggagccgcttcctcatcctgcgggggctgccccgccgccggggtgccggggtgagcgcggcgggagccagggctggggtggcgaacctcggagggggctctcccaggaagccctgcggttagcgcccgcgcttccccaccagtggctgcgcaagctgggaagcgaagaggtcacgtgttggcggaaagtaacttggaggcgaaaggatgaactttgagaagaggaaaaaaagcacaatgaaacaaactacccccttggagtgtctaatagagggggaggcgggagggggggcggaggggcgccgctctccgcgggagatgtggggacgactccggaaatctcgggaaataggcaataactcgagctttggcaacgtcccccagcctagggaggc

SEQ ID NO: 33732 - DNA, 186 bp, Homo sapiens
  misc_feature 1..186: note = chr11:27744558-27744744
  misc_feature 1..186: note = hyper
  source 1..186: mol_type = genomic DNA
ctaacgcaaggtatctttccactgaagctgccctttgcctaccctcagccatcgctagcacagcagagcagaagaaccagggatgaatgtagaccagttgttatggagatgtccgtcgctctgaggagcgctagtgccctgggaagtccccagacgcatttcaggtttcgtcgttttggcactgac

SEQ ID NO: 33733 - DNA, 46 bp, Homo sapiens
  misc_feature 1..46: note = chr11:30037706-30037752
  misc_feature 1..46: note = hyper
  source 1..46: mol_type = genomic DNA
gcagcaattcagacccgttcaccggctgttcccaaaagaagggaac

SEQ ID NO: 33734 - DNA, 836 bp, Homo sapiens
  misc_feature 1..836: note = chr11:30038294-30039130
  misc_feature 1..836: note = hyper
  source 1..836: mol_type = genomic DNA
ttctgttgcctggcccgaggggtgcacagagtcctcgcggctggagcctgggggtgggggttggggctgccccagagaagaccccaagactcctggttcctctggagttcagcacaggagggattgcctgggaaaggaagtcaaggttcccccgaaaagaaacaaaatcctagacagcagcgatcacttgttaagcccgaattcctcctccaacatccatccctctctcgctctcgctggctgcgggagcagcacacgcctcccctggccgcgaacgcgctctgggcgggggcggggccagggccgaaccgagggtgtggcgttcgcgacggtcgccaggggcgcctcccggcgcggcggggcgggtgcagtcacgacgccgcgactccccgcaccccggctgggccccccgactcccaggatctgggatcgattccaggagtctttggctgtggtccccacaggcgaggagcaaatcctggagaagtgtccccgttggggccggaataggggtttcgacggcagcgcgggagtccccagagggcttgggagcggggagctccaatgggaggtgcagtcccgaaaatggggtcctctgggacatctcctctacctaacttgctttctctatatctcccctcgagccccgagccccgtcttcttttccccaccccatcccctcccaaagcgggtttgttgggttgggagccgggtgcatctccggcgaggccacgggcggggagccctcctgtgcctgccagagcgcccagatccctcagtctccgtctcctttgcacacaggagttgggaggcttcagcgccggggttgggcctca

SEQ ID NO: 33735 - DNA, 106 bp, Homo sapiens
  misc_feature 1..106: note = chr11:30040131-30040237
  misc_feature 1..106: note = hyper
  source 1..106: mol_type = genomic DNA
ataaccagaagcccacgtggcgacggggtctccctagacacctctcccagctcgcccgatggaccaagcaggcagtggcagcgctatgccccggactgctggagca

SEQ ID NO: 33736 - DNA, 41 bp, Homo sapiens
  misc_feature 1..41: note = chr11:30605841-30605882
  misc_feature 1..41: note = hyper
  source 1..41: mol_type = genomic DNA
ggtggtgggcagttgcgcgaggcggggtggggggtgcttta

SEQ ID NO: 33737 - DNA, 84 bp, Homo sapiens
  misc_feature 1..84: note = chr11:30605942-30606026
  misc_feature 1..84: note = hyper
  source 1..84: mol_type = genomic DNA
ccttctaggctcacggctggctcttcccggctacaacttccccttccttcctgaaacaccagcgccttactcgctcagtccccc

SEQ ID NO: 33738 - DNA, 76 bp, Homo sapiens
  misc_feature 1..76: note = chr11:30606027-30606103
  misc_feature 1..76: note = hyper
  source 1..76: mol_type = genomic DNA
ttgccacctccgtcacctcctcggccgccgctcctgctggcactgctggcgctagcgctggcggccccgggctccg

SEQ ID NO: 33739 - DNA, 62 bp, Homo sapiens
  misc_feature 1..62: note = chr11:30606323-30606385
  misc_feature 1..62: note = hyper
  source 1..62: mol_type = genomic DNA
gttccttccctggaacggcggagaaaggaagggagggagccagcgagcgttggaagggggtg

SEQ ID NO: 33740 - DNA, 57 bp, Homo sapiens
  misc_feature 1..57: note = chr11:30606698-30606755
  misc_feature 1..57: note = hyper
  source 1..57: mol_type = genomic DNA
gataaccttgttatacgtaaatagcaaagaaactcctgcctctgtagagaagaaatc

SEQ ID NO: 33741 - DNA, 311 bp, Homo sapiens
  misc_feature 1..311: note = chr11:30606795-30607106
  misc_feature 1..311: note = hyper
  source 1..311: mol_type = genomic DNA
cgcctagcctcgaccccagcttgggtcgccgggtcgctccgcaggctgcgagcgcggagacccaggcagcggcggagagtgaggttggggcgcggggacggggtgagaaagagccccgagcgagagcggcgcgcgcgggcggccccgggggcggccgcggggcgcagccggagcacaaagctgcgcggtgccttcccctcgtcactgcacctggcctcgggccgccgcgggagcccggggatcgggccaacacaatgcacccaggcctaggccggggcggctcgaacacatcaccccgggactttctagta

SEQ ID NO: 33742 - DNA, 434 bp, Homo sapiens
  misc_feature 1..434: note = chr11:30607316-30607750
  misc_feature 1..434: note = hyper
  source 1..434: mol_type = genomic DNA
aaaagaatttgctttcgctcaggggttgaaaatcagccctccccgagcgccgaattgcccgggaggcgcccgctcgtgcggatgtcaggggcaccggggcagcccgggtccgcagcctccgagcccctcgcacgcgcctctgacaaggcacctctcacccgggctccgctttgtgtgtgcatttttttcccttcctctagtgctcggcaccgggctcccggccgcctcctccccctcccccgccctccgcctcccttcccggggcggattacctttcccgggctgcgctccggatcccggggatgccttcagcgcccggcgagcaggcgatccatagccgagcggcccgagccggctggaggagcgctgggggcgcgcgggggcggcgaggggcgcgagcgggccagaaccttcgaccccggaggtcccgccgc

SEQ ID NO: 33743 - DNA, 55 bp, Homo sapiens; identical to SEQ ID NO: 10785
  misc_feature 1..55: note = chr11:31818458-31818513
  misc_feature 1..55: note = hyper
  source 1..55: mol_type = genomic DNA

SEQ ID NO: 33744 - DNA, 26 bp, Homo sapiens
  misc_feature 1..26: note = chr11:31818570-31818596
  misc_feature 1..26: note = hyper
  source 1..26: mol_type = genomic DNA
cgctttattttcgggtttggtgaaga

SEQ ID NO: 33745 - DNA, 1042 bp, Homo sapiens; identical to SEQ ID NO: 961
  misc_feature 1..1042: note = chr11:31819319-31820361
  misc_feature 1..1042: note = hyper
  source 1..1042: mol_type = genomic DNA

SEQ ID NO: 33746 - DNA, 928 bp, Homo sapiens
  misc_feature 1..928: note = chr11:31820460-31821388
  misc_feature 1..928: note = hyper
  source 1..928: mol_type = genomic DNA
cgccccaagctcatgggagcccacgcaccggggagagcccggagtggaggctctgggctcagccctcccaggcctaggccaccgtgccctgagtccctccccaagacttctcggactaagtgggccagactcttgtcaggggagggatcaccaggacctcagattgctgggggcggaggggtggacgctcgtgagtgcgaagttcgggtgtcacttgggtgtgtccagtgtctacaagtgggaatcctacggtttcaaaagtcaggcagggatggggttgcctacactcggtggggtcaatcgctagtctcaccagaggcgggagcgggcctgggggccctctgagctcgcggaggcggcgggttcggggcccgtgcgggcggggtcgcccaggggagcccgggccccgcgcgtcaggaggcctccgccggccgagcggccgcgctgggaaacaagaagcgagcgctttgctccctatcttcccagtgtccgtcctatattgttttctgctcttaaaactgacatgtctaattggcaattggtgccgaatcgtgtccagaggtctcttgtggaacatttctacagctgtctccttcaactagacgcttattcatgtcgccttaatgagaaacaaaacgttctctaatgagcaattacagagcgacaggattgttcccataacaaattcttgcgagtgacagaagcatcctttgtaccagatatttcgcatactgttaccgattttcccttccctcgcccgactccatggaggcgccgggcatccggagccggtccgagagctcacggatgcgccggcagcctcctcgcagtcccgcgcgccgcccctggccccgagcccctcggctccgttgtgctcctgggagtgagacgccacgtcccattatcccgcatattatctccttgtcac

SEQ ID NO: 33747 - DNA, 389 bp, Homo sapiens
  misc_feature 1..389: note = chr11:31821389-31821778
  misc_feature 1..389: note = hyper
  source 1..389: mol_type = genomic DNA
aggacaacaaataccgattaatcttcggagtaaactgtttcctattcttgaccaagctacctcggggtgtggaggggagcggaggggagccaactgaccctcccctccgccccaccccccccatcccccgctcttcttcctccagcccttctcacagaacctggggtgtttcaggtcccatctctcctcccagaccagagcggctcccggcatcccgccgtcctgctcacagtatcttcacctcaccacttccacatagtcgccacccacagagagtgagaaagtgggacccagaggggcgaacgggggaggggcaaggatagtggggtggttttagttgggagaccaccacttccaatgccccatccccgactcgccctgcatctccc

SEQ ID NO: 33748 - DNA, 107 bp, Homo sapiens
  misc_feature 1..107: note = chr11:31822002-31822109
  misc_feature 1..107: note = hyper
  source 1..107: mol_type = genomic DNA
cagccaccttcataccgctcctgacatacacaaccctcacattcccaggccaacaaaatggttcaacaaacaccacctacatacaatgtggtcgatgtgtcccaggc

SEQ ID NO: 33749 - DNA, 345 bp, Homo sapiens
  misc_feature 1..345: note = chr11:31822363-31822708
  misc_feature 1..345: note = hyper
  source 1..345: mol_type = genomic DNA
tcgctagccaggttgcgaagaactctgtttattgatgacacctgcaaatcaaaccaaaatcaaaccaaatggtagtgtctcctgaagacacagtcacccatctcagctcacccacaaccttaaaaagcaactctcaacccgttaaaaagctcccagccaccccgggacagtgggtggatttgcagatacaccgtggaaaaaatgatagctatcactttgggcatggaaatttagttggatagagaattgggcggagggggtccttcaccattgcttggtgtctctggtgacctaactcacacggttgctttgctttgttaaaagactgcccgaaaataaaaacta

SEQ ID NO: 33750 - DNA, 40 bp, Homo sapiens
  misc_feature 1..40: note = chr11:31823165-31823205
  misc_feature 1..40: note = hyper
  source 1..40: mol_type = genomic DNA
ccaagcaaagatggacgggcactcccgcttatactgggct

SEQ ID NO: 33751 - DNA, 810 bp, Homo sapiens
  misc_feature 1..810: note = chr11:31824154-31824964
  misc_feature 1..810: note = hyper
  source 1..810: mol_type = genomic DNA
gtccataattagcatcgtttacagtaagaaatgaagagagggcgttgagagtggagggccgcgggggcggcgagtggggcggcgccgggaggatcacctgcagaattcgggaaatgtcgcacggccgggccccgctgtgagctagctctacaatcttctgccgggtggagtccggcagtggccgcccgttgacaaagacaccaccgagctgattcactccgctgtgacctgaggaaagggagaggagaggaaaggggaaaagaagagaagagagcagagtgaagaggaagaagagggagaagaaggaagaggaagatgagggagaacaagaacagaaaggagaggaggaaggggaagaggaagaaggagaggaggaggagacaaccacaatgcatcctcatccccctgccaacctgtgccaacctcggcggtcagttccctgctatcgatcaaataaaggacaacaggaccaccagccatgccagacatcgggcagcccagtccaagcaaccgtgcccctgcccactgtactgcagcagcaacacagagtcagacacatgccaaggaacaagtacacatggacctcactacagccataaccccagcagtgtccccagcccactgcccctcttcataaacactgcagccagcctctgaacccacaaagcgctaagaaccggctctataaatctcccaaagatcccctctgagtgtcaccgcaaaccatgggttctacagatcccacactgaaccttcaaggtctctgcagtgttgggacagtgatagcaaaccttacagcccttgagtgct

SEQ ID NO: 33752 - DNA, 29 bp, Homo sapiens
  misc_feature 1..29: note = chr11:31826042-31826071
  misc_feature 1..29: note = hyper
  source 1..29: mol_type = genomic DNA
acaggcgtttgggggatctgggctccggc

SEQ ID NO: 33753 - DNA, 198 bp, Homo sapiens; identical to SEQ ID NO: 964
  misc_feature 1..198: note = chr11:31826106-31826304
  misc_feature 1..198: note = hyper
  source 1..198: mol_type = genomic DNA

SEQ ID NO: 33754 - DNA, 325 bp, Homo sapiens; identical to SEQ ID NO: 965
  misc_feature 1..325: note = chr11:31826408-31826733
  misc_feature 1..325: note = hyper
  source 1..325: mol_type = genomic DNA

SEQ ID NO: 33755 - DNA, 407 bp, Homo sapiens
  misc_feature 1..407: note = chr11:31827113-31827520
  misc_feature 1..407: note = hyper
  source 1..407: mol_type = genomic DNA
gggcctggtttcgctgggcctccaggctcccaggtcggagctctagactagccctgccgcgtaccagcacccaccacgaacaggaaggtgggtgggaccccacggggtctgggcagaggaaagcagggaggtacaagggccataagtatcaaaagcgctctgggcctgggactatcaggacccaagcaattgcagttgccagggcagggattttccaattcctgggcacctccttaccagacccagtaaaccgtgctctctcccgcgccctgtaacagcgagtttaccacccctaccctgctgcaggcctgggggctcctctccccatcccttctaggcccgtagtggggtgaggaggggaggagctgccctgagagtgacttggggagagaagcccccaaccccgc

SEQ ID NO: 33756 - DNA, 457 bp, Homo sapiens; identical to SEQ ID NO: 967
  misc_feature 1..457: note = chr11:31827597-31828054
  misc_feature 1..457: note = hyper
  source 1..457: mol_type = genomic DNA

SEQ ID NO: 33757 - DNA, 329 bp, Homo sapiens; identical to SEQ ID NO: 10798
  misc_feature 1..329: note = chr11:31829116-31829445
  misc_feature 1..329: note = hyper
  source 1..329: mol_type = genomic DNA

SEQ ID NO: 33758 - DNA, 80 bp, Homo sapiens
  misc_feature 1..80: note = chr11:31830319-31830399
  misc_feature 1..80: note = hyper
  source 1..80: mol_type = genomic DNA
aattacttaagtaaacgtgaacactaagtgcagaagcaacccgggaagtggggcacatcgacacccggaagcagtcctgt

SEQ ID NO: 33759 - DNA, 278 bp, Homo sapiens
  misc_feature 1..278: note = chr11:31831502-31831780
  misc_feature 1..278: note = hyper
  source 1..278: mol_type = genomic DNA
aagggagatgagagtcgggggaagcctggggagcagagagttttcaagttccgagctcagcgctccagtggagttgggggcaagagcccgggggctgggtggaagctgacagtcctcccgctcggctctgagctccctcggagcgcgcgttccaccgccttggcctggtggcttccttcccggctcgcgctagctcgctcttccctctacctccagcgtgcggctgccttgccgactgactccactcgggctggtggcgggcgcggtgcccccctcgg

SEQ ID NO: 33760 - DNA, 138 bp, Homo sapiens
  misc_feature 1..138: note = chr11:31832001-31832139
  misc_feature 1..138: note = hyper
  source 1..138: mol_type = genomic DNA
ctcttcgtcttttcccgcgggtcgggagcattgggcgacgctggggctaggagccgcggctgctgtcgcgcctggagtctcccttcttcccgcgagctcagcccgcgctggcgctggcgctggcgctggggctgagct

SEQ ID NO: 33761 - DNA, 50 bp, Homo sapiens; identical to SEQ ID NO: 10801
  misc_feature 1..50: note = chr11:31832795-31832845
  misc_feature 1..50: note = hyper
  source 1..50: mol_type = genomic DNA

SEQ ID NO: 33762 - DNA, 49 bp, Homo sapiens; identical to SEQ ID NO: 10802
  misc_feature 1..49: note = chr11:31833553-31833602
  misc_feature 1..49: note = hyper
  source 1..49: mol_type = genomic DNA

SEQ ID NO: 33763 - DNA, 149 bp, Homo sapiens; identical to SEQ ID NO: 10803
  misc_feature 1..149: note = chr11:31834086-31834235
  misc_feature 1..149: note = hyper
  source 1..149: mol_type = genomic DNA

SEQ ID NO: 33764 - DNA, 293 bp, Homo sapiens
  misc_feature 1..293: note = chr11:31834502-31834795
  misc_feature 1..293: note = hyper
  source 1..293: mol_type = genomic DNA
tgggcctcaccctctcgttcctgcctgggacccagcagccctgcgaccaaggagcccgggcagggctcccgggaagcaaaggcctccccggccctagccagaggtggggtcgcataaccctctcccctccccgggctggggagggctgccggctctaacccttccccgggagctcgcagcgccgggaggaaacctgggtcagaggtgaaggaggtggcgccgggtgtccaggtccgcggcctcctgggcgaggtttcatttcgcaggagcgcgactttcggaggatgccggca

SEQ ID NO: 33765 - DNA, 162 bp, Homo sapiens
  misc_feature 1..162: note = chr11:31835180-31835342
  misc_feature 1..162: note = hyper
  source 1..162: mol_type = genomic DNA
agtgaatgccactgacgtcattgggtggggaagggggctccgggaaagactcctggaaactcctccgcacaaacaaaaaacaaaaaggacttggctgcttcccatgtgtcaatatttggggaggggagttcaaccccagaatgaggccgagttttcaaagtt

SEQ ID NO: 33766 - DNA, 942 bp, Homo sapiens
  misc_feature 1..942: note = chr11:31835591-31836533
  misc_feature 1..942: note = hyper
  source 1..942: mol_type = genomic DNA
tgctgccctccaagacgcgggggggcggcggggattgcgctttaggttctgtctcctttccccgcctccccacaggcccctgttcccccctaccctccgccccctgtggccagagggaggacctctcaggccggcgggtgcgttcccgcgggggccgccggggtcgtcccacccggtagcggggctgtctgcgtggagggagtcccgctgggggaccgtggctcgccagagcctgcccagagcttctagccagtattgatgcgtcaacatgaggtgaggcaagcatctcacccgcaccgatccctggcattcccctgtgcccaccccatcaggccttcggggaggcaaagaagtgcccacttctggggggaagtgcctccagctcccagcttcagaaccaagagcctcccatccggagttctgacagttctgacacctccaaactctctctttccccggtcaagcagaggcgcagcgccggcgcgctggaaagggtgaagactggcattttttggagaaggaaagtcttggcagacacctgcgtcactttgtagtgccccaaacgtctctctttttgcagaccctgggaaggtgggatcccttgtccgcggagctggcaaacgggtccagtgagccctaaaggcaaaggctcccatcccggccgcccagtccctggtgcctcccccacttccaggcctttgtccctctcctttctccagcaacctgccggttcccgctaacccggcagcctcgccgagcccagagcctagaaaagccaagaagatcccagagccgccccgtggcaccttcaggctgtggccactgctcggcttggggggaagccgcggtgccctcgcccttcctcgcctcctgccaaatggccagtgctaggggctccctgggttcagtcctcagtcctcttccgttcgctctgggaggcca

SEQ ID NO: 33767 - DNA, 30 bp, Homo sapiens
  misc_feature 1..30: note = chr11:31836824-31836854
  misc_feature 1..30: note = hyper
  source 1..30: mol_type = genomic DNA
ttcatcaccctgtgacgatccccccatctc

SEQ ID NO: 33768 - DNA, 159 bp, Homo sapiens; identical to SEQ ID NO: 969
  misc_feature 1..159: note = chr11:31837354-31837513
  misc_feature 1..159: note = hyper
  source 1..159: mol_type = genomic DNA

SEQ ID NO: 33769 - DNA, 823 bp, Homo sapiens
  misc_feature 1..823: note = chr11:31837541-31838364
  misc_feature 1..823: note = hyper
  source 1..823: mol_type = genomic DNA
cgagaggaaagggaatgaaaaatgaagcaacaaatgacaccacccaggctggcagccctcgttcccggccagaccccgctcctcaggcccggctctggcgccgggtggcgtccagcccctgcacgcgcggcgcggcccgcgggaaagtttgtgcagcgagagtgactgtccttccgcctcgcgcgcgctgcccccttctgccccggaggggcgttgggttcccttcggttttcctttccaattctaaaataaataaataaactccgggccctggggaaatctgaatagtaattccagtcatccaaattctatgagagggtctgaggaaaaaaagacaagcctatcacgggcgccctccgatcacgaagggcacgggcatgagaaggcgacagaggaggtcctcggctcgccctgggcgcggagcgaggactctggtcagaggtaattatgtcaccgcgttttctcgccgtgacagccgaataaacacgatctccaataaacatctctaatgagggaggaggcccgaggatggctgggtttgatttatgactggaggagaaggtccacttcccactgcgaagcaggcgacctgctcgccgcccagctccagggagaggaacccgcggaggagaggatcccggcccaggtaaggcgtgcggccggactgccactgcgctcgtcccccgtttccaggtgaggtgagcagggggcgccaccgctcggagtcgggcggaggtcccaacacctgtcacaggtgactgagctccgaaggtgctcccagaagacctagaaagggggcgcaggagcgcgagtgggagtgggg

SEQ ID NO: 33770 - DNA, 1362 bp, Homo sapiens
  misc_feature 1..1362: note = chr11:31838584-31839946
  misc_feature 1..1362: note = hyper
  source 1..1362: mol_type = genomic DNA
ccgcagggtggtgggcgcttctctttcccgggcttggcggcccggctcccatggcgcccgcgcgcttcccgccgaggcagccagcgcagcgcccgcagtaaccggagcccgcgttctagctcagtgagaatcgctaattattaggtcttccgaagtgaagctcaaatcacacgctgggagctttacgcgctgcccagctctgtcggccgcattctttcgtactccgcgtctttctgagaaacgaaccccatctctagactttgttgcggtccagccatctgcactttgcaaccgcgggaaacttctgctgcacctcgcccgacccgcggcagggtgtctttaagcgctccaggcgcgggtacggactttcccaagcgtggatgtcgtgaactgcgatgcagaggaggtctggatgcaaagtgcgtccccacctcctgcatttttcgcggtcgcgagtggctttagcagacagcagcagcagactcccgccccctactcccagctcagggccggactggaagtccactcttaggagtggaacattttgctacttttgcagaagagcacactcggcaaagacaagtccctcctccaccccccttcctatccctccctcagtaactcgcttccatctttgtatgcctccttttaaaagcaaaaatcaagccccggggccacttggggcgggctttgatttggggacagcagtcgctggcagcggagaggccccgcgggccccgagccgggccggggccggagcccgggcggttacctgggagcggagggcggggaggcaggtgagcctggcagcgccggttcccacacttctcaccgccgctcggcaggggaagtggcagatctgacagccgcgttctacgcgaggacctgccccagagtttaaatgtcaatgataagaaaagagggtgctcaggcaggcgctaactttccttaatatccacgccagcgccgtcctcattggctgcccggcccgcgtgacgtcatggcggctagagttgggcacagctctgcgccgactagttttccggccgggcgggagcctgcttctccccacccagggtccggccggctccaacccctgctttggccttccttggcccggcctgtgactgctctagcccggcccggtccagcctgggccgccgtcctgtatggcgtagagtcgatccccaggaaactagtcttgccgagtgcgctcctccgcaccttcgggcactagggccccaagatctctgcccttaggctggccagctacctctctgggtaatcaccctgtcccctcctccgatccccaagggagtcccttcatcggagagacccgaaggccgcgccgggatggagagg

SEQ ID NO: 33771 - DNA, 132 bp, Homo sapiens; identical to SEQ ID NO: 3732
  misc_feature 1..132: note = chr11:31840041-31840173
  misc_feature 1..132: note = hyper
  source 1..132: mol_type = genomic DNA

SEQ ID NO: 33772 - DNA, 315 bp, Homo sapiens; identical to SEQ ID NO: 971
  misc_feature 1..315: note = chr11:31841774-31842089
  misc_feature 1..315: note = hyper
  source 1..315: mol_type = genomic DNA

SEQ ID NO: 33773 - DNA, 102 bp, Homo sapiens
  misc_feature 1..102: note = chr11:31842174-31842276
  misc_feature 1..102: note = hyper
  source 1..102: mol_type = genomic DNA
cgcccagtctgcgtaggctcccaggccagccccggccccagagcttccccatcagccagcagaggctgggtggagagcctggatgggcgtgagaggccttga

SEQ ID NO: 33774 - DNA, 195 bp, Homo sapiens
  misc_feature 1..195: note = chr11:31845092-31845287
  misc_feature 1..195: note = hyper
  source 1..195: mol_type = genomic DNA
ggaagcgagcgtccccgggtctgaggctgctgggtggaaagctggcctaggagggcgagtagggagcaaaatagggcctggtccttgcggggccggggagctagaggccgcaggaagctgggagggccctttccaggcaggcagggcagcctcctggcgcggcccaaggcgcgaggcagccgctggctagggagg

SEQ ID NO: 33775 - DNA, 58 bp, Homo sapiens
  misc_feature 1..58: note = chr11:31845842-31845900
  misc_feature 1..58: note = hyper
  source 1..58: mol_type = genomic DNA
tgcaggtgctaggcacgggaaatggcgtcaggccccagcagaacgcttcacaaagagg

SEQ ID NO: 33776 - DNA, 1140 bp, Homo sapiens
  misc_feature 1..1140: note = chr11:31846162-31847302
  misc_feature 1..1140: note = hyper
  source 1..1140: mol_type = genomic DNA
tcacaaatataatatcggcagctcccggattgcctgcggggttgttcaggccccgggcctgcacagctatgagaagtggggtgcagggtgctatttgcccagcaaaagctcatttcctcccaaatgagtataatgaaaacccgagaggcgatattagtgtaaagatcgggattagtccaaataggagccgcggacttgggcttcaaaggcgacccctactctttttgcccagtctgggggcggagggcgctcgaagggatacttcaaggacaccacatccaacttgtcgcagccccacgttcaggcacaggagggagcgaacattgggcagagggtaatttcaacaaaggacggcaggctccggggatcccggcttttccctgagttctctgggttggaaggagagggtccgggctctgtcggaggagtgggtacagcccagcacatgcttttctgacgcgcagcgctggcctggggagtgggtgcagctgctgcagccagcccccaccccgccccaggctgggaaggacgcagagtataatacgacggcccccttccccaaggggacactagatccagagctccaggcatatttgttgttcaaagttaattatacctgaaagcaaccaaaatgcgcacgccaggcccacggaggccgattgccgaccagcgtagccggcccgcagcgccagagaagccgctcactccggcggagtctctgcaagagaatctgaggctggggaataaaagccgaaactaaatcaggcagcaagagtaacaaaccatctggaaaatggacccacggagccgcaagaatgtactttttttttttatccttgacaacttgtgtcctaaagaaagtgtattgaagataattgaaatgattacaattcattgctgcctgactttgaatatgaacagtcacataatgacatccccgccacacaacaacagtttaatttccattatccgacttcgggatcctagcgccagccgccggggcaacgtggcgctaatgcagaaatcttggctcctgcctgcattattcatttcggggacgtggggatgggataggagtggagagtgggtttcttcccctcccccgaacttattctgaaaatcccggggaccaatggacac

SEQ ID NO: 33777 - DNA, 343 bp, Homo sapiens
  misc_feature 1..343: note = chr11:31847370-31847713
  misc_feature 1..343: note = hyper
  source 1..343: mol_type = genomic DNA
cgctccccggctgtctttttgtcccaggggttcccaggcccgcagggctaggatcccccagctcccaccctagtcagtcccagtcagggaggacctaggccagggcctcctcccaaggctgtcatctggcggggcaaacgctcttctctcattccttcgtctcccttccagccctcgcatcctttccttctttctgcttcagagctctcaggctcgcgtgcagggcgggatgggcccggatcgggggccccttcgcagatttgaaagttgcctcggccttgatcttctcccagcctccctgctggggactcacccccacatcccgctaccccccggggaaaag

SEQ ID NO: 33778 - DNA, 104 bp, Homo sapiens; identical to SEQ ID NO: 3735
  misc_feature 1..104: note = chr11:31847769-31847873
  misc_feature 1..104: note = hyper
  source 1..104: mol_type = genomic DNA

SEQ ID NO: 33779 - DNA, 76 bp, Homo sapiens; identical to SEQ ID NO: 3736
  misc_feature 1..76: note = chr11:31847895-31847971
  misc_feature 1..76: note = hyper
  source 1..76: mol_type = genomic DNA

SEQ ID NO: 33780 - DNA, 280 bp, Homo sapiens
  misc_feature 1..280: note = chr11:31848323-31848603
  misc_feature 1..280: note = hyper
  source 1..280: mol_type = genomic DNA
tggcataactcgaaccggagaagcgaggggagcctgagtgactggggcgcacatgacccccctcctggggcctttgggctcaacccttacttttaacttgttctaacaggaataatggagtagtactactaatgcatggtcagaaggggcttttctgtctagaacgcaggcggcgggagttgcaccgccacagcccgggagaccaaagagtctccactccccgctcccggcgcctcctcgccgaccggagccccgagcccagtgagcccagccggtccca

SEQ ID NO: 33781 - DNA, 353 bp, Homo sapiens; identical to SEQ ID NO: 3738
  misc_feature 1..353: note = chr11:31848722-31849075
  misc_feature 1..353: note = hyper
  source 1..353: mol_type = genomic DNA

SEQ ID NO: 33782 - DNA, 23 bp, Homo sapiens
  misc_feature 1..23: note = chr11:32009104-32009127
  misc_feature 1..23: note = hyper
  source 1..23: mol_type = genomic DNA
ggacagcgccagccccggggtgg

SEQ ID NO: 33783 - skipped

SEQ ID NO: 33784 - DNA, 42 bp, Homo sapiens
  misc_feature 1..42: note = chr11:32354918-32354960
  misc_feature 1..42: note = hyper
  source 1..42: mol_type = genomic DNA
ggacagaaaagctttcgtttgacccaaagctcccccttccgg

SEQ ID NO: 33785 - DNA, 315 bp, Homo sapiens
  misc_feature 1..315: note = chr11:32354999-32355314
  misc_feature 1..315: note = hyper
  source 1..315: mol_type = genomic DNA
cgagcaggcggcttctcctgaccggggagacgcgggaggtttgcaaacagaccttggcctgggctgcgcagggacaaagtgttcaagggcagcaggggaggctgagggagtacacggctgggaacaagggacactgccgcccccagccacgcaggagcggtgtctgcaccactgaaagtcccccggggcccacagctctatccaggcggaagggaagcagccaggccgccgcggatctgaacttgaatcccgggtggaccggacgccccggccggcgctcctgacgcgcggaggagctggcgagaacctgcagat

SEQ ID NO: 33786 - DNA, 263 bp, Homo sapiens
  misc_feature 1..263: note = chr11:32448524-32448787
  misc_feature 1..263: note = hyper
  source 1..263: mol_type = genomic DNA
acctccttcccttgacgtcagccccgggtccccgcgcggaggggagggaggatggggatgggtttgggggcagccggtgtcaggatccccgagcaccagggaggagggggctatgaggtcatgcgcgcccaatcccgggccgcacaggcctcgcgctgctgctccccggcccccgccccaacttccagccccgtgcgggctggtgtgcgccgcagttactaggcaaccctatcgcagacgcgggcggccggccaagttcaccc

SEQ ID NO: 33787 - DNA, 964 bp, Homo sapiens
  misc_feature 1..964: note = chr11:32455482-32456446
  misc_feature 1..964: note = hyper
  source 1..964: mol_type = genomic DNA
tccttccactgcctgcggtagaacctggtcccgcatagcttggactcggataagtcaagttctcttccatccccagaacctgcgtggccgccgcctgagcgaagcccagtgaagatccacttctgtattaccatacgcgggagctatccacggacacgacgctgttccagaaagccatttagttactggaggtgcatgtgctcattctagttctctacgatacttaatgtgcacctaagtgtgtgccaacaccgtattataagggctggaggtgctcctggacattttagcgctgcggaggcagcacagcacaggcgctcacccccgcgctggtcccactccgaatccagagtccagacgtctgaaaagcgctacgcttggtgacaatttggcgtttccttaattaacaaaactctccccaaggcagagccagacactgcgccggtctcctggttccactcccgtggggactagcagtcccggaatctctcggactctaaggggccccagacgccctcccggctcttgcgaacagtcaggctcctagctctgcctggctttggaggatgtcgggggccagtgcctgcgtgcactcccactctccggcctcctccccagccgccgcttccgctatcctcacggcccttgggaagcagctgggtaagagctgcggtcaaaaggggtaggagaggggggtgtcctagagcggagagtccctggcgccactgccccgcgcgtagggggcgctccccggcctacttaccctgattgcgaatagcgggctggctctcgaggcagctgggcaggtagggcgcgttaggaaacatcctggcctggccggatgacgcctggctgggcggaggaggaccgaagggcccgtagcgacaggctccggctgtgccagtgaactggccggaaaagtggacagtgaaggcgctcaggcactgctcctcgtgcggctccg

SEQ ID NO: 33788 - DNA, 154 bp, Homo sapiens; identical to SEQ ID NO: 3740
  misc_feature 1..154: note = chr11:32456758-32456912
  misc_feature 1..154: note = hyper
  source 1..154: mol_type = genomic DNA

SEQ ID NO: 33789 - DNA, 286 bp, Homo sapiens
  misc_feature 1..286: note = chr11:32456913-32457199
  misc_feature 1..286: note = hyper
  source 1..286: mol_type = genomic DNA
gcgaggagacggcggggcccgggcgcctgggctgccgtcccggctctgggtgggtgggtgggtgaatgagtaggtgggagggagggcgggaagtgggggagcggacaggcggtcgggttgcggagagcccccgggtgtgggcgctgccttgaactccttaccccagctgcctggctgccctcagcttcccaaagctcaaataagaggggccggcggcgcggggaagaggaggagccaggaggctcggccgctccattcactcagcagcccaagcccggccaggcag

SEQ ID NO: 33790 - DNA, 218 bp, Homo sapiens
  misc_feature 1..218: note = chr11:32457219-32457437
  misc_feature 1..218: note = hyper
  source 1..218: mol_type = genomic DNA
cgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcaggtaagcagtgagtccgggcagggtcgaatgcggtgggagtagaga

SEQ ID NO: 33791 - DNA, 1099 bp, Homo sapiens
  misc_feature 1..1099: note = chr11:32457684-32458783
  misc_feature 1..1099: note = hyper
  source 1..1099: mol_type = genomic DNA
cctcagttgggtggccgggagttgcaccagttataagccgggcgtatttcgatcggctagtagttgtttacttggtgaggtttgcgccaggcggaaggcggttgccgcctacctaaaattggagtcagcagcacttagtttccctttccagtgaggaatatctaattcttctacggttaagccgggaaaacagcggctagtttaggagggaagaaaacccttgggcaaacgcccaaagcctgcgtatattccggccggagcatcctggcgcccagtttggggaggaggggtgaaggggagggtttggatacgaagcccggcagggagcgggtaactcctggagccactccgccgagcactgcctgtggccctggtcgaggataccattctggttgctcagtgattgaccaggaggcggaagccagttaaggggaccaaggagtggagtagggagaacctccatcggcccacgggcgcgagttagtgttcgaatctttgggagctcgaagagcttcgctaaatctgactcccttcgtctagtctctgtttggcagcccccgcgccccagagcaggtgtttggggcgggtagggggtgttttggtttggtttttggatcttctaaaggagtcagtatctattgggaaacaacccctaggcaaggagaagaaccgggggccggagcggagcgtgtttcagaggtgcgtataaaatcccaggggcgccaggaggcagcagcgacggcgcagcgtgggacggccaggcgcgacgggagggaagcaaccggttgcagtccggcctcctgtacctggctggcccgggctggggctgcaagctttccagccaaacttatgtgaagcaaagtagttgcagtttgacaaagaatggcgtttcaataaatgacatagtaattttttacgctttggtttttagcttgcattgcataaacgttgtcgccattaaattctggctgcggacccgaagtgtgtgcgggcccaggacttactcgaagggcgcacttcttgggaatgcgcatcccgtaggcgcaggagaccctgagggtaaagatgcggcacttgagccctccgcttgcctcccagg

SEQ ID NO: 33792 - DNA, 126 bp, Homo sapiens
  misc_feature 1..126: note = chr11:32459684-32459810
  misc_feature 1..126: note = hyper
  source 1..126: mol_type = genomic DNA
ctttgttgtgggtaacgttctctgcgggagacctgaggttttccaagggggacatgccagctacactggccttggcgccctgagctaagcaccaggactcacagcctagcacgaaggcaggtagca

SEQ ID NO: 33793 - DNA, 30 bp, Homo sapiens
  misc_feature 1..30: note = chr11:32460192-32460222
  misc_feature 1..30: note = hyper
  source 1..30: mol_type = genomic DNA
tccttactggtcaaacgggataatgggata

SEQ ID NO: 33794 - DNA, 47 bp, Homo sapiens
  misc_feature 1..47: note = chr11:32460468-32460515
  misc_feature 1..47: note = hyper
  source 1..47: mol_type = genomic DNA
gatacactggcaaagcgcaggcatcccggcctcgaaggtgcataatt

SEQ ID NO: 33795 - DNA, 93 bp, Homo sapiens
  misc_feature 1..93: note = chr11:32460796-32460889
  misc_feature 1..93: note = hyper
  source 1..93: mol_type = genomic DNA
ctcgctgctgcctgtcgcgggagaggaacaagctttcgactagcgcctctccccggggcccgcgccccgagccccacgcgcaagacagcccaa

SEQ ID NO: 33796 - DNA, 173 bp, Homo sapiens
  misc_feature 1..173: note = chr11:33037467-33037640
  misc_feature 1..173: note = hyper
  source 1..173: mol_type = genomic DNA
tgctggaggagttggcgtccggggagcaagggccatggccaccgtgcaggagaaggctgctgcgctgaacctctcggctctccacagccccgcgcacaggcctccgggtaggtgccgaggactgccgcctgggatggcgcggggcgggctggggtgcgcgggctgggtcccgg

SEQ ID NO: 33797 - DNA, 30 bp, Homo sapiens
  misc_feature 1..30: note = chr11:33850927-33850957
  misc_feature 1..30: note = hyper
  source 1..30: mol_type = genomic DNA
ccgcggacacctgggcggaaccccaagccg

SEQ ID NO: 33798 - DNA, 379 bp, Homo sapiens
  misc_feature 1..379: note = chr11:33890236-33890615
  misc_feature 1..379: note = hyper
  source 1..379: mol_type = genomic DNA
tggtgcattaactttcgaggttcacatgtccccatcggtggaccccgaggaggggtacacctactcagatttactccggatttcgctgctctagaaatccctggaggcccagagccagctccgaggtggacggtcggacccctcacccgcccgttatccgcaaggctggcagcggctccacctgcggaccgggaaggcggccgttggggaccccggaggccgccacttggaatgttcccctttccaagaccaaatggacaaagagaaaggaccgagaaggagagggaagaagggagcagagtcaagcccagaacgctctccggactgcacctgcgcgcctccaggctctcctcgtgcctgctcccgtgcaaactttctg

SEQ ID NO: 33799 - DNA, 30 bp, Homo sapiens
  misc_feature 1..30: note = chr11:33892097-33892127
  misc_feature 1..30: note = hyper
  source 1..30: mol_type = genomic DNA
tgcacgggctggggacgcctagagcagagc

SEQ ID NO: 33800 - DNA, 208 bp, Homo sapiens
  misc_feature 1..208: note = chr11:35440486-35440694
  misc_feature 1..208: note = hyper
  source 1..208: mol_type = genomic DNA
atcccctcacccttccgtagatgccatggtctggggaacgccccctcctcttcagcactatccggcagctgtgggcgagggagaaagcggacgccggggtgagcgcgaagtgcggccgggagcggtatttaagaggagcctctgcccgcccttccacccgcctccggggtaagccctttagcgcctcaacgggcgcaggaggctcctg

SEQ ID NO: 33801 - DNA, 93 bp, Homo sapiens
  misc_feature 1..93: note = chr11:35440936-35441029
  misc_feature 1..93: note = hyper
  source 1..93: mol_type = genomic DNA
cggtgagcgtgcgtgcgcgtgtgcgggtgtgtgcgcgcctggggaggcggtggaggccgctgcgctctggctcggcgccggccagggagggat

SEQ ID NO: 33802 - DNA, 342 bp, Homo sapiens
  misc_feature 1..342: note = chr11:35441295-35441637
  misc_feature 1..342: note = hyper
  source 1..342: mol_type = genomic DNA
gtttcccctgaagcccgcgtggccccaggtcaccccgtgcggggtgaagcgcaggcgaccgcgcggagacccgggatgcccctccgtctccgcctccctggagcagcccctggcgctccctcctcactccccggagcacccgcttcagctcacactcacccccaaactcacaggcaggcacacccaccccatcctcccacgtctgggggtcccaggtccagcggagtcgagcggctgaaacacgcgggtggtgcagcctaaacgcggcccagctgcgctccctcccccgccgaagctcgaataaatctctggccttcaattattcagcgagattaatattaa

SEQ ID NO: 33803 - DNA, 43 bp, Homo sapiens
  misc_feature 1..43: note = chr11:35547532-35547575
  misc_feature 1..43: note = hyper
  source 1..43: mol_type = genomic DNA
cgggagatcttcctacgggaggctgagacgggagctggctttg

SEQ ID NO: 33804 - DNA, 42 bp, Homo sapiens
  misc_feature 1..42: note = chr11:35639614-35639656
  misc_feature 1..42: note = hyper
  source 1..42: mol_type = genomic DNA
agtttgcaggagacccgcgctgcctaggcaaagggacccggc

SEQ ID NO: 33805 - DNA, 79 bp, Homo sapiens
  misc_feature 1..79: note = chr11:35639657-35639736
  misc_feature 1..79: note = hyper
  source 1..79: mol_type = genomic DNA
accaagacacccccgcgagggcccagggcgcgtccctcccgccaggccccagactccggctctgcgccaccccctccta

SEQ ID NO: 33806 - DNA, 915 bp, Homo sapiens
  misc_feature 1..915: note = chr11:35640687-35641602
  misc_feature 1..915: note = hyper
  source 1..915: mol_type = genomic DNA
ggcccgttttgccgacggcacccgcgcctgcgtgcgctacggcatcaacccggagcagattcagggcgaggccctgtcttactatctggcgcgcctgctgggcctccagcgccacgtgccgccgctggcactggctcgggtggaggctcggggcgcgcagtgggcgcaggtgcaggaggagctgcgcgctgcgcactggaccgagggcagcgtggtgagcctgacacgctggctgcccaacctcacggacgtggtggtgcccgcgccctggcgctcggaggacggccgtctgcgccccctccgggatgccgggggtgagctggccaacctcagccaggcggagctggtggacctagtacaatggaccgacttaatccttttcgactacctgacggccaacttcgaccggctcgtaagcaacctcttcagcctgcagtgggacccgcgcgtcatgcagcgtgccaccagcaacctgcaccgcggtccgggcggggcgctggtctttctggacaatgaggcgggcttggtgcacggctaccgggtagcaggcatgtgggacaagtataacgagccgctgttgcagtcagtgtgcgtgttccgcgagcggaccgcgcggcgcgtcctggagctgcaccgcggacaggacgccgcggcccggctgctgcgcctctaccggcgccacgagcctcgcttccccgagctggccgcccttgcagacccccacgctcagctgctacagcgccgcctcgacttcctcgccaagcacattttgcactgtaaggccaagtacggccgccggtctgggacttagtgtcaccgggaggaaaagagagagatctggggctggggtatggatgatggggggaagggcggtcgcctctgccactgtcagggaccagccggccaacgcccacc

SEQ ID NO: 33807 - DNA, 263 bp, Homo sapiens
  misc_feature 1..263: note = chr11:36398106-36398369
  misc_feature 1..263: note = hyper
  source 1..263: mol_type = genomic DNA
gagaaccatccaggtcgctcatttctctccggtgagaaaacttcctcgggaagaccggaaactttttcctaggcgcgcggagtctggggcggaggcgagcggcgggtgtgcgcgactcggggtgattcacgccggggaccccaaggaggtgagtggtgggtggggggcgtctctgggaggggccggagtcataggctcagcaaccgcgcaggattgagcgaaaattaccgcgcgctaatctgacggggcgcggcgtggcgggg

SEQ ID NO: 33808 - DNA, 32 bp, Homo sapiens
  misc_feature 1..32: note = chr11:36398880-36398912
  misc_feature 1..32: note = hyper
  source 1..32: mol_type = genomic DNA
cccggctgcggaccccgcgctgggagtccgca

SEQ ID NO: 33809 - DNA, 162 bp, Homo sapiens
  misc_feature 1..162: note = chr11:36399187-36399349
  misc_feature 1..162: note = hyper
  source 1..162: mol_type = genomic DNA
cccagtccctgtcctcggtcacatgctgccgccgcctcttcccccgcggtgccgggagcccgcgttttgtttgtcagcagttaggcggtgagtatttatagacgccacggcagtcctgcggtgcgcaaggtttcaattactgcgatgcgccccacaagacga

SEQ ID NO: 33810 - DNA, 207 bp, Homo sapiens
  misc_feature 1..207: note = chr11:40314716-40314923
  misc_feature 1..207: note = hyper
  source 1..207: mol_type = genomic DNA
aatttcataatctcacgttaaatggagtgcggggggcgggggcgggggcgggggcggaggtagtggaggaaaatttcaaggctccgtcagctgtcaagaagaaacccattcctccccccgctactttttttttttctttttaaggctcggggtgcctttccttcctctgtccccgcccccacccccagcacccggtccagatcctcc

SEQ ID NO: 33811 - DNA, 135 bp, Homo sapiens
  misc_feature 1..135: note = chr11:40315465-40315600
  misc_feature 1..135: note = hyper
  source 1..135: mol_type = genomic DNA
cggtttgaactctcttcctccccctccctctgctctctcccctctttttctcccaaataaatgctctcccagcaccggcggcagctcttgccagcccaggctttctctcgaccaatgccacgtcctgacgcttag

SEQ ID NO: 33812 - DNA, 115 bp, Homo sapiens
  misc_feature 1..115: note = chr11:43568960-43569075
  misc_feature 1..115: note = hyper
  source 1..115: mol_type = genomic DNA
gagcgacctggctctcggaagccgggcagggtgggggagggggcaggtaagtgggttgcctggcaacccggcagacccgcgggtggacaagctcaaggggcagccaggtgccacc

SEQ ID NO: 33813 - DNA, 187 bp, Homo sapiens
  misc_feature 1..187: note = chr11:43569128-43569315
  misc_feature 1..187: note = hyper
  source 1..187: mol_type = genomic DNA
cgagcgcagccggagcagtcgagcgggcaggacaccgtcagtgccgggagaacacgcgcgcgtgggtggatggcgggagggtcctcacagccagccgcaccacccccctcccccccacatcccgcaacctggcttctcctcgctctaaatctaggggaacaaaaacccggcgcgtctgggacagcct

SEQ ID NO: 33814 - DNA, 32 bp, Homo sapiens
  misc_feature 1..32: note = chr11:43569580-43569612
  misc_feature 1..32: note = hyper
  source 1..32: mol_type = genomic DNA
cgggcggggcggggccgcgctgctacgtaagc

SEQ ID NO: 33815 - DNA, 107 bp, Homo sapiens
  misc_feature 1..107: note = chr11:43596489-43596596
  misc_feature 1..107: note = hyper
  source 1..107: mol_type = genomic DNA
ggtgagtttcctcttcgggtggagagcagaggggaaagccgcagtagcaagccggacactcccctctgggcgctccccaccgccagaactgacgccttcgagggcgg

SEQ ID NO: 33816 - DNA, 360 bp, Homo sapiens
  misc_feature 1..360: note = chr11:43596850-43597210
  misc_feature 1..360: note = hyper
  source 1..360: mol_type = genomic DNA
gcaggagggagagagcgggagccttagaatctgttatttgcgtcactcgaggagccggggctatctgcccgacaaacacacagaattaatccgagttacagccatagctgtctatgctacagtgaccagatgagaaagggcggggaaaggacgcgcgcgggagcgtgtgcacggccgagtttgcattgggcgtcttgggagagtttggggagggggctgtcctgctgggcacgcccctcggggccccgcttgcccggtgcagactaggctgcagcctgctctgcagctgcccagcccaagcctggggtggcgcccgcctcggccgcctcgcctgctcagtggctgcgtggaacacaaagc

SEQ ID NO: 33817 - DNA, 45 bp, Homo sapiens
  misc_feature 1..45: note = chr11:43598418-43598463
  misc_feature 1..45: note = hyper
  source 1..45: mol_type = genomic DNA
gctgcaactctctctcgcgttatgggtcggcgctgttgagctcgg

SEQ ID NO: 33818 - DNA, 30 bp, Homo sapiens; identical to SEQ ID NO: 10840
  misc_feature 1..30: note = chr11:43599075-43599105
  misc_feature 1..30: note = hyper
  source 1..30: mol_type = genomic DNA

SEQ ID NO: 33819 - DNA, 114 bp, Homo sapiens
  misc_feature 1..114: note = chr11:43600016-43600130
  misc_feature 1..114: note = hyper
  source 1..114: mol_type = genomic DNA
aacaagggcttttaccgatgtgcagaataacacaaataacgctgcaacccacactttgtcttgacaattcagttcaaaccaaagctgctcacagcctctcggcccaccccgcgg

SEQ ID NO: 33820 - DNA, 951 bp, Homo sapiens
  misc_feature 1..951: note = chr11:43600516-43601467
  misc_feature 1..951: note = hyper
  source 1..951: mol_type = genomic DNA
aaaaagtgagtaatgcgcgctggctgcgtcatggctctagtcacagttcattccgaactgagaaggaatcgtgacttcgcctggagacgtcccctacatgggagatggggggcgggggggcaccaaatcagtggggacgggggtgggggggaagacctatccaatgaaaaccgctgccaggggggcatttgaactccgtcgcttgctgtctcgctgtcccctctctgccccgcgcacctcgctccccctcccggccggcgctcgcagtggcgcgcctgctcgctctcccgctaagcgacgagtcttcaacaagttggaggaaggcaggaacgcaggggttaagctcggaaagccgcaattaccaagatcgtgaccctcccacacagtacagtaacttatatacttacctggaagaacccgctttgccgccgggcaaacacccgtggggggcggggaggggccggagggagcgggccggcaggagaggggctgcttccagctggctgcagtgcggacgggaccggcgcgctcccgtggcccccagaccgaggtaaggagcagggagtcggcgcccgggtcggctggtggtcggtcggctcactggtagtcggtcggctcacgggtagtctgagcagaacttttttttcccagttgccccgcgccgcggcggcggcgggcgcagaccgcggagcccctctggcgcggcgggcgcgcagacgctcggagggtgtgtgcttgcgtctgtcagtcccggagccgaggggatgccgtgggagggtgagtgggtcgcggagctgcaggagggtgatggatgggcgaagggggtgggtcgacagggacttgaagacagtgcctccaccgtcgagagacgttttctccgggcgtgctgggcgagggtgggagtgtgtgtgcgcgcgcgcgcgcccgcccgcacgtcgattccagggtgcc

SEQ ID NO: 33821 - DNA, 454 bp, Homo sapiens; identical to SEQ ID NO: 973
  misc_feature 1..454: note = chr11:43602393-43602847
  misc_feature 1..454: note = hyper
  source 1..454: mol_type = genomic DNA

SEQ ID NO: 33822 - DNA, 189 bp, Homo sapiens; identical to SEQ ID NO: 974
  misc_feature 1..189: note = chr11:43602848-43603037
  misc_feature 1..189: note = hyper
  source 1..189: mol_type = genomic DNA

SEQ ID NO: 33823 - DNA, 143 bp, Homo sapiens
  misc_feature 1..143: note = chr11:43603076-43603219
  misc_feature 1..143: note = hyper
  source 1..143: mol_type = genomic DNA
cgcaccttcccgaagctgctccatccgagccttacccggccctttccccgttttccacggaagattcggccctttcccccgtcctttccgcggtgcccgaggctttggtcacctgtcttccctccgagcgagtcccccgcccc

SEQ ID NO: 33824 - DNA, 40 bp, Homo sapiens; identical to SEQ ID NO: 3747
  misc_feature 1..40: note = chr11:43603446-43603486
  misc_feature 1..40: note = hyper
  source 1..40: mol_type = genomic DNA

SEQ ID NO: 33825 - DNA, 438 bp, Homo sapiens; identical to SEQ ID NO: 10847
  misc_feature 1..438: note = chr11:43603708-43604146
  misc_feature 1..438: note = hyper
  source 1..438: mol_type = genomic DNA

SEQ ID NO: 33826 - DNA, 73 bp, Homo sapiens
  misc_feature 1..73: note = chr11:43604791-43604864
  misc_feature 1..73: note = hyper
  source 1..73: mol_type = genomic DNA
cctcacttctccctccgaggctaagtgtgggactagggctccagggcccaaggagcaacggccgaacccggcg

SEQ ID NO: 33827 - DNA, 31 bp, Homo sapiens; identical to SEQ ID NO: 10848
  misc_feature 1..31: note = chr11:43963534-43963565
  misc_feature 1..31: note = hyper
  source 1..31: mol_type = genomic DNA

SEQ ID NO: 33828 - DNA, 390 bp, Homo sapiens
  misc_feature 1..390: note = chr11:43963625-43964015
  misc_feature 1..390: note = hyper
  source 1..390: mol_type = genomic DNA
gcgcgcgcgcgcctgcggaggggggtggcaaggatccagaaggggagcccaccccttcttccgagctcagctctggggagccgggcgctcaggctcgccaggctgcaaagagagctgagagctgcctcgcgccccgcgcagaaccggcggtggaataaccagcgcctcaagtgtgtgcatctgggaccagggggcgggggagggggacctgcggccccgcggccaacccggttggtgcagacttggggatcccagaagggacagtgcccgcccagtcgcggcgattgagggtccctgtccgggcgcagctcgggccagccgcgtgctccggggccgcggcttctcccggaacccccgcgggcggggcctgccttccggagccggttggcg

SEQ ID NO: 33829 - DNA, 207 bp, Homo sapiens
  misc_feature 1..207: note = chr11:43964444-43964651
  misc_feature 1..207: note = hyper
  source 1..207: mol_type = genomic DNA
cggaggcgccatggccgccaagcccggcgagctgatgggcatctgctccagttaccaggcggtgatgccgcacttcgtgtgcctggccgacgagttcccgcagcccgtgcggcccgccaagctgcccaagggccggggccggctgcggcggccgcgccagtctcgcttcaagacgcagccggtgaccttcgacgagatccaggaggt

SEQ ID NO: 33830 - DNA, 404 bp, Homo sapiens
  misc_feature 1..404: note = chr11:43964895-43965299
  misc_feature 1..404: note = hyper
  source 1..404: mol_type = genomic DNA
cccgcgccctgctcccgggggacccgcaaggacccgggaccgccgctcctcgcgcgctcggactcccgccccgctgcgaaccggtcggtgcgcccctcgccgcgctcgccctggcccgggagcgccgggagcggggccgctttcctcgtccttgtaaatgtttattttttaactcttcccagtgcgaactctgctgtgagtgtgtgcggggaggcgcgcccgcgctgagtcggcggcgggtagccactccatgcccttgtccgatggtttgcaactccgattttgcacaccgctccaccgtgccccccagcgcacacccattcacactcacgccaacactctcgctgaacacttttataattgttaggcgtggccgttgggactttgggcgcagcgcggctgct

SEQ ID NO: 33831 - DNA, 371 bp, Homo sapiens
  misc_feature 1..371: note = chr11:43965690-43966061
  misc_feature 1..371: note = hyper
  source 1..371: mol_type = genomic DNA
aagccgcaggaggggcggaggcagagctgacgatggagagctctctcctccgtacagttcacttcccagagctggggtcagggtcctcgccccgcacccgccacagaagacgcatctccctctgcgctgattcctggcggcgggtggggagatgtcggagccagcaatgcgagatgtttgggcgttgggacccgagagtgggctggaggccagcctgggttggtcgagagtgtgggtgcgcgctcgctgtcgcgggcaggtgactccctgaccgcagttgacccagcgcagtgcctggcgctcctgcgctgcggggaaaaccgcggccgctatgtctccagccgttctctgcgctccgcagggttcctcca

SEQ ID NO: 33832 - DNA, 33 bp, Homo sapiens
  misc_feature 1..33: note = chr11:44324942-44324975
  misc_feature 1..33: note = hyper
  source 1..33: mol_type = genomic DNA
taggtacttggcagccggtggcccctcttaccc

SEQ ID NO: 33833 - DNA, 30 bp, Homo sapiens
  misc_feature 1..30: note = chr11:44325688-44325718
  misc_feature 1..30: note = hyper
  source 1..30: mol_type = genomic DNA
gtatcatcacatagccgggtcctcgcagtg

SEQ ID NO: 33834 - DNA, 129 bp, Homo sapiens
  misc_feature 1..129: note = chr11:44326062-44326191
  misc_feature 1..129: note = hyper
  source 1..129: mol_type = genomic DNA
ccaaggcctctgagccgcgggggctccgggcaactatccccctcctctcctggcctcaggcaccccagtccaggggtctgcagagaagcccgaagcccggacaaacgcgccggacgtcaacaacctctc

SEQ ID NO: 33835 - DNA, 81 bp, Homo sapiens; identical to SEQ ID NO: 976
  misc_feature 1..81: note = chr11:44330877-44330958
  misc_feature 1..81: note = hyper
  source 1..81: mol_type = genomic DNA

SEQ ID NO: 33836 - DNA, 481 bp, Homo sapiens; identical to SEQ ID NO: 977
  misc_feature 1..481: note = chr11:44330959-44331440
  misc_feature 1..481: note = hyper
  source 1..481: mol_type = genomic DNA

SEQ ID NO: 33837 - DNA, 229 bp, Homo sapiens; identical to SEQ ID NO: 978
  misc_feature 1..229: note = chr11:44331482-44331711
  misc_feature 1..229: note = hyper
  source 1..229: mol_type = genomic DNA

SEQ ID NO: 33838 - DNA, 48 bp, Homo sapiens
  misc_feature 1..48: note = chr11:44332524-44332572
  misc_feature 1..48: note = hyper
  source 1..48: mol_type = genomic DNA
cctctgctgtaagggcgctgggctgggatgtagcggaatctgtgctcc

SEQ ID NO: 33839 - DNA, 122 bp, Homo sapiens; identical to SEQ ID NO: 10857
  misc_feature 1..122: note = chr11:44332922-44333044
  misc_feature 1..122: note = hyper
  source 1..122: mol_type = genomic DNA

SEQ ID NO: 33840 - DNA, 45 bp, Homo sapiens
  misc_feature 1..45: note = chr11:44333583-44333628
  misc_feature 1..45: note = hyper
  source 1..45: mol_type = genomic DNA
atgcccaatgggaaccgcgcctcactggcccgcagacctaagcca

SEQ ID NO: 33841 - DNA, 136 bp, Homo sapiens; identical to SEQ ID NO: 10858
  misc_feature 1..136: note = chr11:44337726-44337862
  misc_feature 1..136: note = hyper
  source 1..136: mol_type = genomic DNA

SEQ ID NO: 33842 - DNA, 176 bp, Homo sapiens; identical to SEQ ID NO: 10859
  misc_feature 1..176: note = chr11:44337882-44338058
  misc_feature 1..176: note = hyper
  source 1..176: mol_type = genomic DNA

SEQ ID NO: 33843 - DNA, 440 bp, Homo sapiens
  misc_feature 1..440: note = chr11:44338086-44338526
  misc_feature 1..440: note = hyper
  source 1..440: mol_type = genomic DNA
cgctgggacttgcaccccgagtttaggggcttagccatttccggaactcgggctagtggactctggggaatcaggcgctgggagaggccttcgcagctgcgtctctcctgcccagcatattgtgttgaatgaggcaagggagtgagggggtcgtaaaggaaacccgcactcaggggcacaccttcatttatctgggaacagcgcggatcccagaggtgcgggataaaccaggcgttccagctgctcacacgctgtttggtaccccgcgtctatgaagcacaaagcaggagcggattggaggttttacaaactgaccaaccccgccgcccgcgcccgctggagggagacgcacacctttgccctgcatattcgcttccaggctctgcatctctgctcttggggagccggccacccgcttttccgcgcgggggctggggttc

SEQ ID NO: 33844 - DNA, 52 bp, Homo sapiens
  misc_feature 1..52: note = chr11:44341230-44341282
  misc_feature 1..52: note = hyper
  source 1..52: mol_type = genomic DNA
catactccccctacccgcccagagcaggcccagagcgcgcaactgcgggcga

SEQ ID NO: 33845 - DNA, 68 bp, Homo sapiens; identical to SEQ ID NO: 3751
  misc_feature 1..68: note = chr11:44341966-44342034
  misc_feature 1..68: note = hyper
  source 1..68: mol_type = genomic DNA

SEQ ID NO: 33846 - DNA, 117 bp, Homo sapiens
  misc_feature 1..117: note = chr11:44748226-44748343
  misc_feature 1..117: note = hyper
  source 1..117: mol_type = genomic DNA
gacgcagagagggcccgcgagcagagcgggaggtggtcggaggcggaggaaggggagatgggcagagggtgggcccagggacccccagacaaggcctggacgcggggttggaggagg

SEQ ID NO: 33847 - DNA, 106 bp, Homo sapiens
  misc_feature 1..106: note = chr11:44748708-44748814
  misc_feature 1..106: note = hyper
  source 1..106: mol_type = genomic DNA
cggacgcgccgccaccgccgggaaggcagccggcgccgggcaagttgcgagcgcgcccctccgaccaggaaagtttccccccggccgccggcgggatttggcgcgg

SEQ ID NO: 33848 - DNA, 220 bp, Homo sapiens
  misc_feature 1..220: note = chr11:45376858-45377078
  misc_feature 1..220: note = hyper
  source 1..220: mol_type = genomic DNA
agaaaggagaggaggcggagacggttagtctagcctctctgtggggcctctctgctggtacccagatgctgagcgctgaaattctcatccgccacacacaacatggcggcttcctggacccgcgcccaattttcgcttccgggatggaagctacgtcatttccccctctgttgccctagcgccccttggaagccaagaatatgaggaagtcttcttcctt

SEQ ID NO: 33849 - DNA, 75 bp, Homo sapiens
  misc_feature 1..75: note = chr11:45377121-45377196
  misc_feature 1..75: note = hyper
  source 1..75: mol_type = genomic DNA
cgctcgaaggctctgctggccgcggctagccggtgaggagggtggggggaggggccgtcccgcgtgtgggggagt

SEQ ID NO: 33850 - DNA, 187 bp, Homo sapiens
  misc_feature 1..187: note = chr11:45686237-45686424
  misc_feature 1..187: note = hyper
  source 1..187: mol_type = genomic DNA
gcagcggtctgggtgcggaggccgggccagggctgggagcaggaagcagggagcggcgcccccgcctccgggtgcagctgggtttggaaagttggtgcgggcgcggggacctcagggtctcaaggcgcctccgcagacccgagccaggcgggtcgtgggacggtgagcccggagcagcccctgagtg

SEQ ID NO: 33851 - DNA, 20 bp, Homo sapiens
  misc_feature 1..20: note = chr11:45686449-45686469
  misc_feature 1..20: note = hyper
  source 1..20: mol_type = genomic DNA
cgcctcgggggccaccgcgc

SEQ ID NO: 33852 - DNA, 66 bp, Homo sapiens
  misc_feature 1..66: note = chr11:45686717-45686783
  misc_feature 1..66: note = hyper
  source 1..66: mol_type = genomic DNA
cggccaatacctggtcggggacgcgccgggagcagctgcagcgcccagcgccggctccatcctcgg

SEQ ID NO: 33853 - DNA, 119 bp, Homo sapiens
  misc_feature 1..119: note = chr11:46259315-46259434
  misc_feature 1..119: note = hyper
  source 1..119: mol_type = genomic DNA
ataatcgggtcaacacgcggcgagtggcggtgcgcgcggggccaaccgcgtggagctgtcgggagggcgataggatgggcgcgcccgggctgcaggcggggagccggaggtgggaggtg

SEQ ID NO: 33854 - DNA, 67 bp, Homo sapiens
  misc_feature 1..67: note = chr11:46299747-46299814
  misc_feature 1..67: note = hyper
  source 1..67: mol_type = genomic DNA
acttcctcaacaatgcggtaagatgaagggtctccgttcccgttccacccctcggcacccgtcctcg

SEQ ID NO: 33855 - DNA, 15 bp, Homo sapiens
  misc_feature 1..15: note = chr11:46316818-46316833
  misc_feature 1..15: note = hyper
  source 1..15: mol_type = genomic DNA
gtaccattactgccc

SEQ ID NO: 33856 - DNA, 461 bp, Homo sapiens; identical to SEQ ID NO: 980
  misc_feature 1..461: note = chr11:46316895-46317356
  misc_feature 1..461: note = hyper
  source 1..461: mol_type = genomic DNA

SEQ ID NO: 33857 - DNA, 290 bp, Homo sapiens; identical to SEQ ID NO: 981
  misc_feature 1..290: note = chr11:46317407-46317697
  misc_feature 1..290: note = hyper
  source 1..290: mol_type = genomic DNA

SEQ ID NO: 33858 - DNA, 128 bp, Homo sapiens
  misc_feature 1..128: note = chr11:46354365-46354493
  misc_feature 1..128: note = hyper
  source 1..128: mol_type = genomic DNA
cgtggtgggctgggccgggctcgctcccttcgtgccctgagcgggcgggctgggcggagcggcgccctcccctccggaccccaccggctggagagtgtctctaaggtgacactcgggtgcgcggcagc

SEQ ID NO: 33859 - DNA, 165 bp, Homo sapiens
  misc_feature 1..165: note = chr11:46354770-46354935
  misc_feature 1..165: note = hyper
  source 1..165: mol_type = genomic DNA
acttgagcgggtgcccgaaaggccgcaggagccgcgggcggaaggcggccgcacgatggccgaggggcagggcggcggagggcagcgctgggactgggctggcggcggccgggcagccgaggaggaggtggtgcggcggcgatgccggcgcggggaggaggccca

SEQ ID NO: 33860 - DNA, 30 bp, Homo sapiens
  misc_feature 1..30: note = chr11:46404027-46404057
  misc_feature 1..30: note = hyper
  source 1..30: mol_type = genomic DNA
tcagagggcaggagacggggggcacagcct

SEQ ID NO: 33861 - DNA, 137 bp, Homo sapiens; identical to SEQ ID NO: 10866
  misc_feature 1..137: note = chr11:46414563-46414700
  misc_feature 1..137: note = hyper
  source 1..137: mol_type = genomic DNA

SEQ ID NO: 33862 - DNA, 635 bp, Homo sapiens
  misc_feature 1..635: note = chr11:46938439-46939074
  misc_feature 1..635: note = hyper
  source 1..635: mol_type = genomic DNA
gccgctgtcccaacacgccaaagaggctacaaataaccttccaggagagagccggggaggggagagcgcagagcggagcggaacgtgggccggccaagctaccgctcttcggagagaaagagctcagtccgcgctagagaggacgcggaaaaaagcccctgaaaacccacaggtagtttaaataagagacatgaaaactctgttttggatttgggaggtaaaccaatctttaaaacgagtgcctagacatctccacgccctgccaggcaagttcggaaatctgcactgactttttccacacgagctgtcctacgtgaaagaaagaaccggtaaaagaccaggcagggtctccagacccctccattctgagccccagctcccttcatcggggctgcgaggcaaatggggagactcggaactcccgccacgatgaatagcgatgggtgaatagggctggggttcaaagatcaaagttctttgatctctgggcacaaactagggaaagctgctcaatcacggggtgcacccagggtcgttaagagcccgcggagaagcagattccatcggagccctagtcccacacaacagggggtacgggcaccaaggagtcctgctgcagccgtccagctcccccg

SEQ ID NO: 33863 - DNA, 605 bp, Homo sapiens
  misc_feature 1..605: note = chr11:47208675-47209280
  misc_feature 1..605: note = hyper
  source 1..605: mol_type = genomic DNA
tacatttttccatatcgccacgatgccaccccacgctaaataaatcccttctccctcctctctccctacttccctctccccgctttcccccgggggtgagattttgcagagcggctccgtctgttatttatatccactggagcggtccaagaatgttccgaagctgacctaatcgccacctgctcggcctctccgcccctcccactctctcctgggcccggtgacccagcggcggtgccctgagccttgaagaccagggggagcgcggaccaacggggtcgaacgcccgggcgcagaaggtcccggacgcagaaggtcccgggcgcgcagaatcgcagcgggtcggagagccccggcgctctcagaggagtgcgcccccagggacgcggctctgagccctgggaagctgaggcgcctggctgcgccctctgaagctcgtacttttcctcccaccctcagctccctgaagagtgtgagtgcgtgcgcgcggagttttaaacggcagctttaaaaatagcaaaattatgttgtttctaaatccaggaggaatcactgacgcgttctttacgcagatgaatccgctcacaaaacgggaaagggacctg

SEQ ID NO: 33864 - DNA, 174 bp, Homo sapiens
  misc_feature 1..174: note = chr11:47615713-47615887
  misc_feature 1..174: note = hyper
  source 1..174: mol_type = genomic DNA
cggtcgagtcgggttcggtctgagcccgcgatctggctccgggctgcgggctgcgggctgcaggctgcaggctgcgggtgccgggctgcgcgctgaccgcccgcgctgcggcaggggcggcgggggctccggctgcttttcccggctctgaggcggcagcggacagggtgctgg

SEQ ID NO: 33865 - DNA, 60 bp, Homo sapiens
  misc_feature 1..60: note = chr11:49229810-49229870
  misc_feature 1..60: note = hyper
  source 1..60: mol_type = genomic DNA
ctccgaggtttgctccgcgaggcgcccccctaccgaagaggaagccgaggagaaagaagc

SEQ ID NO: 33866 - DNA, 556 bp, Homo sapiens
  misc_feature 1..556: note = chr11:57194178-57194734
  misc_feature 1..556: note = hyper
  source 1..556: mol_type = genomic DNA
gaagacacaaactcccgctgccaagttggtgttatcttcagtttactgacaatgaaacaaaagctcccatggatttcaggaacttgcccaaggtcacagggctagtttagtcacgacgcaggccattctactgccagaaatacccccaactcccatgaccctcgcctaggactcgcaaacctggtccccgccgcccttcctcgcatcaacttctaccaggaaagcctccgggggccgctccccgccagcctccgcaccccgctccagcctgcggcctgccctccccgcagaggagcccgaggggccaggccgcgctcggcgccccatggcgcccgaaaggggacccttcgccctacccgcctgctccgcgccggggctctccgcgccctttccgcacgggccaggttcgcattcgcgcctctcgcagcccctcccagtcccctgctcgcctccgccccctcctgcccgcccggaaggggctggggcagacctcccactctccatcacttccttcttcttttcccttgctcacagcctcccgcgccctttttacctc

SEQ ID NO: 33867 - DNA, 30 bp, Homo sapiens
  misc_feature 1..30: note = chr11:57243673-57243703
  misc_feature 1..30: note = hyper
  source 1..30: mol_type = genomic DNA
ttcctccacgggaaccgcctgcggctgctc

SEQ ID NO: 33868 - DNA, 150 bp, Homo sapiens
  misc_feature 1..150: note = chr11:58668329-58668479
  misc_feature 1..150: note = hyper
  source 1..150: mol_type = genomic DNA
cattaagggaatcttcgagtccaagaacggaagctaccattggccttaatcttcacctcccgcttttcttccctgcttcttttctcctccctattccagtaggttagttctctggcgccatcagctggcagcacgcgggaatataccaaa

SEQ ID NO: 33869 - DNA, 467 bp, Homo sapiens
  misc_feature 1..467: note = chr11:58672700-58673167
  misc_feature 1..467: note = hyper
  source 1..467: mol_type = genomic DNA
tcgccagcccctccacgaagttggatcatttgcggagcaggccaagtccctctagacctcacgcagacgcgggtgcagcctgctctgcgacttgcagtcagctggaagctgggcctctgcatcatcagggtggagctctctctgctgctgccgctggatcccgcctggatgcacgtcccgccaccgccgccgacccatcagcggcagaagggcagcaatggccacacaccgaagcaccttggcgggctattccccttgcagctctcctcagcgcgctgctcccactcgcaatcaaaaggcggaaaaagcgcgaaaccgccaggcatctcccatacccacccggctgccgcgcaacccctccttggcttccactgggagacaggggacgccgatgagcaggaagaagcagggcagtgactgcttagtttatcctggtacgcgggaactggctgtggaccgagtggttc

SEQ ID NO: 33870 - DNA, 80 bp, Homo sapiens; identical to SEQ ID NO: 3759
  misc_feature 1..80: note = chr11:58673168-58673248
  misc_feature 1..80: note = hyper
  source 1..80: mol_type = genomic DNA

SEQ ID NO: 33871 - DNA, 53 bp, Homo sapiens
  misc_feature 1..53: note = chr11:59318986-59319039
  misc_feature 1..53: note = hyper
  source 1..53: mol_type = genomic DNA
cccttcacttgaaggcgtaaagaatcccgttcctctatcgagccttttctcct

SEQ ID NO: 33872 - DNA, 241 bp, Homo sapiens
  misc_feature 1..241: note = chr11:59333336-59333577
  misc_feature 1..241: note = hyper
  source 1..241: mol_type = genomic DNA
ccccggtccttgttacggtttaaaaagctggacaaagcccgtgcgccgaacgctttcgaggacttctttggccaagagggggcccgggctgtcaccattcccggcaagcccgcgaccaagcaggcagcggaggcggcgcaggccgagagctcccgcccctctgacagtgagagaagggtcgcagcgcccacggctgcctagaacccgaaagaagaggagcggggtgcggggacacagggtt

SEQ ID NO: 33873 - DNA, 191 bp, Homo sapiens
  misc_feature 1..191: note = chr11:60718663-60718854
  misc_feature 1..191: note = hyper
  source 1..191: mol_type = genomic DNA
ggcgggcagcaggcccgaggcggccaggtagagcagcaggctgagcgcgaccgcgcggtagcggcccaggtacacgtcggccagccagccgcccacgggcgccagcaggtaggaggcgcccaggaataccagcgcggcgcgcgtcgcctgctcgccggtccagttgaagttggtgctgttgaggtacagca

SEQ ID NO: 33874 - DNA, 187 bp, Homo sapiens
  misc_feature 1..187: note = chr11:60718976-60719163
  misc_feature 1..187: note = hyper
  source 1..187: mol_type = genomic DNA
cgctccccgggcacgcggggctgctcccgggcgcgcggcgcgggcatcctggctccgggctgggccccccgcggctcttctctcctctcctctccccgcctcagagccctgcactcctgcccccgggcctcggccctctcccccacccaactggctggccctcctttctcaccgctttggcccaccc

SEQ ID NO: 33875 - DNA, 286 bp, Homo sapiens
  misc_feature 1..286: note = chr11:61062738-61063024
  misc_feature 1..286: note = hyper
  source 1..286: mol_type = genomic DNA
aacacacaaaggcaacgccgcccgcctgctgatgcctctccgagaggcgcggagcccggggcgggggcaaagatcagggacccctgggggcggggtttcgccctcggcccacaccccctgccccggtttgggagtcggcttcctgcgaagcgctgactgaaggcgtcagaccgaggccccgggaggaaacagacttcgggaacaaggctagcaccagaggctgcgcgccccgggcatggcccctgtcggtgggacccgagacgccttgttgtgacgaggtgggaac

SEQ ID NO: 33876 - DNA, 97 bp, Homo sapiens; identical to SEQ ID NO: 10877
  misc_feature 1..97: note = chr11:61063061-61063158
  misc_feature 1..97: note = hyper
  source 1..97: mol_type = genomic DNA

SEQ ID NO: 33877 - DNA, 73 bp, Homo sapiens
  misc_feature 1..73: note = chr11:61276431-61276504
  misc_feature 1..73: note = hyper
  source 1..73: mol_type = genomic DNA
cggtggcagtggcggcggccccggccggggcccgtgaccatgggcatcgccgagtccacgccggatgagctgc

SEQ ID NO: 33878 - DNA, 585 bp, Homo sapiens
  misc_feature 1..585: note = chr11:61276535-61277120
  misc_feature 1..585: note = hyper
  source 1..585: mol_type = genomic DNA
cgaccagcagctggagctgagcgggcggcggttgcggcggctgcccagcgcagtgtgcgcgctgagccgcctgcagaagctgtatgtgagcggcacggggctgcgcgagctgccggaggagatcgaggagctgcgcgagctgcgcatcctggcgctggacttcaacaagctcgagcgactgcctgacggcctgtgccgcctgccgcgcctcacgcgcctctatctgggcggcaaccggctgctggcgctgcccgccgacttcgcgcagttgcagagcctgcgctgcctctggatcgagggcaacttcttgcggcgcttcccgcggccgctgctgcgcctggtggcgctgcagtcgctccagatgggcgacaaccggctgcgcgcgctgccggccgagctgccgcgcatgacgggcttgcgcggcctctggctctacggcaaccgcttcgaggagttcccgcccgcgctgctgcgcatgggccgcctgcacatcctcgacctcgaccgcaaccgcctgggcggcttccccgacctgcacccgctgcgcgcgctgcgcgtcttctcctacgaccacaaccccgtcac

SEQ ID NO: 33879 - DNA, 15 bp, Homo sapiens
  misc_feature 1..15: note = chr11:61277327-61277342
  misc_feature 1..15: note = hyper
  source 1..15: mol_type = genomic DNA
cgctccaggactggg

SEQ ID NO: 33880 - DNA, 38 bp, Homo sapiens
  misc_feature 1..38: note = chr11:61334835-61334873
  misc_feature 1..38: note = hyper
  source 1..38: mol_type = genomic DNA
tgctgaaacagctgtcggccacgcggctccttgtcctt

SEQ ID NO: 33881 - DNA, 213 bp, Homo sapiens
  misc_feature 1..213: note = chr11:61335097-61335310
  misc_feature 1..213: note = hyper
  source 1..213: mol_type = genomic DNA
caggacaaaaagggccgccccgcgaacgtggtaaataccacgccccattccctcccgggggcccgccgcactgcctcctggtggctggcgcgggcactgcaccccggcgggcgcacagacggtccccagcggcggcctgggccagcggcgaagcagcggcagacggttctccggcccccgccgccccctcaccgctcccggggcaatctggcg

SEQ ID NO: 33882 - DNA, 72 bp, Homo sapiens
  misc_feature 1..72: note = chr11:61582570-61582642
  misc_feature 1..72: note = hyper
  source 1..72: mol_type = genomic DNA
tggcgataagattcacgttggcaggtccggcagccccgggccctgtaagtgatgcggcgtgtggggcggggg

SEQ ID NO: 33883 - DNA, 310 bp, Homo sapiens
  misc_feature 1..310: note = chr11:61583252-61583562
  misc_feature 1..310: note = hyper
  source 1..310: mol_type = genomic DNA
cctaccgccccagagcgtaaacagcggtccgctccgcggaatagctgaagacctcgctggcctgcggctcagtggcctccccggcgattcgagaacagctctgggggtcctcgctaagtgtatgccattcccaatcccttatgtacgccagcggccgcttgccctccccggccagcgctgtcccttccgcgtcctccagtcttcacacgacgcaggggtccccaaggcagcggtctccccaagcttcccgtttcagccccatcctcgagaatgggctcctttcctgctccctctccgctcctgctggcga

SEQ ID NO: 33884 - DNA, 498 bp, Homo sapiens
  misc_feature 1..498: note = chr11:61594981-61595479
  misc_feature 1..498: note = hyper
  source 1..498: mol_type = genomic DNA
gaggttgcagaaaggcgccagaatgtggatggcgcggacaatgtgggatactggagtctcgactgccgcgcgccaaggaagggcgtcacctagccaagccggccctggagttgagtgccccgcagcccgccggtccacccgcccggccgcttgctggcaccctggtggccgcgccggctttgtgtcggcatcaggtgcaaacccccagagcgccgggcgtgcgcgcacgcgccccggagcgcgcggagcccattcgttgcccccaccgggatctcctctaggatctcctccggcgcccggggccggagagtgggggagggaggaggtcggacacgtagcctgcctcgcagcagggctcgactccacgcgggagggcgggggagccggggacccgccgctccagcccgctggccttcgaaagatcctcctgggccaatggcaggcggggcgacgcgaccggattggtgcaggcgctctgctgatcgctgtggaaactcg

SEQ ID NO: 33885 - DNA, 520 bp, Homo sapiens
  misc_feature 1..520: note = chr11:61596120-61596640
  misc_feature 1..520: note = hyper
  source 1..520: mol_type = genomic DNA
ggatccctggctccccgtgggccaaacagacctccggcgctgaatggagcttgggacgtcctgtagggaaggaaagtgcatctattgcactcgtaccccctccccaatcctcctcctcctctgggccgactggggtggagaccggatctgggacccggggaggcggcgctgcggtgaaagtcccagcggtggagaacagggcaagcatctaccgcgcgcgccgggacccacgcgtcctccccttcctcggggtttgtctggaggcagggactccccaagaggggcgctcgggccagacggctttggcgcccccagcggggaagatggccgcccctgcgcgccgctgaaaggagcgggagcgcaggcagccaggtgtgggactccgcgcttgtcccgcactctccatccagactgggtggcgagaaggaaagctcgtccccggccggagatcgctcctgctgggactcttgtctaagaagttcctcaatggccacctgggaaaaaccgcccagcagctcgg

SEQ ID NO: 33886 - DNA, 137 bp, Homo sapiens
  misc_feature 1..137: note = chr11:61722850-61722987
  misc_feature 1..137: note = hyper
  source 1..137: mol_type = genomic DNA
agacgttaggtaagacgtcctgccgttagcaatgaaaaccccattttctgagggaagcgctgacatcatggtccctggagcccctgcgcgggaggggagggggtctggcggatttctgggaccagcagggggacccc

SEQ ID NO: 33887 - DNA, 34 bp, Homo sapiens
  misc_feature 1..34: note = chr11:61793162-61793196
  misc_feature 1..34: note = hyper
  source 1..34: mol_type = genomic DNA
tgcagtcagcagacacgtacgggatgtgggaggt

SEQ ID NO: 33888 - DNA, 77 bp, Homo sapiens
  misc_feature 1..77: note = chr11:63258635-63258712
  misc_feature 1..77: note = hyper
  source 1..77: mol_type = genomic DNA
ccgcggaggggaaagcgccgcgggctgcaaacggcagaggcgcgcggggtggcgacagtggcgcgggcgcagtgagc

SEQ ID NO: 33889 - DNA, 30 bp, Homo sapiens
  misc_feature 1..30: note = chr11:63537177-63537207
  misc_feature 1..30: note = hyper
  source 1..30: mol_type = genomic DNA
ccggtcccccagctccggagaagcggagcg

SEQ ID NO: 33890 - DNA, 14 bp, Homo sapiens
  misc_feature 1..14: note = chr11:63768254-63768268
  misc_feature 1..14: note = hyper
  source 1..14: mol_type = genomic DNA
gggcctcagcgtcg

SEQ ID NO: 33891 - DNA, 180 bp, Homo sapiens
  misc_feature 1..180: note = chr11:63803518-63803698
  misc_feature 1..180: note = hyper
  source 1..180: mol_type = genomic DNA
cccctgggcgccctccggctctggttcccgcccgctccttggaataacccctgaggctccagccgtcaccgcaaagtttcccgaggagacccgcctccccggccgctgcgcaggtagggctggctgcaccgggcgggggtcggggtccgcgcgtctgggacagggcgccagagccgacgg

SEQ ID NO: 33892 - DNA, 60 bp, Homo sapiens
  misc_feature 1..60: note = chr11:64058891-64058951
  misc_feature 1..60: note = hyper
  source 1..60: mol_type = genomic DNA
agctgatgcccaggtcggggccctgccgctggccacactgggctccggtccaaggctaga

SEQ ID NO: 33893 - DNA, 216 bp, Homo sapiens
  misc_feature 1..216: note = chr11:64059895-64060111
  misc_feature 1..216: note = hyper
  source 1..216: mol_type = genomic DNA
agccaggaagcagggcgaggcgagaggggacggagaagccgcggagatgctgtcacagccgcagcgggcgagcagggacccaccattcccctgtccccgccttgcgctgtccggcctctcctccgggtttcccttcggacgcctccgagccccctcagcctcctcctcgagggccagctccccgcacccccaccaagctccacacatttcctcgct

SEQ ID NO: 33894 - DNA, 33 bp, Homo sapiens
  misc_feature 1..33: note = chr11:64060160-64060193
  misc_feature 1..33: note = hyper
  source 1..33: mol_type = genomic DNA
cgccttcctttcccttctcggtgccctcctctc

SEQ ID NO: 33895 - DNA, 363 bp, Homo sapiens
  misc_feature 1..363: note = chr11:64066842-64067205
  misc_feature 1..363: note = hyper
  source 1..363: mol_type = genomic DNA
ccagctggactggcacggtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcagg

SEQ ID NO: 33896 - DNA, 229 bp, Homo sapiens
  misc_feature 1..229: note = chr11:64409956-64410185
  misc_feature 1..229: note = hyper
  source 1..229: mol_type = genomic DNA
agcgccccccgcccccgggccaaccgggtggccggcatctacagtgccacttaccgtggccgccgcgggtgaggaagggcatgcggttgatggcgatgggcacggtgccgtgcttgctgtggaagtggtggacgtggtgggtggtgctgaggctggaggagacccgggccccctcggccgcccccagcagcaacagcagcaacagcggcaacagcggcagcagaggtgg

SEQ ID NO: 33897 - DNA, 233 bp, Homo sapiens
  misc_feature 1..233: note = chr11:64410203-64410436
  misc_feature 1..233: note = hyper
  source 1..233: mol_type = genomic DNA
cggcggcaggggcccagccagggccggggggcggcgcgggcacccccccggcccgctccccccggggggcatttcggcccgggggcgaccgcctcacagccccatggccgggggcggggacgcggggctgcgcagccccgcgaagcccccctccggctccgagctccgggagcggggtagggatgaagcggaggtaaaccagggcccaagcctcggtccggagccaacaaaat

SEQ ID NO: 33898 - DNA, 81 bp, Homo sapiens
  misc_feature 1..81: note = chr11:64410678-64410759
  misc_feature 1..81: note = hyper
  source 1..81: mol_type = genomic DNA
agctggggagcggggcggtgcgggctggaggagagaagagggacggagacctggttcccccgaaggcgggagaccgacggc

SEQ ID NO: 33899 - DNA, 196 bp, Homo sapiens
  misc_feature 1..196: note = chr11:64478789-64478985
  misc_feature 1..196: note = hyper
  source 1..196: mol_type = genomic DNA
gaccaggggagagaacgtcaggcctgaggcacacacgagctggaagaacagggacgaggggcggggagagacgcgcatgcgccgcccccagaccgatgggggagcccctccccacgcccagccagaccctaatggaagaggctcctcccagtgcttcctctcctcagcgccccctgccccccgacaccacagcccc

SEQ ID NO: 33900 - DNA, 78 bp, Homo sapiens
  misc_feature 1..78: note = chr11:64480253-64480331
  misc_feature 1..78: note = hyper
  source 1..78: mol_type = genomic DNA
ccaccgccaaccccacgcgccctcgcccggacacgcgtccccgcagccctggagcgctcgcacccactcacaagccct

SEQ ID NO: 33901 - DNA, 845 bp, Homo sapiens
  misc_feature 1..845: note = chr11:64480379-64481224
  misc_feature 1..845: note = hyper
  source 1..845: mol_type = genomic DNA
cgaagcgccccaggccctcacccccgcgcccaggcaccgggcggccgctccccggggctcaccttcgctgcagaacttgccgccgaagcccgtgtggctgcagtcgcagcccacctcgccgggggccagcacggtgcagaggccgccgttggcgcaggggttgcgcgcgggcgcgcacagcgggtcggcggtggcgccgcgcaggccctggctgcccagcagcgcggggggccgctcgcccagcttcaggttggccaagaggccgcggaagggcggctcgtacttgacggtgctcagcgtaagcgccgagaggcgcacgtcgggcgggatgccgcccacgaacaggtcgctggccacctgcatctcgcgccgcttggagcgcacctcggcggcgcgggcctcgccgtccaccgccagcgccgtgcggcgcgcgtcgcgggtcagcagcaccatgtgccagcggtcgtcggccaccggcgtgtccagctgcagcgtggccggctcggcgcacgaaagcgtgaagcgcagccgcaggcggccgtccaccagcagcagctccaggaagtcgcagtcgccgccgtcgtccaggtagagcagcagcgcgcgcgtggcgttggtgcgcaggctgaagctgagctcgccgctgctcgccgcgcccgcccagcgcgcgtagcgagcccactgcccggggccgccgccgaactccaggccgtccgcgcgcgccgccagcgccagcagcagcagcaacagcagcggcggcggtgtcggccgccaccggctcccggacgccatgcctacggcggccccggccccgcccggcccccggcccccgctcaggcttcaga

SEQ ID NO: 33902 - DNA, 129 bp, Homo sapiens
  misc_feature 1..129: note = chr11:64511955-64512084
  misc_feature 1..129: note = hyper
  source 1..129: mol_type = genomic DNA
tgccaaatgggggtacgcgggggagggccccgctggaaggtggctgggaaaagctgggtgcaccgtggaggtcctccgccctccggggatccagcgcgccttagctctcgtggccgctgccccctctcc

SEQ ID NO: 33903 - DNA, 405 bp, Homo sapiens
  misc_feature 1..405: note = chr11:64512898-64513303
  misc_feature 1..405: note = hyper
  source 1..405: mol_type = genomic DNA
gggacctgtggggagcgaggaatgaaatcgtggctatctggagacgcggccttgatgtctgggaatgggggcggggggcccagttcacacaggaggaacggggccccggaagcctggctccccacagggtcgaatggaaaggggcagccgcatgtggcggtgggttctccgcagctcggagactggagacctggatgcctggccaacagggaggaacttgggaggggcagccgcaggcggttggggtccccactagccgggcctaggagagcgggtaacggtttccgaccatttggcttcagacacactcactgtgaaaccaccgaccccaaacctcccttccgaggcgtgcccctcccagccttggggcgggggatccaggaccgcccccgcacctcagtcttg

SEQ ID NO: 33904 - DNA, 233 bp, Homo sapiens
  misc_feature 1..233: note = chr11:64513515-64513748
  misc_feature 1..233: note = hyper
  source 1..233: mol_type = genomic DNA
cctgggtcctgccctcgacagcgcggatcctccgtggtccgggaagcctcagcccaagtcccggctcccagccccggtgggccccacccaggcagacgccccgcccccggccagcgaggctggccgctgacctagtatggacacggcactgggaagagaggcgtggagggtgacgccaggaaaggggctggagaggcctaggccccgcccccacgggtcgccccctccacctc

SEQ ID NO: 33905 - DNA, 475 bp, Homo sapiens
  misc_feature 1..475: note = chr11:64739288-64739763
  misc_feature 1..475: note = hyper
  source 1..475: mol_type = genomic DNA
agaaataaacagaaacgcaaagacaacttcccgagggcccgggccgtcgtgtgccgttacctcagccccaggtggttcccaggctcggccaggctatgtctcacacactgactaggggtccttcggcctcagaaaagtggccccggacggaatacccactaagaagtgctctctgaaaaaggcgggcgccaacctcgaacgaagtcgttttgagggactggctcgccagctcctaagcaacttcggggctcgtgccgcgcacccaccaggccttctgcgcacgcgcaagtgcgcttcccaccgccccttcgggcgcagctccaaggcctggccgcggtctgcgcgtgcgcatttcattgtcgacaccgagaggacgccttggcgccttcaggtccctcctggatttaccagcccattgtttatttcgcgcctgctttagcgtggtgtcgtcgggaactagcgactgcagagtcct

SEQ ID NO: 33906 - DNA, 30 bp, Homo sapiens; identical to SEQ ID NO: 10894
  misc_feature 1..30: note = chr11:65185213-65185243
  misc_feature 1..30: note = hyper
  source 1..30: mol_type = genomic DNA

SEQ ID NO: 33907 - DNA, 246 bp, Homo sapiens
  misc_feature 1..246: note = chr11:65185467-65185713
  misc_feature 1..246: note = hyper
  source 1..246: mol_type = genomic DNA
gagtgctcaggaggacgggggaccaaggcctggggtaaggggcaggtgcccaggcactctagcatggcacggaacaggggacagtcccaggacatccggatgcagggggctgacaccgcaaagttctttcctgtaaagcacagcccgaggcctggggcttggccctgggcagaggaagccccccttagatctgccttggcagtagtgaggaaagggcgtgcacagaccccacgcagcccgaggtga

SEQ ID NO: 33908 - DNA, 190 bp, Homo sapiens
  misc_feature 1..190: note = chr11:65197700-65197890
  misc_feature 1..190: note = hyper
  source 1..190: mol_type = genomic DNA
tcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaa

SEQ ID NO: 33909 - DNA, 97 bp, Homo sapiens
  misc_feature 1..97: note = chr11:65600749-65600846
  misc_feature 1..97: note = hyper
  source 1..97: mol_type = genomic DNA
ccccaggttttctctcgcagcatcggcacccccttgcagccccgctccagtggcgaccgttcgcggaccccggcctcgcttggggcgccctggccgc

SEQ ID NO: 33910 - DNA, 810 bp, Homo sapiens
  misc_feature 1..810: note = chr11:65600847-65601657
  misc_feature 1..810: note = hyper
  source 1..810: mol_type = genomic DNA
ggacttgtggagctccctagtcctcctaggctgcttaccccgccgctccctcccgtccaagagcggaaacctaaacagaccccccttctccacagacattgtcccctgccctcgcccctggtccaccacccacatccccaccactgcttcccattccctgtccccaccctgccaccctcaccctcttccccttccccttccccttccccactgcctggtgggcgccaaactgggcgagtgcgcacgcgcaggccgcacgtggccgttggaaggaggggcccggaacggcggcacggggttgttgtgggggtcagtcccccggggactggagggagacgcggcacgcggcctctgcgaccctatgaactctgaccccagctcccacactgtcgcctatcaccggcccactctccgtgccgcgtgtcccttaaaagctggggcctgggacaggaacgacagacaatgcagccaatggcgtcacgcgcggtgccccgctacccaatcgaaaggcgtggctgagggaaacgcggtgggaaccgcccccgactccaggcgactccttggccgggcgggggagagcgtccccgtcagctgagagcatcctcactcggtcagttcctcgggcgagttacggggacgacctgcgggagcacgcgggcagtggccggacgctgaagcccaggagagcgatggagacgtatgcggaggttgggaaggagggcaaggtagagaaaggatgaagacccccaccccagcctcccctcactccatgaaagcccgtgatgcccaatcatgcggtggtgtgtgtgt

SEQ ID NO: 33911 - DNA, 34 bp, Homo sapiens
  misc_feature 1..34: note = chr11:65640238-65640272
  misc_feature 1..34: note = hyper
  source 1..34: mol_type = genomic DNA
gcacagctccctggacgcgcggccccaggaagcg

SEQ ID NO: 33912 - DNA, 73 bp, Homo sapiens; identical to SEQ ID NO: 985
  misc_feature 1..73: note = chr11:65816447-65816520
  misc_feature 1..73: note = hyper
  source 1..73: mol_type = genomic DNA

SEQ ID NO: 33913 - DNA, 142 bp, Homo sapiens
  misc_feature 1..142: note = chr11:65816560-65816702
  misc_feature 1..142: note = hyper
  source 1..142: mol_type = genomic DNA
cggggtccgagggtgcccggggccctgcgcgccgagtgccggtggcttgcctctcagcgcctggatgggatcaggtggcagcgtccgctaggctcgctcctcccggctctgcccgccccccgccccccgccccccatcgcac

SEQ ID NO: 33914 - DNA, 44 bp, Homo sapiens
  misc_feature 1..44: note = chr11:66186333-66186377
  misc_feature 1..44: note = hyper
  source 1..44: mol_type = genomic DNA
actctttcagcaccacggacagcggtcggcgcagtattccttca

SEQ ID NO: 33915 - DNA, 93 bp, Homo sapiens
  misc_feature 1..93: note = chr11:66187374-66187467
  misc_feature 1..93: note = hyper
  source 1..93: mol_type = genomic DNA
ccggcgctgccccttcgcttctcagctgctcccccatcttgcccgcctaggcagggcggggagccctccggagcggtgcggaggcagccaggc

SEQ ID NO: 33916 - DNA, 390 bp, Homo sapiens
  misc_feature 1..390: note = chr11:66188095-66188485
  misc_feature 1..390: note = hyper
  source 1..390: mol_type = genomic DNA
aattagtgtcagtgccggcccctctctgccctctgcggactcctgccgcgggcttcaggccgccctaaacctggccctgtcgcttccctcaactgaacgcattcagacgccagggtccccacactccattcaagctttcctaacgcagcgccttcctctccgctcagctcccgccaggcttggccccctccgcagcctcctgctcccccctcgcccgcctccctccctctctcattctacgtcatgagatgacgtcggaagccgggcgggaggaggagcccccctccccagtcagcggctcccgctgcagcttgcttagcccagcctcccgctctcccgcccccccggctctaaaacgagccccccacgcctggcaggagctatataagg

SEQ ID NO: 33917 - DNA, 214 bp, Homo sapiens
  misc_feature 1..214: note = chr11:66188570-66188784
  misc_feature 1..214: note = hyper
  source 1..214: mol_type = genomic DNA
cggaggaggaagccgccggtgcgtcgggacgggagcgcaggtgctcgggcacccgagctggagctccgcagccgccggtcatgtaccgctccaccaagggcgcctccaaggcgcgccgggaccagatcaacgccgagatccggaacctcaaggagctgctgccgctggccgaagcggacaaggtccggctgtcctacctgcacatcatgagcct

SEQ ID NO: 33918 - DNA, 257 bp, Homo sapiens; identical to SEQ ID NO: 3770
  misc_feature 1..257: note = chr11:66188852-66189109
  misc_feature 1..257: note = hyper
  source 1..257: mol_type = genomic DNA

SEQ ID NO: 33919 - DNA, 51 bp, Homo sapiens
  misc_feature 1..51: note = chr11:66726274-66726325
  misc_feature 1..51: note = hyper
  source 1..51: mol_type = genomic DNA
gcaagcacaacagttcgcactggggctcaggcatcccggctagacgcagat

SEQ ID NO: 33920 - DNA, 211 bp, Homo sapiens
  misc_feature 1..211: note = chr11:66790706-66790917
  misc_feature 1..211: note = hyper
  source 1..211: mol_type = genomic DNA
gcgggctcctgggagcgtgcccggactgcggcgcagctccggtccgccgccccggcccggccgagcccccggcccgcgccgcgctcctcggaggcgggagcccggcgacactgcaggggtggcgttgccgccggcggccgggctaggcgcaggtgcgtgcgcgctgcgggaggcgggccggcagctggagcccagccggagcggcggcccc

SEQ ID NO: 33921 - DNA, 30 bp, Homo sapiens
  misc_feature 1..30: note = chr11:66791312-66791342
  misc_feature 1..30: note = hyper
  source 1..30: mol_type = genomic DNA
caccctggaggttcccgaggcaggagcgct

SEQ ID NO: 33922 - DNA, 32 bp, Homo sapiens
  misc_feature 1..32: note = chr11:67232123-67232155
  misc_feature 1..32: note = hyper
  source 1..32: mol_type = genomic DNA
ccggtggcccttgaccgcgcagtagatgaaga

SEQ ID NO: 33923 - DNA, 468 bp, Homo sapiens
  misc_feature 1..468: note = chr11:67478815-67479283
  misc_feature 1..468: note = hyper
  source 1..468: mol_type = genomic DNA
cacgcggcccgggtccgcggccgacagctgggaggatctggagcggggccgggtcgcaagaagaccctgaccctgctcccgcgctggggcgcgtgctaagggcccgcagggtttcagctgtattttcgaacccctgtgcttggccgaggggttcccaaggctccactccgccttggagggggctgcggaagcccggaggtgacccgggctctgggaggggcgtccccaatgtgggggaggggagacaggggcctttgaatacagcgcgggactcagagggggtccccccgacctaagacgtggtaaactgaggccggcgaggagggaggctgagtccggggaccaggcggcccctcactgctcctccggtccgtctcccctctgcgcctgttcgtacgggcagggccggcggccgagtccagcgggctcggggccaggcctgggccccgcgggcggcgcctcctcctc

SEQ ID NO: 33924 - DNA, 373 bp, Homo sapiens
  misc_feature 1..373: note = chr11:67895795-67896168
  misc_feature 1..373: note = hyper
  source 1..373: mol_type = genomic DNA
accctcctcccccagcgctactgcccgggccgaattccaaggccagcggctgcccgctgagaaggaatccggaccaacgggattctggcttccctctggcccctcctggcgagagcggcgccgggaggagggggcctcagaaggggcgggcaggggcggggcccgcggggtaggcggagctcccaggaaaacagcgggcggggcctcgcgcgaggggcggggttggcggcgaggcgtcccaggacccccattcctccctccgccccggggcttctggggagcggcgcagcttgactgccaccgactgcgggcctccctgccctacaagcccccacccccgcccccccttgggacctggcgaggagttgccccg

SEQ ID NO: 33925 - DNA, 371 bp, Homo sapiens
  misc_feature 1..371: note = chr11:68451833-68452204
  misc_feature 1..371: note = hyper
  source 1..371: mol_type = genomic DNA
tgagggggggctctccgccgcacccgcctatgatggcccagaggacccgagctcgggtcactcccgtcgccctcggggctcggcgagggtgcaggaggcgggcgctgagccggtgacgcgactccgggcggctcccgggtgcgccgcatatatagcagcggcggcggtggcggcggccacaccgggcggcggacacgtggagggacccggcccgcgccttctgcccctgctgccggccgcgccatgcggtgagcgccccaggccgccagagcccacccgacccggcccgacgcccggacctgccgcccagacccgccaccgcacccggaccccgacgctccgaacccgggcgcagccgcagctcaaggtac

SEQ ID NO: 33926 - DNA, 38 bp, Homo sapiens
  misc_feature 1..38: note = chr11:68452502-68452540
  misc_feature 1..38: note = hyper
  source 1..38: mol_type = genomic DNA
aggggacatcagagccggccgggcgtggagggcttcct

SEQ ID NO: 33927 - DNA, 41 bp, Homo sapiens
  misc_feature 1..41: note = chr11:68607302-68607343
  misc_feature 1..41: note = hyper
  source 1..41: mol_type = genomic DNA
gccaaacgcagcagccgcagcagtatcggaagggacccagt

SEQ ID NO: 33928 - DNA, 43 bp, Homo sapiens
  misc_feature 1..43: note = chr11:69452211-69452254
  misc_feature 1..43: note = hyper
  source 1..43: mol_type = genomic DNA
tgcgggggagagggccgaacgtgacctccgaggtcacccccag

SEQ ID NO: 33929 - DNA, 30 bp, Homo sapiens
  misc_feature 1..30: note = chr11:69452718-69452748
  misc_feature 1..30: note = hyper
  source 1..30: mol_type = genomic DNA
tgtccatgtgccgagcgtgtggctgtctcg

SEQ ID NO: 33930 - DNA, 59 bp, Homo sapiens
  misc_feature 1..59: note = chr11:69453263-69453322
  misc_feature 1..59: note = hyper
  source 1..59: mol_type = genomic DNA
aacacgcgcctgcagcggaattcgctttctcctgaccgaccatccgcccaggccgcggt

SEQ ID NO: 33931 - DNA, 355 bp, Homo sapiens
  misc_feature 1..355: note = chr11:69517081-69517436
  misc_feature 1..355: note = hyper
  source 1..355: mol_type = genomic DNA
aggagctggttgggccggaggcggccccgcctctgcatcctttctggggtgggggccccgggcaggcgcggccacccccgccctggcccctgctccgccagggagtccggggctgcgtgtgaggcctgcgcgggccgagacctcacacagcctcctctgcgcgcggggccgcgggaggggcgcgggttcgttcctttgaactcccagcctttgttcccggccaccagagccccagcgctcgtacacttccggccccgggacctctgcggttacctgggccttccctgccagcccccaccccctgcccccaccagaaagcgtttacaggacaggtgaggcccgcaggaggaaaagc

SEQ ID NO: 33932 - DNA, 55 bp, Homo sapiens
  misc_feature 1..55: note = chr11:69517954-69518009
  misc_feature 1..55: note = hyper
  source 1..55: mol_type = genomic DNA
tctccttcaggcctccgcccggggacaggcgccggtcccccgccccggcgcatcc

SEQ ID NO: 33933 - DNA, 392 bp, Homo sapiens
  misc_feature 1..392: note = chr11:69518209-69518601
  misc_feature 1..392: note = hyper
  source 1..392: mol_type = genomic DNA
tgtgcttctccctagcgtcccgcgctgtttggggactaacggagggatcctaacgtccaggtgccaaaacctggggttcccaggagttgaggggtccgcaggagcctaagggtggcaaaggaaggaagggcgctggggtggggcgcgcgcagcggggtggggtgcgcgcggcggggcgggcgggggtgctggcgggcactcactgtgcgcgctctggccccgcgcgcagtccacgacgccgtcggcacggatgcgcaggaagcagctggagagcccgtgggggccggaggtgtacaggtgccgcaggcggatggggtcgccccagccgtagtgcacgtggggccccgcgtccgagaaggcgagggggcgcccggccacggccagccagaggc

SEQ ID NO: 33934 - DNA, 37 bp, Homo sapiens
  misc_feature 1..37: note = chr11:69519059-69519096
  misc_feature 1..37: note = hyper
  source 1..37: mol_type = genomic DNA
ggaactcctccccaccgcgcagcggccccgaggttct

SEQ ID NO: 33935 - DNA, 243 bp, Homo sapiens
  misc_feature 1..243: note = chr11:69519374-69519617
  misc_feature 1..243: note = hyper
  source 1..243: mol_type = genomic DNA
tttccccggcagttccgacagtctcaggttctttcagcttcatcttcttgcaattcctgccccgccccttttatccgggtaaattgccccccgacggggggccgggcgcgctctcggccggcggggaaacaatggaagccgcgcggactgtaggtggcgccgcagcctcggcgtccgcctgggctttgcgctcctggccccgcgcccctgcctgctccgcgctcgccccggccccgcggctgt

SEQ ID NO: 33936 - DNA, 297 bp, Homo sapiens
  misc_feature 1..297: note = chr11:69588887-69589184
  misc_feature 1..297: note = hyper
  source 1..297: mol_type = genomic DNA
cagcaggcctgggggcggggcgcaggtcattgcggggcaggtgatccctggcccactccgcccctcggcttgttcgcctccggggaccctatttctggggtggggttggggataaagggccagggttcccggcgcagccgcccccaagggcctccagagcccaagctgccctctagggcctccggagcccaagcctgcgctagctcagattagcttgcctgtgtaggggacccccggcggccgcacccagtcccggaccttcagacgcgagcccgaccccagcggttccccagcctg

SEQ ID NO: 33937 - DNA, 100 bp, Homo sapiens; identical to SEQ ID NO: 10910
  misc_feature 1..100: note = chr11:69589407-69589507
  misc_feature 1..100: note = hyper
  source 1..100: mol_type = genomic DNA

SEQ ID NO: 33938 - DNA, 289 bp, Homo sapiens
  misc_feature 1..289: note = chr11:69589824-69590113
  misc_feature 1..289: note = hyper
  source 1..289: mol_type = genomic DNA
ctaccgcggccgtcccgggccccgacatcccggcccgagggccgtgcgtcggtcaggcggtcagtgcgcccgggaagctggggggcagagctgcgcctgtggcgtcccgcgggagcgcacggccgacctcgggcaggagtgcgcaaccgaggaggtgcgggaggcaagcgacggggcccccgggcgccgggctctaccccggctgcatggagcggcgagccgggcggaaagcgcgcggctggagctgggactctgaggagcagtgcgcgcctccctgagcgccaggccc

SEQ ID NO: 33939 - DNA, 521 bp, Homo sapiens
  misc_feature 1..521: note = chr11:69590114-69590635
  misc_feature 1..521: note = hyper
  source 1..521: mol_type = genomic DNA
cccgaggccgagccgctatatatatagcccggcgccccctcctactcgcccgctcccgcggggggccgttcgcgttctcctgggcgcccggggcgctgtggcgttcgcggctggtcgcaggccgcctgccaatcagggccgggggaagggaggaggctggggactagcgccgcgagtgccacctggagggaccccggcccccacccttggctccgcccggcccacggacctgttcgtcccgccccttggcggctcctacacttctgcttttcagccagttttgcctcttgcactttgtccctgcctgtccccgtccccgtctccctctctgctccggccgccttggcgcagccctaactcgggcatccgaagctcctagtgggcgcagaagccagcggctgctgcctgcccttcgcctttcggaggctcacgggaacttggttcctttgctggggccttgaggaccggcctgggaaggaggggtggataagagcagtaagcgacaccggggcctggctggg

SEQ ID NO: 33940 - DNA, 54 bp, Homo sapiens
  misc_feature 1..54: note = chr11:71274712-71274766
  misc_feature 1..54: note = hyper
  source 1..54: mol_type = genomic DNA
ctccctctgcagtcacgcctgagaaccacaagtgagacacggggagaattgcat

SEQ ID NO: 33941 - DNA, 536 bp, Homo sapiens
  misc_feature 1..536: note = chr11:71318274-71318810
  misc_feature 1..536: note = hyper
  source 1..536: mol_type = genomic DNA
taggcggggaaggtgcggggcgaggcggccgcggctccctggcatccctctccttacccccaggctaagctggcggtgctgctggtgacgctggtggcggccgcggtctcctacctgcggatggagcagaagctgcggcggggcgtgcgccagccccgcatcccgtggccccagcacaaggtgcgcagttaccgctacttggaggaggacaactcggacgagagcgacgcggagggcgagcatggggacggcgcggaggaggaggcgccgcccgcggggaccaggcctggtcccgagcaggctggactcggccgccggccctgcccgtaggaacaggcgcaggggggcgactggccagaggagcagtgaggggccgcctggtccacggactcagcctccctcctcgccggccttagtttaccacttcttaggtcggggggaccccctccgagtcccgcgctgtcttcaaaggcccctgtctcccgtcccccacgttggggacgcccctcccagagcccaggtcacctccgggcttc

SEQ ID NO: 33942 - DNA, 66 bp, Homo sapiens; identical to SEQ ID NO: 10914
  misc_feature 1..66: note = chr11:71318952-71319018
  misc_feature 1..66: note = hyper
  source 1..66: mol_type = genomic DNA

SEQ ID NO: 33943 - DNA, 88 bp, Homo sapiens
  misc_feature 1..88: note = chr11:71951172-71951260
  misc_feature 1..88: note = hyper
  source 1..88: mol_type = genomic DNA
ccgccgcgcccttggcgctggccgcgcgctcctgtttgcggaacttggcccggcggttctggaaccagacctgcgggcacaggggcca

SEQ ID NO: 33944 - DNA, 109 bp, Homo sapiens
  misc_feature 1..109: note = chr11:71951583-71951692
  misc_feature 1..109: note = hyper
  source 1..109: mol_type = genomic DNA
ggagtgttccagggccgtggagagcagtttagggcgccagtaaaccttttgtctagggcatccagtcaaggcgggccaactgaacatctgtacacggagttgtacaaat

SEQ ID NO: 33945 - DNA, 282 bp, Homo sapiens
  misc_feature 1..282: note = chr11:71952135-71952417
  misc_feature 1..282: note = hyper
  source 1..282: mol_type = genomic DNA
atacacgcacctgcacgcgagcctcagtgaggtcgatcttgagcgccagctcctcacgcgtgtaaatgtcggggtagtgggtctcagcgaaaacgcgctccagctccttgagctgcgcgctggtgaacgtggtgcggatgcgccgctgcttgcgcttctcgtgcaggccggatggctctgggaagaacttgtagggcactgcgggtgtgtgcaggggggccggggggggggcaaaaaggatgggggagtgagaagcagagttcaacccgttgtgtccagctc

SEQ ID NO: 33946 - DNA, 72 bp, Homo sapiens
  misc_feature 1..72: note = chr11:71952458-71952530
  misc_feature 1..72: note = hyper
  source 1..72: mol_type = genomic DNA
cgtcttggtcccggcagcctggggccgagcgtcctccctattactcaatggagccggcgggataaaggcgga

SEQ ID NO: 33947 - DNA, 231 bp, Homo sapiens
  misc_feature 1..231: note = chr11:71954593-71954824
  misc_feature 1..231: note = hyper
  source 1..231: mol_type = genomic DNA
ttgacctgaagggcacgagacagagatttggcaacgagaaaaaggaacaggagagatgagagggtgaggctcattcctgcggaggagaacctcgtattctgggggtctctcggggcattggagggtctggccaaggcaggaatgggggcggctgagggggacagtcgcattcacttggcgagcgggcccagggattctgcaggaattggagggagggttgggccggggctg

SEQ ID NO: 33948 - DNA, 57 bp, Homo sapiens
  misc_feature 1..57: note = chr11:71955068-71955125
  misc_feature 1..57: note = hyper
  source 1..57: mol_type = genomic DNA
ggggccgggccaggccgggtcggggtcggggtccgggtggaggtcggaagggaggtt

SEQ ID NO: 33949 - DNA, 264 bp, Homo sapiens
  misc_feature 1..264: note = chr11:71955189-71955453
  misc_feature 1..264: note = hyper
  source 1..264: mol_type = genomic DNA
cggccgcactcagcccgggtgcaacgcaagtgcagccagcccggcccgcgcgccttttaacgcgcaggaccccgcggaggggggcggggcggggcgagctccgaaggggcggggcctaggaggcccagacaccgcccaaagccgccccgacccccaccccgaagggtccccgccgccgtcttagggctcagaggtgtggagctgggatgcgcgggaccctatccccggagtccctatcctgccccaatccggaccagaccttcg

SEQ ID NO: 33950 - DNA, 56 bp, Homo sapiens
  misc_feature 1..56: note = chr11:71955705-71955761
  misc_feature 1..56: note = hyper
  source 1..56: mol_type = genomic DNA
gggacagggaagggacgtggatagacagaggaaacagagaccgggagagaaagggg

SEQ ID NO: 33951 - DNA, 248 bp, Homo sapiens
  misc_feature 1..248: note = chr11:71956129-71956377
  misc_feature 1..248: note = hyper
  source 1..248: mol_type = genomic DNA
agggacagccacaagcgcgggagcagaggctgagagcggagagaaaacgcctccggggagcttagacacgagggctggagcgcagaggggcccagggatgatgctggaggctctggggtgcggcctccacggggctgcggagagggagggtcgtgggagccaggtccctctaccctgacttgtcccgaggcccacacgaccttgcaccttcagggcccgcctgcctctccccccgttccctcagctcc

SEQ ID NO: 33952 - DNA, 30 bp, Homo sapiens
  misc_feature 1..30: note = chr11:72388069-72388099
  misc_feature 1..30: note = hyper
  source 1..30: mol_type = genomic DNA
ggagtcaagaaacaccgttttttgttagct

SEQ ID NO: 33953 - DNA, 322 bp, Homo sapiens
  misc_feature 1..322: note = chr11:72432837-72433159
  misc_feature 1..322: note = hyper
  source 1..322: mol_type = genomic DNA
agggcctccctcctacgtgcccaacagcaacaacagcaacggcggcacctcgcttaccctcagacgcctgctgggtcttggggctgaggactcccacagctccggccaggcgggctgcgtatgcccaagaatgtcgtgtacctgcccgtgcaagcctgggtcccgcctgggctggtctcgcaaacagcctggcccctggcccctgggtgggtctgaggctgcgttctcttggaggtttttgagcccaggtatggctttgcacctgtgatttatgtctttaagtgtttgtgaatcacttctctacgtgcgtgtgtgtttgttt

SEQ ID NO: 33954 - DNA, 30 bp, Homo sapiens
  misc_feature 1..30: note = chr11:72929613-72929643
  misc_feature 1..30: note = hyper
  source 1..30: mol_type = genomic DNA
cgagccggcgtgtagcgcataactggacgg

SEQ ID NO: 33955 - DNA, 109 bp, Homo sapiens
  misc_feature 1..109: note = chr11:73019882-73019991
  misc_feature 1..109: note = hyper
  source 1..109: mol_type = genomic DNA
ccgcccccgcgcagccgcgcccgctccgcagcctctcgccgtcggttcgccagctctcccggcgcttcgacgcgccgcgtctggacgacggctccgctgggacccgaga

SEQ ID NO: 33956 - DNA, 36 bp, Homo sapiens
  misc_feature 1..36: note = chr11:74178590-74178626
  misc_feature 1..36: note = hyper
  source 1..36: mol_type = genomic DNA
ctctgggctcccacccgcgctcggctcccttttccc

SEQ ID NO: 33957 - DNA, 205 bp, Homo sapiens
  misc_feature 1..205: note = chr11:74394395-74394600
  misc_feature 1..205: note = hyper
  source 1..205: mol_type = genomic DNA
ggtggccctgggtagcgagcgcggccgggcgggcgccgtggcctcaggggccctccccgggctgggcacccccacgccgcccgggcactgctcgcggccgcgctttacaagcgaaaacaaacacggccacaagcagcccctgtgcgacgcggccccgcgcccgccagcgccgccgccgcccggtcaaagccggctttgtgcccgt

SEQ ID NO: 33958 - DNA, 167 bp, Homo sapiens
  misc_feature 1..167: note = chr11:74441835-74442002
  misc_feature 1..167: note = hyper
  source 1..167: mol_type = genomic DNA
ctcccggtctacttacgggctcgagcgtgggagtccagggggaaccagagcagcgcgagtcccagcaaggaggagaggaccctcacctcgggaaccatcctttccccagggtcaggccgctggtccgggagcggagtcgggaggaagggagacgaaaaggacacgga

SEQ ID NO: 33959 - DNA, 388 bp, Homo sapiens; identical to SEQ ID NO: 10923
  misc_feature 1..388: note = chr11:74442255-74442643
  misc_feature 1..388: note = hyper
  source 1..388: mol_type = genomic DNA

SEQ ID NO: 33960 - DNA, 136 bp, Homo sapiens
  misc_feature 1..136: note = chr11:74442705-74442841
  misc_feature 1..136: note = hyper
  source 1..136: mol_type = genomic DNA
cgggccacggggtttaacccctgactccccgcgacgccaagaatgcaggagggcagagttgagggagacctcaggtggaactttcaggtggggaaggctgagctgtcggggctgcgggtaccgggaaggctcaggg

SEQ ID NO: 33961 - DNA, 103 bp, Homo sapiens
  misc_feature 1..103: note = chr11:74951674-74951777
  misc_feature 1..103: note = hyper
  source 1..103: mol_type = genomic DNA
aggatgaagagaaagcgcagcagccgacagccctgattctcgggagcctcccaccccgcctcccacggcgaggagggcgcggagactccgctgggggcggagg

SEQ ID NO: 33962 - DNA, 303 bp, Homo sapiens
  misc_feature 1..303: note = chr11:74952123-74952426
  misc_feature 1..303: note = hyper
  source 1..303: mol_type = genomic DNA
ccaggggctgctgctcgtggcggcggcgctgagccagcccgcggcaccctgccccttccagtgctactgcttcggcggccccaagctgctgctgcgctgcgcgtcgggagccgagctccgccagcctccgcgggacgtgccgcccgacgcgcgcaacctcaccatcgtaggcgccaacctgacggtgctgcgcgcggccgccttcgccggcggggacggggacggcgaccaggcggcgggcgtgcgcctgccgctcctgagcgcgctgcgcctcacgcacaaccacatcgaggtggtggagga

SEQ ID NO: 33963 - skipped

SEQ ID NO: 33964 - DNA, 242 bp, Homo sapiens
  misc_feature 1..242: note = chr11:74952948-74953190
  misc_feature 1..242: note = hyper
  source 1..242: mol_type = genomic DNA
cgcggacagcggcgccgacgctcgcggagaggaggcggaggccgccggcccggagctggaagcctcctacgtgttcttcgggctggtgctggcactcatcggcctcatcttcctcatggtgctctacctaaaccgccgcggcatccagcgctggatgcgcaacctgcgcgaggcgtgccgggaccagatggagggctaccactaccgctacgagcaggacgccgacccgcgccgcgcgcccg

SEQ ID NO: 33965 - DNA, 313 bp, Homo sapiens
  misc_feature 1..313: note = chr11:75141346-75141659
  misc_feature 1..313: note = hyper
  source 1..313: mol_type = genomic DNA
cgtagtcgagcaccacggccagcgccgccgccgccccggccgggctcgtgcctggcgcctcgggagctactggcaccactggcaccacggccgggccgcgctcgggccgcccggccgcgaacaagctgcggaagtaggcgctgcccgcgctgagcgccgcgcggtggcacggaaagtcgcgcccgccggcgcgcagcaccacgtcggtgagggtgccgctccgccggtaggcgttcagggcctgcagcacgcgctgcgcgtggcacggacccgcgcacggcgcttcgcagcccggctccgactcctccggcgc

SEQ ID NO: 33966 - DNA, 247 bp, Homo sapiens
  misc_feature 1..247: note = chr11:75294375-75294622
  misc_feature 1..247: note = hyper
  source 1..247: mol_type = genomic DNA
cactatccttcccaccggcccgatcccgcgtcccgaggtctcgcggggccaggctgcacgggcggcggagcccggagcccggggcggggccggagatgagcctgcaggcggggggctgtgcgagtgcgcggggacgggggctgctgtttccgagccgagagccctggtagcggggctctgtgggcggagacgccctcccgagcctgggcatcttcggagtgggactctcgggtcggagttccgccgc

SEQ ID NO: 33967 - DNA, 75 bp, Homo sapiens
  misc_feature 1..75: note = chr11:75294662-75294737
  misc_feature 1..75: note = hyper
  source 1..75: mol_type = genomic DNA
cgggtggggagcctcccattccagagaccccccgactccctgcccctcgcggcgtaggggcgccctttctgcggc

SEQ ID NO: 33968 - DNA, 848 bp, Homo sapiens
  misc_feature 1..848: note = chr11:75378401-75379249
  misc_feature 1..848: note = hyper
  source 1..848: mol_type = genomic DNA
tggagggaggctgcacgctaggcctgcgctggggatcctgggccccgggcagcccgcggggagggtctgcgtggtgactcccccgcgctagcagcggccgcgtctcacctgtaggagctgctcactgcactcgccacctcctcgcggatttgccggttgagggcgtccgccgcggcgcgccccctgccagcctcggggccggtggcctggacctgggcctgggccgcgggcagcggcgtctgctcgtgccccaggccctcggcgcggcgcacaatccaggcaggcccggccttcctgcgcgtgtcgcgctcgtccgccccggacgcctttccggccgccaggccacccgctccgccgggggccgcctcctgctcccgggcctcagcggcggcctgcactggccagcgctcctggctctgcggccggcgcttgggcgccccgagaatgggcgccgacgcctgggaggccgcagagatctgcacgggcttggggatccacgggtggtccccgcggcgcggcagcggccaggcgcggaagtccttctggtactgggtctcgcgctcgaagggagcgtcggagggctggtattcgctgcgcggccggcagctgggctcgggccgctgcaccttccaggctcggtaatcctgccgcatcaccgagtccgcggggccggaggtggagccggagcccaggcccgggcccggcccgctccggccggggcccgccgccggctcgcgctcgccggtaggcccaggcgctggccccgttgcccgggcaactgcatccaactcgccctgggctggctgcgtctctatggcaaccgcgcgcgccgaggggggcgcgagcgc

SEQ ID NO: 33969 - DNA, 803 bp, Homo sapiens
  misc_feature 1..803: note = chr11:75379282-75380085
  misc_feature 1..803: note = hyper
  source 1..803: mol_type = genomic DNA
cggcggggcgcccgggtgctcggtggcctccgagtacttggtgaaaaccagcggcacagcgatgtccgctttgtccaactggttccagaagcgggcgatgcagcaggccctcgtgatgcacggccacgccatgatgctagctgaaaagccggcctcctctttcttcttgtggttctaaagcaagtctctataatcttccttcagcctccgatcctgaccggccaatgtggttcccaccgttttctacccccgatcagccggagctagttcgccctcctccctcagcgagcacccggggagagctgtcctaggagagtctgtagagtccctcgattaccggtcgcaaacgcctttgggagcgcagtctgctgcgagcgccgaagggtgagacgcacggcgttcccgagtccccggcgagggtgtctgggacgcgcccctccctgcggctgcggcggcgcacagacctcggtcgagcgaggcgacgtgaggagaggtggctacaggcttaagccatggcgcagaggaggggccgggcggtgtggccgcagggtccgcggaccgggctcgagtctccttcctgccggcgtcctagtgcagccggccacctagcagggctgggaggccatcacctccagcggagaccgagcattgctgcctccgccgctgcccgcgaggatgccgcagccgccgccgccaccgcctcttctcctgggaagcgaccccacccttttctgcagctctcggtctccgccgctgcccgcgaatgatgctgcagccgctgccgccgccgcctctgcctctgc

SEQ ID NO: 33970 - DNA, 358 bp, Homo sapiens
  misc_feature 1..358: note = chr11:75863301-75863659
  misc_feature 1..358: note = hyper
  source 1..358: mol_type = genomic DNA
aggacctttgagtcacgtctctgcctgacctcagccctgcgggccccgttcccgccattccttcctgcctctcacgttgactgggctccccctgtcggtcggcactggctgaacagccatggagtggcgctttggggaaaccacgggcgaccaggaaagatctcaggcaagcctcgggtaagtgagctgtaaactgagacctgaacccagacacagcccatgccaggccgagcgaagagcctgtgcaggggcttggagtagagaagagcacggctcctgtgaaggattcagaggctggagctgggcgatgggccaccgcgcggaggaggcgcgggcggtggtccgagttcctcaaggg

SEQ ID NO: 33971 - DNA, 218 bp, Homo sapiens
  misc_feature 1..218: note = chr11:76032896-76033114
  misc_feature 1..218: note = hyper
  source 1..218: mol_type = genomic DNA
tgccctgcccatgcccgccccacaaggcccacgcttgcgccctcgggctgcgcagggcgagggtttgggggcgcggtactgacgggtgtccaggcctctcctcgaagggttccgcgcgcagaaaggtgggccggggccagaagacgcgctggaaaggcgttttctgccccctccgggcctcgggaatatttgtgggctgccggcggggcaggcggggt

SEQ ID NO: 33972 - DNA, 127 bp, Homo sapiens
  misc_feature 1..127: note = chr11:76382096-76382223
  misc_feature 1..127: note = hyper
  source 1..127: mol_type = genomic DNA
gtccggaggggggcgcggtggctctaggagccgcaggtccacagaggaaatccggcctggccccgatttcccagctgctggcgccgccgcacttaacgcgggggcaaacaggcgaggtgacggcggg

SEQ ID NO: 33973 - DNA, 427 bp, Homo sapiens
  misc_feature 1..427: note = chr11:78672891-78673318
  misc_feature 1..427: note = hyper
  source 1..427: mol_type = genomic DNA
ctgatgtttccttctcgtgatgtctgtctgtgcatctttgtcggtacatctgcctgtccgatgtctctcatgggggttggggacagaagcagccctccaactcttgcacactccagcggcgccgcggggcaagagcggggctgcctgagcccgcggagccacgtcaggcccccagctcccccggatcccaccacgcaccaggcccctccgcccggcaagtggcccaagcaggcatccgcaacggaaggacaattttaaaaacaaaccctcaaaagtaggaagagagagggacttaccgttcgccgcgacccccaggctggcggagccacttttaactaagaatgaattagggacaaactcttcctcagagtctgagtccggggttggctgggccacaccgttgcctagcaaccgcctctggctctca

SEQ ID NO: 33974 - DNA, 66 bp, Homo sapiens
  misc_feature 1..66: note = chr11:79148413-79148479
  misc_feature 1..66: note = hyper
  source 1..66: mol_type = genomic DNA
agcgcgctgtgagtccgcaggaacgcggccgggccggggacgggagaaaggcgcggccgggaccct

SEQ ID NO: 33975 - DNA, 142 bp, Homo sapiens; identical to SEQ ID NO: 10935
  misc_feature 1..142: note = chr11:79148873-79149015
  misc_feature 1..142: note = hyper
  source 1..142: mol_type = genomic DNA

SEQ ID NO: 33976 - DNA, 479 bp, Homo sapiens
  misc_feature 1..479: note = chr11:79149239-79149718
  misc_feature 1..479: note = hyper
  source 1..479: mol_type = genomic DNA
cttcagcgttccccacggctgtgtcagggctggggtggcttatccccctacagacgaaaatcaagatttaaaagcatactcttactgtggtttctctatcaaagcccatcaacgtgatacacaggctgcggcgctggagggaagcggcgaaacggggagaataaacgcaacagaagcaaactgctgtctgcagaggcgagaggcgaaggaacggaagccatacccgaccccagccccatcccgtccccatcagcgccgggctagcgcaggaaaccaggaataggtgtaggtaagggtggcagcccggcagagccagcgttctactccctctaacccctcgccagcgtgggcctggatggctgggctgcctgggcatctccaagggggaccaggcaccgcgggcaggtttctaaacacgtgaagggcacagggcttgaaagacaaggaggggcgcccaggaagggcggaaaagaggggct

SEQ ID NO: 33977 - DNA, 141 bp, Homo sapiens
  misc_feature 1..141: note = chr11:79149929-79150070
  misc_feature 1..141: note = hyper
  source 1..141: mol_type = genomic DNA
catcgcacaagtgggcgccgtggtgcgaggcgtatcctagctacccaggccggggtgggggcgccccggtacttacactccccaagcaggcaaactttcaggcttgtctttcgagaaccgggagctcgcatcacagttccg

SEQ ID NO: 33978 - DNA, 47 bp, Homo sapiens
  misc_feature 1..47: note = chr11:79150289-79150336
  misc_feature 1..47: note = hyper
  source 1..47: mol_type = genomic DNA
ctggctgcctccctgcgcccctttcactgcgtcgatggtttacagat

SEQ ID NO: 33979 - DNA, 180 bp, Homo sapiens
  misc_feature 1..180: note = chr11:79150890-79151070
  misc_feature 1..180: note = hyper
  source 1..180: mol_type = genomic DNA
cgggagccctccaagcgtccatctggcggctgcagcctcagttggctcctagacgaacatcaataccgcggccgggcgcccggtgaggagaggcgggcgccccgcgggttgcagagggcgaggagctggggtcgcatctccaggatctgagctccaaccaccgcccgtgcggggctgctg

SEQ ID NO: 33980 - DNA, 40 bp, Homo sapiens
  misc_feature 1..40: note = chr11:79151349-79151389
  misc_feature 1..40: note = hyper
  source 1..40: mol_type = genomic DNA
aacagcttgcctcttcggccacccgcgccctagcctccct

SEQ ID NO: 33981 - DNA, 205 bp, Homo sapiens
  misc_feature 1..205: note = chr11:79151681-79151886
  misc_feature 1..205: note = hyper
  source 1..205: mol_type = genomic DNA
aggaaggagcaggtccgggctctgcgctcagctccagcgagaccaacaatagctcccgcggggagcggagccccagcgagcctccagccgcgcgcgcacgaccggctcccgctcccggccgctcccggccggcgtccctgccagcactgctgccccacatgaaacagctgcaatcccgaggcttctggggggttggggcgggtgt

SEQ ID NO: 33982 - DNA, 264 bp, Homo sapiens
  misc_feature 1..264: note = chr11:79152006-79152270
  misc_feature 1..264: note = hyper
  source 1..264: mol_type = genomic DNA
cagaaagagagggcgagcgagagagagacacacacacacacgcacacgcacacgcaggttacatgaatgggaggcggtagccaatcctacgaggccggcgagccgcgcggcgcactggcgctgggagcagggccgcactccggcgcgggggggcgccacgcaggtgatgggcgcctctccgggggccacgcgcggccgctccctcaccccagtctcggttcctctgtctccttcccccttcctctccgccgccttctccatctt

SEQ ID NO: 33983 - DNA, 30 bp, Homo sapiens
  misc_feature 1..30: note = chr11:79152805-79152835
  misc_feature 1..30: note = hyper
  source 1..30: mol_type = genomic DNA
ctcgaatgtttggatcgtgatggcaagcac

SEQ ID NO: 33984 - DNA, 149 bp, Homo sapiens
  misc_feature 1..149: note = chr11:82443420-82443569
  misc_feature 1..149: note = hyper
  source 1..149: mol_type = genomic DNA
tttaggagaaacccacggaggcgcggcgctctccacagccgtctctaatgaagggaagcgtgcctcgaagtcagtcccggtgcgccccctcctcccccggcgccccttcccaaaccccgtcggatctccaaaggctggaataggcggtg

SEQ ID NO: 33985 - DNA, 69 bp, Homo sapiens; identical to SEQ ID NO: 10941
  misc_feature 1..69: note = chr11:82443651-82443720
  misc_feature 1..69: note = hyper
  source 1..69: mol_type = genomic DNA

SEQ ID NO: 33986 - DNA, 153 bp, Homo sapiens
  misc_feature 1..153: note = chr11:82444032-82444185
  misc_feature 1..153: note = hyper
  source 1..153: mol_type = genomic DNA
ccgacgggccacacccgccgccgcctgcccgggacggctccgtgaagaaggacggaggcagattgcgtgcccgcagcgggaccttcctggcccctgggatcgccgtggcccccgcggggcctgccacgtcccctcccgcgcccccagtgcccg

SEQ ID NO: 33987 - DNA, 599 bp, Homo sapiens
  misc_feature 1..599: note = chr11:82444593-82445192
  misc_feature 1..599: note = hyper
  source 1..599: mol_type = genomic DNA
gcacgtcccctccttcggctcccgacagcagcgcacccgccggagccccggtctcatcgtcctcgaaacagcagcccttgtccagggctccgaaggcgccccctagcccgtccggggagcccccgaagccgaagggcacgaaagggtgcgtgctgaggagcgccgcctgcaccgccatcgccgcggctcccgggctgtccgcagcgctgcccgtgcgcccccgccagctcctgcccgccgcccagacccagctcccgccccggcgcggcgcgcgcggcgcagcctactagttccgggcctggctcgctgcgctgcctcccgggggagctcattaggtcttgtaagcaaggggcggagggagggagcgcgcggcgaccgtcccggtggtagaggggaggggcttacttagcctggcttggaggagtggggggtcgctttagttttctgagctttctgaagctcaacgccttaactccttcgtttccctttgccccgtggtgtttctcttgactcctctaaccgcaaggggtgaggaagagatggctggtctcaaactccagttcaggcccatgaggccgctgcagcgcttgataggcttc

SEQ ID NO: 33988 - DNA, 83 bp, Homo sapiens
  misc_feature 1..83: note = chr11:84431452-84431535
  misc_feature 1..83: note = hyper
  source 1..83: mol_type = genomic DNA
gcggcagtggcagctcgctgggggacccaaacgctgtgctcgccgggcacatggagcgacagcctagaccgagctgccgcttc

SEQ ID NO: 33989 - DNA, 164 bp, Homo sapiens
  misc_feature 1..164: note = chr11:84431536-84431700
  misc_feature 1..164: note = hyper
  source 1..164: mol_type = genomic DNA
atcactgccccctgcacccgccgtggccatcccggagccccggtggaagcaacgccgcgggcaagtaccgagcctctcggggtctcccttccctggggaacgaggcgtgtggggggagggacagaaccaagaaagaatttttccccctacggtgaatttggggg

SEQ ID NO: 33990 - DNA, 316 bp, Homo sapiens
  misc_feature 1..316: note = chr11:84431954-84432270
  misc_feature 1..316: note = hyper
  source 1..316: mol_type = genomic DNA
agtcactgtggggagcgctggccgggcaagtggggtgggaggaaggggctgagaaagggaggaagcgctgtgcttgccagactggccctgcctttgggcgctcttggtgccacgaaggagtccccagcgtgggagcgcgggacctccccgcgctgacgtgaccccgagactgcatttggcccccaccgctacagccacccgagggtagaagacctccgaggccgacttcccgggaaggggaggcccgctcggagcgcggcagggaacttcctcccagccctttgacaacagcatgccttgccgggggcagagggcc

SEQ ID NO: 33991 - DNA, 78 bp, Homo sapiens
  misc_feature 1..78: note = chr11:86085784-86085862
  misc_feature 1..78: note = hyper
  source 1..78: mol_type = genomic DNA
cgagcgagcctttctcgcgtcccagcaacgcgcccttccctctgccgggcctattctccctggtgcccctcccttcct

SEQ ID NO: 33992 - DNA, 60 bp, Homo sapiens; identical to SEQ ID NO: 3775
  misc_feature 1..60: note = chr11:86085931-86085991
  misc_feature 1..60: note = hyper
  source 1..60: mol_type = genomic DNA

SEQ ID NO: 33993 - DNA, 257 bp, Homo sapiens
  misc_feature 1..257: note = chr11:86382846-86383103
  misc_feature 1..257: note = hyper
  source 1..257: mol_type = genomic DNA
ttcaggggcacagggcgcgccgggccaggcttggagtggcagccttgggcgggcgcggtgggtgtccagcgcgggagggcgccgcaggcccggcccggccagggagccagccgcgtgcctgtccccagcgcggcacccatggtccttggcagacctggcacgggagagaaagcaaggtcagggcctccttccagccagccaggacccacgcgcgctgcggggcaccgggcctgatccggggacgcgccctctgggag

SEQ ID NO: 33994 - DNA, 190 bp, Homo sapiens
  misc_feature 1..190: note = chr11:87908294-87908484
  misc_feature 1..190: note = hyper
  source 1..190: mol_type = genomic DNA
actggaaaccggccgcgaggcgctctatccccctgaccccctccccccgcgctcacctgcgatatcccagagctgcaggcgcaccacagtctccgggtcccagtggagcaccttgagcgcgaagtccacgccgattgtggcccggtagtgcgaagagaagttctggtgcacgtagcgcttgatgatactg

SEQ ID NO: 33995 - DNA, 226 bp, Homo sapiens
  misc_feature 1..226: note = chr11:88241750-88241976
  misc_feature 1..226: note = hyper
  source 1..226: mol_type = genomic DNA
cagggacattcacaacgacgaggagctctgagtgtaatctcttatgataagagtgtcatatttgggagacgacgggatacagagggccgactcggacactggcgagttgggggttgtgctccccgagtccaccgagtctctgaagggggacggcggggtgagagccaccagctcctccaggtctggcttggcggccgcagcctcgggaccggccgcggggctctcc

SEQ ID NO: 33996 - DNA, 145 bp, Homo sapiens; identical to SEQ ID NO: 989
  misc_feature 1..145: note = chr11:88242130-88242275
  misc_feature 1..145: note = hyper
  source 1..145: mol_type = genomic DNA

SEQ ID NO: 33997 - DNA, 266 bp, Homo sapiens
  misc_feature 1..266: note = chr11:88242358-88242624
  misc_feature 1..266: note = hyper
  source 1..266: mol_type = genomic DNA
cgggcgccgggaagtgctcctcagcctcggccacatcatacagcgccttggggccggcgtctggggactcgggcccgcctgggccggcgcctgcgcagcccgcaccgcccgtggcccccacgcccccagcgctcccgcctgcgccagcgccagcgcccaggccacggctctccgtgctcttggggaagggcttgatgacggccgtttggttggggttttctttcttgttgatgtggatggacaggcgctgccacaggtgctgcccc

SEQ ID NO: 33998 - DNA, 185 bp, Homo sapiens
  misc_feature 1..185: note = chr11:88798746-88798931
  misc_feature 1..185: note = hyper
  source 1..185: mol_type = genomic DNA
aaacttgcaggacctcgtagcgttcctggctctaccagccctccacctgcccaccacttgccctcctgggtctttttagccccagctcccgccccttgcttgattgctctccatccctgcactgggggaggggctccagcggtatcctatatccgtggtaactatagccaagagaaagaaaaagg

SEQ ID NO: 33999 - DNA, 247 bp, Homo sapiens
  misc_feature 1..247: note = chr11:88798965-88799212
  misc_feature 1..247: note = hyper
  source 1..247: mol_type = genomic DNA
cgcccccaggcagccgctcctcgagggcttcctgcgctctcgtagcggccttggctgcagctggagcgctagtgtcggcgatggaggcagcggtgacagcaggcagaacggctgcggggcccgcggcggtggcgctcgctctctcgcgccagcgccgggagcacgtgccgcgctcgggcagacgcagctggaagcgcagcgcagggctggcttatactcccgcagcgcgcggcgggggttggcagaa

SEQ ID NO: 34000 - DNA, 124 bp, Homo sapiens
  misc_feature 1..124: note = chr11:89224502-89224626
  misc_feature 1..124: note = hyper
  source 1..124: mol_type = genomic DNA
tgccgggccgctgagcgaggaccgagggtcaaagactgagtggaagcccgaaggcccggcgccgagccagcccgggcggggtctgctacccagagccgggttttccgggcgccctgactcccac

SEQ ID NO: 34001 - DNA, 569 bp, Homo sapiens
  misc_feature 1..569: note = chr11:91957315-91957884
  misc_feature 1..569: note = hyper
  source 1..569: mol_type = genomic DNA
gaagagattggaccacgttagctgcttagtctagttccctcctccacaaggcaatcggatgaccccaggatctcaatgtttaggaaagtcgtaggagccctcactgggaggcacatttttagtccagaggcacgacatttgatggtttaatcttcacactacaaactagccttgggacgttatataaaccatgttaacctcgatgtgcctcagtttcctctttgtcccaggagagtaacgcgttctctgtcttcacagggatgtggtgcgggtgagactcaatgcactgtgcgaaagctctcccaagccagcaagcaccacgctctccccgcggcaggaaagtacgttggtgtcatcctagagccccagagggctgagggaagactcgagctctaaaattagccgcttccaggcccggcgccgggaatgccctccagttcgccgcgcctcctccgccgccccctcccgcgcgccccctctcccctgcgccacgctcctagatcgctagtcatccccgccgccgaggctcctctccccctcgcccttttcgctcgcggtttgggaggagg

SEQ ID NO: 34002 - DNA, 67 bp, Homo sapiens
  misc_feature 1..67: note = chr11:91958196-91958263
  misc_feature 1..67: note = hyper
  source 1..67: mol_type = genomic DNA
ctcagtcccggctagcgcgcggtgggcgctgcggcggcagcagccgggggaccggctcgcccggagc

SEQ ID NO: 34003 - DNA, 626 bp, Homo sapiens
  misc_feature 1..626: note = chr11:91958569-91959195
  misc_feature 1..626: note = hyper
  source 1..626: mol_type = genomic DNA
ccccgcggcgggagccgggaggtttacacggagagttggccaagtttggggctgaggatctggggaggggttgcgaggggggttgcggatcagtgcacccatccccggctcccagccgcccctgcaggtggatgagaaggttcaggtggcgagcctgcttggcagccggtgcctctcgggcgcagtgggggatgttcagatgccgatggatgatgcacttaggggaccccgaggtgcaagttgggtcatcgctaggcgaggcgcggcgcagagagggagcccagcctccactttcgctaggaaagggaaagggttaccagtctgcgggtccgttccccacgcctgactcgggcttgcggggcttgtggtcagggtgagatgtagtgaacggcggcggcggctcttcgactggggacgacatcctttacggagtggttggggacagagactgtccctgctatcttgacaaggagagggaaccggaatgctttgcgagagtgcatgatttttggcgggcgtgtgggaaggctgcttgtctttgaaaagaaagcagcgcgggtctgaccatccccaggagtgcggaggagctgtctccggattgggggcgagaacgccaggggcaccag

SEQ ID NO: 34004 - DNA, 120 bp, Homo sapiens
  misc_feature 1..120: note = chr11:91959509-91959629
  misc_feature 1..120: note = hyper
  source 1..120: mol_type = genomic DNA
catgattgggctttgcggaaagcaacttttattcactttccaccgttctcctcttgtgggcggggggtggcgggggcgtgcttggggcaaggatgcaggggtggccggagtttggctgcg

SEQ ID NO: 34005 - DNA, 58 bp, Homo sapiens
  misc_feature 1..58: note = chr11:91960056-91960114
  misc_feature 1..58: note = hyper
  source 1..58: mol_type = genomic DNA
cctctcccctcctcccgctcctctccgcccccagactctggcgcgtttgttttccaag

SEQ ID NO: 34006 - DNA, 101 bp, Homo sapiens
  misc_feature 1..101: note = chr11:91960369-91960470
  misc_feature 1..101: note = hyper
  source 1..101: mol_type = genomic DNA
ttctcccacttgcctcggacatattaattttctggccccgacgctagtcttttcaaaggcgagtccggggtagtgggaggaaggggcgggggagcaggcct

SEQ ID NO: 34007 - DNA, 73 bp, Homo sapiens
  misc_feature 1..73: note = chr11:92675236-92675309
  misc_feature 1..73: note = hyper
  source 1..73: mol_type = genomic DNA
tgtaagcaaaggctccggagagctggtgaaagatgcttccttcccttctctcctaccccgacatcactgaatg

SEQ ID NO: 34008 - DNA, 365 bp, Homo sapiens
  misc_feature 1..365: note = chr11:93063583-93063948
  misc_feature 1..365: note = hyper
  source 1..365: mol_type = genomic DNA
agagggggcactggacgtataactgcgggacagcgaggtcgcgctcgcgcggggtgaggttggaggcagccgaggagccgcacagggcagcgcctgccgccgccgccgcgcccatcccccactccgacggccacgagttcgggccgcgacgtccccatggcaacacgcggcggcgccgcgcgcggggagggagaggcccaactgcctcgttggtcgcgcggcgggagggcccaggcggcgggagcgcggcggcgggtggcggggccccttggggcgggcctggcggggcgggaggtgacatacgcggtcctgcgccctcgcctcagacctctcgggcgagcgcggcgcagcgcaggtaatggctc

SEQ ID NO: 34009 - DNA, 415 bp, Homo sapiens
  misc_feature 1..415: note = chr11:94134049-94134464
  misc_feature 1..415: note = hyper
  source 1..415: mol_type = genomic DNA
gcgtgatcattatgtcggcaactgccaggttgacgatgaagaggctggtggccgagtgcattcgctggttcttgaagatgacatgacagaccaggacgttgccaaagagtgagaagacaatgatgaaggagtaagccacaatgagcagggctttcaccgtggggttctgggactcagcgccgtagcgcctcctgcccacaaagttctgccagtcggagaaggtgtagttgttccaagagaagaagtgcgaggcattgggcacggccagggccgcctccgcgctctgctcgtcggcccggccctcgtggggctcggtggctcgcaccaaggggaggagacagagcagcaagaggtgagggaccattttgcaggagccacccctcccctgggagcctgcgggccgggcgtcccctcc

SEQ ID NO: 34010 - DNA, 171 bp, Homo sapiens
  misc_feature 1..171: note = chr11:94134682-94134853
  misc_feature 1..171: note = hyper
  source 1..171: mol_type = genomic DNA
cgacggtgacgcgctctggctctgacaagcctggctccccccaccctaccgggtggcgccgttgctgaccccacgcccagccgttcccactcccgcctgaaactcctccgacagggcttcgcttcgggggctcagtccccagcgcgtacacactcgcgtggtgtcggctta

SEQ ID NO: 34011 - DNA, 52 bp, Homo sapiens
  misc_feature 1..52: note = chr11:94277933-94277985
  misc_feature 1..52: note = hyper
  source 1..52: mol_type = genomic DNA
ggctgcgcttcaacatcagcggctgccgcctgctcaccgaccgcgcgtccta

SEQ ID NO: 34012 - DNA, 248 bp, Homo sapiens
  misc_feature 1..248: note = chr11:94473423-94473671
  misc_feature 1..248: note = hyper
  source 1..248: mol_type = genomic DNA
agcccacagaacaaacgatttcccaagcatcagaggagggcagacataacataacagagcagggaatcgggttagaacgggttatgctctgattttttggaaaatgggcaaacggggcggggactagggaggattccgccagccgggagttgggaggccgcgcgcgcctctgcggagcgtgacggccacggtcgcctagcaacgagcggggatgcgcggggcgcctgggtgggcgaggggtgctcgcc

SEQ ID NO: 34013 - DNA, 97 bp, Homo sapiens; identical to SEQ ID NO: 3783
  misc_feature 1..97: note = chr11:94473672-94473769
  misc_feature 1..97: note = hyper
  source 1..97: mol_type = genomic DNA

SEQ ID NO: 34014 - DNA, 96 bp, Homo sapiens; identical to SEQ ID NO: 3784
  misc_feature 1..96: note = chr11:94473802-94473898
  misc_feature 1..96: note = hyper
  source 1..96: mol_type = genomic DNA

SEQ ID NO: 34015 - DNA, 58 bp, Homo sapiens
  misc_feature 1..58: note = chr11:94474489-94474547
  misc_feature 1..58: note = hyper
  source 1..58: mol_type = genomic DNA
ggcttctgaaacctgcgctcatcttgccgggaggacacagcggcgactggttctgact

SEQ ID NO: 34016 - DNA, 577 bp, Homo sapiens
  misc_feature 1..577: note = chr11:94501445-94502022
  misc_feature 1..577: note = hyper
  source 1..577: mol_type = genomic DNA
gtagggttctagtgacgagcccgggcgaccctccccggcccgcgcgcggggagcggggagcgcggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaaggtaaccagcccccactcgaggtgccgggagggcgtctccgagtctcccacgcgaagaacccagtcgccccgggctccccgggcccctgctgctcacggaagggggcagcttctgggggcccggggctgagatcccagattgttgtttttaagcgggttcccttgccccgctccaggtccagttgcctgcgggccgggcctcagcgtcttgccgccccgcgacccacgttgactgaagttgtggccccggggtttgggccccggggtgctgcgcgcccgacgcggggctggcctttc

SEQ ID NO: 34017 - DNA, 15 bp, Homo sapiens
  misc_feature 1..15: note = chr11:94502757-94502772
  misc_feature 1..15: note = hyper
  source 1..15: mol_type = genomic DNA
cgaagatttttgcct

SEQ ID NO: 34018 - DNA, 34 bp, Homo sapiens
  misc_feature 1..34: note = chr11:94884262-94884296
  misc_feature 1..34: note = hyper
  source 1..34: mol_type = genomic DNA
cctggaccctctaaccgctcggtggggtcagagc

SEQ ID NO: 34019 - DNA, 522 bp, Homo sapiens
  misc_feature 1..522: note = chr11:98891367-98891889
  misc_feature 1..522: note = hyper
  source 1..522: mol_type = genomic DNA
gttgcagagcagaaacgctcggggaaggggggcaggtcctctgtacttagcagggaaggaaaatgccggttgactagtgagacgagtggagaaacacagagcaccctccgggaggcgcacagttcgttaagcccagggacatgctcaatgaacctttgcagcaagaggcagtgaggcgctggacgcgggcgccggtgacagcgcgggcggccggggaggggcgaggggccgccccgggaggacacagccagtcagaggcgcggggcgcagggcgcgcggacgcattggaggaaaacacgcgagccccaaacacaccagccgcaggaggcgccgcacctacttcccaatataaccaactacggcgtgggggagcggaactgcgagaaggcggcagccaaagtgccattaaagctcggggcggagaggatgcgttacctgggtcccgtctgctgcgagaggcagggcaagctggaggattccctctgaatgattaagaactccgcaattcgcctctgccacagg

SEQ ID NO: 34020 - DNA, 762 bp, Homo sapiens
  misc_feature 1..762: note = chr11:100997659-100998421
  misc_feature 1..762: note = hyper
  source 1..762: mol_type = genomic DNA
gctttcggttctggccggccacctctcaagtcccacccctcccgggggaacggtgccttaactcctctccaagacaagcactcctggtaaacgtccttcttctaagaaagaagcatttcataaagcccccaactcgccgcgcactttctgccccactgggctacagcggacctagtgtgacgctgcacgttttaaatcggggttggttctgcttcggaatctggaagattcggaaagttaaaaaacaaacaaaaaaacagctttcagggaggcacgccccaaaaatagtatattctgcgcccaccttcgtgtccccaagagtgaggagaggagggaagaagaagggaggcaactgcccctgtgctgtgtcccgctgcccaccctctccggccgccccggggagcgcagcggtgcgctggggctggggctgagggttggcggccgccgccgccaacggaaccgctactcccggacgcgctgggcgtgccccgtcccgggccctcacctcaggtagttgagatagggcgggtagacctgcggcaggccctccttgagcacggcggcctggtagccgagctgcgggagcccgttgaggccgagtgcagggtagagcgcgggggccgccccggcggcggcggcagaggcggaggtggagggcaggccgtcccgcgggagcaggcagccgctcgcgcccggcgccttgcagggcggcggcgcgaacgggccctgctggggcggcgcgccctccgctttgtacaggat

SEQ ID NO: 34021 - DNA, 78 bp, Homo sapiens
  misc_feature 1..78: note = chr11:100998667-100998745
  misc_feature 1..78: note = hyper
  source 1..78: mol_type = genomic DNA
gctatagagagggtacgcgtcgtccttgggctcggcgtcgggcgggtacgcgcagtcggggaagtcgcctacagcgac

SEQ ID NO: 34022 - DNA, 88 bp, Homo sapiens
  misc_feature 1..88: note = chr11:100999617-100999705
  misc_feature 1..88: note = hyper
  source 1..88: mol_type = genomic DNA
gagggaagagtagcccgtccagggagataggtatggccgaaacttcaggcaaggtgtccgaggtctggctccccgggaacggacctgc

SEQ ID NO: 34023 - DNA, 428 bp, Homo sapiens
  misc_feature 1..428: note = chr11:101453090-101453518
  misc_feature 1..428: note = hyper
  source 1..428: mol_type = genomic DNA
tagagctgagaacctcgggaaaccgcttgcgggtggatgtgacaagtcaggaaacttgactacccaatcacccaaaggggcaatgggacagaaatgctatctgcccgctgcacatgtggtcacagcggtgtcggggaagcggagtcttttcttctggagtccactctgcttactccctacctcccctcccgccacccacccagctaaaaaaaaaaataccctagattcataaacaaaagcttgcagttacccacagcccaatacaaacgacccgacgccctcacttctatagcccgtgagtctcccagcccctaacaggctcgtctccccagacgccccgggtgaaaaggttcgcgccgccggtggagagtcctattggttctatttctgtcttcactccaaggccccaggaccggggagaggtcctg

SEQ ID NO: 34024 - DNA, 187 bp, Homo sapiens
  misc_feature 1..187: note = chr11:101454510-101454697
  misc_feature 1..187: note = hyper
  source 1..187: mol_type = genomic DNA
gggcagagagggcacaggcggggccgctggtggtagcgaagcgtaagagcggagagcaagggagacggagctgaagagttactatgtcaacagagactctccagccctcagctcccgccttcatcccccgcactctccgtcaagatccccacctttaaagggatccgagcgacgttctagaaagcag

SEQ ID NO: 34025 - DNA, 154 bp, Homo sapiens
  misc_feature 1..154: note = chr11:101918352-101918506
  misc_feature 1..154: note = hyper
  source 1..154: mol_type = genomic DNA
tcgcggctgtggaggcgcaggccgggcgtcgaggggcccgcgcgggtcggcgccattctgagtgaaccctgaggcttcctgagtgaaccccgaaccacccgggaagggcggatgctgtgggtgggatcggttatcggtgcgctctgagagggtg

SEQ ID NO: 34026 - DNA, 30 bp, Homo sapiens
  misc_feature 1..30: note = chr11:102980458-102980488
  misc_feature 1..30: note = hyper
  source 1..30: mol_type = genomic DNA
ggtgcagcgatccgacgcaggaatctcctt

SEQ ID NO: 34027 - DNA, 34 bp, Homo sapiens
  misc_feature 1..34: note = chr11:104034042-104034076
  misc_feature 1..34: note = hyper
  source 1..34: mol_type = genomic DNA
actgctagattgaaacgcacgatttctcctctca

SEQ ID NO: 34028 - DNA, 345 bp, Homo sapiens; identical to SEQ ID NO: 3787
  misc_feature 1..345: note = chr11:104034409-104034754
  misc_feature 1..345: note = hyper
  source 1..345: mol_type = genomic DNA

SEQ ID NO: 34029 - DNA, 463 bp, Homo sapiens; identical to SEQ ID NO: 3788
  misc_feature 1..463: note = chr11:104034755-104035218
  misc_feature 1..463: note = hyper
  source 1..463: mol_type = genomic DNA

SEQ ID NO: 34030 - DNA, 312 bp, Homo sapiens; identical to SEQ ID NO: 10977
  misc_feature 1..312: note = chr11:105481005-105481317
  misc_feature 1..312: note = hyper
  source 1..312: mol_type = genomic DNA

SEQ ID NO: 34031-34032 - skipped (2 entries)

SEQ ID NO: 34033 - DNA, 238 bp, Homo sapiens
  misc_feature 1..238: note = chr11:105481323-105481561
  misc_feature 1..238: note = hyper
  source 1..238: mol_type = genomic DNA
ccagtgtttgtgtgtatgtgagaaagcaaggggcgagcgcgagtgcgagtgaggcaaagatagagcgcatgtctcatccctgcgagcagccactagacgctccaccaccatcttttgcatgtgcaacatttgcagccggacagaaaacctctcccagggctatggagactgcgggaaaaatctggcggctcgcgatggattgctaaggagaactagtcataatcttaaaccaccgaaa

SEQ ID NO: 34034 - DNA, 256 bp, Homo sapiens
  misc_feature 1..256: note = chr11:105481621-105481877
  misc_feature 1..256: note = hyper
  source 1..256: mol_type = genomic DNA
attttaattttagcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtaaggtgtgctccgatggggtgtgcatgtggctggttgtagcagatatccgaaagtgagttaaa

SEQ ID NO: 34035 - DNA, 808 bp, Homo sapiens
  misc_feature 1..808: note = chr11:106888283-106889091
  misc_feature 1..808: note = hyper
  source 1..808: mol_type = genomic DNA
tgtagtcccctcttccgccctagcctaggggatcctctgtcgccggagccactggaaccctaggccgtgcagggtaaggccgggccgccccccagcggtcgggctctgcgctcgcgccccggctcgcccagcgccaactttacagatccgcgttctctcccccgaaggcggtccccccttccgccccccgctcaccgagggcgccgtcaggcggctgatgctctcgcccagcgagtccaggttgacccgcctccggcgctgcaccctcctggccccggcagtggcagcggcggcggcggcagaagcagccggggtcggggccggggcggcggcagcggcagctgcggccgggctgggctccagcggcccgggcgggctccggctgccattccagcagagcctagacagggggcactccccctcctcctccgggctggtctccaggtagtcggagcccagggagctgaaggactcggacgaaatcttccttcgagacatgctgccggcggagctgcagcggccgaggcggtggcggcgaggacgcgagcggcggcggaggcggcggtggcgggaccggcaagcgacaacgttaagcgcgtcggggccgcggggcgctgcggtcgcgcccggcggggcgggagtccccggggccgcggagccccccgagccggctgctcatggcgggaacttggggcgccgccgcaccttggggcccgggctcggcggcggcgccgggctgggctgggggccgccgccgcctctgctgctgctcgcgcggcgccgcctcagcgcccgcctcggcgcatcg

SEQ ID NO: 34036 - DNA, 32 bp, Homo sapiens
  misc_feature 1..32: note = chr11:106889400-106889432
  misc_feature 1..32: note = hyper
  source 1..32: mol_type = genomic DNA
cgttgctgtcctctgcgcgccctccctgctcc

SEQ ID NO: 34037 - DNA, 494 bp, Homo sapiens
  misc_feature 1..494: note = chr11:106889690-106890184
  misc_feature 1..494: note = hyper
  source 1..494: mol_type = genomic DNA
ccactccagaggagacgctttcaggggaagggaaggacaggggcaacattttggcgcccatcctgctggagcagctcctggggacttgtgttccccgcctcgtgcgaggccgtgtgggcgcggagcgagcccagaaaggggcggcagtgaggacagcgtctgctctgacaagacagcactgttgctgagcctcagccgggcggggtgcgcggggctcccggctccgctggctcctcactagtgctggacagctccgcttgccacctatagccgcctttgcaggcgttgagaactggagaacagttcctcctcaaacgacctagcacctggcccgggggaaaccggggaatgatcccacgtccctcatcctcagggctctttgcgccaaatatgcgatctgtttgcacctgactgcaaatgctgctcagaaagctaaggggagtagggataaatgcttctcgaactgactcgccacagcgcgagcatgtcttgcc

SEQ ID NO: 34038 - DNA, 847 bp, Homo sapiens
  misc_feature 1..847: note = chr11:107461623-107462470
  misc_feature 1..847: note = hyper
  source 1..847: mol_type = genomic DNA
tcaccatcttcctgtcgtgggctcctccagggaggccacccgggagcaattaaactgggccacaccagccacctcccacagcagcggggtccgcagatttaaccctttccccccagattccggcactgggtgccgcgctctctcccccagcaccgcgcccgcgcccccggctcccggactgggcatgctcagtagccgcccgcttcgtgctcccagggaagcctctgcacgccctcccccgctgctctcggtcgcctcctcgccgccagccgccccgggtgcatcccggcttgctccgctccacgcgacccagattcctgccccgcccccgccccttccgcgcccgcagccagtgcggcagccgcggccgcccctgtccagcctcggcgcccgggaccgagcgcgtcgctcgccgccgcggagcgcgtagccggagcgcctggggaaggcggagatgaagaccacgccgccgcgcgccgggagctgctgagcctaccgccgccagagtccaggtgattggcgaccccagaggagcctagggagtaggggcgaatgcccttggggaggagagaggtgcggcgaggacgcgaggcatcacgcaagctgcgctgtgcctgggaggcagcagaaatgctaagcatcgggggcagagagggaacgggaatgaaagtgcactctgccttggtgcaggggctccggggtcacccaggacagtgatttccccttctatcctgtcctcccaattaacacccgagaggctgcaggtcggcgcgagaggctgtttgcatctcggcccgggcgtaggtcgcctagcgacctaacgccgagggctcggggaagggatccc

SEQ ID NO: 34039 - DNA, 499 bp, Homo sapiens
  misc_feature 1..499: note = chr11:107799306-107799805
  misc_feature 1..499: note = hyper
  source 1..499: mol_type = genomic DNA
tggatctaccagttccgcctcatcgtgatcggggactccaccgtgggcaagtcctgcctcctgcaccgcttcacccagggccgcttccccgggctgcgctcccccgcctgcgaccccaccgtcggcgtggacttcttctcccgcctgctggagatcgagccgggcaagaggatcaagctacagctctgggacacggcgggacaggagcggttcaggtagggaccccggggaccttgggcaccgcgccgccccctcagcccgcccggacgccccttccccaggcgtccgccccgccggccctggtcgggagaggctctggcccttccctctcgaaagtgcaaacactccattctcgcttcccctttgcccctcctcttccagggacgacttcctcctccgcaatttctcacttctttctttggcgcccatttcctgcgccccctttccatctttcctttcccgcctgaaccggggtcgtcctcgccgccccctcttcccc

SEQ ID NO: 34040 - DNA, 30 bp, Homo sapiens
  misc_feature 1..30: note = chr11:107800015-107800045
  misc_feature 1..30: note = hyper
  source 1..30: mol_type = genomic DNA
cttcacagcaaggagcgctccaacccaggt

SEQ ID NO: 34041 - DNA, 43 bp, Homo sapiens
  misc_feature 1..43: note = chr11:109292787-109292830
  misc_feature 1..43: note = hyper
  source 1..43: mol_type = genomic DNA
gcggtggctgcctgacgtcaccggcctctctggcaataggctg

SEQ ID NO: 34042 - DNA, 284 bp, Homo sapiens; identical to SEQ ID NO: 10988
  misc_feature 1..284: note = chr11:109292891-109293175
  misc_feature 1..284: note = hyper
  source 1..284: mol_type = genomic DNA

SEQ ID NO: 34043 - DNA, 258 bp, Homo sapiens
  misc_feature 1..258: note = chr11:109293506-109293764
  misc_feature 1..258: note = hyper
  source 1..258: mol_type = genomic DNA
agaagagatggagcgcgttcctgcgcgtcagccgcggtcgcggacagaggcagagtgggatgtggtgccaggggtatccccctgggaatgggacccaagggatctgacgctgtccagggagggcgagtctggacggggagggaaaggaagggaggactgcgtacccggagcccgcgcggcggcccggagtgggtgctgggaagggtaggatccaggcgaagacatcaaccgagagggcgcagaaaagaggagagccgg

SEQ ID NO: 34044 - DNA, 26 bp, Homo sapiens
  misc_feature 1..26: note = chr11:109293873-109293899
  misc_feature 1..26: note = hyper
  source 1..26: mol_type = genomic DNA
cgcggtgccggcgcagaccccatcct

SEQ ID NO: 34045 - DNA, 51 bp, Homo sapiens
  misc_feature 1..51: note = chr11:109294138-109294189
  misc_feature 1..51: note = hyper
  source 1..51: mol_type = genomic DNA
tgttcgaggtggtatcggcgaggatctctcgggcgccgctcactccttggt

SEQ ID NO: 34046 - DNA, 647 bp, Homo sapiens
  misc_feature 1..647: note = chr11:110581773-110582420
  misc_feature 1..647: note = hyper
  source 1..647: mol_type = genomic DNA
gcgggggtggggaggcgggggacaggcagacagggctagaaacacccaaatcaattcctcagggagcgaaacggcagaggccggcagcccgcggcccacgtgcacttgctcagggaaccgttccagcgaaacctgacccggatcggaatcctcccgcagcacagcggccgtgtttatcggaatggaacgctacaagttgtcacctgcatccctctcccagctttgacagggaacacgcgctgcccccacgcccacaccgacacccggatccctatccagcccggccagagtcccaggggccagggaccagtgcagggagaaggtcccccacctcagccctcaggacccccaaccacagcccacccgcccccaccctgctcggttctaggcccagccgaacctacatgtccccgtagtgtcgagcgttatcatccacagtcgcccctcaaactgtgacccccacctgggagacccggaatcatccaggaccctggtgtggggggcagtactccccatatctgccccccgaaaactgctatggagcagccgcgcctcggcgggcaggtgagggggccgagcccaccagcgccgcagccccgctgcctaccttcttcagcgccggctgccgctcccgggcagacatcgcc

SEQ ID NO: 34047 - DNA, 608 bp, Homo sapiens
  misc_feature 1..608: note = chr11:110582421-110583029
  misc_feature 1..608: note = hyper
  source 1..608: mol_type = genomic DNA
gccctgactttggggctgacaccgccaaagggcagtcagtgctcgcccaggccacttcgggaggcccaggggcacggcgaggggtcggggaaaggcgatcgcccactacagcccgcgcgcctagactgagggaggagccgggctgcagaaccggcggcggatggagacgggagggaggctgcgaggtcgctcgaggagagactaaggctctagaaacggagaagcgggcgctctgcgggaggcggcggcgctgccgctggccgtcaagggcgggaagtgttctgggactctcattaggggccgcgagcctcgagcgtcaaattcccgcggcgtccgcctagcgcgctgctgtggcgggcgcggagggcgcgcgccggcagtgggggctgcggcggcggagggcacgggcccccgctcagcgtcctcaccttcttggtgcagctgcctcccgcgagccgagacactcctgtcagggaagaggagcgccccggctgtccccctagagtctcctgctggggggacatcgcttccatgaagaaaatcttcaaacaaatcccagcccaggaggaggctacacgatcatgtccgcgggctgccggccggagggg

SEQ ID NO: 34048 - DNA, 1109 bp, Homo sapiens
  misc_feature 1..1109: note = chr11:110583043-110584152
  misc_feature 1..1109: note = hyper
  source 1..1109: mol_type = genomic DNA
cggaggcgcggctgccgtgctcaggcagggagccgagctccgggtgctcgccgcgcgcctcccgtcggggccatgtacctccgcctgcgctcgacaccgcgggctggaggcgagtgcagcggcgacagcccgtcagcgccgcggcccgccccgcctcgggcccgccccctccgctccgggcgccctgcgccggggcccgcccccgcagccctcctcagccctcctccagcctgggccctcctagcctcgtcccagcctgcggcgcgcctggcgggcgtctctctatatatgttagcacaccggccaccggctgaccttttcggtctgtgactccgcgtgggtgcagcccgcaggagctcatcggcctgtgtcacgcacgggggcctctagtgcacggacacgcgcctctcccgccacctgcccactcccaccagaccccatcccttcccgcgccgtgcccgcggcggaaggcgcccctgcagcgcgtgcatccgcggagcggtggcgacctcagcctgagcagaggagttgcagtgattcctgcctcgctttcagcggactgcggagggaatcccccaccccaccccactggggatagggtggcacgtcgcagagtgtcgcagctgtacaaatttggaagcccacagcatcgcctgacctcttgtgcaatcccgaacgctagcctgttcgggtaaccctgagtgggcttctgcagccggtcatgtcagcggcccctgcacatttgcacccgcggtttccgctgtctgcaggctgcagagacgggggcattccaaacgtgaaagagcaatgaaggaaaatgcagacagagcgaggacgccgaaatttggctaagctattgagaaggctacaatatgtggaagtgtttatcagatatctgcgccgagagcataacttcctgtcagcccaaatagaggcaaaaatattttaaaggccaaagaataatcagagggagaggatttggagctgacccgcgttgagctgagtgttgctgcactttgcggggctggttgactggtacggatgattcggtagatggcattcttcccttggagtcaggactagagaagcagtggcggattagtgaggaa

SEQ ID NO: 34049 - DNA, 35 bp, Homo sapiens
  misc_feature 1..35: note = chr11:111170024-111170059
  misc_feature 1..35: note = hyper
  source 1..35: mol_type = genomic DNA
acccagcgcacttcccggcgcgattcctggacgca

SEQ ID NO: 34050 - DNA, 390 bp, Homo sapiens
  misc_feature 1..390: note = chr11:111383125-111383515
  misc_feature 1..390: note = hyper
  source 1..390: mol_type = genomic DNA
ctcccccacccgccccgtctcgcgcccgccccgcccctcggcccgcggggttccaaggacggttggtcgcccccgccacagtcactcggccgctcagagcggcggggcgcacggggtcgagagagccagctctagggtttggggctgggaactgaagcctggcgtgaaggaagtgggagcccgggccgaggaggcgaaggggaaaggaaaagcgaggggaacctgagcgggagggccctgagaggagcgggaggctgcgggaaggggaggcctggcactcctgggggtcatgggggtcggggcgcggctcccggcctgggagggcgcgggtcctccccggcagcgccgcccgctggcccagctacgcgtgttgtgcgctgcgaggccggc

SEQ ID NO: 34051 - DNA, 16 bp, Homo sapiens
  misc_feature 1..16: note = chr11:111383516-111383532
  misc_feature 1..16: note = hyper
  source 1..16: mol_type = genomic DNA
ggggtcccgctgggcc

SEQ ID NO: 34052 - DNA, 348 bp, Homo sapiens; identical to SEQ ID NO: 3793
  misc_feature 1..348: note = chr11:111383557-111383905
  misc_feature 1..348: note = hyper
  source 1..348: mol_type = genomic DNA

SEQ ID NO: 34053 - DNA, 30 bp, Homo sapiens
  misc_feature 1..30: note = chr11:111385419-111385449
  misc_feature 1..30: note = hyper
  source 1..30: mol_type = genomic DNA
ctggtaccaacttggcggttctcggagggg

SEQ ID NO: 34054 - DNA, 16 bp, Homo sapiens
  misc_feature 1..16: note = chr11:111411183-111411199
  misc_feature 1..16: note = hyper
  source 1..16: mol_type = genomic DNA
gattgcctaggggccc

SEQ ID NO: 34055 - DNA, 382 bp, Homo sapiens
  misc_feature 1..382: note = chr11:111411200-111411582
  misc_feature 1..382: note = hyper
  source 1..382: mol_type = genomic DNA
actgaagtattcctccgcccagcgcctcgggcaaacgcgggatctcccagggaagctcggagggggacagggagctggttcccctctgcgactcgcccctctctggctggccgagtgtctggcgccaacctcgctggaggaggctgtcgggggcgggccagccagcggggctgccctcctcgcagtgacgtcccagggggcggaggggcgaccgactgactccgcgccctcccccccgcctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaac

SEQ ID NO: 34056 - DNA, 435 bp, Homo sapiens
  misc_feature 1..435: note = chr11:111411821-111412256
  misc_feature 1..435: note = hyper
  source 1..435: mol_type = genomic DNA
cgtctgagacccacgccagttcccggagctgcgcagttccctgcgcgtcctggaacgctcgaagcccgttcccagtccagagttatgggggtgggttggagaatgtaggagaggtggggcagtgggcaaacctgccccagtgggtgccccttcggcccgctcctttacacgcatcgaatcagtccttgggaccacccccgcggggcaggcttgccagctggcccccgcctaccgcccgctccgggaggcggccgcagagacagcggggtagggatgctggatccccggtgccgtgggaaccctgcctgttactcctcgtctcttctgcggggttggatggctgggtcgagcgcccggtatgagagcgcttagagatcgggaaagaactccagttagtgtgggacgagccccacctgactccggggaatgactctc

SEQ ID NO: 34057 - DNA, 30 bp, Homo sapiens
  misc_feature 1..30: note = chr11:111412594-111412624
  misc_feature 1..30: note = hyper
  source 1..30: mol_type = genomic DNA
ggccctcccacccttcgccttcctgcaaat

SEQ ID NO: 34058 - DNA, 137 bp, Homo sapiens
  misc_feature 1..137: note = chr11:113345029-113345166
  misc_feature 1..137: note = hyper
  source 1..137: mol_type = genomic DNA
ggtgtctcttgtctccgcataccaccctagaggggctctcggtccatcatagagccgggccgagagccgggcggtcaccctccgctactgccgccaccgtcgcctgcactgccgggtagaaacgggtctggcaccca

SEQ ID NO: 34059 - DNA, 320 bp, Homo sapiens; identical to SEQ ID NO: 11002
  misc_feature 1..320: note = chr11:113345418-113345738
  misc_feature 1..320: note = hyper
  source 1..320: mol_type = genomic DNA

SEQ ID NO: 34060 - DNA, 102 bp, Homo sapiens
  misc_feature 1..102: note = chr11:113346239-113346341
  misc_feature 1..102: note = hyper
  source 1..102: mol_type = genomic DNA
gatccccggcctgaacgggtaggaggggttgggggattccgccatcccttgttttgaggcgggaacgcaaccctcgaccgcccactgcgctcccacccacac

SEQ ID NO: 34061 - DNA, 181 bp, Homo sapiens
  misc_feature 1..181: note = chr11:113929598-113929779
  misc_feature 1..181: note = hyper
  source 1..181: mol_type = genomic DNA
gtttctcccaggactcgaccttggcctccagcaatcgcgacagctaaaaacgggtgtctcgcttcgacaatagatccccgcggaccttctggcacctggttcactagcgcccgcgaactctgcctcgggagacttattgaaatccggatgctcaagccgggaggcgcgcagtaaccaggag

SEQ ID NO: 34062 - DNA, 32 bp, Homo sapiens
  misc_feature 1..32: note = chr11:113929995-113930027
  misc_feature 1..32: note = hyper
  source 1..32: mol_type = genomic DNA
aggtgggggctgctgcgcgcccttcaccctca

SEQ ID NO: 34063 - DNA, 352 bp, Homo sapiens; identical to SEQ ID NO: 11005
  misc_feature 1..352: note = chr11:113930374-113930726
  misc_feature 1..352: note = hyper
  source 1..352: mol_type = genomic DNA

SEQ ID NO: 34064 - DNA, 34 bp, Homo sapiens
  misc_feature 1..34: note = chr11:113931033-113931067
  misc_feature 1..34: note = hyper
  source 1..34: mol_type = genomic DNA
tgtgtgtttattcgccggccggctgggaagctag

SEQ ID NO: 34065 - DNA, 354 bp, Homo sapiens
  misc_feature 1..354: note = chr11:113931343-113931697
  misc_feature 1..354: note = hyper
  source 1..354: mol_type = genomic DNA
cctttcccaccctggcgcgcccgccgctagctcgcacagcgcctcgcacactcccgcacgcgcttgaaatgcgcacggtcccgccggcccgcggaaccacccggacgcacggagcgctccgcaccgactcgctcgccgcctccccgagacgctcgcaccgtgcttgggccgggcgcgctggccgctggcgccgctggccagaggcctgggacccagccggtcgctcccagggggtcacggccctgggtcggagagggagggcgggcagaccccttctcgcctttcctcccacaactcgctgcggggcttttgtgcttccccttcgccgcggggcgggtccgcctcccctgccgc

SEQ ID NO: 34066 - DNA, 30 bp, Homo sapiens
  misc_feature 1..30: note = chr11:113932041-113932071
  misc_feature 1..30: note = hyper
  source 1..30: mol_type = genomic DNA
aggcttgtttcagggcgccaagcttccatt

SEQ ID NO: 34067 - DNA, 30 bp, Homo sapiens
  misc_feature 1..30: note = chr11:115373239-115373269
  misc_feature 1..30: note = hyper
  source 1..30: mol_type = genomic DNA
aagttgtaaccacaccggcatcggctgaac

SEQ ID NO: 34068 - DNA, 792 bp, Homo sapiens
  misc_feature 1..792: note = chr11:115373755-115374547
  misc_feature 1..792: note = hyper
  source 1..792: mol_type = genomic DNA
tcgccgctcgcaccccgcggccccgtgccactcggtcccggcgcccgcctggagcctgcagcaggggccagaggacgccgcgcggctgccaagcgcggcgaggtggcgggaagggaggctgggtgcagcacagccggcctctccgctgaggaagagctccggctcccttttgttagcaaaagcaaacactgccctcttctttcccgaccgcgccaacgcgcccggcacacgggcagccacacatcgggctccagccgagtgctcggtgtcttcagggaaggcaccgggcgtgcagagccgcccctgggcaaattcccaagactgctcttcacgcagggagcgcgcggaggcccgcagggtgcccgcctggccgcagaggccgcgacgccccctccgccaccctcgggccgccgaaagaacgggcagccgggaaatcccgtgtccccactcgtggcagaggacgctgtggggcgggcgggctgcgggctcccggcgccttcccgcagaggcggcgacagcggccgccccccccgcggggccgggccggggaactttccccgcctggagccgggccaaaaagacccgcagcagagccgagggggcggagggctgcgaacggccggagggaaacacgagaggcgtgcagtttggggacaggggagaaaggcagagcgcgttgggggaaggggcaggggagatcagacaagtctggggatgtcctggggaccggggagaaatcacgccgcgggcggctgggagtcagccaccaggaggcttcggggatggagaact

SEQ ID NO: 34069 - DNA, 249 bp, Homo sapiens
  misc_feature 1..249: note = chr11:115375185-115375434
  misc_feature 1..249: note = hyper
  source 1..249: mol_type = genomic DNA
gacatgcgctggaggcggagtccgggcagaccaatcacagcgccgcgagcccaacccggctctcggagggcctcgctccctcccccaccccgccccctggcgctggcgttcggcggcgcgcccgcgccacctaggggcggggccaaggggaggggcgtatgcaaatatgtttatgttaaaattcgggttttgctttccccggatcaaggaaaaagtgttctcccgggcgcctggcgtgcaaggactcgg

SEQ ID NO: 34070 - DNA, 72 bp, Homo sapiens
  misc_feature 1..72: note = chr11:115530024-115530096
  misc_feature 1..72: note = hyper
  source 1..72: mol_type = genomic DNA
ggtgctctcgggccacggggaagggacactcgggaaagacaccagagaccgggagggtgcagctgggctctt

SEQ ID NO: 34071 - DNA, 201 bp, Homo sapiens; identical to SEQ ID NO: 994
  misc_feature 1..201: note = chr11:115530221-115530422
  misc_feature 1..201: note = hyper
  source 1..201: mol_type = genomic DNA

SEQ ID NO: 34072 - DNA, 63 bp, Homo sapiens
  misc_feature 1..63: note = chr11:115630411-115630474
  misc_feature 1..63: note = hyper
  source 1..63: mol_type = genomic DNA
ccccttctccagcctcgcctccccaatgcgcttcccgcctctgcatcgccgccggccccttca

SEQ ID NO: 34073 - DNA, 99 bp, Homo sapiens; identical to SEQ ID NO: 3799
  misc_feature 1..99: note = chr11:115630530-115630629
  misc_feature 1..99: note = hyper
  source 1..99: mol_type = genomic DNA

SEQ ID NO: 34074 - DNA, 259 bp, Homo sapiens; identical to SEQ ID NO: 3800
  misc_feature 1..259: note = chr11:115630630-115630889
  misc_feature 1..259: note = hyper
  source 1..259: mol_type = genomic DNA

SEQ ID NO: 34075 - DNA, 474 bp, Homo sapiens
  misc_feature 1..474: note = chr11:115630890-115631364
  misc_feature 1..474: note = hyper
  source 1..474: mol_type = genomic DNA
gcggccgggtcatcagaagcacagtggagccgccccctgctttgggaggagcaaaagagcctctcgcttgcctcccgctcgagctccttctcctcttccttttcctagcgcttctctccctccctcggcggggtccgcagagacagctgggcaggcggaggctgcgcgcctctcgcacctccacgcccaccctcccgccgcccccccctcggcctgaaagatctgcgtccacaccaccctgcacccagggcccgtcaggttttgcagaagtttgctgagggtcctcacagggggtctcccaggggaaggggtggagggctggaggggccgcggtgggaagaggtggcagacgccgcctggcaacggagaccctaccctttctagaaattcagaacgcagagaaaccagtgcccagccctgctcttcagcaaacggtgtatttcagcccgagtttccttccgggggtttggctgt

SEQ ID NO: 34076 - DNA, 35 bp, Homo sapiens
  misc_feature 1..35: note = chr11:116451313-116451348
  misc_feature 1..35: note = hyper
  source 1..35: mol_type = genomic DNA
agacctggagctttgcggttcgcggcccgggttgg

SEQ ID NO: 34077 - DNA, 264 bp, Homo sapiens
  misc_feature 1..264: note = chr11:116706504-116706768
  misc_feature 1..264: note = hyper
  source 1..264: mol_type = genomic DNA
gggggcggcggcgggcgcctcactgggtgttgagcttcttagtgtactcctcgagagcgctcaggaagctgaccttgaagctctccagcacgggcagcaggccttggcggaggtcctcgagcgcgggcttggccttctcgctgagcgtgctcagatgctcggtggccttggcgtggtactcggccagtctggcgccgccgttctccttgagagcctcaaggcgcgcggccaagcgctggcgcagctcgtcgctgtagggggcca

SEQ ID NO: 34078 - DNA, 227 bp, Homo sapiens
  misc_feature 1..227: note = chr11:117667351-117667578
  misc_feature 1..227: note = hyper
  source 1..227: mol_type = genomic DNA
ctaggtcaagagtcacggcctgaggacccctcgactcggagggcactccggggtcccagtgccaccaagccgcaggaagagggcaaggggctgggggaggggtccagggcagaactgccgccgtgcagggagcagggagatgaggggctcctttgccaccacccctacgggcgcgccccaaaacggcagacgcgggtggctggcggagcggtcgggggctgactctc

SEQ ID NO: 34079 - DNA, 197 bp, Homo sapiens
  misc_feature 1..197: note = chr11:117667865-117668062
  misc_feature 1..197: note = hyper
  source 1..197: mol_type = genomic DNA
cagcgcgctcccagccgcccgcactcggcgccccgctctctctgctcctcagcccagcgctcggctgcggcggcggctcctccctcctcggctccccggctcctgtcatccgcggggctgggctaggcggccgctctccccgcccccccgcggcaccccgggtggtgagcgccgcgcgagcccggagcccagacgga

SEQ ID NO: 34080 - DNA, 178 bp, Homo sapiens
  misc_feature 1..178: note = chr11:117746361-117746539
  misc_feature 1..178: note = hyper
  source 1..178: mol_type = genomic DNA
cccagccagacagcacgaagccacagagacaaaggaagtagtggcagagagcacactggtggggagaagcctccagtagccacggtcccgcgagcgtgcaggcttgcagcaggtgacgcggcagacccatgtttccagcgaggctgctcccagctcccaccctcgggtgcctcctcta

SEQ ID NO: 34081 - DNA, 220 bp, Homo sapiens
  misc_feature 1..220: note = chr11:117747536-117747756
  misc_feature 1..220: note = hyper
  source 1..220: mol_type = genomic DNA
tgggtagcggccgcgcgcagaccccctctcctcctctccctgtccgtcctcccgctctgtgctcgcgcgcgtcctctgctcctctctcctctcgaggggcggagagatttttccaaagggcagtcaagctccgagaagcaacaggagactgccgccgaggaggcgtgcaagcgccggagcggatttgccatcagctgttgcttttcggtttccctctggt

SEQ ID NO: 34082 - DNA, 64 bp, Homo sapiens
  misc_feature 1..64: note = chr11:118024161-118024225
  misc_feature 1..64: note = hyper
  source 1..64: mol_type = genomic DNA
caccttctgccccatcgctcagcaactccggcggttgttttaggaagcccggaacagagctttc

SEQ ID NO: 34083 - DNA, 90 bp, Homo sapiens
  misc_feature 1..90: note = chr11:118663112-118663202
  misc_feature 1..90: note = hyper
  source 1..90: mol_type = genomic DNA
gaagagttagtagggcgcaaccgtcttctcctgccctcgaagggcaagactgaagaaagtaggggcggaggaggccgggccctccactaa

SEQ ID NO: 34084 - DNA, 52 bp, Homo sapiens
  misc_feature 1..52: note = chr11:119191797-119191849
  misc_feature 1..52: note = hyper
  source 1..52: mol_type = genomic DNA
ccataaatgctcaggcggctgcgggtggatgggcgcgcggggagcctggggc

SEQ ID NO: 34085 - DNA, 510 bp, Homo sapiens
  misc_feature 1..510: note = chr11:119210471-119210981
  misc_feature 1..510: note = hyper
  source 1..510: mol_type = genomic DNA
gcaccgagcactccccggcaggcccggtgggccccgcgggtcccgcctctcctcgcggcccggggtcccctcgaggtcccggcagtcctgcggggtaagcggggcggcagggtgagagtagcggcggctcagcccgcagcggggcggcgactctaaggtcaccgtacccctccccgcccctgcctgagcttcggccagcgcctcctcccgcacgggtacctcctccaccccttcccgcagggcagatctggggggctggccaagggggctcccgccgcctgggcccctcccccgctcagggctgcaaagcgcggggagtggcgccccctggcgggagacccgagtcccggacaccgggagctggagctgcggccgcgcctgctcggacatcgccaccgatagccgcggcggtgccttcttacccggcctcccgccctcgcctttctctcccggagccccgggcgcgccgtcgcggccgtcgcggccatcgcggcccggcaagccctggct

SEQ ID NO: 34086 - DNA, 44 bp, Homo sapiens
  misc_feature 1..44: note = chr11:119211198-119211242
  misc_feature 1..44: note = hyper
  source 1..44: mol_type = genomic DNA
cctctctccccaccccggcgcggcccagtcggtccccaccccac

SEQ ID NO: 34087 - DNA, 83 bp, Homo sapiens
  misc_feature 1..83: note = chr11:119234852-119234935
  misc_feature 1..83: note = hyper
  source 1..83: mol_type = genomic DNA
ccgcctcaacctccccggcgtgcgccgccaacagcccgggtcccggctctcgcgctccggccgactggcggccccgccggcgc

SEQ ID NO: 34088 - DNA, 40 bp, Homo sapiens
  misc_feature 1..40: note = chr11:119292779-119292819
  misc_feature 1..40: note = hyper
  source 1..40: mol_type = genomic DNA
cgcagggcattgcctcggttgagtgcgcccgggtgcgcag

SEQ ID NO: 34089 - DNA, 15 bp, Homo sapiens
  misc_feature 1..15: note = chr11:119293305-119293320
  misc_feature 1..15: note = hyper
  source 1..15: mol_type = genomic DNA
agctctcccctcccc

SEQ ID NO: 34090 - DNA, 33 bp, Homo sapiens; identical to SEQ ID NO: 11021
  misc_feature 1..33: note = chr11:119293352-119293385
  misc_feature 1..33: note = hyper
  source 1..33: mol_type = genomic DNA

SEQ ID NO: 34091 - DNA, 562 bp, Homo sapiens
  misc_feature 1..562: note = chr11:119293386-119293948
  misc_feature 1..562: note = hyper
  source 1..562: mol_type = genomic DNA
cacccagcccgccgcgaggtcacccggcagattccctctagctcgccatcctccatcctctccccgcagtttcatccgtcctcctccccgcctctgcgagctgggtttggggacgtctgggtggaatgtagacccacaggctgtccttggtgcccttcctccctgttctccagcgccccagccccagacaccagtcccccagcgggcgaaagcccgggagcgccttccccgaaagacatcagggtgccacgcggcccctgccctgcagaagcatccccctcccgcccctgcctggaaagcaggcccctccctaagctctgcgcccttcttccctgggcgccctcggaccgtggcccgaagcctagtgttgggaagtcttgcatgggcgcctgacggcggtccccgagccccaggtcccaccggctccagttcccacctggactggggtcttccgctgctgcagcctcctccagacgcgccgccgcctccggttgctgcacccagctcggagcccgcagttttcaccggggatggaggagagggggagcggggagccgggggc

SEQ ID NO: 34092 - DNA, 146 bp, Homo sapiens
  misc_feature 1..146: note = chr11:119612122-119612268
  misc_feature 1..146: note = hyper
  source 1..146: mol_type = genomic DNA
gcgcctgggaccctgcggggcctcctggaggcgggacgggcacggcgccacctagcggtcgtgggccgcggagagagcgtccctgtccttccccgtgtgggacctgcaaccgccccatagcgcagagtccgggaggctccagccac

SEQ ID NO: 34093 - DNA, 109 bp, Homo sapiens
  misc_feature 1..109: note = chr11:119612323-119612432
  misc_feature 1..109: note = hyper
  source 1..109: mol_type = genomic DNA
cgtacttttactggggtacggggagccctgccccacggctgtcagctcgggtcgggcgcgccgggtgcccaggaggcagcctcccaccctcccccgcacacgtcgttcc

SEQ ID NO: 34094 - DNA, 442 bp, Homo sapiens
  misc_feature 1..442: note = chr11:119612977-119613419
  misc_feature 1..442: note = hyper
  source 1..442: mol_type = genomic DNA
acacacagaggcacacacaggtacaccccgcctcctgccgcgcctgacactccgcagggcccgggggtgggtgggcaggggtgcgagggggcgtggggctgggcgcgccggcctggggggaaagccccgcctcccggatgtcgtctcttcgccccctactagctcttgtctcctccccaacccctcgccccaccccctgcctaatttttgccagtggatcatcggcctttggatgaatccgcagcaaatggctcattcggggcgggcccgcctccccatccccccagtgtgcggtctcctctccccagcaaagatgttcggtggcacttacggcccctttttaacaccaggcgaagccaatattgttaggaaggaagaactgctgtggcagctgctgcaaagacaaatcatatgcagtaatgcatcacgggctgagggaggg

SEQ ID NO: 34095 - DNA, 94 bp, Homo sapiens
  misc_feature 1..94: note = chr11:119884295-119884389
  misc_feature 1..94: note = hyper
  source 1..94: mol_type = genomic DNA
aagttgtgctgctgccggtgctcggatggaccccggggagcagcagccactgctcagagcagtctgttttgcctgttgccggaggctggggggt

SEQ ID NO: 34096 - DNA, 118 bp, Homo sapiens
  misc_feature 1..118: note = chr11:120110849-120110967
  misc_feature 1..118: note = hyper
  source 1..118: mol_type = genomic DNA
gtgtggcaatcctggcggcgccgagtgttgcccgggccggagcagcggagcgcgcgacagtggcggcgacggctccggcagcggctcccgcggcggcggcggccgggaactggaggaa

SEQ ID NO: 34097 - DNA, 131 bp, Homo sapiens
  misc_feature 1..131: note = chr11:120382817-120382948
  misc_feature 1..131: note = hyper
  source 1..131: mol_type = genomic DNA
ctgcgtctccagattcgccgccgaaccccccaccgctctgctcccgtagttcctccagtcttcaccccggtccgtctccctccctccgcatcccttccccgggctcgcggtcctcccgctctggtcctccc

SEQ ID NO: 34098 - DNA, 476 bp, Homo sapiens
  misc_feature 1..476: note = chr11:120435401-120435877
  misc_feature 1..476: note = hyper
  source 1..476: mol_type = genomic DNA
gcaccctaaagggcacggccgccgccgcagcaggtaattagctggaccgcggcggagcgcgcggaggtggctgctggctgcaaggactgcgcccagcctccgcctcgcccctcgaggctcccgcgtgggccggcgggcagtgcgtgggccacaggaagcgggctgactggacccggctcaggacttcgcacaagggcagctctttgtttacagctcctctcccagctccccgctttcctttcgcccaccgcctcccttttccggcgatcggctccgccggctgcgggggggtggggggggtggggtgtcctgtgtagccgcccacctcctgtcccggcctcgtgctcccgctggggactgtttgcggtgagtctgtcgcacgcacgtcagggccgaggcagtgatgcggggcagcgtgggaggacgggctgcggagcccgcgtcatcctgcctgtggggagcgctgtgcctgctct

SEQ ID NO: 34099 - DNA, 129 bp, Homo sapiens
  misc_feature 1..129: note = chr11:121298044-121298173
  misc_feature 1..129: note = hyper
  source 1..129: mol_type = genomic DNA
gcgcccggcccagcccggcccgcccacctcgcgcggaaacttcgagctgcgcagccgccgcgccggcgcctccccagcaaagctccgctaagtgcggccggcgggggtgcggggcgttgggcacctgac

SEQ ID NO: 34100 - DNA, 163 bp, Homo sapiens
  misc_feature 1..163: note = chr11:121593473-121593636
  misc_feature 1..163: note = hyper
  source 1..163: mol_type = genomic DNA
ggggtggggggcggccggagagaaggggcccgcgtctccgccgcttccatcaccgccctggaaatagcatctgaacgcgcacggcccgaccaggcttcccccaagctgctaagatttcatttcacctccgacaggcttcatggggactcgctgttaaaagatc

SEQ ID NO: 34101 - DNA, 1143 bp, Homo sapiens
  misc_feature 1..1143: note = chr11:122847170-122848313
  misc_feature 1..1143: note = hyper
  source 1..1143: mol_type = genomic DNA
gaaactgcctagggccgaggggagggggcgtacgcgtaggagaacgcggtggcaaaccattcctggaaacgcgtgatcattcccagttttgccctgcgagcctacaaacccggtaaaagaataagagacctcccaggggaaaaggagaggggtaaagcgcaaagtcaatcagacccccgccccatctattccccaaacaggtgcacgcccggaacgcctttagccttaaccctttggccttcatcttgatttcctaaaatgcactgagaatgaatatttccacacacaacccgaggaacactcacttttaaaatatcagtagcccgtggaacgtggaagcgttgcgggacaggagcgcaacaagttcgggaagcagaaattgctctaggggttttctgtgcccaagtttcccgccgcgcgctggcgccgcgcagtacgcgggaggcagggcgtaaggggcgtctgcgcctgggggctacaaactcaggaagggtgccaggatgcagaaccgcgagctctagaggagaacagggacgggagaggatggaagcgccgcccagagaaggagggagtcgccttagtatttgagtcagagatgggactctggggatgggggatgggggcgagtgggaggttagtgacgagcagtgcacgagtctgtcctgaaactggacgttttaaagatcagattgtggttctatctggatctcggcggagcggaggccccagagacctggtccctttgcagccaaacggactgcccaagaacgggcaaggacttggcgtggagaggaaagaacagagctaggggcaagttgctgaaaggcgagggagaaaggggtctatgatcggagaaaacagagagccgagagctgaatttccagtctgggacgcggtacttgggctggtccctgaccccaaggacgacggacgcaggaaaatgggcgcccgggcgcacagtctcccgtggctgggaccgggagggctagaggggaggcgggaggccgggccgcgggccgtgctggctccgcaccggcctggaggacaggtgggttttgtttgtcttccaggagcggatttccaaggcccgccacgagactggagtctgagtcttccggtccaggagggaaccgcgctcggccc

SEQ ID NO: 34102 - DNA, 391 bp, Homo sapiens
  misc_feature 1..391: note = chr11:122848368-122848759
  misc_feature 1..391: note = hyper
  source 1..391: mol_type = genomic DNA
cggccctgagcccagctccccctcgtctccaatgtccacctcgtcctctggctcggtcagcacgaagggaccggcgggcaggctcagccgagcctcggcggcggtggcggcctctgaaccgcgggggctgccctcggggctttctggcccgtctggtgctttgggttcgtcttggcttttccgcagttgctttttatgcttcatccgccggttctggaaccacgttttcacctgatttcggggagataaaaataaaatcatgtcattcctccaaatctgagccatcgctggggtttaggaaaatgggctgcagtccgttgatgaagtatccaagagcggtgatagcctcaactgctcataagttatcgccttaagccgaatgagaatcgaa

SEQ ID NO: 34103 - DNA, 331 bp, Homo sapiens
  misc_feature 1..331: note = chr11:122849793-122850124
  misc_feature 1..331: note = hyper
  source 1..331: mol_type = genomic DNA
gagccaccgcgcccggccaggtgtaggtaattttacgaaagctcttgggaaaggcttagaataagcgtcagcggggtctatttctactcgaactccacaaggtcccgaaggtattaagacttgaaggcagagaggaacgaagcagagatcagggcctccctctcctcccgcccacctgcgtctcggacaggctgagggccgtggccagctccactcgttctggcgtggacaggtagcgctggatctcgaacctcttctccaagcccgagagctgcgagtcagagaaaaccgtgcgggctttgcggcggcggcagtgcttccccggcagctc

SEQ ID NO: 34104 - DNA, 1116 bp, Homo sapiens
  misc_feature 1..1116: note = chr11:122850148-122851264
  misc_feature 1..1116: note = hyper
  source 1..1116: mol_type = genomic DNA
cgctgggactggcatccctgcagagagaagagcaaccaagtgggcagagcgtgggtcgccggagagcaatctccgctccgctcccctcccctcccctagcccccagtgccttcctccgcccctcgcctccgtcagtctgctcgccccaaagcccctcaagcctttctctcaggaatccagggcagaggaagaaaaaaaaaaaaagccgcaagaatagcgcttggagatctttatctggaaagtcatctagaaatacaaacaacaaacagtaaataaaacagaaaagaaaatcggaaaatagatccggaggctgtttaaaaatgtcttcttggagagacttccgtagggtcggccagcgcggagtcttcagttgcgcctggccaagttttttgcaaacgtcaaatggcccaggagcagtcctgtccccagcccccacctatcctcctagacccctgatgacactcattgctgttctggggctggtagatgcatggatataatcttgcctccaaaccttactgaaaaatacctttctgtttcccaagccacccctatccccctgcagccaaagggagagcaaaactgccttatccggagaagccccggagccgaaacagaggagcatttctcgcctctcacgtctcctcgtccgtttcggggtcgcgctagggacccagctacctaatatagtcctcattctttttctcattctttccctctcactccaagcccagcgaagcagaagggtttgaggggtttttccatggccgggtccggggagacttgtctttcctgaccctcgcaggcttgactctgtctgagacgcaccaagcagagagaagctgccacaagcaacatcggccaatcccagagaaaataaacaaacataacaacaaccagtgcgggtacttagggctttggccactgctgtatgggaggaccaccggagcagctgagaatagattgtcaccggcgggtggtgaagccagtgcagagatgcggacctggatttacaaacacttttagctttgttctggattccagcgcgcacaaactgcctcctgtcttgcccccagcccctccaccgaccatggttgttgccgcctctgagctatg

SEQ ID NO: 34105 - DNA, 482 bp, Homo sapiens
  misc_feature 1..482: note = chr11:122852370-122852852
  misc_feature 1..482: note = hyper
  source 1..482: mol_type = genomic DNA
gagattcatcttgagcggagcacctgccacaggacaagggccgggacgaagtggaggacgcaggcagagtctccaagcctgctcgaaagccggcaaccaccctccgaggctcgaatctccgctgctctctcccgggcctgggctaccccgggcgctggagaggcaagaagacaagctcctgggtaggttgggtctctgtgttggagaattggcagcttggagaggggggccgggagagccaatgacgaggctgccagaggcagaggggagggtgcgggaggctcggggcggggcggggagctgtccgcggtgctgaacaccaccggccgagcctgggaacaacagagcccgcagggttcttgttcctaccaggtttctcgacctcaatttctgccccgtcactgcaggggctgctttgttcccagtcgtttttaaaagaaagccaaaaggaaaaagtctctgttgtccggcaaactcctctt

SEQ ID NO: 34106 - DNA, 114 bp, Homo sapiens; identical to SEQ ID NO: 11039
  misc_feature 1..114: note = chr11:122854915-122855029
  misc_feature 1..114: note = hyper
  source 1..114: mol_type = genomic DNA

SEQ ID NO: 34107 - DNA, 18 bp, Homo sapiens
  misc_feature 1..18: note = chr11:122855030-122855048
  misc_feature 1..18: note = hyper
  source 1..18: mol_type = genomic DNA
ccccgcctctgccggggc

SEQ ID NO: 34108 - DNA, 17 bp, Homo sapiens
  misc_feature 1..17: note = chr11:122855721-122855738
  misc_feature 1..17: note = hyper
  source 1..17: mol_type = genomic DNA
cgcgggccccagggctg

SEQ ID NO: 34109 - DNA, 440 bp, Homo sapiens
  misc_feature 1..440: note = chr11:123065493-123065933
  misc_feature 1..440: note = hyper
  source 1..440: mol_type = genomic DNA
cagggactgaaaagccggctgactccaggggctgcagggacacccggtcagaaccggcgtctttcccggacgcagggctgcgtttgcccacggccatccaaactcccgccctcccagaggcactcacctagcaagaggagaaggaggagggacatcccgatccccggacgcgggcgcttccccgctcagctgctgcttggctccggggcggccgggcgcctccgacggacctcgggcgagctgggcgcggcgcctcggggtgcgcgcgaggtggctgcagccatgtgccgggcgggagccggccccgcgccccgtgcccctgggggcagatgggctcccggcgctcgccccaccagctggcgcccggacgggagccgggaccagggtcagggaggaaaacgcgaggcgaaaaggcgctaccgcttcgtggaacacttttc

SEQ ID NO: 34110 - DNA, 53 bp, Homo sapiens
  misc_feature 1..53: note = chr11:123066144-123066197
  misc_feature 1..53: note = hyper
  source 1..53: mol_type = genomic DNA
ggggccgtgcagaggcgggtgggttgagaggcgccgggcgtaggattgattct

SEQ ID NO: 34111 - DNA, 381 bp, Homo sapiens
  misc_feature 1..381: note = chr11:123172482-123172863
  misc_feature 1..381: note = hyper
  source 1..381: mol_type = genomic DNA
gggcaggcggcagcacgggaagaggccagcaggtggcgcggtcgcccaacccggccgccccccgggcgccgagggaagcgggtcaggggcgtccccacctgcccaagcgccggctctcccaggcagcaggggcggcggcggcctggctggctgcgctgcagagcggagagcaggagcggcgtgggaggaattcggagcactttcgccgcctgcctccttttactgctggttgccctcaaaggagccctctccctccacacgcctttgggccttaccagccgccggaagcggcggcatccatcccagcaaagcgtgcattccatcctctggaaaaaaagtctttgagcttcctttacagtgaccttactttggggactgaac

SEQ ID NO: 34112 - DNA, 75 bp, Homo sapiens
  misc_feature 1..75: note = chr11:123172915-123172990
  misc_feature 1..75: note = hyper
  source 1..75: mol_type = genomic DNA
cgtggttgacgaagccattccctccttgctacttgccttgtgtgatacactgtcacggcccgggcttctggcttg

SEQ ID NO: 34113 - DNA, 80 bp, Homo sapiens
  misc_feature 1..80: note = chr11:123228636-123228716
  misc_feature 1..80: note = hyper
  source 1..80: mol_type = genomic DNA
atcgtgaagatcctccgggtcacctatgcactcctgctaatctctgccatttgccttcttacaccctttccataccttcc

SEQ ID NO: 34114 - DNA, 392 bp, Homo sapiens; identical to SEQ ID NO: 999
  misc_feature 1..392: note = chr11:123228788-123229180
  misc_feature 1..392: note = hyper
  source 1..392: mol_type = genomic DNA

SEQ ID NO: 34115 - DNA, 226 bp, Homo sapiens; identical to SEQ ID NO: 1000
  misc_feature 1..226: note = chr11:123229181-123229407
  misc_feature 1..226: note = hyper
  source 1..226: mol_type = genomic DNA

SEQ ID NO: 34116 - skipped

SEQ ID NO: 34117 - DNA, 151 bp, Homo sapiens
  misc_feature 1..151: note = chr11:123300811-123300962
  misc_feature 1..151: note = hyper
  source 1..151: mol_type = genomic DNA
cctttacttggaggtcgagtccctccccgagggaatccgtgtacagttacactagcggtcgctgccagtgctagcccattcaggatagcccccctcaccccgcccccagcccccgctcctcctcctccttttttgtttttatccagtgtct

SEQ ID NO: 34118 - skipped

SEQ ID NO: 34119 - DNA, 990 bp, Homo sapiens
  misc_feature 1..990: note = chr11:123301082-123302072
  misc_feature 1..990: note = hyper
  source 1..990: mol_type = genomic DNA
cgcaaaccgctgagagtttgctgcaccgccccctggggcccctggctgccgagtcccgctaaggcaaagacgccagcaagcgaggaagcgcagcggaagaaaaacaagcgggcgcgcgaggggagccccaggagggctgccgagtggctggcaggcggctcccgcccctcccgggtggcctcgccggcggctgacggcccggaggacgcgcgctccgaaaagttagactccgggcggcggcgcgctacgccgcgtcccctcgcgtcccttcctcgctgcgctccgggaaaggaacttgttccttcggccccaggattggggagtgtgccgcggggccgagggtggggaacagccagagggagacgcgaaccaggccgctggcggagggctcagggggagcgcagaggcgacggcccccatgccggcggccaacatgatggagaaccggccgctgcccgccctgcaggtgcccgagccgcagggtgcgcccgagggcagcccggtctggtccagttcgtcgacccccacgcttcgccgccggcgcttcaagatgcgccgcatgaagaacgtacaggagcagagcctggaggccgggctggcccgggacctgcccgccgtcttggcccccggcaaggagttcctgcagctgccgtccatcgagatcacgccctccagcgacgaggacaccccgtggtccaactgctccacacccagcgcgtccccgcgccgaaaacgcttcctcctccgcaagtggctgagggtgagggagcggaaggagtgcagtgaaagcaggtacgtccccgttccgcccgtctccttcccttccctcccgtcctctccagagccgtccagggccccggggcattctgggggaaacgtcctgggggagaacaggagcccgtcaccagaggcgcttctggagggcgctgcgcctggtcccagggatggtggcattcagcttccacgcgtgccacccgctccccaactcag

SEQ ID NO: 34120 - DNA, 30 bp, Homo sapiens
  misc_feature 1..30: note = chr11:123524569-123524599
  misc_feature 1..30: note = hyper
  source 1..30: mol_type = genomic DNA
cctctcagattctttcgaggaaaccctttg

SEQ ID NO: 34121 - DNA, 150 bp, Homo sapiens
  misc_feature 1..150: note = chr11:123524827-123524977
  misc_feature 1..150: note = hyper
  source 1..150: mol_type = genomic DNA
ctcgcgcccctgcctcgctcgtttgcgcccagggtaagctcagctcggaagggagtcgcactgctggcctagcagccaggctgtggaagggtccaggttgattcacctctcgcctccccaggatcggttgcgttccgactggaatcctcc

SEQ ID NO: 34122 - DNA, 61 bp, Homo sapiens
  misc_feature 1..61: note = chr11:123525412-123525473
  misc_feature 1..61: note = hyper
  source 1..61: mol_type = genomic DNA
cgcgccgagcgggggcggagccgggagcggcgcagacacttccagccgggatatctttgct

SEQ ID NO: 34123 - DNA, 20 bp, Homo sapiens
  misc_feature 1..20: note = chr11:124629399-124629419
  misc_feature 1..20: note = hyper
  source 1..20: mol_type = genomic DNA
ctcggccctctgcctcggag

SEQ ID NO: 34124 - DNA, 15 bp, Homo sapiens
  misc_feature 1..15: note = chr11:124629499-124629514
  misc_feature 1..15: note = hyper
  source 1..15: mol_type = genomic DNA
cgccctaggagagcc

SEQ ID NO: 34125 - DNA, 214 bp, Homo sapiens
  misc_feature 1..214: note = chr11:124631577-124631791
  misc_feature 1..214: note = hyper
  source 1..214: mol_type = genomic DNA
gcttgtatgtggggtcggggatgagagggggctagagttaagtccttaagctctttagccagtgtctcatctagcggctcagctcatccggctctgctgggtggggggtggggagtggacagggtgaggaatggttccgataactcaccccagaggtatccaggtcttccgagagatgcccttacctccccccgccatccgcccccacacccaa

SEQ ID NO: 34126 - DNA, 46 bp, Homo sapiens
  misc_feature 1..46: note = chr11:124709117-124709163
  misc_feature 1..46: note = hyper
  source 1..46: mol_type = genomic DNA
ctgcaaaccagaagacgcggcctgggaggggcgtagagccctcccc

SEQ ID NO: 34127 - DNA, 183 bp, Homo sapiens
  misc_feature 1..183: note = chr11:124709482-124709665
  misc_feature 1..183: note = hyper
  source 1..183: mol_type = genomic DNA
cgcctaatccccgcacgcggacacctgggtgggagcgcgggcgagtggagggcgcgcctgcacgcaggatcccgggctgggcaacggcctagaccgcctctcgccaaacctcccacgccagcgccagtccgacgaacaggagctggtccagcgaacaataaaaggccccggggctggggaggg

SEQ ID NO: 34128 - DNA, 156 bp, Homo sapiens
  misc_feature 1..156: note = chr11:124712781-124712937
  misc_feature 1..156: note = hyper
  source 1..156: mol_type = genomic DNA
gggacttgatgcaaacgaccgcatggcagtaggctcgctgggcagatgcccaggagatattagggctgctggggctgaggtaatatcctgcgaggccagccgggtctgcagccctggctgggtcacgacccaggctctgcctggctcggacatcct

SEQ ID NO: 34129 - DNA, 336 bp, Homo sapiens
  misc_feature 1..336: note = chr11:124713057-124713393
  misc_feature 1..336: note = hyper
  source 1..336: mol_type = genomic DNA
gcctcctcccgctgggaggataattaaagcgccaaacggcggagcgggcgggcagcgttcccgggggcgcatttcatcggggctgattaatgaggccggggagttaatgaggagaaagctaaacgcagggagctgagccgcggaaggcctctccgaggccctggagggggtcctccgaaggcatctcccgccctctctttctagtagcggcttagcgcaagccacatggtgccccaggctcctctcgccgcctcaagccaggggcgggggggaggaggggtcgccccaagtcataccggccgcactgaagtcggtctcctccgcttgtggctaacc

SEQ ID NO: 34130 - DNA, 49 bp, Homo sapiens; identical to SEQ ID NO: 11053
  misc_feature 1..49: note = chr11:124735054-124735103
  misc_feature 1..49: note = hyper
  source 1..49: mol_type = genomic DNA

SEQ ID NO: 34131 - DNA, 1075 bp, Homo sapiens
  misc_feature 1..1075: note = chr11:124735382-124736457
  misc_feature 1..1075: note = hyper
  source 1..1075: mol_type = genomic DNA
ctgtggaggggcttacggctcccagcccacgggtctcagacccaggggctgggcccccagcccccagtcccgatcccagctgggtcgagccatgctgcgctacctgctgaaaacgctgctgcagatgaacttgttcgcggactctctggccggggacatctccaactccagcgagctgctcttgggcttcaactcctcgctggcggcgctcaaccacaccctgctgcctcccggcgatccctctctcaacggtgagaccctgcctcttggggatatgggatcctgggatggggatgaggtgagagggcggcgtggaagggaaggagaagcgctcctgtcccgaggtccgggattgagtggcgcctcccagcgcctccctgggtcgtggggtctaagggataatttggagcttcgagcacatgagtgggggtacccgcgggaggtcgagggcttgggagaagatggctactgagtctttttacacctccttcccttcccctacaacgcccaccccaggtgagaagaaccgttgctggtaacgggcagggaagtccgagctaagaaaggcccgggcccagcgcagggagggcagaggagggggcacagtctcccgccggcctcggccaagccaggtcactcggtgacccacccaggcagctggtcttcggaaccccgaagtttcccaagaactcacttaggaccagaggaagccaaaatgctggatgtgtttgctacggaggggataggggcggcgatcattttaaggaaacttagaagtttgtctttcagcggcgggactctcagccggcccaccccggcagagctgtggcgggcgggcggagctggcggcgaggtcgttaccgctaattacggtgattaataaatgactgggacagcgcgctctcccctagcgccgcggggaagctgcgggagccggccgccgccagcctgcggagaggccggagcgcgccccctgcctgccgcatcgggaacccccgctttaccgggcgctttcgcgtgtggttccctccaggtgcacgcggtccccatccctctgcctcgacccactcgagtc

SEQ ID NO: 34132 - DNA, 558 bp, Homo sapiens
  misc_feature 1..558: note = chr11:124738461-124739019
  misc_feature 1..558: note = hyper
  source 1..558: mol_type = genomic DNA
gatccctctactaaccggcctgtctgtaggcatcttcctttgagacgaggaacgcggaacgtctgccaataaggacatattggatcctgcagagggagagggtaggcaggtggggactgagctccgcagagaagcataggagatggaacgaccagaggattctctttccctctggagcctcaatctctccccacaatttccctgtctgaacgctctgcgccaccccctgtccccagggtcaagggtaggaccggaggacgctatgccccgcatcgtggagcagccgccagatctgctggtctcccgaggcgagcccgccacgttgccctgccgcgctgaaggccgaccccgacccaacattgagtggtacaagaacggggcgcgtgtggccactgtgcgggaggatccgcgtgcgcaccgcctgctgctgcccagcggcgccctcttcttcccgcgcatcgtgcacgggcgccgcgcgcggccggacgaaggtgtctacacttgcgtggctcgcaactacctgggggcagcagcgagcagaaacgcctcgctggaagt

SEQ ID NO: 34133 - DNA, 60 bp, Homo sapiens
  misc_feature 1..60: note = chr11:124739403-124739463
  misc_feature 1..60: note = hyper
  source 1..60: mol_type = genomic DNA
agcagtactggaatgcgtgcccccccgcggccacccggagccttccgtgtcctggaggaa

SEQ ID NO: 34134 - DNA, 252 bp, Homo sapiens
  misc_feature 1..252: note = chr11:124933396-124933648
  misc_feature 1..252: note = hyper
  source 1..252: mol_type = genomic DNA
gagatcaccccagatcggccccggcgtcgccgcgtggccaggggtgctggggggacttggtcccgagctcctccagcggcgcccgcctcggaggttgataaccctccctgcccaactccgcccgcgctcccccagaccccgcgacgctggctcggtgacactggggaagaacaggctgccagggagggtctccatcgtttcccgtttccatcctcccctcctaacacacatccggggcgccttcagagcgcc

SEQ ID NO: 34135 - DNA, 77 bp, Homo sapiens
  misc_feature 1..77: note = chr11:125034228-125034305
  misc_feature 1..77: note = hyper
  source 1..77: mol_type = genomic DNA
aatctcacctcatctcggtcccctcagcaccggtgatatcttggaactcggccccggttgttcgctaaggaggactt

SEQ ID NO: 34136 - DNA, 50 bp, Homo sapiens
  misc_feature 1..50: note = chr11:125034731-125034781
  misc_feature 1..50: note = hyper
  source 1..50: mol_type = genomic DNA
cggcggctgctgctgcgggcggctgcctcagagcgcgtgtgttttattcc

SEQ ID NO: 34137 - DNA, 969 bp, Homo sapiens
  misc_feature 1..969: note = chr11:125035368-125036337
  misc_feature 1..969: note = hyper
  source 1..969: mol_type = genomic DNA
tccagcggctggaggcgggagcggtcccaggctggggccaggtgaccggaggagtcgaggagccgcggccgcggcctggggaggcagggcgaatgagggtttgcagacggatcagtggagacaggggaacaccggcggggcccgggaagccaggatccgaggggctacacgcacggaccctcacccagggaggagcgagaatgtgtagggtcaccggctttccatgattgctggggatctttggtgaggcgggcgtaggggcccgcgcgaggcttgggaatcgggagcccttctggctcgagaactaggggatgagttcgtaaaagagggaactgaaagcgatcgagagcggagagctgagggggatggcgcaggatcccgaatctgccgctcaaagtttgcatttctttcgggttaggagacgggctttcctggctcccgatccccaggaagaaacgagcgaaatgggccgtcctttcccggggctcttcacgggggagccgggggtttccgcgcggtggggagactcgggttgggaattgaggggtaggggcttgtggatcggcctgaattagggctgggttttaggaccagtctagagttcggtttataggatccagactgtttacggaatcgggatcgaggggccgataagtagtttacacgccggccagagcagagggctggaggtcggagttgggggctggaggaacgggtggcgtttttaggattcagtaacaggatcacagctttttcttgtggtggaagctattggaatttggggagggtagcacgaggggtcctgcagctccgcgtgtgaaaaagcgtttaggtaggcgatgaaagtagttgatctgagccatggcaggcgagccccgaatttttgctgcttccccctgaaagtgtttctttaggaggagaggacttgggccacacaggacccggtcctaagagagcgattccgggaag

SEQ ID NO: 34138 - DNA, 30 bp, Homo sapiens
  misc_feature 1..30: note = chr11:125133214-125133244
  misc_feature 1..30: note = hyper
  source 1..30: mol_type = genomic DNA
agcagtgggggaagccgcatgaggaggagc

SEQ ID NO: 34139 - DNA, 584 bp, Homo sapiens
  misc_feature 1..584: note = chr11:125365065-125365649
  misc_feature 1..584: note = hyper
  source 1..584: mol_type = genomic DNA
ctcctccccccagtccggtggggtaaagaaagcctcctccaggcagcacaatggctggcactctgaggaagccggactcatcccgtgcaggccgcatacacactccactgcccttccggccaaacaagcccggacacgggagagggatgagagtcggggatgcctagcggcgaggagagaagggataggcaaaagggaagaagagcgggctgtgatacctcctcgacgccgtcaaacactgctccccgcattccagagcccggggcccacccgacggcagcgcgccccgccaccgcgcagccgccccggtcccttctcccgcccgtctgtagtaaaacaatcgctctcccggcgtctgcggccgctgccagcggttctgacactgcaggaatgcgcggtctggggaaggctccgcactctggggaggggcacgagcggggtcgggggtaagtttttagggacaaagatgatcttggggcgtttacggtgactggaccagataacggtcccgggacgaggtaccgacccactgccccagcgcgatcgggcggcgttcccttcttcccccagcccccatacctcgc

SEQ ID NO: 34140 - DNA, 583 bp, Homo sapiens
  misc_feature 1..583: note = chr11:125365709-125366292
  misc_feature 1..583: note = hyper
  source 1..583: mol_type = genomic DNA
acacacacacacacacacacaccaggcctggctggagggccgatgctgagatgatactggaagtgcccatcatcccacatctccagggcctggcgcggcgtcccagctgcgctccctgaagggctgggcaggaaggcgacggcctcccgttgttcctttctaatcccagaatgggaccaggtgaggggagctgcggcgaccccagaccgtcctgtcagagaatcccggggcctccttaccacccccaccagaccccacccccagcagtgagtcgggtcctaactaaagtcaacccccgcgacggcacctgtgcgggtcctggcggagggaggcggatcccggggctcagccggacacccccatccacgggccgcgggagcggccggagcgcagcgcagcgcagcggagagccagccagccagccagccagcgagcgctccccgcgcagctccggcggcgcccggctccgctcccgcctccaccccaccccttccccgcgctcgtgcccgggctccgggggcgcgcccgcgctcgggcacccacccaactggcacgcgcgggagctggacgtcatcccctcgtt

SEQ ID NO: 34141 - DNA, 181 bp, Homo sapiens; identical to SEQ ID NO: 1003
  misc_feature 1..181: note = chr11:125773880-125774061
  misc_feature 1..181: note = hyper
  source 1..181: mol_type = genomic DNA

SEQ ID NO: 34142 - DNA, 327 bp, Homo sapiens
  misc_feature 1..327: note = chr11:125774122-125774449
  misc_feature 1..327: note = hyper
  source 1..327: mol_type = genomic DNA
cggaagctgccccctctgccctccggtccgcgccctttcgccccgctctctgccctccgccccgctctctgccctccgccccgctctctgccccccgccccgctctctgccctccgccccttccgcgcgccacccagccttccagcgcctgcgcgccgcaccgcggtggtcgcgggcgcggacgcggacgcctgccccctaaggaagcccattggccagcggatggggccagcaccgcctcgcgccggtggtggaagcacgtgctgggggcgggagcagcaatcgcagccatggcgtcgttactgtggggaggcgacgcaggggcgg

SEQ ID NO: 34143 - DNA, 15 bp, Homo sapiens
  misc_feature 1..15: note = chr11:125774480-125774495
  misc_feature 1..15: note = hyper
  source 1..15: mol_type = genomic DNA
cgccaccgagccggg

SEQ ID NO: 34144 - DNA, 58 bp, Homo sapiens
  misc_feature 1..58: note = chr11:126226052-126226110
  misc_feature 1..58: note = hyper
  source 1..58: mol_type = genomic DNA
cacctccagcatcctcgagcgatggtttctcccacaactaccccggtcaggtccagca

SEQ ID NO: 34145 - DNA, 30 bp, Homo sapiens
  misc_feature 1..30: note = chr11:126870182-126870212
  misc_feature 1..30: note = hyper
  source 1..30: mol_type = genomic DNA
ttgcattcgcaaaggcgaagaggcaatgcc

SEQ ID NO: 34146 - DNA, 16 bp, Homo sapiens
  misc_feature 1..16: note = chr11:126870413-126870429
  misc_feature 1..16: note = hyper
  source 1..16: mol_type = genomic DNA
gcagcgaaggaaagcc

SEQ ID NO: 34147 - DNA, 71 bp, Homo sapiens
  misc_feature 1..71: note = chr11:126870430-126870501
  misc_feature 1..71: note = hyper
  source 1..71: mol_type = genomic DNA
gcggggtaacttggctgtggttagtttctcttccttggcggctctcggtgctcagcctccgccggtcctct

SEQ ID NO: 34148 - DNA, 216 bp, Homo sapiens
  misc_feature 1..216: note = chr11:126870524-126870740
  misc_feature 1..216: note = hyper
  source 1..216: mol_type = genomic DNA
cgtccgtgggtccctccgggtggcttcggtctctttgtgcctctgggtatctgcagccagccgacacaaactgcctgttcttagccgcctcgggaagccgggattgtcagcaatgtccccactcggagaagatccattctctggctcttggcatcccaggcacacggcttcctcaggcgggctcctcccacagtgagcgagcgagctagtgacgag

SEQ ID NO: 34149 - DNA, 764 bp, Homo sapiens
  misc_feature 1..764: note = chr11:126873058-126873822
  misc_feature 1..764: note = hyper
  source 1..764: mol_type = genomic DNA
aaaaggaccaggaggcgtatcaagcctgagtgccggaaaacccacggcaatcttcagcagccaccacgtggggcagagaacgcgagcagtacctgcaggacccacagccggtcgggctctggcgccagcctcgacggcggccccgccatctccgcccggctgcccgcggcctcacctcctccgggggctcggttagcctcctggcgctgcaaggctgcctgcgcgcggttcgctccgggggagggaggaggagggaggcggcgaggagccgacggctccacctgatggagaagcgcggagagtccctagacctcggagtgcgctgcaagaggggagaggagagagaccgccgcccctgctggaagccttcgcgtccgggggcggcgcgcgggggaaggggtctctggacagtcggtggaggcggcagccctacagagacagccgaaagccagcaacttggaaaaccgcccgaattctgggtttctgcacatccaggctggctccaggtctcttgtgcccaccgtgcaagccggcgggatgccagcaggtggcatcctctccagcgtttcttcgccaggcgtggagtccggaggccgaatccatcagtccccagccccctccccaagcctccggtgccaagtgctgggtcctgtgagcccctggcccgccccccacctccgccagcggggcgagccggagctgggtgacccagaccctcgcggaggcgggagcctacagaggatgccggccggccccaggttctg

SEQ ID NO: 34150 - DNA, 106 bp, Homo sapiens
  misc_feature 1..106: note = chr11:128556994-128557100
  misc_feature 1..106: note = hyper
  source 1..106: mol_type = genomic DNA
ctgtttgcatgtgggcgtgtgtatgtggggttgtgtgcgggtatgcgggcgccacgcgcttctcctacaggtgagacacgcgctcagtcctcgagcccaccttctt

SEQ ID NO: 34151 - DNA, 423 bp, Homo sapiens
  misc_feature 1..423: note = chr11:128562763-128563186
  misc_feature 1..423: note = hyper
  source 1..423: mol_type = genomic DNA
aactggggcgcgcggcggcccaggagggaggcggggaggtctccgggttgggccggggaacgccggcctccaggctgggtagggaggacggtccagagcgcgggcctccgggtctcaccccgggaaaagtctgggtctgctctgcgctgttgcgtgctgcgctcctgggacctgctgactgtcctagagggaacgtcccgcggtagtgtcagttccctggggaccaggaagggcgactcttgcctgggagtcagtgcttgggccgtcgggtccgggtaagcgctgggggtttggctcgagaagatgcggataggtggcctagggcgccgcggatctccgccctctgcgggcaccgggagcccagggtcgaggcgcgccgccccgaggggccccttctcctaacaatgcgcccggaatggagtc

SEQ ID NO: 34152 - DNA, 484 bp, Homo sapiens
  misc_feature 1..484: note = chr11:128563336-128563820
  misc_feature 1..484: note = hyper
  source 1..484: mol_type = genomic DNA
cggttttcgtccgagtcttccccggcagtaggcgctgggttacccgcagccctagccaactctccctccataccccccctaccccacccccaaaaagtttgtctccggctggaaaaagcattaatgaacgtatctgtgggaagaaacggaaagtgaatgagtcaggagggccaccttcggccaaccgcctcaggaaaagcaaagaagccaaaggtctttggctttggattttgggggaaggtgatggggggaggttcagacttcgggaatcagggcgcggacgctgggcgtggaccccgtcattgttcccggctagctcttatctcccaggagcaagtatcctgtgtgcgcagcgcatgaatgtgtctgggcatctccgcgtatatttatatagtgtgtgatgcgaaaagcaggaccagcaggggaggaagagggggtgtggggggggagggaagacgagggagagcagaggggagagaagaga

SEQ ID NO: 34153 - DNA, 516 bp, Homo sapiens
  misc_feature 1..516: note = chr11:128563880-128564396
  misc_feature 1..516: note = hyper
  source 1..516: mol_type = genomic DNA
gagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggtaagcggcggggcaacggacgcgggcggcggggaccggccggggaggcgaagcggcgggcgggtaggtgcggggcccgcgtcccggaagacgtggcctctctcccttccctccgcgccccggcttcgcgccggctcctccggcgctcgggtggcgagtcctactcgcgggccagccggccaggcgcccgcattgagggcgaccctcccccgaaatcccagcccc

SEQ ID NO: 34154 - DNA, 223 bp, Homo sapiens
  misc_feature 1..223: note = chr11:128564651-128564874
  misc_feature 1..223: note = hyper
  source 1..223: mol_type = genomic DNA
gtgggtaagtggcctcgttgcacgagggtaggggtgcaagtgagtgtgtcgggggatctatctgagcgggctcctccagatggaagcccctgtttacatgtcagcgctttcccttcctctcggcactcagtcgcccggctctaggcgctggagagccgccggctccgcgggactcctgggccggcctcgccgcctctccggcggggaaccttccccagccccc

SEQ ID NO: 34155 - skipped

SEQ ID NO: 34156 - DNA, 542 bp, Homo sapiens
  misc_feature 1..542: note = chr11:128564991-128565533
  misc_feature 1..542: note = hyper
  source 1..542: mol_type = genomic DNA
cgcctccgttgcaggggccggctgtgagcccgcgccccgcgcccgcccggccattcccaccccagccgccgccgccaagcctgggtctaggttgcaaagtgcaacccaggcggaaaggtgagggtttgggttcgcgtctcacttcagaaaagttgactgctgtctctgaaagggttcgccaagtagggccaggagcagagaggagggacaccccctaacgtgacgggccttagaggacctaggggaatgaatgggaccaggggttagcttcgaggctgccgcgcaacaccaagcgggagtctgtctggaaaaactattaggctggcgaggtggggactggcagagcccgccattccccagaacccgaaagaatcgactccctgctcagggctcagcaagagaaggctaagatgttgggctcagagaattcaagagatttttatcttctgggtggggtcgtggtttttattttctaagttttttttatgaaagtttgaaatatgctgacttaggtaaaagacaccaaccgaaggaacttgcaa

SEQ ID NO: 34157 - DNA, 462 bp, Homo sapiens
  misc_feature 1..462: note = chr11:129242780-129243242
  misc_feature 1..462: note = hyper
  source 1..462: mol_type = genomic DNA
gaagagagaaaacagaagcgggaaattcgacagaggaggagaggcccaaagggcggggagcaatgcggggaagggagaagtgggagggaagaagaggagaggagtcagtggcggtggaaggaaggggaagaaccagagagaagaaaagaggttaaggaaaagaagagcaatgcaaagtcggggccccgaatagtgccgcattctgtgggcacacgccgggcagatagaaagtatagacgcgacgcgctcggcccctcgtcgggcgtcgggtcctggtgctgtcgctcaggtgctggtccccagctccaagcccgcctcgtagtcggcgctgcgggtgagatcgcccgcaagcactcagtttactggcggctgcctaccagcggctcactttcctcggggcgcctaaagctccccgcccggcattgccccgggagcgaacgctgagcccctgggacccagccc

SEQ ID NO: 34158 - DNA, 380 bp, Homo sapiens
  misc_feature 1..380: note = chr11:129243304-129243684
  misc_feature 1..380: note = hyper
  source 1..380: mol_type = genomic DNA
cggacggcgatgccagggctgagcggtgagctgtcccgggtcccgcgctttgaccgcggaccagcctcagggtcccgccgcggaagcagggggcgcgcctggggccagcctgtagaccccagagtccggcggcaggacccccggcgccacccggacacctggcagcagttctcgcctgccctgcagccgcctctgcatggagaaagagaatgaaagaaaacaattctagatggagaggaggggaggggaggccagtttgcaaatacttcgggaatgaagttcctcaaagacgcgttgcgggccttgtctaatgctaggctgtgacttggcctcttaacatctattttctcacgcctgtaatcccagcactttgggaggcg

SEQ ID NO: 34159 - DNA, 377 bp, Homo sapiens
  misc_feature 1..377: note = chr11:129243924-129244301
  misc_feature 1..377: note = hyper
  source 1..377: mol_type = genomic DNA
aagaaaaaatctattttctctaacagcctaatgattagtcctctgggcgtgtccctccctcctagtttaatcaccggcccaggcgccctcatttacttgcttccgcggccaccagggccccctgggcaagcagctccgcagagagcccgccggcactcgcggacgcttctaggctgggagcggggaggaaatgtcaccggccccaaactcggccctagggaaggccatccgcgtctatacttctcagtgtccctgtcgtgcgttttccttccaaccccatgcacactcattccaacataaagtcgtggaaacgggcgtgcactgggctgttcccgccgaacaccgggcgcgactcaggctgccggaggcttcccggg

SEQ ID NO: 34160 - DNA, 204 bp, Homo sapiens; identical to SEQ ID NO: 1011
  misc_feature 1..204: note = chr11:129244440-129244644
  misc_feature 1..204: note = hyper
  source 1..204: mol_type = genomic DNA

SEQ ID NO: 34161 - DNA, 30 bp, Homo sapiens
  misc_feature 1..30: note = chr11:129245832-129245862
  misc_feature 1..30: note = hyper
  source 1..30: mol_type = genomic DNA
gcggggcccaggccccgccgtcgcgccagc

SEQ ID NO: 34162 - DNA, 206 bp, Homo sapiens
  misc_feature 1..206: note = chr11:129565510-129565716
  misc_feature 1..206: note = hyper
  source 1..206: mol_type = genomic DNA
caacaggtaaagcttcggatggaacctgctgtgttctgtcctcttccagctgagccaggcccgcgggccccctccaggagctccgggcaagcagcccctcatggcccgtggtggaactgcaccctcagcactggagagggcggtcgcaggagcctgcgaggaaggtggggtctcagtgctttcgcacagggcgagtggagctggaa

SEQ ID NO: 34163 - DNA, 308 bp, Homo sapiens
  misc_feature 1..308: note = chr11:130297447-130297755
  misc_feature 1..308: note = hyper
  source 1..308: mol_type = genomic DNA
gctctcagtcctacctgcaggtcggccccgtagaaggcagccatggacgcatcggccaccagcagcgtctccacgaagcgcgcctcagacacaaaccgcttggtcctactcgtggcccccaggggcggtggcggctcgctagcgccttctgcctcctcttcttggctctcctcctcgctgtcctcctggtggtctcctctctcctgcctctgaccctctcccgtctccacctcccactcgggtcctcgcgggagggggcgggctccggcgggaccccagcgctgcaggcggtgcggctgagccaggga

SEQ ID NO: 34164 - DNA, 91 bp, Homo sapiens
  misc_feature 1..91: note = chr11:130298269-130298360
  misc_feature 1..91: note = hyper
  source 1..91: mol_type = genomic DNA
tctctccaggaaaagcggaatcaatcgggtgcaaggccgactcggcccgcggggcccggcggcgggagcgctcccccggcggcccctctgg

SEQ ID NO: 34165 - DNA, 68 bp, Homo sapiens
  misc_feature 1..68: note = chr11:130318554-130318622
  misc_feature 1..68: note = hyper
  source 1..68: mol_type = genomic DNA
gcggttgcgagaagccgcccggcaccttccgctagttctcggctgcaaatcttcgtccttgcacttga

SEQ ID NO: 34166 - DNA, 30 bp, Homo sapiens
  misc_feature 1..30: note = chr11:130319107-130319137
  misc_feature 1..30: note = hyper
  source 1..30: mol_type = genomic DNA
cactgagcatctgggcgtccccctccaggg

SEQ ID NO: 34167 - DNA, 37 bp, Homo sapiens
  misc_feature 1..37: note = chr11:131558038-131558075
  misc_feature 1..37: note = hyper
  source 1..37: mol_type = genomic DNA
tgcagctccccagaacggccaccggagggcacccgcg

SEQ ID NO: 34168 - DNA, 69 bp, Homo sapiens
  misc_feature 1..69: note = chr11:131780262-131780331
  misc_feature 1..69: note = hyper
  source 1..69: mol_type = genomic DNA
cctaatttggaagcgcgtaaatggttaaactcctggcctgggctgggctggtgcacagcctgggcccgg

SEQ ID NO: 34169 - DNA, 203 bp, Homo sapiens; identical to SEQ ID NO: 1012
  misc_feature 1..203: note = chr11:131780876-131781079
  misc_feature 1..203: note = hyper
  source 1..203: mol_type = genomic DNA

SEQ ID NO: 34170 - DNA, 15 bp, Homo sapiens
  misc_feature 1..15: note = chr11:131781572-131781587
  misc_feature 1..15: note = hyper
  source 1..15: mol_type = genomic DNA
tggtttgtatggggt

SEQ ID NO: 34171 - DNA, 43 bp, Homo sapiens; identical to SEQ ID NO: 11082
  misc_feature 1..43: note = chr11:132813715-132813758
  misc_feature 1..43: note = hyper
  source 1..43: mol_type = genomic DNA

SEQ ID NO: 34172 - DNA, 294 bp, Homo sapiens
  misc_feature 1..294: note = chr11:132813907-132814201
  misc_feature 1..294: note = hyper
  source 1..294: mol_type = genomic DNA
cgcggactgcgcgctcatcccgacgggcgggcgcccaccttaacctccgccgcgcccaccgggctggggatgcctgcggggatgagcccgcaccgcgcccacttcgctccgtcccgacacccgcgccagcggagagaacgcggcgcccctcgcagcggcttcccctacagaggggcggggtggggggagcggggagggagaggggagggcgggagagggagttctggggaaagcagcaaactgaaaactgacactggcaccttccctcgccgatgccagcgcagaagttgacaa

SEQ ID NO: 34173 - DNA, 75 bp, Homo sapiens
  misc_feature 1..75: note = chr11:132864134-132864209
  misc_feature 1..75: note = hyper
  source 1..75: mol_type = genomic DNA
gcgcgggagcacgtccggggcttttacggccggaactcgggctattaaaaagcccaggcgcgattttctaattaa

SEQ ID NO: 34174 - DNA, 86 bp, Homo sapiens
  misc_feature 1..86: note = chr11:132934044-132934130
  misc_feature 1..86: note = hyper
  source 1..86: mol_type = genomic DNA
gagtgaggggtggagcggagcccagccgagggagggaaggagaggaacgccggcccactagccgaccccagcgcaacccagcgcgg

SEQ ID NO: 34175 - DNA, 185 bp, Homo sapiens
  misc_feature 1..185: note = chr11:132934388-132934573
  misc_feature 1..185: note = hyper
  source 1..185: mol_type = genomic DNA
cctaccagagactgtcgctggcgtcctcaggggccgctgcagggccaccttgtgtgcttgccctttccccacggtagactgccccgggagggggactgtgctgcctgaattcttgtccgggtgggactggcctcggtgaaggatccgggaatgggacttccgggccgggccggaggggaagtgtc

SEQ ID NO: 34176 - DNA, 449 bp, Homo sapiens
  misc_feature 1..449: note = chr11:132952542-132952991
  misc_feature 1..449: note = hyper
  source 1..449: mol_type = genomic DNA
gagtggcacagccctcggcacggcacggccctgtcagctacgaagccgggcgaggggctcaaggcccctctggagaccgcttctcccccgcggcccgtcccgccgctgcggaccccatgcgcggcctccccgccccggcgcctgggcctcctcgcggcccgggcggggcccaccaacccggagaggtcgccagcctgcagggtgccgggggcccctccgagccgacctcgtcccaggcagacgcgctgcccggagaccgccgcaagggggcgccaggggccggggcggacgtcgcgccagtgcctcgccgggaccgcacctcgtccgcgcggccgccagagggcgcccgtcagcgccggagcccgcggcggacgccccagccgagcccagccactgcctggtggagccacagggcacccgcccggaaacaccgcctgcgccccgacggc

SEQ ID NO: 34177 - DNA, 88 bp, Homo sapiens
  misc_feature 1..88: note = chr11:132953232-132953320
  misc_feature 1..88: note = hyper
  source 1..88: mol_type = genomic DNA
cgcatgcgtgtgtgctcccactgccccagcctgagtcccggatactggtgcccctgtctcgggtcgctggctgcggagagggctggcc

SEQ ID NO: 34178 - DNA, 122 bp, Homo sapiens; identical to SEQ ID NO: 11088
  misc_feature 1..122: note = chr11:133402168-133402290
  misc_feature 1..122: note = hyper
  source 1..122: mol_type = genomic DNA

SEQ ID NO: 34179 - DNA, 330 bp, Homo sapiens
  misc_feature 1..330: note = chr11:133825189-133825519
  misc_feature 1..330: note = hyper
  source 1..330: mol_type = genomic DNA
gaagagttttaaaaccgtccggaccaacatgtcagttaacaaaatcacccttcgcttcgccctctgctcgttctgttttcagacaccaccacccccctcagaagcagaggcgacatattcattccattccggaaagtttcctgaagcacgcccccctgcacagacgagtgacgaggggaccccgtgagaggcgcctccagcccacccggcgccccatgccgctgggagagggttctctgtcggcgagtcctgcctgctgactcccacccacagcgggttctctcccgccgccatctcctccggcttggtgaacttgcccgcagccgggtc

SEQ ID NO: 34180 - DNA, 183 bp, Homo sapiens
  misc_feature 1..183: note = chr11:133825520-133825703
  misc_feature 1..183: note = hyper
  source 1..183: mol_type = genomic DNA
tgtctgcgcgctgacagccctgagctcacagtcctggcaccctccaggctccgctcccacttccatacaagggccgagagccgggggtgccacccagaggcttgtaggtcgctctgcccatctccaaagcaaaagcccgcgcgctcacgcacgcatcacccaactcggtggctccccccttgc

SEQ ID NO: 34181 - DNA, 622 bp, Homo sapiens
  misc_feature 1..622: note = chr11:133825704-133826326
  misc_feature 1..622: note = hyper
  source 1..622: mol_type = genomic DNA
tctcccccagctcagacccaggaaagcggaaagagaaaatcccccctccgctcggattcacagcgtggggacccccccttccccgcccctcccctcccccgccgccgcccccagccagctctgcctcgcagcctggggagggcggcgtggggcccgcgcggctgcggcgcgctcccggggaacttttgcctggccggggcccaggtgcggctgagaggcgcgggggccggcggggtccagccaaaagcggacacacctcgaagctggcctcatcaatcctcctctcaccgggcgcccctgctagggggatccgacctccagctgccaagatgtgtgggcaggaggggcgcgagcggagcgatggacgcccgcagggccgcgcgaacccggggccttagacgcgggtgccgccagtcccagggatcctccgggtcgcgcctccctgcaggcgctcctcgcggcgcggggctctagcgtgctgcagcctgcccggagaccgcaaactcccgcagccagagtttcccgcagctctgggaggcggccgccgggcaggaggcgacgggctaggcgcgccggtgtgcaccgtggggcccgtggtgggcgaagtcgacccaggttccac

SEQ ID NO: 34182 - DNA, 619 bp, Homo sapiens
  misc_feature 1..619: note = chr11:133826744-133827363
  misc_feature 1..619: note = hyper
  source 1..619: mol_type = genomic DNA
gcgccgcctacgccccgcgccggtgctcctgcagcccgggtggccagctctccatccctcctaggctccgctcggctcggcgcgcgcctccccggccccggcgcagcggcacctgcactactcgcccgggcggagcgcagccaggtccacggtgaagcctagccgggccgggcctccggaaccgcccccgccgcccgcctattgggcgccgcccgcaagccgggggtccgattggctcagccttccgcccgtcgcggcgcgaaggaggcgagcccatttcaaggtgcgttgaagtgtggcgagcacagagccgcagaatcatgcgcattgccggggagaaggtggtatagcgtctctgcccgcttctctctcggctcacactgcgtggcaagtttctggtgagggaaatggtagcttctaacgggaccctggcgggtctcaattaccccggacaggtctgagggaagtggagcccccgcccactcatggaacccaacatccggtttccatccggcaaaaagcagttcccgagaggaccatgctgattctatgatggggaaacccaggagccggcggcccgggagagccggggaacgtccttcgccggagatcttttcaa

SEQ ID NO: 34183 - DNA, 223 bp, Homo sapiens
  misc_feature 1..223: note = chr11:133906745-133906968
  misc_feature 1..223: note = hyper
  source 1..223: mol_type = genomic DNA
cgcccccacccccaccgccaagccgaaaacccaatcctgggcccacccatttgcgtggatgccacagctcggccggaaggcttcagcgtgggagggggtgggggtgacaccagggctgccccttgagagcgacaccggcctgaaccccgtcctccccgcgccccccagccccgcctcgctgcagacggttcgccttgtccactcttctcgactcttctcgact

SEQ ID NO: 34184 - DNA, 16 bp, Homo sapiens
  misc_feature 1..16: note = chr11:133938772-133938788
  misc_feature 1..16: note = hyper
  source 1..16: mol_type = genomic DNA
agagaacccatgtgcc

SEQ ID NO: 34185 - DNA, 275 bp, Homo sapiens; identical to SEQ ID NO: 3830
  misc_feature 1..275: note = chr11:133938789-133939064
  misc_feature 1..275: note = hyper
  source 1..275: mol_type = genomic DNA

SEQ ID NO: 34186 - DNA, 372 bp, Homo sapiens
  misc_feature 1..372: note = chr11:133939065-133939437
  misc_feature 1..372: note = hyper
  source 1..372: mol_type = genomic DNA
cgtttccgctgttgggagactagggtctgggggcgacggaagcagagcgggccgaagctgctggagccggtccgggcgaggatagcggtcctggctccgagggctcccggggtcccgggccggaggggcggcgcgcgcccgcgtccccgcagccagggctgggactcgggcctggctagggcgggggccctgggacgcccggcagttggaccggggcggggagctaatttgggatggggggcccgtcccaggcagtgagtcggtcccggacagccgtcggaccccgggggcgggctcttctcgggcggggtcctgtgctgggcggtgggctcatcccccgggtgggctcctcccaggcggggtcctgtgctg

SEQ ID NO: 34187 - DNA, 50 bp, Homo sapiens
  misc_feature 1..50: note = chr11:133994694-133994744
  misc_feature 1..50: note = hyper
  source 1..50: mol_type = genomic DNA
ctctaagcttgtcagcgaaaacgctgtgctgagcccggcagaagtctgcc

SEQ ID NO: 34188 - DNA, 953 bp, Homo sapiens
  misc_feature 1..953: note = chr11:134145474-134146427
  misc_feature 1..953: note = hyper
  source 1..953: mol_type = genomic DNA
ctgtgttctttgcaacggaagaagcaaagacttcaaagggagaaatcggaagatttcttttttcatcgtagggacttcacatcagcgtttccaaaaccgagtccatcgccttttccctctgcgcagcctctatcccttcctgtgtttcgcatctcaataaacgtccccgccaagtgacttcagcctgaaacatgcggcctcccggactcctctctgtgtcaccgacctcttgcgctcagttctccggagctgccggtttaacctcgcaagtcttcccggaacccgtgccctcctcctgggcagcgttaccaccacgagcgcctacctgagaggacgcctgttctcatccagcctccaccctgcagccgagcaatctccgtaaaacgaacacctggcttagtttctgctggaaaccgttgaatagtccccactgtcttctggaagggtctgggcagctcggcgtggcgtccacggccccaccaggcctctgcctcctgcaggtcccgctacttcgtcaccaaagcgcccgccgcgctcgcatctgctgtgaggctgtgctcgggccgctcccgccgagggaacggccctcccaaggctctgcgccccaattctcgctcgtttgccaagaggtagccgtgtcggggagctagagttctccggggactctctcctgcccctcgtggccctctgtggaaccctcgttttaggatctgcacgccgtttccagtcgcgcgcgcggcacggagaccgcccgctgtgccccgcgctgcgctctctccgcccctctcccgcgcaggcctccctgtgccagccggctgtcgacccaggttaggaagcccgaggtcggggcgttaccccaagggccctcccgcttcccctccgagggcagagaggcgtccgcgcccggacgcactgcgggaacacctggagcgccggcggagctcggctgtccc

SEQ ID NO: 34189 - DNA, 232 bp, Homo sapiens; identical to SEQ ID NO: 1015
  misc_feature 1..232: note = chr11:134146444-134146676
  misc_feature 1..232: note = hyper
  source 1..232: mol_type = genomic DNA

SEQ ID NO: 34190 - DNA, 236 bp, Homo sapiens
  misc_feature 1..236: note = chr11:134146677-134146913
  misc_feature 1..236: note = hyper
  source 1..236: mol_type = genomic DNA
tcccgggctgcccaccaccccggcgcgtgcccgggagcctccaccctccccgggttctgtggccggccacgcgccccaggcacgcgccgcgccgggccgcgccaccaagcccgctgtccccagctttcctcggcagatcccctggctacccccaccctgcggaggggccgttcaccagatgccagaaaatcagggtggggcacgcaggccaggggctccagcggctgggcaccgtg

SEQ ID NO: 34191 - DNA, 336 bp, Homo sapiens
  misc_feature 1..336: note = chr11:134201818-134202154
  misc_feature 1..336: note = hyper
  source 1..336: mol_type = genomic DNA
gccccagccaatgagcgccggcgggccggttgcccaggcgaccagtgcgcggctccgccccccgcggcgaggctcccgcgcgcggctgagtgcggactggagtgggaacccgggtccccgcgcttagagaacacgcgatgaccacgtggagcctccggcggaggccggcccgcacgctgggactcctgctgctggtcgtcttgggcttcctggtgctccgcaggtgagagagagcttcgcgcagcacctgccggaccccacattccccagccctccgcacctcgggttctctcctcccgcgacccgcgaatcccgagttcccggggggagcagccc

SEQ ID NO: 34192 - DNA, 209 bp, Homo sapiens
  misc_feature 1..209: note = chr11:134281434-134281643
  misc_feature 1..209: note = hyper
  source 1..209: mol_type = genomic DNA
ctcttcccctaatcccggtcgacgagggcaggctgtgccgggttttgtttcgcagcccctcggcagcagcgcctcccagcccgagctcggttctcggccccctttccagctgcccccagcgcgcgcagcgcacacacacacacacacacacacacacacacacaccccagcgcgcgcccgggaggacatggcgtgggcaccgatgggga

SEQ ID NO: 34193 - DNA, 71 bp, Homo sapiens
  misc_feature 1..71: note = chr11:134281706-134281777
  misc_feature 1..71: note = hyper
  source 1..71: mol_type = genomic DNA
cgacgagtccggagcgtctccggtgcggtccatcgcgggcaacggcccctacgccccggccccggcgcccc

SEQ ID NO: 34194 - DNA, 70 bp, Homo sapiens; identical to SEQ ID NO: 11103
  misc_feature 1..70: note = chr11:134282862-134282932
  misc_feature 1..70: note = hyper
  source 1..70: mol_type = genomic DNA

SEQ ID NO: 34195 - DNA, 221 bp, Homo sapiens
  misc_feature 1..221: note = chr12:298173-298394
  misc_feature 1..221: note = hyper
  source 1..221: mol_type = genomic DNA
cagcagagaggatggcgaattggtgcagggcgaaggaatctgaaagagggctgtgcggtccgcagagagcgaggcttgggagcccgacccaaagcgtgccctccagggtgcagcaccgacgggtgccgcggcgtttgcaggcggggagaaggcggcgggaagtactggactagctgcgggcaggggccggctgaggcgcgcgcccgcgtgctaggggcccc

SEQ ID NO: 34196 - DNA, 198 bp, Homo sapiens
  misc_feature 1..198: note = chr12:570015-570213
  misc_feature 1..198: note = hyper
  source 1..198: mol_type = genomic DNA
gacgctggcggagaccgggcccctccagccgctccgggcttgcggttcccggggaggaggtccgtggggtccacgcgcgagctagggattcgggtgcgggatgccctcggccgtccacacccaggcgcgcgctccagtccgcgcagcccaaactttgcccaccgccttctgtttggctcactccgtttcctctcctgc

SEQ ID NO: 34197 - DNA, 68 bp, Homo sapiens
  misc_feature 1..68: note = chr12:1059279-1059347
  misc_feature 1..68: note = hyper
  source 1..68: mol_type = genomic DNA
gaccttcccagattccgcccgggccgaggcagcggtggacctggtggttctcgcggcctctcaccacc

SEQ ID NO: 34198 - DNA, 349 bp, Homo sapiens
  misc_feature 1..349: note = chr12:1639033-1639382
  misc_feature 1..349: note = hyper
  source 1..349: mol_type = genomic DNA
cgcgtagcaagaaagcggaggacataactctcttcccctctcagagcctcgggccccgcagacgccgaggtgggcgctcgtgccaggatcgcggggcgcgggtacgggctccttgggcgccccgagggggctgctggccggggtaagagccgcggtttcttcggaggatcgggtcgagttccaggagaagggggcagcaggcgtgcggcgccgggagaagggggccgggcggcggagactccccgtccgcacccccgcggcgaggcccccgggccgctctgcttaggggccgagggagccgggcgggaggcaggtgcggaggtcgcggtcccagcgcctgggaggagcc

SEQ ID NO: 34199 - DNA, 30 bp, Homo sapiens
  misc_feature 1..30: note = chr12:1906030-1906060
  misc_feature 1..30: note = hyper
  source 1..30: mol_type = genomic DNA
tccccggggccagggcgggttataactagc

SEQ ID NO: 34200 - DNA, 556 bp, Homo sapiens
  misc_feature 1..556: note = chr12:2161498-2162054
  misc_feature 1..556: note = hyper
  source 1..556: mol_type = genomic DNA
tgtcacttctacaaccgctctgattataattgatcaaacagaatcacggaatcacggctcatcttgccgttttgttcagtggcccgatccgaaacgagactctggtagtcgggcaaattgtattcctcctccttggaattccgctcacagaggccttcccggcgtggccggcccagcagggacgcgccgccgcagcggaggagagaacgcgggcggggggctgcaggccggcgcggggggcgcgacgccgccggcggggcgcgagggggtgtgtccgcgccgcggccaccgcggccaccgcggctggcgcccgggtgcgccgcgcgccccggcctccccgggggctcctcacgccgcccctcgcccgccggcggccggggcccgctccctttgacgtcatgcgggcggagggctcgctcgggcggcgctgccgcgggcgccgggagggggcccgacttcgggctccagtccgccgccgtgcgccccgcgccgtgcgcccggctccctgcgcgccgccgcagccacatctggaagcgttcagcgcgtctgcctccgg

SEQ ID NO: 34201 - DNA, 1443 bp, Homo sapiens
  misc_feature 1..1443: note = chr12:2162067-2163510
  misc_feature 1..1443: note = hyper
  source 1..1443: mol_type = genomic DNA
cgggcgggcggcgcgggcaggggcgggcgcgggcgcggcggggctgggccggggggagtgagcgcggcgctctcgcgcgcccggtgtctccctctcgctgcctctgcagaaacagctcctgccagagcggcgctcggcgcggcgcggcgggcccggagcggcggcggcggctcttcctgcctccgcgcccaggagttgccggctccctttgacagcagagagccgggcaggggcctcaggaggactcgctgggagtgggcagaggcgcctcggcccctgccggcccaggcgggccccgcgcgccccccgcccctcctctccgcctcttctcgccctgcctctcccgatttattttttcaaatggtgtagccgccggaggtgcggtgctcagttcttggaaggggcccggatgtactgaggatgcgttacagtttcactcgaggaggcagtagtggaaaggagcagtttttggggtttgatgccataatgggaatcaggtaatcgtcggcggggaagaagaaacgctgcagaccacggcttcctcgaatcttgcgcgaaagccgccggcctcggaggagggattaatccagacccgccggggggtgttttcacatttcttcctcttcgtggctgctcctcctattaaaaccatttttggtccatggtcaatgagaatacgaggatgtacattccagaggaaaaccaccaaggtaaggctggaccccgccgcctcgccggggctccctgccttttccaccgggttcctgccctacccgcgctccccgcggccccggggccggtccctgcggagtggcccggggccgcgtccgcgaggggcgcctccgcctcgtcggagcgcccgggagcccggcgggaccggggcccgaaccgccgcgcgagacggagcggaaaattcccgcccctccccctccgggccccagcttctccagagcatgtgtttcctgtgaaattccaggcgaggggggaaaagttccccaagtggctgccgccgcctcgctttctcgcgtccgcctggagagcccggctgcctggccagccgcgcggggggcagagggcgccggcgccgcggagcccagaggcccggggtccctcgcccggctcggggcgcggctgggagcgcgcgcgcgcgcaccctgcgccggcagagcccggcgcccacggccgcccctggggcgccctcgcgctgcccggcgtccactctcgtccaggcgcccctgccctgggcggcgcgctccaggtggcgggtgggggcggcggtgcagatgtgaagcccagcgcgcccctctggttccccctctgtaggtccccttcttcctctctccctccctcctccgccgctcacctacacccacccacctctccactgctgttgaccccgagcgcgcccacgccgcgtgtgttctcattcgcacccacatgtgg

SEQ ID NO: 34202 - DNA, 63 bp, Homo sapiens
  misc_feature 1..63: note = chr12:2800100-2800163
  misc_feature 1..63: note = hyper
  source 1..63: mol_type = genomic DNA
agatcccaagttcatcgaggtcaccacccaggagctggccgacgcctgcgacatgaccataga

SEQ ID NO: 34203 - DNA, 402 bp, Homo sapiens
  misc_feature 1..402: note = chr12:2861741-2862143
  misc_feature 1..402: note = hyper
  source 1..402: mol_type = genomic DNA
ccatctgctcctccccgctcactcaggtctcctgctcaggacgcccttgccgagggcgcggggcatttgtactgaagaagggctgcaggagagtcggtgacccctccttctacttgtatgtagcggccccaagtgtcccgggagctggtggggcgcttgggctgtatgagcccggccgccaggaggctggggctgcgtcaggagctgtccgtggtgcttaagcggcgtctgctcgggcgcggggtgtggcgcggcgggtgagcgctgtccctggtcctggagaggttcctggcccccagtggcaacggtgagagcagtggcccagaaggccagtaccgggaacgacgatggcgggcacaagggtgggcttgcagcagctgctgctggtgctcccacaggctg

SEQ ID NO: 34204 - DNA, 324 bp, Homo sapiens
  misc_feature 1..324: note = chr12:2862267-2862591
  misc_feature 1..324: note = hyper
  source 1..324: mol_type = genomic DNA
cgcgcaccgggttttccagcaggctctcgatgccacccaccgccgcctgcgccctgcctgcccctgggctggcgcctgggagcgcgagggcgcgggaacccagcagcccagcggtcctctcccacgggcccagcctccctcccgccgccagcgccgcgtcaccgccaccccgattgtcacacactcaccacggggagaggccgcggcccagagcaccccttcctgtctcttggtgtccagaggaggctctgcctcccgctgggcagagaggagagggaggaggccagcgagagggagcctgtgtcggggcgtgggagggaagca

SEQ ID NO: 34205 - DNA, 405 bp, Homo sapiens
  misc_feature 1..405: note = chr12:3474894-3475299
  misc_feature 1..405: note = hyper
  source 1..405: mol_type = genomic DNA
tcccgggagggcacacggcccccagaggcccagagctcttcccaaggcacaagtgcagaaggcggactcaggcgtgtggttaaggaccccctgctgcgggcccctgcacacaccaacgcgtgctcccacgcgccgcgactcccccgggatgcctgccccacccctatccgcagccagcgtccccctgcccgccggccccgccacggtccatcagggactgcgggcggcggaggtggcggcgccttgccgggacccccagcctccctcccccgcccccggcgccccaccccacgcgggcgcgcttctcccgccgcagccgcccgcgctcacctggcccggacacgggctccgccacgcggtgatggaagctgagcctagagaggcggagagcggcggctcgcaggg

SEQ ID NO: 34206 - DNA, 62 bp, Homo sapiens
  misc_feature 1..62: note = chr12:3475605-3475667
  misc_feature 1..62: note = hyper
  source 1..62: mol_type = genomic DNA
gctttcaaacctccccgcgctccgcagcccccagcccccgccctacccgccctctcagatcc

SEQ ID NO: 34207 - DNA, 256 bp, Homo sapiens
  misc_feature 1..256: note = chr12:3599973-3600229
  misc_feature 1..256: note = hyper
  source 1..256: mol_type = genomic DNA
caaatcgtaattcgccgaggaaggatccaggaactggcagaggagcgggagagctggggtgggccggggtggggagggtgcgagttaactgtggcccggtctcgcccggacctcgccctaggtgggagcacgcgcaccgggtctgagaacctgcaagagcctcgcccggcgccggctttctctgggccccccgcgcgggcctggcctccacgtaagttgtgtgcagcgccagggagtggaggcggccgagaccctc

SEQ ID NO: 34208 - DNA, 115 bp, Homo sapiens; identical to SEQ ID NO: 3839
  misc_feature 1..115: note = chr12:3600230-3600345
  misc_feature 1..115: note = hyper
  source 1..115: mol_type = genomic DNA

SEQ ID NO: 34209 - DNA, 15 bp, Homo sapiens
  misc_feature 1..15: note = chr12:3600768-3600783
  misc_feature 1..15: note = hyper
  source 1..15: mol_type = genomic DNA
tcaccaaacccttgc

SEQ ID NO: 34210 - skipped

SEQ ID NO: 34211 - DNA, 214 bp, Homo sapiens
  misc_feature 1..214: note = chr12:3601042-3601256
  misc_feature 1..214: note = hyper
  source 1..214: mol_type = genomic DNA
tgtgtgtgtgtgttggtggggggtgggggggaagttcatgtctcaggtcccctccctcttgaaaatgcaaaacagtcactctcaccccatcaccctctcctgccacccgctgctcccttctcccgcccccaagtcccaaaccccgggcagccgcgctcccctgccctctcctctgggctccgtgagggctcccgggtcccggctttgtgcagag

SEQ ID NO: 34212 - DNA, 62 bp, Homo sapiens
  misc_feature 1..62: note = chr12:3601510-3601572
  misc_feature 1..62: note = hyper
  source 1..62: mol_type = genomic DNA
acccggcagggcacacgggccgcggccaccttcagcaccagggacagcgtccgcccctgcag

SEQ ID NO: 34213 - DNA, 696 bp, Homo sapiens
  misc_feature 1..696: note = chr12:3602021-3602717
  misc_feature 1..696: note = hyper
  source 1..696: mol_type = genomic DNA
gtctggtggggctgccgcacatttcacatatggttacccatatgcagcggggggcggggatgggggtgtggcgcggggattgtccctctgtcttgccggaatgcaaaaaggtagagagacccttcctggtcttcttccctcgagttcttaactctgcgctaaaacccctaccccacggcgtaggcagcaaagctttataaatcccccttctctgagagactagaagcagcatgcatctgacaattgtcaatttcaaaacaaacacgctccgggacttgaacgcagcggggcattcagtagcgaatgctgtctccttgagttagggcaaagcctgcgtgcccgccgtcccctcaccacttcctcttccccagcccccacctgagagcagacattcggaatgatgtgtagtgcgaggcggctagcctcccagcagaaagccatccttaccattcccctcaccctccgccctctgatcgcccacccgccgaaagggtttctaaaaatagcccagggcttcaaggccgcgcttctgtgaagtgtggagcgagcgggcacgtagcggtctctgccaggtggctggagccctggaagcgagaaggcgcttcctccctgcatttccacctcaccccacccccggctcatttttctaagaaaaagtttttgcggttccctttgcctcctacccccgctgccgcg

SEQ ID NO: 34214 - DNA, 15 bp, Homo sapiens
  misc_feature 1..15: note = chr12:3602864-3602879
  misc_feature 1..15: note = hyper
  source 1..15: mol_type = genomic DNA
cgctcccccttctca

SEQ ID NO: 34215 - DNA, 329 bp, Homo sapiens
  misc_feature 1..329: note = chr12:4140405-4140734
  misc_feature 1..329: note = hyper
  source 1..329: mol_type = genomic DNA
actgcctgagcctcccgcccgcccgccgcgcccccgcccggggccgggaaacgagcagggacaactccccgcccgcgcctccccgcgcccggcggcccggctagcaacccagaggcgcggcgctgcgattggctgcgcgggggagaaggggcgctgcgctgctccaatcgccggccgcgcccggaggccgcgccgccaggaggccgcggacgcgtgctcgcatgcctgtggtatttgctcagaggggcatgaccacttcgggcaagcctttaaatgtgagtcagctttcggccgatccctgggaaaaattccttcggtgttgtcaggca

SEQ ID NO: 34216 - DNA, 419 bp, Homo sapiens
  misc_feature 1..419: note = chr12:4274001-4274420
  misc_feature 1..419: note = hyper
  source 1..419: mol_type = genomic DNA
cgtccgccccggggagagctggaaggtgggcccggatctcccacatcactatgagctcattccagccccggccaagcaaagcctggccctactcgctccacatgcatttcagtctcctctcgcctttcatgcgcggaggagccgggagggagaggatgtgacctcatctgcgcggcatctgagcccaggggtgccccagctcttccacccaggccgctccccgagcccagctccccgcgcccctctctctatccaggagagacgcattggacagccaggagggctcgacgtggaaggaaaggaagctgcaattctgggacaggggcagacgggagaggaagtgaacgtggctaaacgctcactttatgtaaaacgtcccccagactagaatctcgtccacagagctgcacacatacact

SEQ ID NO: 34217 - DNA, 577 bp, Homo sapiens
  misc_feature 1..577: note = chr12:4377981-4378558
  misc_feature 1..577: note = hyper
  source 1..577: mol_type = genomic DNA
gcagcaaaattcatccgatatcgctcacaatgcatgcacgggttatcttacatgtaatagccatcgtattaaccaacccagctgatactgagatggtgaatggggcgggggagcagggaggaatatgtcgcgcatgaaaaactccgggtgtaaaagtcaatgcagaactcactccccgaggaaccgaaaaagacattcacgactctcaagtggagagaggatagaaagtcaagtggcgggggtcgcgaccagtgatcgggatttcagtctgatctcagtacccagcggaacaggaccataacctaaagaaatgagctttttccggagcaaagagcggccccgatttcaaagtagaaaaaataaactgcttgggggtggaagatggcgaggggcggggggcggggagggaggcgggtcgcggcgctggctccggggtccgcggcacggcctcctctgccgcgctgcccagggcccggaccctgcccggcgctgcgcccaccgcgagggtgccagacccgccgcgccgccgccgcgctctcccagccgcggccccctcccccgccgcttcctcttgctc

SEQ ID NO: 34218 - DNA, 1118 bp, Homo sapiens
  misc_feature 1..1118: note = chr12:4378802-4379920
  misc_feature 1..1118: note = hyper
  source 1..1118: mol_type = genomic DNA
ttccagagctattttcggccgcgtgaggcgtgtcctaagctgaatcagacaggaagagggggaagttcgggtcttttaattttttttttttccgaagggaggggagtgagatgctaggtgggtgacagacggcaggcgctcgccttcttaactcacgcctgtcgcatctgccgcctcagtaatccagccccgtccaagccgaaattcgccgaagggagtgcggatgcacaggcctggcggactctgcccccctccagaacgcagcggcccagcgccccggcgggcgcggctgcgaccagagggtcccggaagcgagtgaacacctgcaatcgcactgcccgtccccacccaccctgctcccccgtgctctccgcttcccgacgttttcctcttctccttgtccgcatttttctactttgcctgcactccctccttcctcttgatgtgcctcctatgtgtcccctcggatttatgtgtcccctcgcattttgccagtcgggttttcggttttgattgaccgtccatccctccacggagaaacacaaacacagctccactctttgggggagccgaggggaaggcagtggctcccatttctgagcctgaactcagtcactacccgctccccacctggcctaggcgcccctgcgcggagaaggcgggactcgaactcgcgctgctcccgggccttgagccgaccgcggaatcacctggctgggaggcatcctccaggtaagcttgggagtatgtgtgcttagtgctgcaggctcctgcagaaaagtgcctataaacacccaacaccctgctgcaccctccacctccaggctttgtacactttccaaccgaaactccaaaacgctagcgtagagggtggggagccggccggaaaaagaataaaagtccaataaaactggcgttcgctaaagtttatcaccagtcctacatgggatatatatatatgtatttttttttccgtgaagggtgaaaaggagataaggaagaaccaacaatctaccccctcccgccgccccccacccccgcgccacggtgatcagtttggacttcaaagccagagcacaggctcttgcgctttttcttgaaaccgaagtctacactga

SEQ ID NO: 34219 - DNA, 30 bp, Homo sapiens
  misc_feature 1..30: note = chr12:4380166-4380196
  misc_feature 1..30: note = hyper
  source 1..30: mol_type = genomic DNA
ggaacagtcagtaatcggaaggggaagtgg

SEQ ID NO: 34220 - DNA, 139 bp, Homo sapiens
  misc_feature 1..139: note = chr12:4380525-4380664
  misc_feature 1..139: note = hyper
  source 1..139: mol_type = genomic DNA
ctggatgcctttccccggagaagggggggtgtgcggagtcggggtggaagagaccttgctcgcagagctatatcaagtgatgtccagaggctgggagccccggcggcctctgtcccttgcctgtcgggttagatttata

SEQ ID NO: 34221 - DNA, 41 bp, Homo sapiens
  misc_feature 1..41: note = chr12:4380888-4380929
  misc_feature 1..41: note = hyper
  source 1..41: mol_type = genomic DNA
acacggtattcggcccgggtgtcatccgcggcgctggactg

SEQ ID NO: 34222 - DNA, 508 bp, Homo sapiens
  misc_feature 1..508: note = chr12:4381878-4382386
  misc_feature 1..508: note = hyper
  source 1..508: mol_type = genomic DNA
gggcgaaggaccgagcgtggaggcctcatgcctccggggaaaggaaggggtggtggtgtttgcgcagggggagcgagggggagccggacctaatccctcactcgccccctccccctcccgggccatttcctagaaagctgcatcggtgtggccacgctcagcgcagacacctcgggcggcttgtcagcagatgcaggggcgaggaagcgggtttttcctgcgtggccgctggccgcgggggaaccgctgggagccctgcccccggcctgcggcggccctagacgctgcaccgcgtcgccccacggcgcccgaagagcccccagaaacacgatggtttctgctcgaggatcacattctatccctccagagaagcaccccccttccttcctaatacccacctctccctccctcttcttcctctgcacacactctgcaggggggggcagaagggacgttgttctggtccctttaatcggggctttcgaaacagcttcgaagttatcaggaa

SEQ ID NO: 34223 - DNA, 802 bp, Homo sapiens
  misc_feature 1..802: note = chr12:4383224-4384026
  misc_feature 1..802: note = hyper
  source 1..802: mol_type = genomic DNA
gaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtaggtcggggggtggcgctcgccaggagccaggacccctccggatgctcgggtccccggccggagccctaaacctgggagagggcaatccccgcgccggcctcccggctcctgtgcgggagtttaccgcgcgccttctggcgagacgcgtggctttatttctgttcctctccagataaactggggaggcagaggggggaggaaaatctgggagaagcgaggctgtcctgggcgggggtaggggagcatcccgcgcgcgtgttcctgcatgtggctgcctcttcttcccacccccctcgcgacctgtcttttgcgaagccgccgcggctgcttgcgctgcggccaggaagagagtcggggcctgaaatcgggaccccgagtagaaaggcaaccccccccaaaaggccagagcaaattcgtcttggcctcaggtccccgcctgtggtcgcgactccgcgctggcacttcaccggggaggtggagggaggagggagaaggagagaaacggggaattcgggagccccggaagtcccattgaagaaacgcgtgtttcaggggaacccaaaagaaccgcttcttgcccctcactccaagtctttgcccagcgagccgtgtgcccacgtat

SEQ ID NO: 34224 - DNA, 808 bp, Homo sapiens; identical to SEQ ID NO: 1018
  misc_feature 1..808: note = chr12:5017990-5018798
  misc_feature 1..808: note = hyper
  source 1..808: mol_type = genomic DNA

SEQ ID NO: 34225 - skipped

SEQ ID NO: 34226 - DNA, 229 bp, Homo sapiens; identical to SEQ ID NO: 1020
  misc_feature 1..229: note = chr12:5018806-5019035
  misc_feature 1..229: note = hyper
  source 1..229: mol_type = genomic DNA

SEQ ID NO: 34227 - DNA, 659 bp, Homo sapiens; identical to SEQ ID NO: 1021
  misc_feature 1..659: note = chr12:5019084-5019743
  misc_feature 1..659: note = hyper
  source 1..659: mol_type = genomic DNA

SEQ ID NO: 34228 - DNA, 521 bp, Homo sapiens
  misc_feature 1..521: note = chr12:5019793-5020314
  misc_feature 1..521: note = hyper
  source 1..521: mol_type = genomic DNA
cggctgttgggcattggggaaagtgggatggaagagccccaaacttggatttccgggtgtctgcgtgtcgtctgtccgtgtgtgtgtgatagccctagcaaacgtccagtgctttctcaagctagaggtctgtgttcttcggtgtctgtaggtccgtcccatctgaatgcttctgattttctacccccgtatcactttctatttctctgcagcgtgcatcgatcgccctggtgggagcttagaaggcggcaggcgaagaggggtaggaggggggagagccgaggagaagcagagagggtggcaggcgtggggatctgccgagccggcactgcaccgggtcctaggaaggctctcggaggggaggggaggccagggcgacccccgaagcaatggcccagtccgctagaacggcactgcgttaaggcacctgggatcaggaagaaatatctaaacaacaacaacagaaaaccaacaaacccccaaacccaaacccaaccctctgcaaaaagctgcacccggcc

SEQ ID NO: 34229 - DNA, 372 bp, Homo sapiens
  misc_feature 1..372: note = chr12:5152915-5153287
  misc_feature 1..372: note = hyper
  source 1..372: mol_type = genomic DNA
taggggccccagctgcgccctccggggagacacccgctgccacgagacccgggaggggaagcgggaggagggggagaggaggggaaggcgggggaggcgccgagggtggaggccaagcgcggcgcagccagagaggggcggctgaaggttgcatctgctggaaggaggcttttcggctgcttggtaacgggctgccagaagagagagaggcagagagcagggcagcggcttcttgacgtcagggccaagcgaggggatcgcgccagcaaccccagctctccccagagaggggccggccgaccgctggagcggagcctgacgccaggcgcccgcggagcgtgagtagggggcgcgggagccggtcagctgggg

SEQ ID NO: 34230 - DNA, 104 bp, Homo sapiens; identical to SEQ ID NO: 11129
  misc_feature 1..104: note = chr12:5153357-5153461
  misc_feature 1..104: note = hyper
  source 1..104: mol_type = genomic DNA

SEQ ID NO: 34231 - DNA, 102 bp, Homo sapiens
  misc_feature 1..102: note = chr12:5541088-5541190
  misc_feature 1..102: note = hyper
  source 1..102: mol_type = genomic DNA
aaatgaccccttccccgccacgggtcccgaagtgagggcggggggggggctctggggcgcgggcgcgcgcggcgcggcgcgggccggcgggggagggcggcg

SEQ ID NO: 34232 - DNA, 205 bp, Homo sapiens
  misc_feature 1..205: note = chr12:5541504-5541709
  misc_feature 1..205: note = hyper
  source 1..205: mol_type = genomic DNA
cacggtaaggggaggcggcgggcaccttgggtgggcaggtttggggatgggggtccacgtggggagggattttccagtggactggtgcggggggccccagatccgcatcccgccccacccccatcgcgccgcgctcactcactttcccgggcttgtgtcttccccaaagtttgcgctgggatctgctcaggccgaagcgcaaccg

SEQ ID NO: 34233 - DNA, 896 bp, Homo sapiens
  misc_feature 1..896: note = chr12:5542015-5542911
  misc_feature 1..896: note = hyper
  source 1..896: mol_type = genomic DNA
tggcagacagaactccgggcggggaggtgccgcggcagctcccctgcacacgccctgcactctgccggccgctgagcctgattctcagctcgccccagcaccactctggcccgggcgtgggctggggggaggggacgcgcagctcaggacccggaacctcgcgttccagttttgggagttgggactcactgccacgcgccgcgtacctgcgttggagttccccgaaagggttttttcagaaaagacctcgcgccccgggctcctcttggccagcgcccacccggtggccaccccaccctgggcctttgcgcagatgttggagctccgtacgcagcccgcacatctgggacccctccggggagcggcgggcacccgggcccggccatcccaggggatctccttgcggtatcgtccagcctgttctcggactttgagcggtggcgtgggaggccgggagacctgggcacccgcgcagccagccaggtcggagtttaaaggtcccacgacggaccgaactgtcccattgccccagagctttactcagtggtggatgctcctgatgaaatttgggacgcttgggagttgaaggttagggacaggaggggcgagggccgagggcatgggatgggggagtaggattctgcttgttgctctccgcgggagtgggtgcgcgtccaggaggcgctgcttctttgcgggagtttggctgctgcgttcattcgtcgtctgcgcttcagatgcacggcactgagacccttgcgtccgacggtgtcggggctgtggactagaaaggatcccttttgctggaatcgaggctggggtgggattgccggtgggggaaacaccgaaaagatcgtctggcctcggcctctggcggcgggcggcaggttctgagt

SEQ ID NO: 34234 - DNA, 116 bp, Homo sapiens
  misc_feature 1..116: note = chr12:6444922-6445038
  misc_feature 1..116: note = hyper
  source 1..116: mol_type = genomic DNA
accaactccacatttcggagcaggaggccagtcaccctgagtcagccacggggagacgctgcagctgtaagctgtgcaggcccggaagttcaagcctcagccgcaaacaggggaag

SEQ ID NO: 34235 - DNA, 30 bp, Homo sapiens
  misc_feature 1..30: note = chr12:6450544-6450574
  misc_feature 1..30: note = hyper
  source 1..30: mol_type = genomic DNA
gacagaattcagaaccgtctggactccccg

SEQ ID NO: 34236 - DNA, 90 bp, Homo sapiens
  misc_feature 1..90: note = chr12:6472461-6472551
  misc_feature 1..90: note = hyper
  source 1..90: mol_type = genomic DNA
acttttttttttgcccgcgagcccacgaggccccgcgtggtgtcactgggctgcgcgggcgggtcaggaaaggagcggagcccatgggtg

SEQ ID NO: 34237 - DNA, 46 bp, Homo sapiens
  misc_feature 1..46: note = chr12:6472854-6472900
  misc_feature 1..46: note = hyper
  source 1..46: mol_type = genomic DNA
ctcctctttaatttccgggtacctgaaggggcgaggggaagagggt

SEQ ID NO: 34238 - DNA, 153 bp, Homo sapiens; identical to SEQ ID NO: 3849
  misc_feature 1..153: note = chr12:6664370-6664523
  misc_feature 1..153: note = hyper
  source 1..153: mol_type = genomic DNA

SEQ ID NO: 34239 - DNA, 65 bp, Homo sapiens
  misc_feature 1..65: note = chr12:6809448-6809513
  misc_feature 1..65: note = hyper
  source 1..65: mol_type = genomic DNA
cgaggaaaaggaggtcggcgaagggaccccgaggcagggagtgccgagagcggactggggacccg

SEQ ID NO: 34240 - DNA, 30 bp, Homo sapiens
  misc_feature 1..30: note = chr12:8088887-8088917
  misc_feature 1..30: note = hyper
  source 1..30: mol_type = genomic DNA
aatcttgtgatctctcggaattctgtgtta

SEQ ID NO: 34241 - DNA, 386 bp, Homo sapiens
  misc_feature 1..386: note = chr12:8123142-8123528
  misc_feature 1..386: note = hyper
  source 1..386: mol_type = genomic DNA
ccgcgctctccctttcttgcactcgtctttatcttctaagccctccacatgcttttaaactgtcagtcttttcatttttatttcttcctcttggacgcatttacccaaattggcccgagggaggctgagacagcagatacgaaagaaaaatgtgtgtatgcgtgagtctttgggtggcgaagaaggaggaggaggaatgtagctcggggctcggcccccgtgctgggattccgagggcgggggacaggatgcgcgcgcggcgggtagcgtgccacacggcacgtcccggccgctgcaggaaggcggggctcaggtcccgccgactcccacatgctgggggacaccgggagcgcctcccactcccagcccgccggagagccttgcaa

SEQ ID NO: 34242 - DNA, 592 bp, Homo sapiens
  misc_feature 1..592: note = chr12:8171294-8171886
  misc_feature 1..592: note = hyper
  source 1..592: mol_type = genomic DNA
aatctggccccaggccgccgccgccgcgcccggcagtgacagcgaccgcgccgctgcgctcccgccggccccgcccgcagccgctgggacccactaactgcctcgaaaagcctaggattcgactttgaatggtccgttaatgtggtcgcaaaacgtgactcggttcatcgggcgctccctgtaagcaagacaagcacccacctgcggtcagagcaggggtccggctcgcggtcggggttgtccaggccctcccggcttctcacctgcgcaccacacggtccagccctggcggctgcaggggatccctccgagcgccccctcaggcgtcttcctgcgaccggggagagggaaccctttacggggaaacagttttggggcccaccacccttggcgccgccgttaggagggtgtgaacatttctgctttaagagatacccgagcccctcaccgcctgcggcagggaggtggtgccccggctatcgccgcgggctggccggctgggctgggaagaaggctcagggtgagatcaggcaaagagttctttcggactcacgagctctttttggatgaaaagccccgcagttctctccac

SEQ ID NO: 34243 - DNA, 92 bp, Homo sapiens
  misc_feature 1..92: note = chr12:8548890-8548982
  misc_feature 1..92: note = hyper
  source 1..92: mol_type = genomic DNA
tcagaatgaaggccgccctcccaacttcaacccggggcaggccacggagcctctcgccgcccctacccctcgttccccgcatccccgcgcac

SEQ ID NO: 34244 - DNA, 160 bp, Homo sapiens
  misc_feature 1..160: note = chr12:10306356-10306516
  misc_feature 1..160: note = hyper
  source 1..160: mol_type = genomic DNA
cccagccagcacatccgccatcctgcaccccaggttccggcacgggctgcgacggggcctcggaactgctcccaagcggctgggaaagaactcagtcaggcatgtcggcctgcaaagcacccaggatgggcagtggagtctgcaccgttgacaggctcct

SEQ ID NO: 34245 - DNA, 279 bp, Homo sapiens
  misc_feature 1..279: note = chr12:11653509-11653788
  misc_feature 1..279: note = hyper
  source 1..279: mol_type = genomic DNA
cgacgagctggagcggcggctgaacgagctgagcgcctagaatcgcagcctgtgggagcatccgcagctgccgcaagcgcagcctccgcccggattccttacctcgtagccgtccccgctgccggccctcctaggcaccgctgccgccgccaccgccggggcccaggaacatcttcaggaccacggacagcgctcatccgcccggccactgcccgcgcccgagctggcatcgtttcagaaccacgaacagctcctggcgcaacccgagccagaccctgg

SEQ ID NO: 34246 - DNA, 30 bp, Homo sapiens; identical to SEQ ID NO: 11139
  misc_feature 1..30: note = chr12:12869188-12869218
  misc_feature 1..30: note = hyper
  source 1..30: mol_type = genomic DNA

SEQ ID NO: 34247 - DNA, 43 bp, Homo sapiens
  misc_feature 1..43: note = chr12:13069440-13069483
  misc_feature 1..43: note = hyper
  source 1..43: mol_type = genomic DNA
cagacacccagtaggcgcgaggcaaatgcgtcccattttaaga

SEQ ID NO: 34248 - DNA, 208 bp, Homo sapiens
  misc_feature 1..208: note = chr12:13154576-13154784
  misc_feature 1..208: note = hyper
  source 1..208: mol_type = genomic DNA
ctgagcgggggcccccgaggtgacggccagcccggcgcccacctgggacgcaaccccgggcaatgcctccggccgcggggagcaaatcaagaaagggccgagaaagttgtgatcggctctgtcctgacgctcatctctctgcgatcgcgggcaactgcctggtggtatctccgtgtgcttcgtcaagaagctccgccagccctccaac

SEQ ID NO: 34249 - DNA, 51 bp, Homo sapiens
  misc_feature 1..51: note = chr12:13431314-13431365
  misc_feature 1..51: note = hyper
  source 1..51: mol_type = genomic DNA
caggggagcaggggccgctggccgggaatcgcaagccggtctcctgtacat

SEQ ID NO: 34250 - DNA, 30 bp, Homo sapiens
  misc_feature 1..30: note = chr12:14133113-14133143
  misc_feature 1..30: note = hyper
  source 1..30: mol_type = genomic DNA
ccagagtaattattccgtgtgcatgtgagg

SEQ ID NO: 34251 - DNA, 30 bp, Homo sapiens
  misc_feature 1..30: note = chr12:14133343-14133373
  misc_feature 1..30: note = hyper
  source 1..30: mol_type = genomic DNA
gagaaaaatgcattccgaaaaagatatcaa

SEQ ID NO: 34252 - DNA, 1668 bp, Homo sapiens
  misc_feature 1..1668: note = chr12:14133587-14135255
  misc_feature 1..1668: note = hyper
  source 1..1668: mol_type = genomic DNA
gaagggggggagaagcggcaccatacagcaacacacactcacacacacgcagaaacacaattcccacttaactcgccagcgagtgcggcccccagccccatctgcattgctgctgacttgtctcgctcgctctccccatcgcctccagcagcagcgccgcctcccaccccgggcttgtgctgaatgggttctgattgtgcacggggtgcacactgggcatttcttggaaggggcacactgacgcgcgcacacacgcccccgacgcgcacgcgccccgcgcgcactcacactcacccccgcgcacactcacccccgcgcacactcacgctgccgccgcgctgaggtgcagcgcacggggcttcacctgcaacgtgtcgattggacggatgggctcggcgcgtgggtccggcccggggcgccgctgccctgcccctctgctaggtgaagggatgaaaccccccaaaagaccagagacagccctacccagtcacagcaccccctcccccacaaaaaaaaaaaacctttaaaaaagccacgtccaaattagcaagtgccgggttctgctggatttcagagctttacctcatgccagattcgttcacgatttcacggcttcgaccctttatctgcctgacacccccaaacccctacattcaaaggagagactccaaagcccatctttacgtaccggctccgagcgcctccgcggttgcagtctgcggagaggggtggccggtggctgggaatggagggttttcctttcctgcaaagcaggattaatgatccgtctcgggggttttgaagttcatgactcttctttgcaaggcaaaaggatatgcattcggacgccagcactactggatggtggtgatcaagaatcacccttgacgagcactctcgatagagcgaagccccgagatttcctagaggtgaagaagccggaggaagtggtttttgaaagggggtggggggaaccttcctttctcaaaaagaggtggggggtggagaggcaggagcccagattccagttggtgaggatcggagccgggggaagggaagcgggcgggggcaggctgtgcaagtcaaccgcgcggcagccggagagggagagcaggaggggaggaggggagcgtcagaaaaatgggtattaatcaccggggacggggggaggcgcggggaacgcaggttgcctggtctggatttgggtctcacactcaaaaacgtgccgcgcacacacacacagacacacacacaccccctacctcgcacaccctgactccggggggaggagaaacccacgaagctggggaagatactgcttctgctcccaggggcgggtgtgagcgcgcgtgtcctctttctccacaccccccaccccaccccacccccaagcccctgcaccccctcactcctcttgctaagactctggcggaggcagcttcccacgtcatgtgctggggaagtggggtggtaaggtggatggaagggggacggaagggggaagaagcttagcccgagtccgtggcgcctcctcccggccgcagcggggaacagcaccgacggagagcggctgaggggcgaggggagctagacagtgccccccgtgggcggcccgcgggctgcggaaagcatctccaaggcggagctgtagttcgaaattgaagaccc

SEQ ID NO: 34253 - DNA, 333 bp, Homo sapiens
  misc_feature 1..333: note = chr12:14927056-14927389
  misc_feature 1..333: note = hyper
  source 1..333: mol_type = genomic DNA
ttatgtgcttggaagcgagcgtggtcgtggaaaacccgtaaccgctaaattcatctgggtccccaaagactgagccggctggcctcgttatttatgtgagcggctatgtaaatgaggattcggagattgctctattgattggagagagctggaggaggcggtctctcttccagagcgctagttgggagcggagcctgcctgtcattggtcaccagagccaatggaaaggggctgccgcgcggccgtaaagagtttgtagaggcagttcgggtgcggtacgttgcattccggtaccggacgccgagagcggtttgtctccgtctctggagttgt

SEQ ID NO: 34254 - DNA, 83 bp, Homo sapiens
  misc_feature 1..83: note = chr12:14927697-14927780
  misc_feature 1..83: note = hyper
  source 1..83: mol_type = genomic DNA
gggcaaagtgaccatcgctcagggcggcgtcctgcccaacatccaggccgtgctgctgcccaagaagacggagagtcagaaga

SEQ ID NO: 34255 - DNA, 30 bp, Homo sapiens
  misc_feature 1..30: note = chr12:14928130-14928160
  misc_feature 1..30: note = hyper
  source 1..30: mol_type = genomic DNA
gggtggaagccacctcgctgtcagtagggc

SEQ ID NO: 34256 - DNA, 328 bp, Homo sapiens
  misc_feature 1..328: note = chr12:15374199-15374527
  misc_feature 1..328: note = hyper
  source 1..328: mol_type = genomic DNA
agccctcccacactgcgcagcccaggcttcaggttgcgtttgcgagttgctgggctgcggtcgtgggtgggactcgccgcagaagcaagtgccagtggcccggcgggggtctcctcactcgcgctcgctccgactagcggcggagggactgcggcaggacgcgagctgagcccggccaaggccgctgcgctcagcggccaggatgctgcagtgcggcgcttcggcgccccctactgggggcaggggcaggctcctcccgccgcgctgcctcccaggcttgcgagcttgggtctttaacgtgctgcacccaagacgggcttcccttttt

SEQ ID NO: 34257 - DNA, 70 bp, Homo sapiens
  misc_feature 1..70: note = chr12:15475751-15475821
  misc_feature 1..70: note = hyper
  source 1..70: mol_type = genomic DNA
acccctttttcccagcggtccgggcggcagccgcgctccggcgccctcgctctgccgttgggagcggcgc

SEQ ID NO: 34258 - DNA, 41 bp, Homo sapiens
  misc_feature 1..41: note = chr12:16500483-16500524
  misc_feature 1..41: note = hyper
  source 1..41: mol_type = genomic DNA
tggcgaggttggggtcgggctttaaacgtgggagggctaat

SEQ ID NO: 34259 - DNA, 119 bp, Homo sapiens
  misc_feature 1..119: note = chr12:16757916-16758035
  misc_feature 1..119: note = hyper
  source 1..119: mol_type = genomic DNA
agtgtggacctggtgcgcagcctacaccgccgaggaccgactattgtgaagccactttgggagcgggtcggagtggcggcagggggtgggggaagggatgaggacggccagacaagaca

SEQ ID NO: 34260 - DNA, 30 bp, Homo sapiens
  misc_feature 1..30: note = chr12:16758398-16758428
  misc_feature 1..30: note = hyper
  source 1..30: mol_type = genomic DNA
acagccacttttccacggcaaaggaacaac

SEQ ID NO: 34261 - DNA, 89 bp, Homo sapiens
  misc_feature 1..89: note = chr12:20521231-20521320
  misc_feature 1..89: note = hyper
  source 1..89: mol_type = genomic DNA
cttaaagaaagaaagcggaattgtcgatcactccagttgccagttttatacaattttaagcagtcgtcgccactcgtttcccctttgca

SEQ ID NO: 34262 - DNA, 74 bp, Homo sapiens
  misc_feature 1..74: note = chr12:20521767-20521841
  misc_feature 1..74: note = hyper
  source 1..74: mol_type = genomic DNA
gaatggcccggagcccgccctgcgcccccggctcctccagcgtcagcggctcctgcgcgcgggatgcattgggc

SEQ ID NO: 34263 - DNA, 425 bp, Homo sapiens
  misc_feature 1..425: note = chr12:20522347-20522772
  misc_feature 1..425: note = hyper
  source 1..425: mol_type = genomic DNA
cgtggctgctggggagacctggtgctgcagccgctccggagctctcggaaactttcctccgcgctgtgcgcgggctccctgtcctttctgctggcgctgctggtgaggctggtccgcggggaggtcggctgtgacctggagcagtgtaaggaggcggcggcggcggaggaggaggaagcagccccgggagcagaagggggcgtcttcccggggcctcggggaggtgctcccgggggcggtgcgcggctcagcccctggctgcagccctcggcgctgctcttcagtctcctgtgtgccttcttctggatgggcttgtacctcctgcgcgccggggtgcgcctgcctctggctgtcgcgctgctggccgcctgctgcgggggggaagcgctcgtccagattgggctgggcgtcggggaggatcactt

SEQ ID NO: 34264 - DNA, 620 bp, Homo sapiens
  misc_feature 1..620: note = chr12:21680400-21681020
  misc_feature 1..620: note = hyper
  source 1..620: mol_type = genomic DNA
cagtaacccgacctccgctccaaagcgcccttgcggcgtccggtcaggcgcggggctttcctccagagctccagggcccctggctcagcccggggttgcgctgggagcgctggaaactcggcagccccgcgcgaccctatcctggagcaacctgccccctccccacgcccggggactgcgctgtgccgggaggagctgaggtttaagcccgggttgtcccgggccaggctgtcgctgagccccaggtctcgtttttgcagagggtcgccgcttcatctccgaccagagccggagaaaggacctctccgaccggccactgccgggtgagtgaccaagggtgcaagggcgctagtcctgcgcttttggaataggatggggcgggcagggcttgctccgcgctggtgccgaaagaaagcgtctcctcaccggaaagacgcggctctgaggcgccctcagatacagtccgcccgagggcagcccgggttggcagcagcagcagctggatgccgagcgccggagctgggagctcgcgcgtccagccccgcgccaatggtggcaagggcggcccaggctggcgctgcggctccccaagccttattggcttgcggctgttcagccag

SEQ ID NO: 34265 - DNA, 479 bp, Homo sapiens
  misc_feature 1..479: note = chr12:21810495-21810974
  misc_feature 1..479: note = hyper
  source 1..479: mol_type = genomic DNA
gcacggccccccctgcgccccaaactgagcggcaaagtcagggcccgcggccggatgctcagagctaaaggccgcggaggacagatgtgcttcttcctccttcccgcgtctccccatacaagtactaccccgcacgtcccatcaggcttgcctgtgggccaggattcagggtcctgagccgaaacctaccaggagagagaaggctctggagacctctgtaacagtcgtgcggagaagacaaagtcagctgcgtgcgtctcctccggcgccggctctgcaaggagggaggagggggcggggccccacaaccaccgcagcctcttaggtttctccattgtgattggaaatccgagtaccgcctacccctcccctcggctcgctcaatccccttcaaggacaagggctcaagtatgcacactccctcccccaccctccagatgaggaggtctccttccagaggcttccgctctcagctggtc

SEQ ID NO: 34266 - DNA, 208 bp, Homo sapiens
  misc_feature 1..208: note = chr12:21927174-21927382
  misc_feature 1..208: note = hyper
  source 1..208: mol_type = genomic DNA
gaattattttaaatgcgaaagaagtatgagttgcatctaaaaagagttaaaaaggttcctgtggaaatcataatattataaattgaaaacttttttttttttttttttttacaacgaaggaatcaaatatacaaggtgcgggggggaaaaaacccaagacaacagcctgcgggttgcagtagggagtgtgccccgaaaagtccatcca

SEQ ID NO: 34267 - DNA, 30 bp, Homo sapiens
  misc_feature 1..30: note = chr12:21927596-21927626
  misc_feature 1..30: note = hyper
  source 1..30: mol_type = genomic DNA
acaaattgggggctgcgtgtcctaaggaga

SEQ ID NO: 34268 - DNA, 45 bp, Homo sapiens
  misc_feature 1..45: note = chr12:21927907-21927952
  misc_feature 1..45: note = hyper
  source 1..45: mol_type = genomic DNA
ggccagagggagggacgacccgggggagggcgggacctgcagagc

SEQ ID NO: 34269 - DNA, 34 bp, Homo sapiens
  misc_feature 1..34: note = chr12:21928417-21928451
  misc_feature 1..34: note = hyper
  source 1..34: mol_type = genomic DNA
taccccaaacagggacggccgttaacacttcagc

SEQ ID NO: 34270 - DNA, 71 bp, Homo sapiens; identical to SEQ ID NO: 1024
  misc_feature 1..71: note = chr12:22093889-22093960
  misc_feature 1..71: note = hyper
  source 1..71: mol_type = genomic DNA

SEQ ID NO: 34271 - DNA, 308 bp, Homo sapiens; identical to SEQ ID NO: 1025
  misc_feature 1..308: note = chr12:22093961-22094269
  misc_feature 1..308: note = hyper
  source 1..308: mol_type = genomic DNA

SEQ ID NO: 34272 - DNA, 471 bp, Homo sapiens; identical to SEQ ID NO: 1026
  misc_feature 1..471: note = chr12:22094577-22095048
  misc_feature 1..471: note = hyper
  source 1..471: mol_type = genomic DNA

SEQ ID NO: 34273 - DNA, 83 bp, Homo sapiens; identical to SEQ ID NO: 1027
  misc_feature 1..83: note = chr12:22486799-22486882
  misc_feature 1..83: note = hyper
  source 1..83: mol_type = genomic DNA

SEQ ID NO: 34274 - DNA, 326 bp, Homo sapiens
  misc_feature 1..326: note = chr12:22487133-22487459
  misc_feature 1..326: note = hyper
  source 1..326: mol_type = genomic DNA
cgtttgtcgccgggcccgcccgcaggggctcatcgcagccccggcgtcccaggggcgggggccggggcctcagcacaaagctaggcgaagtggcagcggagggtcccccaccgccagccccccatgcacacacacctttggttctcttacttgcaaacgcacgcacgcttcttcggccccgtcggccccaaaggtcagcgcaaggattttttcaaatgcaacttttccaaggatttctttctaggggaagtggctgggggtgaagtcacgatctatggccatggtcgcttcccctgcagaaggcgggcgctggggtctccgagtgc

SEQ ID NO: 34275 - DNA, 807 bp, Homo sapiens
  misc_feature 1..807: note = chr12:22487460-22488267
  misc_feature 1..807: note = hyper
  source 1..807: mol_type = genomic DNA
cagagagcggcggcggcgagtcgctcccgccggttctgcagcatcacggtcgccctcggcgagggtccgggagaaggctcggctccctcctaaacatgtggcccgtggcgtccccttgtcccctccgagcgatgctcctgcgcccttcgccgcctcccgcgctgctgcgccgccaggcaacccccccccccccaccccgccccgagacgcgctctctgcgccgcaccaagtccttggaaatttccacggcggcccgggaccgctatcctgccccgggctcctccgcctcgcccgccgggaccctcgctccccacccctcccggagaagaaaagaactcgctctcatcagttaattcagcggcgcgccgcagccttccgctgcgccccggacttcgcagacaaacgcccggggattggtggaaatcaaggtctccccctccctcccccacccgcaaaattgcctccttcgacccgatccgagccgcgacactcgcccagagcgcgcacccctcactcgtgcccttgttctttggagataacggcagacaataaaaaccaacagccccccgccaatagaaatatatcagtccctgagtgtggcggagactggctaatatcctgatccttcgacaagcggccggtgtgcccaggctgtcaccctgctgccgtcaccctagtctttctctagctggttggatattaacccgcagccaggcgcgaggaggctggcggagatttattccttcctgggcccccacccccattagccggtcccggagccgcggcccgtgtgtgtgcgcgcgcgcc

SEQ ID NO: 34276 - DNA, 340 bp, Homo sapiens
  misc_feature 1..340: note = chr12:22488339-22488679
  misc_feature 1..340: note = hyper
  source 1..340: mol_type = genomic DNA
cgaggaggtgcgtgcactccggggtcctccgcctcgcctcctccctgaaaggaagtgctgcatccagatgtgcaggcagctggtgcccaaacactagacctcaagatgtcacattgccttggaggcgcgcggccttttagattaaaggaccgttggttcttagacgtccttcttgcccttcttgcttgtgataagcgataagcttatcgcaaccccgaccttggaaaagcaccacccgccttgacccaccgagccgagagagtcgctgttagccatttctgctcgccccggcggccgacgcatagctcgggtacctcctagcggtcgcctattctatttg

SEQ ID NO: 34277 - DNA, 302 bp, Homo sapiens
  misc_feature 1..302: note = chr12:24714636-24714938
  misc_feature 1..302: note = hyper
  source 1..302: mol_type = genomic DNA
ttgtttcagaaattccgggcgggagggagggggagtggtagggagaaggattgcagaaagcgaaacaaaaagacgaaagagtcgggaggtgggggtgactaaggttagggggtgggccaggggtcgctctgatatcctagaagggttaaggggctttgtccaacttttagggtctggccttggacattggccgcgatgcccagcacagcccagggttctccccgcactctcctctcgcatcaaccacctccaccgccaccacttacaaaacaataccagcaacagtacgcaggcttcccaac

SEQ ID NO: 34278 - DNA, 225 bp, Homo sapiens
  misc_feature 1..225: note = chr12:24715158-24715383
  misc_feature 1..225: note = hyper
  source 1..225: mol_type = genomic DNA
gctgagtggcgggcccggcgagcggcagaggggagctctgcgccttggaggtctgcccacaacaacatcgggacgaacaacaaagttaaaacgcagcgattcacgcaccttacccggtctcgttaatgcctcctccggcgtgggatgcaaagtggcacagaggcgggctgggggcccccgggaggagactggagatgggttttggtggctcgcctttttcactct

SEQ ID NO: 34279 - DNA, 447 bp, Homo sapiens
  misc_feature 1..447: note = chr12:24715757-24716204
  misc_feature 1..447: note = hyper
  source 1..447: mol_type = genomic DNA
ctccttcttgcagctcgccgcccggccgccctctctatccatccgaagggaaggagccccagagttttcttccccgtctgctgcagagtaactagattgtaaataacgcggcgattacccacaccgtgcaggaattttttttttatctgccctccacttaaaggagcgataaaaatgaaatggcaggagtggaaggagccagggagagcgggatatctctagatctcgatggagctcgcatctataaatacgcattcatgtttagtcaagtccctttgtcaacttcttcccggcgcctgagcctcagccgctgctctgcgcccaggacctggcccctcccggccccctagtccagtggtcaggcggtcgggccggcagggagggcgcgcgcggggggctgcggggtccgtggaacctttccgggaggcgagccgcgggctgctgggc

SEQ ID NO: 34280 - DNA, 212 bp, Homo sapiens; identical to SEQ ID NO: 11164
  misc_feature 1..212: note = chr12:24716205-24716417
  misc_feature 1..212: note = hyper
  source 1..212: mol_type = genomic DNA

SEQ ID NO: 34281 - DNA, 245 bp, Homo sapiens
  misc_feature 1..245: note = chr12:25056242-25056487
  misc_feature 1..245: note = hyper
  source 1..245: mol_type = genomic DNA
cgcgagcatccttgtttattaaacaacctctaggtgaatggccgggaagcgcccctcggtcaaggctaaggaaacctcggagaaactacattagggcagcttttccaccgactccaaatccaactgacaaaaagcagtttctgccctcgagagtttgcgggcggggattgacatttgtgcgtctgctcttgtctgccactgaccgctatgtgcaaactgaagggggagaacgtgaatccagcttt

SEQ ID NO: 34282 - DNA, 623 bp, Homo sapiens
  misc_feature 1..623: note = chr12:25101375-25101998
  misc_feature 1..623: note = hyper
  source 1..623: mol_type = genomic DNA
taacagtgaaaagatcgttctccctcccctctccacccgggtcaactcttccagccgctccctcctgcatcacgaacacacgctgcaggaaagcgcatttacagcccgggacatccccagacctcctctccaaaattccccacctcctgtgcataggagaaactgagagaagccctcacttcctttccaaacttcacaagcaggggagggagctgtagcagactttcacctccgttcccaaaagcgaatgtgaaaaagtccgagaaggcacgtcctgcgagtggaggttaaaccgaaatctgaacagaatgcacggtccccgcaaactacgattgataaagaagatactgagacgtttgcgggggatataagccatggttgtctcgccttcctcccctccctgccaactatgtttcttggagaaatcgccggttcgattcacgcacacatttttgtaaaacacggacaaaaccataagtagttaccttcattgttccgtcggccacgagggaagctcgagctgagcggagggcagatcccaagggtcgtagcccctggccgtgtggaccgggtctgcggctgcagagcgcggtcccggctgcagcaagacctggggcagtgcc

SEQ ID NO: 34283 - DNA, 77 bp, Homo sapiens; identical to SEQ ID NO: 3860
  misc_feature 1..77: note = chr12:25102009-25102086
  misc_feature 1..77: note = hyper
  source 1..77: mol_type = genomic DNA

SEQ ID NO: 34284 - DNA, 57 bp, Homo sapiens
  misc_feature 1..57: note = chr12:26348245-26348302
  misc_feature 1..57: note = hyper
  source 1..57: mol_type = genomic DNA
agtgaggaaaacagacgccccgcactcgcacacgcgcgcactcgcagcctgtctgaa

SEQ ID NO: 34285 - DNA, 219 bp, Homo sapiens; identical to SEQ ID NO: 11168
  misc_feature 1..219: note = chr12:28122168-28122387
  misc_feature 1..219: note = hyper
  source 1..219: mol_type = genomic DNA

SEQ ID NO: 34286 - DNA, 35 bp, Homo sapiens
  misc_feature 1..35: note = chr12:28123589-28123624
  misc_feature 1..35: note = hyper
  source 1..35: mol_type = genomic DNA
gccggcggtccccggcgcgccgagctggacgagcg

SEQ ID NO: 34287 - DNA, 660 bp, Homo sapiens
  misc_feature 1..660: note = chr12:28127648-28128308
  misc_feature 1..660: note = hyper
  source 1..660: mol_type = genomic DNA
ctgccctggtgtttgcgctcccactgcagcaagggaggcctgagtctcttagggcaggggtccagggtcttgggagaggccttagggcaagggggatgatctttttcagcctcccctcccctcctcccacccagcgtcctcatccccaccgcctgcgatagacttgggtcgcccattaggaagctgatccgcagggacggggcaggcttggctcctggggatcttaggctccatgggaacttcgggggtctcggggcccgtgagcggatctagctactacttcccctaggttctcctcgggcttcagtccctaagagtctggactccggactgccgcacagaatccttcttgcccggagcggtattattgaggtctttgcgttctgccccgccctgtcccgccggcttgggtgcttggtttctaacccgagtatactcggagtctctggtcctgcgcgcccccctcctcccgggagagccccgtatctggctgcgggtaagggaaaacttcgggaaccccgagacccaaggacagggtcggagggagcgcgcgaacttcctctgagcagggctcttcctcccctcccctctccctccaggtcaatttatgactcaaacatgagataagccctaggcagacggtgacgctgacttccccgt

SEQ ID NO: 34288 - DNA, 537 bp, Homo sapiens
  misc_feature 1..537: note = chr12:28128547-28129084
  misc_feature 1..537: note = hyper
  source 1..537: mol_type = genomic DNA
aggagaggatatgaacggacgtggaacgaagttctgtctgccaactccctccgtctgattcttggaatccggtggcatcttaaaggacggaattgagggcaaggagaagattattaatccccgaagcccgctctgtctatatataactgctcagtggttacagttggcgatcgcagggtgggggttgggggtgtagaccgtgggccatggaacacgtggcatctctccagggcataaaaatcaatctagctggtggctcctatggagtttgtaaattgcgcagagctggctgggggaagccagtgagctgtccatggtggttaaggctcgttgatgtgcgtcctcgggctgtcctggtgaggcacagacccccctaccccaggggccgcaacgccccagagccccagcctgccagcgatccagccggtgtgcgcccgacacgaggctggacgtgtgtttgcacaactccaggacgcgctcttgcacagaggccgaattccagagatagacggaaaaatctcccgattccaaattgtg

SEQ ID NO: 34289 - DNA, 421 bp, Homo sapiens
  misc_feature 1..421: note = chr12:29935902-29936323
  misc_feature 1..421: note = hyper
  source 1..421: mol_type = genomic DNA
cgtctcatctgaacgaaacccttaaggggctgatacacttctcatctgcaaagctgcccaacagcctccgagaaattctctacttggaagcatcgccaccaccgccacccctccggaaccctctgggtccgcgctagtcccacttggtcacgatccggcaggcgaaggggtgcggaggcggtttcaccagcccgctcccagccctgcctcgagagagaagcccgctgagagggcagacagttgagaaactcgatcccaactccccagccggcgcctcccgaaccgccccgagagcccagattagccgggcagtggatcccggagcaaagtgccatgcacatcctggagaggagggaggcgtggagggaaagggcggcaaaaatgaaatgcccccaagtcagtcccgcaacttctcccggtc

SEQ ID NO: 34290 - DNA, 348 bp, Homo sapiens
  misc_feature 1..348: note = chr12:29936995-29937343
  misc_feature 1..348: note = hyper
  source 1..348: mol_type = genomic DNA
ggcgccctctgcccccggcccgccttgcttgcaggtggaccggggttcgcggcgcgcggctgcccgggagctgcggggaaggacaccccaggttcccacttgcggtgtccggctgtgctcacccccacgcccccgcccccatccttctcccccgaatggggctgggaaggggcacatctggcggacccctcccgggggacccaggagggtttagcaggtgcgcagtctggaacccccacacccaccttccagggagaaaagtgccgctgcttcccgggaagttcccggcttttcagcacccgggacaacagcagcggcgcccggagagacgctctccacccgccccgc

SEQ ID NO: 34291 - DNA, 58 bp, Homo sapiens; identical to SEQ ID NO: 11172
  misc_feature 1..58: note = chr12:29937344-29937402
  misc_feature 1..58: note = hyper
  source 1..58: mol_type = genomic DNA

SEQ ID NO: 34292 - DNA, 156 bp, Homo sapiens
  misc_feature 1..156: note = chr12:30322769-30322925
  misc_feature 1..156: note = hyper
  source 1..156: mol_type = genomic DNA
acgtcccagccaaggcgcggcggggagccttggacaggagtgcacttgaaggtgagggtgcagagtggccggtgggacttgtggctggtgttctcggccatgccctggccccagaagtcgttggtgaagatgccccagcagagcgaggcgctgggc

SEQ ID NO: 34293 - DNA, 426 bp, Homo sapiens; identical to SEQ ID NO: 3863
  misc_feature 1..426: note = chr12:30323014-30323440
  misc_feature 1..426: note = hyper
  source 1..426: mol_type = genomic DNA

SEQ ID NO: 34294 - DNA, 24 bp, Homo sapiens
  misc_feature 1..24: note = chr12:30323502-30323526
  misc_feature 1..24: note = hyper
  source 1..24: mol_type = genomic DNA
cgccagcttcgtgatcttctgccc

SEQ ID NO: 34295 - DNA, 68 bp, Homo sapiens
  misc_feature 1..68: note = chr12:30354049-30354117
  misc_feature 1..68: note = hyper
  source 1..68: mol_type = genomic DNA
gggggttccaggcttcgcacctgctaaacctgcctcgtcacctgggaggggtccgccagatgtgcccc

SEQ ID NO: 34296 - DNA, 15 bp, Homo sapiens
  misc_feature 1..15: note = chr12:30975310-30975325
  misc_feature 1..15: note = hyper
  source 1..15: mol_type = genomic DNA
cacaaaacaaaagag

SEQ ID NO: 34297 - DNA, 551 bp, Homo sapiens
  misc_feature 1..551: note = chr12:30975388-30975939
  misc_feature 1..551: note = hyper
  source 1..551: mol_type = genomic DNA
cgccagctcctttctcggctgcctgcccagctgctgggctggagctccgcgtgctgggtgtaggtcaagtgatcccgtcgcgggcgggcggaggtggccgggcagccgccgctgtgcccgggtctggggtgagctgcactgctgccctgggccccggctcccacgcctgtttcccggagctccgcggctccggctgcttcgccctccctctgtgggctgggctggggtcctcgcgagaagtcctgccccgctcccttctccaaatccacaggccctgtttctctggagacagggaggctcatacaggatatgtgcaaatgcttttattacaagctgagttgaaagacacccgtttgctctcgggtccttttggtgagcgccgcaggaagccgggctcctctctccccagaggcggccgcaggttcgcggcgcagggcctgcagtgccaggagcaggcaggggcctctgccctccccttcgtccctgatctcccgcctcctcctcacccgccgtctctgcgaactcaccctgggctgcggcctttcttccct

SEQ ID NO: 34298 - DNA, 110 bp, Homo sapiens
  misc_feature 1..110: note = chr12:31079258-31079368
  misc_feature 1..110: note = hyper
  source 1..110: mol_type = genomic DNA
gcagggagacctaagcggggagctgcggagcgcggggagtttgaaagccgctccaccgccctactagtccgtccttttgccccgccccccttagggatccccccggcaac

SEQ ID NO: 34299 - DNA, 247 bp, Homo sapiens; identical to SEQ ID NO: 3867
  misc_feature 1..247: note = chr12:31079417-31079664
  misc_feature 1..247: note = hyper
  source 1..247: mol_type = genomic DNA

SEQ ID NO: 34300 - DNA, 117 bp, Homo sapiens; identical to SEQ ID NO: 3868
  misc_feature 1..117: note = chr12:31079693-31079810
  misc_feature 1..117: note = hyper
  source 1..117: mol_type = genomic DNA

SEQ ID NO: 34301 - DNA, 30 bp, Homo sapiens
  misc_feature 1..30: note = chr12:33048755-33048785
  misc_feature 1..30: note = hyper
  source 1..30: mol_type = genomic DNA
ggtgggggtaggaagcgcagctaggcgggc

SEQ ID NO: 34302 - DNA, 64 bp, Homo sapiens
  misc_feature 1..64: note = chr12:33049326-33049390
  misc_feature 1..64: note = hyper
  source 1..64: mol_type = genomic DNA
caggtgggcagaacacggggtcccgcactcccagcacgcggggtgagggcgggataggaggagg

SEQ ID NO: 34303 - DNA, 239 bp, Homo sapiens
  misc_feature 1..239: note = chr12:33591774-33592013
  misc_feature 1..239: note = hyper
  source 1..239: mol_type = genomic DNA
agccgcgggttacctcggaggccaaggcagccacctctgcaagggagttctgcgtccaagcatggcttgtccgtcccgcctggcccccatcaacaaggccgggaccagcggccggtggaacgagcgagagcagccctagtcccacaggtgagccgcccccacaagcagccaagccgcgagccgtcccggcgccgtcaccgcccgcactcacttctccactccgggagggagatgggagg

SEQ ID NO: 34304 - DNA, 28 bp, Homo sapiens
  misc_feature 1..28: note = chr12:33592057-33592085
  misc_feature 1..28: note = hyper
  source 1..28: mol_type = genomic DNA
cggcgccgggaggcgggaagcggaccag

SEQ ID NO: 34305 - DNA, 64 bp, Homo sapiens
  misc_feature 1..64: note = chr12:33592578-33592642
  misc_feature 1..64: note = hyper
  source 1..64: mol_type = genomic DNA
tgcgccgctgagagccggcaactcttaggagccccacgttggccccatggcgggagcggagggc

SEQ ID NO: 34306 - DNA, 205 bp, Homo sapiens
  misc_feature 1..205: note = chr12:33592643-33592848
  misc_feature 1..205: note = hyper
  source 1..205: mol_type = genomic DNA
taggggaaggagaggcgcgcgaggaggctgcggctgccgcgaggtttgcgccaactctcccgccgcgcgagcgagccgaggcgcgctggaactagagacccggcatggagtgctgaggggaggggggagccgtaaaaaagccaaagcaagccctcgactcgcaagcacgcccccctcctctccccagcgcactggtgtttctggc

SEQ ID NO: 34307 - DNA, 102 bp, Homo sapiens
  misc_feature 1..102: note = chr12:33592932-33593034
  misc_feature 1..102: note = hyper
  source 1..102: mol_type = genomic DNA
cgtcctctgaagaagggactcgcgagggagggagggagggagggcgggcggcccggcgcccctgccgaggccggggatgctcatcgttgcccagagttggcc

SEQ ID NO: 34308 - DNA, 40 bp, Homo sapiens; identical to SEQ ID NO: 11185
  misc_feature 1..40: note = chr12:33593092-33593132
  misc_feature 1..40: note = hyper
  source 1..40: mol_type = genomic DNA

SEQ ID NO: 34309 - DNA, 66 bp, Homo sapiens
  misc_feature 1..66: note = chr12:39298564-39298630
  misc_feature 1..66: note = hyper
  source 1..66: mol_type = genomic DNA
gccactgcgcccggccgagagtcagtttttacaagcactcagatgtgggcccgaaaacaaatcaaa

SEQ ID NO: 34310 - DNA, 206 bp, Homo sapiens
  misc_feature 1..206: note = chr12:39299436-39299642
  misc_feature 1..206: note = hyper
  source 1..206: mol_type = genomic DNA
ggcagaagaaggaggcggaggcagcgcgcgggatgggggagggaagggaggaggcggacctccgcgcagagccacgagggaaccgctagccagtcctgggtgaaactgacgctgccaggcaagtggcgcgcggggatcccggtttcccagcccccttccggcaggcagcagcccgggcgggggacacactccgtgatcccctcctg

SEQ ID NO: 34311 - DNA, 111 bp, Homo sapiens
  misc_feature 1..111: note = chr12:39299877-39299988
  misc_feature 1..111: note = hyper
  source 1..111: mol_type = genomic DNA
gggggcacctctgcccgttcctaactgccccgttataaggtccccctccccacaattggttctcacctcgccctcggagctcttgggagatccctccgtccctcctactgt

SEQ ID NO: 34312 - DNA, 30 bp, Homo sapiens; identical to SEQ ID NO: 11188
  misc_feature 1..30: note = chr12:39300375-39300405
  misc_feature 1..30: note = hyper
  source 1..30: mol_type = genomic DNA

SEQ ID NO: 34313 - DNA, 32 bp, Homo sapiens
  misc_feature 1..32: note = chr12:39539440-39539472
  misc_feature 1..32: note = hyper
  source 1..32: mol_type = genomic DNA
caaggctctgggaagcgcgctgacaggatttc

SEQ ID NO: 34314 - DNA, 291 bp, Homo sapiens
  misc_feature 1..291: note = chr12:40618404-40618695
  misc_feature 1..291: note = hyper
  source 1..291: mol_type = genomic DNA
gggctgcgcactgcgcgcctccgctgcggggctccgggcctgtggactcagcggagtccgctgagtcagtttcttcccgcgcgactcccggccgcgccgccgctgcggtggaatctggtcccaggaggcggcgtccgcccggggtccggtctaggcgtgcgtgggggccacggtcacggtcatcccagccaggcccggctccagcagccccacggccgccgccagagttctgcgcggcccgtcgcctcggcggagcctctggcaggcccctgagctcgtttttggggcctg

SEQ ID NO: 34315 - DNA, 30 bp, Homo sapiens
  misc_feature 1..30: note = chr12:40619018-40619048
  misc_feature 1..30: note = hyper
  source 1..30: mol_type = genomic DNA
gaaaacagatagaaacgctggtccaaatcc

SEQ ID NO: 34316 - DNA, 30 bp, Homo sapiens; identical to SEQ ID NO: 11190
  misc_feature 1..30: note = chr12:41086182-41086212
  misc_feature 1..30: note = hyper
  source 1..30: mol_type = genomic DNA

SEQ ID NO: 34317 - DNA, 259 bp, Homo sapiens
  misc_feature 1..259: note = chr12:41086824-41087083
  misc_feature 1..259: note = hyper
  source 1..259: mol_type = genomic DNA
cccatcccacctgggcgcctggctagcgcatcccggaaaacctgggagcggttgcggagaggggaggaagcgacttgtttgtcccctgacccctctgttaagatctagctcccttcaggagatgggggtggggaagaatccctgcaactcgaagggcacgttccgattaattacgtctccgttgagaaggcaccggcccttctccacgatctgcggcaggtgggagggagagaccgcggagccacggccccttccctcc

SEQ ID NO: 34318 - DNA, 412 bp, Homo sapiens
  misc_feature 1..412: note = chr12:41582427-41582839
  misc_feature 1..412: note = hyper
  source 1..412: mol_type = genomic DNA
gcccttggcgcccggcgagctgtaccgggtgctgccgctgcgcagcctcatccagaagctgcgagtccagtgcgactaccgcgcccgcggctgcggccactcggtcaggctgcacgagctggaggcgcacgtcgagcactgcgacttcggccctgcccgccggctccgcagccgcgggggctgcgcttcggggctgggcggtggtgaggtgcccgcgcgggggggctgcggtccgacacccagggctggccggggcgggggcgcgcgcggggggccgccgggcggccgctggggccgcgggcggggacccgggcctcgggtcctcgcctggaggcggcgcgagaaggcgctgctggcgcagctctgggcgctgcagggcgaggtgcagctcacggcgcgcaggtaccaggag

SEQ ID NO: 34319 - DNA, 241 bp, Homo sapiens; identical to SEQ ID NO: 11193
  misc_feature 1..241: note = chr12:41583049-41583290
  misc_feature 1..241: note = hyper
  source 1..241: mol_type = genomic DNA

SEQ ID NO: 34320 - DNA, 35 bp, Homo sapiens
  misc_feature 1..35: note = chr12:42326337-42326372
  misc_feature 1..35: note = hyper
  source 1..35: mol_type = genomic DNA
ggaaaccagcagcagcgcggcgctgggcaggctgc

SEQ ID NO: 34321 - DNA, 74 bp, Homo sapiens
  misc_feature 1..74: note = chr12:42326647-42326721
  misc_feature 1..74: note = hyper
  source 1..74: mol_type = genomic DNA
tgcactacacctttgcgcgcaccgggcccagccggcccagtccctcaagcatcagtagacggaaaatgctcctg

SEQ ID NO: 34322 - DNA, 559 bp, Homo sapiens
  misc_feature 1..559: note = chr12:42983315-42983874
  misc_feature 1..559: note = hyper
  source 1..559: mol_type = genomic DNA
ggggctgctgggctgcggggctgcggggctgaggagctgcggtccgcggcgtcaggggtgggcgagggtgagcagcgcacgaaccatccagagcccagaaagtctccgtgccgaccgcggcgcgtctcggggaagtcagcgcaggctgcgcgaggctggcatgttccgggcgcgctgtcgggcggcggcggccgcgggagacggcgctggcagctgggctgcaggcggagtgcgctcgggctccggagccgcgcgctgcggcgccgccgcgcaccccgccctcggccgcggggcccggcgcgagcgaaaacgcggagcgcggacgccgccgcgggatcgaggccgctgggcgcgcgcccacgcgtaccccggctcggccctgaaagcgaggtcgggcccggctcgggccgcgcccgggggcagggctgcgagcaggcctgggaccggctccacgcgcagccagtggggcagagcagcaggcggattatgcgcagggagaaaaaagttcaccaaccgcggtccagagtcgcaagtgcggctcgctcggagcctctgcccc

SEQ ID NO: 34323 - DNA, 42 bp, Homo sapiens
  misc_feature 1..42: note = chr12:42984438-42984480
  misc_feature 1..42: note = hyper
  source 1..42: mol_type = genomic DNA
agctgggctctcaggcgcactcacccacgttgaactggggct

SEQ ID NO: 34324 - DNA, 15 bp, Homo sapiens
  misc_feature 1..15: note = chr12:43945109-43945124
  misc_feature 1..15: note = hyper
  source 1..15: mol_type = genomic DNA
cgttcctcattgtcc

SEQ ID NO: 34325 - DNA, 15 bp, Homo sapiens
  misc_feature 1..15: note = chr12:43945365-43945380
  misc_feature 1..15: note = hyper
  source 1..15: mol_type = genomic DNA
ccaactcgttccctc

SEQ ID NO: 34326 - DNA, 365 bp, Homo sapiens
  misc_feature 1..365: note = chr12:43945416-43945781
  misc_feature 1..365: note = hyper
  source 1..365: mol_type = genomic DNA
cgtgtggtcctgggagtgcgatgcgtcttaggcgcgcgcgattcctcgaaacccggcgcagtcgcgacctctccggctgactggtccgggagtcccgggagctccagcagggccagcgttccccaacgggctgagccgctcgtccccgcgacctgcatgtcccactcgggccccgcgcccccacttagccgctgaaggcgtctcgcggtgactttaccttgcctggggtggaagtcaacttcccaagacctggtgatgaagagcgagagatggtagagcagcccagtcagccacttggccacccacatggttccaccctggggaccccgatcggggaggcccaccagagccgccggcagccaagc

SEQ ID NO: 34327 - DNA, 217 bp, Homo sapiens; identical to SEQ ID NO: 11197
  misc_feature 1..217: note = chr12:43946202-43946419
  misc_feature 1..217: note = hyper
  source 1..217: mol_type = genomic DNA

SEQ ID NO: 34328 - DNA, 376 bp, Homo sapiens
  misc_feature 1..376: note = chr12:45269011-45269387
  misc_feature 1..376: note = hyper
  source 1..376: mol_type = genomic DNA
aaagagaaaggctttcgtcccattatgcagccccgggacctgacgcactccggtcgtggactccccaagttctaactctgttaagacgtcaatctgtagggaagggtccacaccaagcccccaaactggtgaggggtatgaggtgggagagagaaaaaggaaaagctccatcaaaatgcaagtctcttcctccagggcagcaaagaaccgcgttttcgcgacaatattgggaactgaagatgagaggcgactgcctcctcctccgccgagagccttacctgagatcagcagccaagctttaaatagcggagcacccagtcccgtttccatgacctcctttaaacccttctctctgcaaagttccccctcagccctc

SEQ ID NO: 34329 - DNA, 486 bp, Homo sapiens
  misc_feature 1..486: note = chr12:45269416-45269902
  misc_feature 1..486: note = hyper
  source 1..486: mol_type = genomic DNA
cgcggtctccaaggcaagcacagaaaaaaaaaaaatccatatccaaacccgcccccttactccaagcttcccactccagacctactttgggtccgggaaaagcgaggcttccccagccagcccatgctgccccgaggcgggagccatccctttccccagccccagctctgcggccactcacctgctccgagaccgaagatcaaacagaatgttctcagtaagacccgagactccatggtgcggatcagctcagtccatcgtctccctctttaaaaataaaaataaaaatcgaagaggttcttggaatcaagcgggaaaataacgtttgtctctcctgctgctgcctcggatttactgatcagtaggattaatacgctttggttgcctaagaaagaaaagggaggcctccccaggcgcgtgaagaacttagaccctccaatgcgcacatcattcccacacgcagggccgaggcggcagcgcggcccg

SEQ ID NO: 34330 - DNA, 233 bp, Homo sapiens
  misc_feature 1..233: note = chr12:45270680-45270913
  misc_feature 1..233: note = hyper
  source 1..233: mol_type = genomic DNA
ggagaggttccctgccgggggcggggcgctggagagcttccccggcgcggagagcttcccgggcgcggagagcgcagagaacttggccaggaggtgctggacagctccggaacccgcgcgccccctgccaaataaagcgtggagacccggactcgggctctctgggaccagcatacagcagaaggcaaggggaactgagccagggcgtctgttcacgccgaaatatctaccta

SEQ ID NO: 34331 - DNA, 32 bp, Homo sapiens
  misc_feature 1..32: note = chr12:45443857-45443889
  misc_feature 1..32: note = hyper
  source 1..32: mol_type = genomic DNA
ctccccaagttgggccgcgcaaagctctcctt

SEQ ID NO: 34332 - DNA, 386 bp, Homo sapiens
  misc_feature 1..386: note = chr12:45444296-45444682
  misc_feature 1..386: note = hyper
  source 1..386: mol_type = genomic DNA
agctggctcacctggcgctgaaggctggaaggtacagtctcggtcccccggagcccggcccggcagcctcgcactgtccgcagagggactgagcacttgaaaagcccaccgcgttccgtagggcgccccggcggggctaacttgttcggctgcggggcacagctttaggggaactgggctagcaggcaggggccggagctgcgcgcccgcggtggccagggcggtcgccgggtcgtggggcgcgggcggctgcagcctgggcgttggggcgcccccgacccgcagcaaattctcgatcaggaaactcttgcccaggttgccaaagccgggcgcagcggggaggttgaggagcgcggaggaagccacaacgtcccagtacgcaccgg

SEQ ID NO: 34333 - DNA, 129 bp, Homo sapiens
  misc_feature 1..129: note = chr12:45444714-45444843
  misc_feature 1..129: note = hyper
  source 1..129: mol_type = genomic DNA
cggcgccaaccggtctgctgcgcgcccgccttgcgcccgcctgtcgcccgggcgccccgcaccgcacccagagccgcagcttctcgccgccgcctcccgcagggctggagcgcgcggagccaggcaggg

SEQ ID NO: 34334 - DNA, 237 bp, Homo sapiens; identical to SEQ ID NO: 11204
  misc_feature 1..237: note = chr12:45445162-45445399
  misc_feature 1..237: note = hyper
  source 1..237: mol_type = genomic DNA

SEQ ID NO: 34335 - DNA, 86 bp, Homo sapiens
  misc_feature 1..86: note = chr12:46767304-46767390
  misc_feature 1..86: note = hyper
  source 1..86: mol_type = genomic DNA
ctcttatcccaccaccgccgccccgggcaaaggcactgccttgtctgaatgcgggtctgaggcgctttctgcggagcctggtcctt

SEQ ID NO: 34336 - DNA, 276 bp, Homo sapiens
  misc_feature 1..276: note = chr12:47225027-47225303
  misc_feature 1..276: note = hyper
  source 1..276: mol_type = genomic DNA
cgcgctcgccacctctcctggactcaagggtgctcccggcttacgcttctcggggcttcccgggtccgggttccctctcccccgtctcactttcttccttcattcgctcttctctcaatttttcctccatcagctctaacctgtaatcaattcccgccttctgcccctcctccctaggcttctcttagctcggttgccgcgaccccactatccgtccccgttcgcatttctgcaccgccctgcccttcactccagcgcgcagcaggccgggcaatc

SEQ ID NO: 34337 - DNA, 158 bp, Homo sapiens
  misc_feature 1..158: note = chr12:47225319-47225477
  misc_feature 1..158: note = hyper
  source 1..158: mol_type = genomic DNA
cgccctcggaaccgctggcgcagttttcagactcgcccaccgcccagagaccaggggcccacatccagctctgctctcgccttctcccttgaaagagactccttgggggctccccaggtcagagtaccccgcccggggaatcatgctggtctctgggg

SEQ ID NO: 34338 - DNA, 90 bp, Homo sapiens
  misc_feature 1..90: note = chr12:47225550-47225640
  misc_feature 1..90: note = hyper
  source 1..90: mol_type = genomic DNA
cgggtccagggactcgggtaacaccttgccagcaggatcccgggcggtcgcggagccagctcccgcgggggaagtcgggcctctcagcca

SEQ ID NO: 34339 - DNA, 30 bp, Homo sapiens
  misc_feature 1..30: note = chr12:48395941-48395971
  misc_feature 1..30: note = hyper
  source 1..30: mol_type = genomic DNA
ccatctggaagccatcgctgccaatctccc

SEQ ID NO: 34340 - DNA, 327 bp, Homo sapiens
  misc_feature 1..327: note = chr12:48396748-48397075
  misc_feature 1..327: note = hyper
  source 1..327: mol_type = genomic DNA
gggcccacagagcctcgaaggcagagaacttttattccccccgccgaagagtttccctctgcgattgatttacaatctgtaacatacaaagacagggctggaatcccagccgtcggaaacgtgcccaaacacgtggaaaaaaaaatcctctctacctaatacactttccaggcttcgtttgtcctgaatataatcccagacagtggaccttaccaaaggaggggtagaaaggtgcagtccgaacagcatttggacccgactacaagagccatctctaactataccggttgaaatagttgtagcaaccgtagcaatcgaccagcctgc

SEQ ID NO: 34341 - DNA, 1466 bp, Homo sapiens
  misc_feature 1..1466: note = chr12:48397135-48398601
  misc_feature 1..1466: note = hyper
  source 1..1466: mol_type = genomic DNA
ctggctcggtgagttccagaatttagaaaagtaactcattgtagtacctcggggcggcggggaatggggtaagaccgcggggaagggggcgctattttcgggggcatttgaaaagcacggtctggttggaatgttatcgtctttcagatggcctctcctactggaagtttctgtaccctttatcagaagagaggcgcaggcggacggagggaagtcgagatgagcgctagggctgcaccttgctccagggccagctgggagggggagggtaccctaaagaggcgctgaggtctcagagggcctatcggaagccgttctttgtggcctgggatttcagcccaccagtgtcagagtgttagtcccctttgtctaactctgctttgagcccaccagccaccaagccttggacaggctgtgaagtcaaccctttggcgtttgcttgctccctcgctcgcgctctctctttcctacttcacctaagttcgatgagttgagatctgtttttgctgaactcgaagtgcttcgaagaggcgagctgtgtgcatgtgcgcctaattatcaaagctggtggaaaagagcccatttatatctgtgcgcaaacttctccgagccaacactttgcaagttcagtattctagcgcaacgtagggacctgcaaatacttgcaactgcgatgggcaccgaggaccctgggacagagtccttgattggcagaactcttcttggtgaacttctgcgtgtcctgtgcctaagtcggcgcgctacgaccccgggagccgttttagcccggagccgcgggctccagagctggagcgggccggggagaaggatgctgagggacgcatggaaagcaggcaggcaggcaggggcgggggaagacttacggacatcctggccctgacaccgaaggacagcggcgacgagcagcgtcagcagcaccagcgtctggggagccccgaggcgaatcatggctcaccgcggggcctggctgagccgggcccgggcggagcgcagcgaaacggcaggagcacggcgcgggtccgggtctctaccgcgccctcatgcaggaggcccttggagcaggagggggaagcgggagacccggcagcccagcagcgctctgcgtcttctccccgccgcggcgcccgttatatgcgcccggcccctttcgaggctggcgaactcgcccaaaccgcgggccgccccctgccccccgctgggctgtaacctgaaccgcccgcccccggagcccgcctgggccctgccagtgcccgcacctgcccaagccggacccccctctctgggagtcacgcttcccgccctccacccctagtgcgccgagtggcctgatcgggcggggcgcagagatggcccctgccccccaaacccggggctgcggcgctgcccccctctgaccacaggcgggaagggtggcctccggcccctcccctcggagttctgccgga

SEQ ID NO: 34342 - DNA, 188 bp, Homo sapiens
  misc_feature 1..188: note = chr12:48576788-48576976
  misc_feature 1..188: note = hyper
  source 1..188: mol_type = genomic DNA
actcccagagacctgcgtaggagcggtagggtctcataaaggagggagtcccatccttcccccgctccggtgatttctatagctagagggctgatttactgcagaaacctccgtagcgccctcctcctgcctctgcaccgtcaggcccggtgggtccggctccagagcgccaccgtgccccagctcaa

SEQ ID NO: 34343 - DNA, 44 bp, Homo sapiens
  misc_feature 1..44: note = chr12:48577469-48577513
  misc_feature 1..44: note = hyper
  source 1..44: mol_type = genomic DNA
ggcctgggggagtcccgagtccgacgcgccgctggcctcagcct

SEQ ID NO: 34344 - DNA, 432 bp, Homo sapiens
  misc_feature 1..432: note = chr12:48577898-48578330
  misc_feature 1..432: note = hyper
  source 1..432: mol_type = genomic DNA
ccactcaatggaggacggtctgctggagatcatgaccaaggacggcggcgacatgccggcgcccctggaggtgtccaccgtgccggcagtgggggacgtgatctccggggagtacaacggcggcatgaaggaactgatggagcacctgaaagcccagctgcaagccctgtttgaggacgtgagggccatgaggggggccctggacgagcaggcctcgcacatccaggtgctctcggacgacgtgtgcgccaaccagcgagccatcgtctccatgtgccagattatgaccactgcgccccgccagggcggcttgggcgtggtcggcggcaaggggagcttccagagcgacccccaagagccggagactccttcgcctgggatcggggacagcggcttgctgggtcgcgatcccgaggacgaggaggaagagga

SEQ ID NO: 34345 - DNA, 197 bp, Homo sapiens
  misc_feature 1..197: note = chr12:49297738-49297935
  misc_feature 1..197: note = hyper
  source 1..197: mol_type = genomic DNA
ataaataaataaataaataaataaataaaatgcactgaggagacagatttttgagagttaaaaggaccctctcaaaaaccgaccgcggtcctccactgggtagggggcgctccaagacagggactcttctagcctgttgcctctccatgttagcgatatcctcgttgctaggagactagacgcgtcttacagtggga

SEQ ID NO: 34346 - DNA, 95 bp, Homo sapiens
  misc_feature 1..95: note = chr12:49363823-49363918
  misc_feature 1..95: note = hyper
  source 1..95: mol_type = genomic DNA
ccaccccctagcctccgcggcagcgccgacccgcccagccaggctcaccgcgcttgaggatggcgctgtggtgcggcaggcggccgccgccctca

SEQ ID NO: 34347 - DNA, 30 bp, Homo sapiens
  misc_feature 1..30: note = chr12:49364135-49364165
  misc_feature 1..30: note = hyper
  source 1..30: mol_type = genomic DNA
tgggaaccaagaaggcgtctggggtctgcg

SEQ ID NO: 34348 - DNA, 150 bp, Homo sapiens
  misc_feature 1..150: note = chr12:49366374-49366524
  misc_feature 1..150: note = hyper
  source 1..150: mol_type = genomic DNA
gagacccagtggcagcgaacgggttaggcgccaccgtgctcccgcctgactcaccctcgaagctctaaccactgtgggctatttttgccagagaggggccccaggctttccagccgccccccgcccctgccagaccgcagcccaaggcac

SEQ ID NO: 34349 - DNA, 39 bp, Homo sapiens
  misc_feature 1..39: note = chr12:49367954-49367993
  misc_feature 1..39: note = hyper
  source 1..39: mol_type = genomic DNA
caggagggatggatgcgcccgtggcggtgagctcagctg

SEQ ID NO: 34350 - DNA, 30 bp, Homo sapiens
  misc_feature 1..30: note = chr12:49373373-49373403
  misc_feature 1..30: note = hyper
  source 1..30: mol_type = genomic DNA
ggggatcctgcacagcgtgagtggggggct

SEQ ID NO: 34351 - DNA, 693 bp, Homo sapiens
  misc_feature 1..693: note = chr12:49373730-49374423
  misc_feature 1..693: note = hyper
  source 1..693: mol_type = genomic DNA
agataaagaaagtttcgggtcgcggacgccggctgaccgccgctttcccccagcctctctcaaaagcgcctgggaagctgctctctgcaggcgtgtgtctggcctctcgcccagcaaggcttgcaccgccaaaatgggccgaaagttttgggctgcgaagaagtcttggggatgtatggttcttccgctcccctctcttcggtttgtctctctggggctgctccacttccgctatcgagccaaaatgcgccctagaatctcccagtaaggtgtgattacgcccgtggacgtggctgcgtgcccacgcacctgctttctctactagccctagagaccagctttccagcactgccggccctggctctcaggactcaaagtgcggagtcgggggtgggattccggtcccaagcccttcatgagggtgctggccgcgccccgcgtaccccctcgctgatccccgctcccttctcccacaggctgtcgagaaacggcgtttatcttcgctatcacctccgccggggtcacccattcggtggcgcgctcctgctcagaaggttccatcgaatcctgcacgtgtgactaccggcggcgcggccccgggggccccgactggcactgggggggctgcagcgacaacattgacttcggccgcctcttcggccgggagttcgtggactccggggagaaggggcg

SEQ ID NO: 34352 - DNA, 346 bp, Homo sapiens
  misc_feature 1..346: note = chr12:49374681-49375027
  misc_feature 1..346: note = hyper
  source 1..346: mol_type = genomic DNA
caagcacagtctcttcgctgtacagattcgaaaaataagcctgagaggccgagactgactcgccgcggcggagcagggttgggcagggtttccaaatctcagcggaacatttcgcgcctcccttcccctgggctcagctaggcctgggcctttgctgaggtccggcccccgtggcgtccgggagagggcagtgtctgggagggtgactctggcccggtgccctgggacactctttcttcccctatccccgcagaccgtattctccgagatgcgccaggagtgcaagtgccacgggatgtccggctcatgcacggtgcgcacgtgctggatgcggctgcccacgctg

SEQ ID NO: 34353 - DNA, 414 bp, Homo sapiens
  misc_feature 1..414: note = chr12:49375115-49375529
  misc_feature 1..414: note = hyper
  source 1..414: mol_type = genomic DNA
cggagctgctgcgcctggagccggaagacccggcccacaaaccgccctccccccacgacctcgtctacttcgagaaatcgcccaacttctgcacgtacagcggacgcctgggcacagcaggcacggcagggcgcgcctgtaacagctcgtcgcccgcgctggacggctgcgagctgctctgctgcggcaggggccaccgcacgcgcacgcagcgcgtcaccgagcgctgcaactgcaccttccactggtgctgccacgtcagctgccgcaactgcacgcacacgcgcgtactgcacgagtgtctgtgaggcgctgcgcggactcgcccccaggaacgctctcctcgagccctcccccaaacagactcgctagcactcaagacccggttattcgcccacccgagtacctccagtc

SEQ ID NO: 34354 - DNA, 241 bp, Homo sapiens
  misc_feature 1..241: note = chr12:49388730-49388971
  misc_feature 1..241: note = hyper
  source 1..241: mol_type = genomic DNA
ggcagtgggaagagccgacaggggtgggctgggggcaaggaagggagagtcccggctgggggagaaaagaggtgggccaggagctcccaacgaagaaagcagccccctcccctcacacagagcgggaagtagcagaggagtcccgggggagggccactgtggggaaagggtcagtgaaaggaagacgatgccaaggctggataaagggaagcttagatttattgagcgcctactgtgtgcc

SEQ ID NO: 34355 - DNA, 267 bp, Homo sapiens
  misc_feature 1..267: note = chr12:49390838-49391105
  misc_feature 1..267: note = hyper
  source 1..267: mol_type = genomic DNA
tagggccctggggtccgcgcccagccccggccggcgcgccgctggaccaccgccacttccgacccctcggctctgccctgggctcccgaagctgctgggcctaaggcttggtgctctgggctacctggctgcgtgggggcgtcccgcaggtttacttcgggggccgggagccccaagatgcggaaagtgcgctcctccagtgtggagtcccccggcctcccgccctcagcttcgcccccgcggcccccgccgggctggtgtaaaagg

SEQ ID NO: 34356 - DNA, 940 bp, Homo sapiens
  misc_feature 1..940: note = chr12:49391146-49392086
  misc_feature 1..940: note = hyper
  source 1..940: mol_type = genomic DNA
cgtggccccttcaccctcctccttgccgggcttcgattggctgggggaatcccccaccacgcgtgtcaccccagagggcaaaagctgcacctgctgggttcggggggttggaacatattgggatcgtatcactacgcacgtggcgtcaatgacaaagacgccttccccacgggacaggccctgggaactgcggggcaaggtgtgggcacggcgggtcgccttccaaccctccagggtctccggtcctgccccctctccaagacccagagattctctccatccggtgcctccgggagcccagggtctggggagtgtctggctatggcggggcggctgctttttaggggagggaatccagcatttgggaaaccagatctgttctccttctttcccttccctcgagcccttgaggtggtgcctggatctgggagcgggatgcggggcacagggagccgcagttgcagaccccgcaggagctatctcggtgcctgcgctccctgtagctttggcttggggatggctgtcgctaccactgttcaggtcagcagcagccagccccaggcttttctccacgacccccttgccgggctctggccttgctctggccgctccacagcctggggatccccccaagagaccttgcccctgtcggagaccccaagccccgaggacgtcccggtagatccgaggatccagcctcttctttgtgcgccctccgtctgtcctggctggagtcgcagctggggctgatgaagtgggcacctgagagttcccggggcctctcttagtccccaaggtcctatgggggccttcgtaagaaggtggagccacgtagggtggcggccggtcccagcggcgtcgtggggcggtcccggcagaacctctcagcagcaggtgagcctcgtagcttgggggcccgggccgccgacctccccagggc

SEQ ID NO: 34357 - DNA, 44 bp, Homo sapiens
  misc_feature 1..44: note = chr12:49392556-49392600
  misc_feature 1..44: note = hyper
  source 1..44: mol_type = genomic DNA
gtgtgtgagtgtgtgcgcgtgtgcacgtgcgtatatgttaggac

SEQ ID NO: 34358 - DNA, 530 bp, Homo sapiens
  misc_feature 1..530: note = chr12:49483686-49484216
  misc_feature 1..530: note = hyper
  source 1..530: mol_type = genomic DNA
ccaatgcatgccagtcggctggacggccccgccggggagcagcgcccctagcgcgtgcagcagtctcaagggggcaaaagcgcggtgcgcccactggtgactctccagaaccgcgtagcaagaggccaggacatcgttcaccagcagcgtcccgtgcgcggtgagcggcgcgaacacgcccacggcttcctcccgcgccacacgggccacgcgcgctggccgaagcgcatccccgccgggcgccagcaccgagtccccagcgcgtagccggcgcgcgaacaccggtgcaaagtcgcctggcgcgggcgccggccctcgagcggcaaacaccaggtgccagggcgtgagcaacagtttgcgtggaggccactcggtctccacagccacaaatgaagcccggcgctgcaagtcccggtccaggaagagcagcaccggcgtgggcaccacccggcctgacgcatcggccgccaaaacccagtctccgcggtgcagttcccgcagccctttccgctcgccgctccacaggcgca

SEQ ID NO: 34359 - DNA, 170 bp, Homo sapiens
  misc_feature 1..170: note = chr12:49485716-49485886
  misc_feature 1..170: note = hyper
  source 1..170: mol_type = genomic DNA
ccaagaggagctgtgcgggatcaaggctgctggaaaaaggattggggtggcgggggttgcgcgaagtacaatggccattatccgggatgacttaaccgagcgagaatcctgagcccaggccgggaacgcgctgggagaagcggactcagcagctccggccacaaaggcgc

SEQ ID NO: 34360 - DNA, 30 bp, Homo sapiens
  misc_feature 1..30: note = chr12:49487666-49487696
  misc_feature 1..30: note = hyper
  source 1..30: mol_type = genomic DNA
tgggtggctgacccccggtccacgcctcag

SEQ ID NO: 34361 - DNA, 30 bp, Homo sapiens
  misc_feature 1..30: note = chr12:49688858-49688888
  misc_feature 1..30: note = hyper
  source 1..30: mol_type = genomic DNA
gtgggaggagctgcccgtgccccccctgag

SEQ ID NO: 34362 - DNA, 72 bp, Homo sapiens
  misc_feature 1..72: note = chr12:49690983-49691055
  misc_feature 1..72: note = hyper
  source 1..72: mol_type = genomic DNA
caagcaggagatgaacgagtcccgacgccagatccagagtctaacgtgcgaggtggacgggctgcgcggcac

SEQ ID NO: 34363 - DNA, 36 bp, Homo sapiens
  misc_feature 1..36: note = chr12:49727091-49727127
  misc_feature 1..36: note = hyper
  source 1..36: mol_type = genomic DNA
cgaaggcggccgggcagccgccgcaggggctgggga

SEQ ID NO: 34364 - DNA, 649 bp, Homo sapiens
  misc_feature 1..649: note = chr12:49729713-49730362
  misc_feature 1..649: note = hyper
  source 1..649: mol_type = genomic DNA
ggcatctcacctgtccgttcttcatgaggtcggcccacatgctggtgccgtcgccgccgcgcatgagcacgtggtaagcgaagaagtagacgcctggcatggggcaagtaaacttgccgctggctgcctcgtaggcgttgcccacgttggtcaccacgtcgtcgaagcgcagcacctcgtaaccctcgtggggccgccgcaggcccgcgtagaaagcaatgcgaggcacgtagccggcagcgggcgccaccccgcccggacctggaccgggagggcccggggggcctggcctgccgggttctcctgggggccctcttggacctggtggtccagggggcccccgcaggcctgctttcccgcgccggcccacctctcccttggcgcctggcgggaaggggggcacggaagcaggcgcgccgtcgggaccagggccacggggcccatgcgggtcgcacaccatgcggcagcgacccagcatctcgtagtgcgctggcccgcgggagctgtgcaccagcagcgggatggccaccagcagcagcagcaccatggccactccgacggccgcgcccgccaccctcttgcggcggctcagccgcgacgctgccagggccagcaaatcttcctcactcttgggcgcaatggctgccgg

SEQ ID NO: 34365 - DNA, 55 bp, Homo sapiens
  misc_feature 1..55: note = chr12:49735987-49736042
  misc_feature 1..55: note = hyper
  source 1..55: mol_type = genomic DNA
gacaaagagcagcttcggatggatgagggtcccagcggatcggaaatgtgaaggg

SEQ ID NO: 34366 - DNA, 36 bp, Homo sapiens
  misc_feature 1..36: note = chr12:49736792-49736828
  misc_feature 1..36: note = hyper
  source 1..36: mol_type = genomic DNA
gggggcccgtggccccgagcgcgcattcattactcg

SEQ ID NO: 34367 - DNA, 94 bp, Homo sapiens; identical to SEQ ID NO: 1035
  misc_feature 1..94: note = chr12:50297461-50297555
  misc_feature 1..94: note = hyper
  source 1..94: mol_type = genomic DNA

SEQ ID NO: 34368 - DNA, 115 bp, Homo sapiens; identical to SEQ ID NO: 1036
  misc_feature 1..115: note = chr12:50297973-50298088
  misc_feature 1..115: note = hyper
  source 1..115: mol_type = genomic DNA

SEQ ID NO: 34369 - DNA, 186 bp, Homo sapiens; identical to SEQ ID NO: 11223
  misc_feature 1..186: note = chr12:50355598-50355784
  misc_feature 1..186: note = hyper
  source 1..186: mol_type = genomic DNA

SEQ ID NO: 34370 - DNA, 92 bp, Homo sapiens
  misc_feature 1..92: note = chr12:50426787-50426879
  misc_feature 1..92: note = hyper
  source 1..92: mol_type = genomic DNA
caggcgaactgtcatcgacgatccctggacgcgggcgtcgggggcagggaggcttggctaggtccctggctgccaaccgtctggccacagcc

SEQ ID NO: 34371 - DNA, 241 bp, Homo sapiens
  misc_feature 1..241: note = chr12:50444182-50444423
  misc_feature 1..241: note = hyper
  source 1..241: mol_type = genomic DNA
ctgtgtgaggtgcagcggacaccagcctggtgtccgttcccaaagagtatgcctatgtgcccggagctcctgtgtgtgcacatacatgtgcccacgtgcaagccccacacggcctggagttccagctcccgacaagctgagcctcctgtgagccgaggctgagagggccgcctattaccctgtttccaaacaactcccctttctgcgccagcgccgctgcctctcccgtctgtttgcccct

SEQ ID NO: 34372 - DNA, 85 bp, Homo sapiens
  misc_feature 1..85: note = chr12:52208668-52208753
  misc_feature 1..85: note = hyper
  source 1..85: mol_type = genomic DNA
cgccgccatccctggcgggaaccagggaccgaggactgtgcggggacggggacgtggacgggctccgcgccggtgatgggggagg

SEQ ID NO: 34373 - DNA, 109 bp, Homo sapiens
  misc_feature 1..109: note = chr12:52241703-52241812
  misc_feature 1..109: note = hyper
  source 1..109: mol_type = genomic DNA
cccctgactctgagacgcgggctctgttctcccgggccagaggagaagacatgaagagggtgggtgttaggggcgcggggaccctaagtagcctcggcctcctgtcact

SEQ ID NO: 34374 - DNA, 133 bp, Homo sapiens
  misc_feature 1..133: note = chr12:52242262-52242395
  misc_feature 1..133: note = hyper
  source 1..133: mol_type = genomic DNA
gacaccctgaccgaacggtcacctccccccgccccatcccggcccgcccgcggccccgtacctcggcatcacggccgggtcctaggtgagtgtgcgcggcctgggggcgcgtccggcccggggaccggggcgg

SEQ ID NO: 34375 - DNA, 610 bp, Homo sapiens
  misc_feature 1..610: note = chr12:52262803-52263413
  misc_feature 1..610: note = hyper
  source 1..610: mol_type = genomic DNA
cgtgtgcacgccagccgagcgagtggccgagggacacccccgtgcttcccaaggcctggctccacgaggagcagaaccccagcggtgggattctgtcgcgcaatgctgtgtggctccgactagggcccgccctccagcaaagagatgctggtgggtgctctcggttcacccccgcactcgccccaggggggctcgcgggccacctggagctcccgcccctcggtggccagggctgcgcgtgaaagggggacgttcggacgcgggggcgcggagccagcgcgcgagcctcggagcctcccccaggctgtgggggaagaggagggaggagggagcagatggcagcaattaccgctcggaccctcccccgccgtagcctggggccggaagatcggctcggcagctcgctcctgcgggaggggcggcggcctccccggccgggaaccggcggggagggggtccgggaggggcggctctggccgccggggcgcgggcatcccagcttctaggggagagtgatgtgagggcccggtggagacacctccttctcccgggacgagggctgagagattccctttggaaaggccgagtctccggccgcccccacccccag

SEQ ID NO: 34376 - DNA, 159 bp, Homo sapiens
  misc_feature 1..159: note = chr12:52301147-52301306
  misc_feature 1..159: note = hyper
  source 1..159: mol_type = genomic DNA
gtcctgcagccccagcgaggggcgagcggcggccagtcggcgagctgggcaataaggaaacggtttattaggagggagtggtggagctgggccaggcaggaagacgctggaataagaaacatttttgctccagcccccatcccagtcccgggaggctgc

SEQ ID NO: 34377 - DNA, 32 bp, Homo sapiens
  misc_feature 1..32: note = chr12:52317406-52317438
  misc_feature 1..32: note = hyper
  source 1..32: mol_type = genomic DNA
tccccacacagggaccgcggggcctttcccgg

SEQ ID NO: 34378 - DNA, 37 bp, Homo sapiens
  misc_feature 1..37: note = chr12:52400452-52400489
  misc_feature 1..37: note = hyper
  source 1..37: mol_type = genomic DNA
cccctccaggtatcacgcagccccgagccccgagccc

SEQ ID NO: 34379 - DNA, 391 bp, Homo sapiens
  misc_feature 1..391: note = chr12:52400516-52400907
  misc_feature 1..391: note = hyper
  source 1..391: mol_type = genomic DNA
cgcgtccgcggctcgttttcccccactgagcgcccagctcccgcagtttccccggccgtcgagcgccgtgggcggggctccagggcggcggcgcctcgcggggagggtcctccgtgctgggggcgaggccacccgaggcagctccccgcccgcccccaaccccgccccgctctcggagcctataaagggaggcgacccgcggcccgcccggctggcatcccccagccgccgccagccccgccgaggggagccagcgccgtctctgaggggcgtccggcgccggagccatgaccctccgccgactcaggaagctgcagcagaaggaggaggcggcggccaccccggaccccgccgcccggactcccgactcggaagtcgcgcccgccgctcc

SEQ ID NO: 34380 - DNA, 629 bp, Homo sapiens
  misc_feature 1..629: note = chr12:52400908-52401537
  misc_feature 1..629: note = hyper
  source 1..629: mol_type = genomic DNA
gtcccgaccccgggaccccctgccgcagccgccacccctgggcccccagcggacgagctgtacgcggcgctggaggactatcaccctgccgagctgtaccgcgcgctcgccgtgtccgggggcaccctgccccgccgaaaggtgcgtcccccgcccgccttcaggatctgctcagcccctctccgactccctacagggcctgctgactccgcagtgccctctcctcggcgtccgcggagtcccccaccttcttccccggcccgctgggtgcctcgactccccgcgttccccgctgctgcgaaggccgtggccctcgcctgcacaccgcgcccaggctcggtggctcttaactccgcgccccatgcacgccccctctctccctccttgactcctcccagcaccccccttctcctacccgctccatctggctttctgccccccatgccccgcctccccgtggccaggtgtcctgggtccccaggagcccctcgcccgagggacagagacagccccaggcaagttgaaggtccgagagcccccggtgggagaagcgggccggtggctgcgccgcgtgcgttctcactctgaggaagtgcgtggggagccgctgactccggatagcacaccct

SEQ ID NO: 34381 - DNA, 30 bp, Homo sapiens
  misc_feature 1..30: note = chr12:52615930-52615960
  misc_feature 1..30: note = hyper
  source 1..30: mol_type = genomic DNA
ttggggtgctggagccgactcatacggctc

SEQ ID NO: 34382 - DNA, 182 bp, Homo sapiens
  misc_feature 1..182: note = chr12:52626865-52627047
  misc_feature 1..182: note = hyper
  source 1..182: mol_type = genomic DNA
tgaaagcctgggcttcggcggggcgggcgggcagagggcggagggcggccccaggaggggcctggcagcagagaaaggtggcccgcggcagccccgcccctacctgtggaagcccagccgcccgctcccgcggataaaaggcgcggagtgtccccgaggtcagcgagtgcgcgctcctcctc

SEQ ID NO: 34383 - DNA, 14 bp, Homo sapiens
  misc_feature 1..14: note = chr12:52627272-52627286
  misc_feature 1..14: note = hyper
  source 1..14: mol_type = genomic DNA
gaggtcaccattaa

SEQ ID NO: 34384 - DNA, 82 bp, Homo sapiens
  misc_feature 1..82: note = chr12:52652138-52652220
  misc_feature 1..82: note = hyper
  source 1..82: mol_type = genomic DNA
tgcgtccgcaggagccggcgcggaagcccccgcacacgctgtggctgccgaagcctccggtgaggccgcggtagcaggagac

SEQ ID NO: 34385 - DNA, 37 bp, Homo sapiens
  misc_feature 1..37: note = chr12:52652599-52652636
  misc_feature 1..37: note = hyper
  source 1..37: mol_type = genomic DNA
gagtggaacccctccacctgtccgcccctccgccggg

SEQ ID NO: 34386 - DNA, 30 bp, Homo sapiens
  misc_feature 1..30: note = chr12:52701983-52702013
  misc_feature 1..30: note = hyper
  source 1..30: mol_type = genomic DNA
gcggcactgacctctcgccttctctccctg

SEQ ID NO: 34387 - DNA, 211 bp, Homo sapiens; identical to SEQ ID NO: 11234
  misc_feature 1..211: note = chr12:52702362-52702573
  misc_feature 1..211: note = hyper
  source 1..211: mol_type = genomic DNA

SEQ ID NO: 34388 - DNA, 30 bp, Homo sapiens
  misc_feature 1..30: note = chr12:53084893-53084923
  misc_feature 1..30: note = hyper
  source 1..30: mol_type = genomic DNA
agtttgaggagagggcggtgaggggcaggc

SEQ ID NO: 34389 - DNA, 402 bp, Homo sapiens
  misc_feature 1..402: note = chr12:53108074-53108476
  misc_feature 1..402: note = hyper
  source 1..402: mol_type = genomic DNA
aaggggactggggtccgaggacgcccctggcgcggggttcagaatttgtggcgggaccgccagctctaggaggagctttgttctctctggcggcgctgctgccgccgccgccgccaccccggctgacggcgcaggagtcccggagccagagaagccccccgagcaccgcggagctcccgcccaagccccagccgctgcggccccggctaccgccgcgggcccgggctccgactcctcctcccagggcgcagccgccgccagtgctgctgtggccagtctctgcaaagacggtcggggtcagggagcctggcagtgtccgcccggcacgccagcccctcccacagtcccgagccgcaggtcttcccggggtgacgccccgccgagatccggcaaggcgtgggg

SEQ ID NO: 34390 - DNA, 41 bp, Homo sapiens
  misc_feature 1..41: note = chr12:53359275-53359316
  misc_feature 1..41: note = hyper
  source 1..41: mol_type = genomic DNA
cctccttaaagatctcgcagtgaggttagggagctgctccc

SEQ ID NO: 34391 - DNA, 210 bp, Homo sapiens
  misc_feature 1..210: note = chr12:53359385-53359595
  misc_feature 1..210: note = hyper
  source 1..210: mol_type = genomic DNA
cgcgctcccattgggtggtgcctgggtgtccccggctcggcagctgcggctgcttcccagccccggggtctcagggccgtcccgccggtcccagggcaccgctcctgtgccccacgccgccgcttccccagttgccccctgactgcaagagtctcctggttttcggcttgtcctgggactcctgggagagcccaccgagagttctggggc

SEQ ID NO: 34392 - DNA, 183 bp, Homo sapiens
  misc_feature 1..183: note = chr12:53719608-53719791
  misc_feature 1..183: note = hyper
  source 1..183: mol_type = genomic DNA
gtggtttttgttcttcggctaactccgtggcgggcacgactgattgcagacccagggcagggggcgggttacgtgccaggcccagtctgcccgccgggagccgcaccaccgcccgactggggccgcgcaggagtccgcactgcaaccgcggtgcccgcgctcgggtcgcgtcactgccctgac

SEQ ID NO: 34393 - DNA, 564 bp, Homo sapiens
  misc_feature 1..564: note = chr12:54089081-54089645
  misc_feature 1..564: note = hyper
  source 1..564: mol_type = genomic DNA
ttttttttttatcagcggaaacagagacggagtcctcatcagcttcaattacaaatattaaggtcccggacagcactttgacagagaggcggccagccccccacttcgtaccacccccctaaatcatctccgaattaacatcacatcggcggctggcgcgtgttcagatttaaatggtggcatattgttcgcggacggtctagctcagaaccgcgagctcgcagctcccgcggcgggccccgcctctgcccacaccggcccctgcggcctcccgggaggctgtgactcaggagtcgcgggaggctccgactcaggagtcgcgggaggctccgggccctgtctccagcagggggctgcaggcgagggcgcgctggggcgggggcgggcgggctgcacagaggggtcggatgtggggcgagttgggcagaggaagaggaaccgcagatgccgggtggcgggagaggggctggggctgcagggagacaggtgggtttggtcggggttgggggttaggaggggaggacatgctctctgcaaattaggtgcaaacgaaggctcagaatg

SEQ ID NO: 34394 - DNA, 106 bp, Homo sapiens
  misc_feature 1..106: note = chr12:54132252-54132358
  misc_feature 1..106: note = hyper
  source 1..106: mol_type = genomic DNA
tgcgaggaggaaagacgcagaggctgcgcactttccttcctctcccccagacccgcgcaaggcgctgagggggtcctccctccggcaaaggcggagggacggcctg

SEQ ID NO: 34395 - DNA, 763 bp, Homo sapiens
  misc_feature 1..763: note = chr12:54144857-54145620
  misc_feature 1..763: note = hyper
  source 1..763: mol_type = genomic DNA
acacactcactcctgcgcacacaggctgctccgcggacacgcttcacggagcaggtgtgcccacgcgcaataccctcctggcccacaggcctccgcacgcacaggacacacacacacactctctcctggcctccctcccgccgcccctcctctgagccctgcggcccggccttccgcacctcccaacgcctgcaggggttgggggcgctggggctcggggcgctcactcggacctcggagccaatcgccagagatctaatggctcctttggcagtgggaaggggtgtgcgtgggtgtcctctccttcactctttccccagccctgtcgcctcccaccccccttccggccgcggcagtttccgaaatcgcccggcggccgcgaattcattagtggggggcggatgtaaacgcagcgcggtggaacgttttaattaggcctgaacaataaacaagctaaacgaggcgcgcaggactccctggtgggccctcagcctcctccgcgcggcgcggactcattacggctgcagccaatttcatgccagcgccgagcactggctgggccgggagtggggtcgggggtgcgtgcgggtgcgatccgggcctgcagggtgcggagcgggggcgtcccggggcgagggcagcgggccggttcccgcccgcccggggccgcggcttccgcatttctgcaccatccacctgcctttttcagtgtccttgagatgacgctccctccccacaccagagcggccggctggagagtcta

SEQ ID NO: 34396 - DNA, 15 bp, Homo sapiens
  misc_feature 1..15: note = chr12:54145843-54145858
  misc_feature 1..15: note = hyper
  source 1..15: mol_type = genomic DNA
ggtagactctgcagc

SEQ ID NO: 34397 - DNA, 92 bp, Homo sapiens
  misc_feature 1..92: note = chr12:54145880-54145972
  misc_feature 1..92: note = hyper
  source 1..92: mol_type = genomic DNA
cgctgcctacacccccttgggctcccctccaaggtcccctccgctcgcccctctctgcccgctgccgccgccgccgccgccttccaggcctc

SEQ ID NO: 34398 - DNA, 656 bp, Homo sapiens
  misc_feature 1..656: note = chr12:54321250-54321906
  misc_feature 1..656: note = hyper
  source 1..656: mol_type = genomic DNA
aaatttctgccctgtcgttccaatgccatgatggagaaggacccctaaaatcgcctttggcgtgtgcagctcgagcgttacaacgatgcaaagtgcggtctttggaggatgcgggagtcggtaacccctcaattcactctcgccgttccttctctccagtctgcgcgaaagccaggtccgagggcttcgaagatctgggggacccgagctgcgcacagtggcgggaaacgagcgggctcagctggccgggccgcgtcccctagccaccgcccgcccgcccgctgctttggcctccggagaagcctggagaggggcctgcgcctcttgaaaaatggcttttgggggcggtaggtctcgggagggcgactggggaaagtgacttgccgcggcttcgagtagagacgttggtgcgggacccaactcctggggaaggcggggagcgctgggcggatgcctggccctagtgcggcgccaacacatacaagttccgctgtgaatgtttgaaagtgtaagtttctctcggattgatttttttttcctttaaatgtatccccttcaaaaaaaaaaaaaaacaaacaaacaaaaaaaaaaaaaacaaagacgtggacaggcaggcgccacccggtctgggagctgaggttcgtgactgctgccga

SEQ ID NO: 34399 - DNA, 83 bp, Homo sapiens
  misc_feature 1..83: note = chr12:54322131-54322214
  misc_feature 1..83: note = hyper
  source 1..83: mol_type = genomic DNA
agtcgggagcccccacgcgccagtcgagcctacgcagctgtggggtgggaaggagaagacaagtcctccgccaagaactcccc

SEQ ID NO: 34400 - DNA, 421 bp, Homo sapiens
  misc_feature 1..421: note = chr12:54324544-54324965
  misc_feature 1..421: note = hyper
  source 1..421: mol_type = genomic DNA
gggcgcttcctagtgcgggcactcatcctgccgctctccggtcggccatttattgtcttgtggggaagggctttcgccaagaaacttggtctgggttagtgaaataaaatactaaacaattactatatgtaaaattttaaaaccagcatattaaaataaactaaggaactctctgtcgtgggagaaatccacaggaaaaggaagagaaggagttagatgctggcgccgagttcctggcggagccaggcggcggtgactcctcaggctgagcggaatcgccatccaggcgccggaaacgacccgaatcccaaaatccgtggaagaaaattgcgctgaaagaacagagccaacgcccccgtcctgccaagtttggcgagacggcaagttggcttcaggagcacaatgccgctaaatgatgcct

SEQ ID NO: 34401 - DNA, 203 bp, Homo sapiens
  misc_feature 1..203: note = chr12:54329276-54329479
  misc_feature 1..203: note = hyper
  source 1..203: mol_type = genomic DNA
acgcacatacacagacgcttcccgtgaaaaagcatattaaatatctcctttctgtgttggatcatttaaaagaaaacatttcagagttgaacttagccgagagcttggttcatgagctgtagctgagggcagagtggcttctgccgctccgcggttgtagaagtccctttgaaaaagcagccgagagcagagccggggcttcc

SEQ ID NO: 34402 - DNA, 302 bp, Homo sapiens
  misc_feature 1..302: note = chr12:54329604-54329906
  misc_feature 1..302: note = hyper
  source 1..302: mol_type = genomic DNA
cgaaggccggcggggcgcgcccgggtgagcaccgcagccgagggtttcagcgccaggccctggaaaggctttctagggcgagatcgccttggagatgtaattactacgtttctagtggtgcatattctcctggagtgtttaatttgattttacttgtgtctcagcgagatccacatttttttttcgggggagggggaagaaaccaccccaggcttaaagttaattaaccagcaaggctttactttccaccgccctcctgcaggctcttgcctcggcgcctcccttcccgatcccggctcgcc

SEQ ID NO: 34403 - DNA, 144 bp, Homo sapiens
  misc_feature 1..144: note = chr12:54330304-54330448
  misc_feature 1..144: note = hyper
  source 1..144: mol_type = genomic DNA
tctggttcccactcccgccattctggttcctactcccaaaggctggggacgtgtctttgagtcctggcccgcggaaaacgggtccggcgttgggcctgaccggggagggagccccaagaatggggtgggcgtttcaggcccttt

SEQ ID NO: 34404 - DNA, 241 bp, Homo sapiens
  misc_feature 1..241: note = chr12:54330856-54331097
  misc_feature 1..241: note = hyper
  source 1..241: mol_type = genomic DNA
aatgccagcccagcccgcagcctgctttctgaactctgagctgacccttctggatgaagatcacgcagataagaattactatcctaactcaccgatgtccgggtgctctcaaccgtcaaacaccaccttctccccacaaagaggagggaggtggcccgaaggggtttctgcagacctgtccatttgctctccacttgaggggtgcagtaggtctggctgagcgaggcgctgctctgtggcc

SEQ ID NO: 34405 - DNA, 770 bp, Homo sapiens
  misc_feature 1..770: note = chr12:54332944-54333714
  misc_feature 1..770: note = hyper
  source 1..770: mol_type = genomic DNA
gggcgcccctcagggcgccgtctatacggacatcccggccccggaggcggcgcgccagtgtgccccgccgcccgcaccccccacctcgtccagcgccaccctgggctacggctaccccttcgggggcagctactacggctgccgcctgtcgcacaacgtgaacctgcagcagaagccttgcgcctaccacccgggcgataaatacccggagccgtcgggcgccctgcccggtgacgacctgtcctctagggccaaggagttcgccttctaccccagcttcgccagctcctaccaggcgatgcccggctacctggacgtgtcggtggtgcccgggatcagcgggcacccggagccgcgtcacgacgccctcatccccgtcgaaggctaccagcactgggctctctccaatggctgggacagtcaggtgtactgctccaaggagcagtcgcagtccgcccacctctggaagtctcccttcccaggtaaggaagggacccgagcgccgccgccgccggggacccctccccgccctgcctgccccggggctccgcgccccaaccacccccgccgtctggccccggcgcgcccgctcggctgggctgcctatggagccggccgggcgagctgcactgaggaatgcgccggggaagaaatctgctccgacacgttctctgtagctgcccggccgagaatgaagcaatcacaggcgcccgaaagccgggccgccggctctgctctgtccggtagctcgcctccgcctccccttgcag

SEQ ID NO: 34406 - DNA, 152 bp, Homo sapiens
  misc_feature 1..152: note = chr12:54338666-54338818
  misc_feature 1..152: note = hyper
  source 1..152: mol_type = genomic DNA
gcaatcctctggccccgttgagcccctgccagaactctgtgcctaggcagcctcgggtcctctatctcagtccagccgcttgcctcacttcttcccgcttgccttatctccccgcagacgtggttcccctgcagcccgaggtgagcagctac

SEQ ID NO: 34407 - DNA, 597 bp, Homo sapiens
  misc_feature 1..597: note = chr12:54338978-54339575
  misc_feature 1..597: note = hyper
  source 1..597: mol_type = genomic DNA
ggcgggtcaaagagaagaaggtggtcagcaaatcgaaagcgcctcatctccactccacctgaccacccacccgctgcttgccccatctatttatgtctccgctttgtaccataaccgaacccacggaaagacgctgcgcgggtgcagaagagtatttaatgttaaggaaagagaagaaccgcgccgcccggaggcagagaggctccatggccgtgctgctgggccatccccaactccctatcccatccccagcctccacccccatccagatgggactcacgtggcttcaacagctttggaaatgggtcccgagtgggccgtgcgaggaaggctgtcgacctctactcctccttgcgctcaccttgccagaaagtctggtggcagcgcagagcccaatcattccaaccaaagcagggttggggaatcccgaatggccccaattcttgcctcatcctatgaccaggcttttagaggaccttccctaagggcgcagcttcggagcaggatctgtccagctcatactttccttcgctgtccctcccgcactccttaggcaagatttcccagtaaagattttctgtgcgtattttaaaagtc

SEQ ID NO: 34408 - DNA, 261 bp, Homo sapiens
  misc_feature 1..261: note = chr12:54343569-54343830
  misc_feature 1..261: note = hyper
  source 1..261: mol_type = genomic DNA
aaggccttgatcttccggtggccagcgaaggggagggctgcttgcccccttgacgcgccatcccccttcccgcaggagcccgccgcctctgtttacacacagaggaggtgtcgtctccagtctagacaagggcgctaataacgcccataaaaggcggcctctccagagatgctctggcaactccgctcccgcgcgcctgccgctggccgctttctccacctccccccgccccgcccttctctgataccttggcgaggccgg

SEQ ID NO: 34409 - DNA, 40 bp, Homo sapiens
  misc_feature 1..40: note = chr12:54345186-54345226
  misc_feature 1..40: note = hyper
  source 1..40: mol_type = genomic DNA
gcagtcactcacagccgattccccgcggtctaagccgcca

SEQ ID NO: 34410 - DNA, 85 bp, Homo sapiens
  misc_feature 1..85: note = chr12:54345574-54345659
  misc_feature 1..85: note = hyper
  source 1..85: mol_type = genomic DNA
gcaccaatcgctccacggtttgggtgcctcggcctgaccacctatagttttgcgcatggtcagcgaagtgccggcgggttaagcc

SEQ ID NO: 34411 - DNA, 67 bp, Homo sapiens
  misc_feature 1..67: note = chr12:54345965-54346032
  misc_feature 1..67: note = hyper
  source 1..67: mol_type = genomic DNA
ggtgggtctcagggagcaggacaccggggatgcgaattttgctagtggttgtcgacagctctccctg

SEQ ID NO: 34412 - DNA, 210 bp, Homo sapiens
  misc_feature 1..210: note = chr12:54348787-54348997
  misc_feature 1..210: note = hyper
  source 1..210: mol_type = genomic DNA
cttccccaacttccgcgcgtccggggcgcagcttcccgggctgccttcgctgtcctacccacgccgcgacaacgtgtgctccctgtcctggccgtcggcggagccgtgcaatggctacccgcagccctacctcggcagcccagtgtctctcaaccctcccttcggccgcacgtgcgagctggcgcgcgtggaggacggcaagggttacta

SEQ ID NO: 34413 - DNA, 120 bp, Homo sapiens
  misc_feature 1..120: note = chr12:54349255-54349375
  misc_feature 1..120: note = hyper
  source 1..120: mol_type = genomic DNA
cgccggcgcaggcgaccccggcagcttggtatcgccgttgaaccccggcggcgggctctcggccagcggtaaggaccccggccactcaagcggcggattcaaacccgacctcttaccagg

SEQ ID NO: 34414 - DNA, 180 bp, Homo sapiens; identical to SEQ ID NO: 1042
  misc_feature 1..180: note = chr12:54354514-54354694
  misc_feature 1..180: note = hyper
  source 1..180: mol_type = genomic DNA

SEQ ID NO: 34415 - DNA, 273 bp, Homo sapiens
  misc_feature 1..273: note = chr12:54354814-54355087
  misc_feature 1..273: note = hyper
  source 1..273: mol_type = genomic DNA
cggaaggttccggtgtaattcagcgggaggtggaaggcaggccccgatcccacagcgcgcctatgctcagcctttggtccgagcggccgccctcctgcgtgtgcctcggtccagacggcgctgccgattttccaaggagaggccgtggcccgcgtccgccgctgcaggactccccagcttcgccctccgctccgcgctgcagccctgcgcggtgctctcggttgccactctagccgaggcctcgagacaaagacgcgccgggcactggtggac

SEQ ID NO: 34416 - DNA, 40 bp, Homo sapiens
  misc_feature 1..40: note = chr12:54359643-54359683
  misc_feature 1..40: note = hyper
  source 1..40: mol_type = genomic DNA
ggcagaagcaagggtcggctgttgctctccctcgcccggg

SEQ ID NO: 34417 - DNA, 342 bp, Homo sapiens
  misc_feature 1..342: note = chr12:54359742-54360084
  misc_feature 1..342: note = hyper
  source 1..342: mol_type = genomic DNA
cgtaccttataaggaaggcgccggtcctccatttcagccttttctctgccaggacgcggccgtggcatttctggtcttgtaaacatcagactctttggggccttaaaaaaataaagacgcccctccttcctttaccgggggtgagccggccggggaaagcggcggacagggaaatcaactaatgaagactccgggaaacttttctctctttttctctctctggctccgctccccgccagctggggacccttccctccctccttcctccccctcccttcccccgcctctctttttctctatctcccagtcttctgtacctctcgccgccgtctgtaactctgg

SEQ ID NO: 34418 - DNA, 30 bp, Homo sapiens
  misc_feature 1..30: note = chr12:54363641-54363671
  misc_feature 1..30: note = hyper
  source 1..30: mol_type = genomic DNA
ctcctttccctaccacgatctgctctctag

SEQ ID NO: 34419 - DNA, 376 bp, Homo sapiens
  misc_feature 1..376: note = chr12:54366919-54367295
  misc_feature 1..376: note = hyper
  source 1..376: mol_type = genomic DNA
agagagagactaagacggataacgcgtcatctcgccttcccaaattttcccccctcgctagaccgggtccaaaacctccatccggagccggcaggagaggagaacgatgtttaactcggtcaacctgggcaacttctgctctccgtcgcgcaaggagaggggcgcagatttcggcgagcgagggagctgcgcctccaacctctatctgcccagttgcacttactacatgcccgagttctccacggtctcctccttcctgccccaggccccctctcgtcagatctcctatccctactcggcccaagtgcccccggtccgggaggtctcctacggcctggagccatccggcaagtggcaccatcggaacagctactcc

SEQ ID NO: 34420 - DNA, 105 bp, Homo sapiens
  misc_feature 1..105: note = chr12:54367525-54367630
  misc_feature 1..105: note = hyper
  source 1..105: mol_type = genomic DNA
cgagcccccctgctccggcaagggcgaggccaagggggagcccgaggcacccccggcctcgggactggcgtcccgggctgaggcgggtgccgaggcggaggctga

SEQ ID NO: 34421 - DNA, 72 bp, Homo sapiens
  misc_feature 1..72: note = chr12:54368360-54368432
  misc_feature 1..72: note = hyper
  source 1..72: mol_type = genomic DNA
aggcgggggtctgggcgtttctcccgggtccgcggccttagtgcttgcctagaactgcggtgtggaaggcgc

SEQ ID NO: 34422 - DNA, 355 bp, Homo sapiens
  misc_feature 1..355: note = chr12:54368647-54369002
  misc_feature 1..355: note = hyper
  source 1..355: mol_type = genomic DNA
agcagacagggggcccgaggggacgcacgtgtacctggagggctttccttctgtcccagaccctgtcagccgcggctctcgcctgagaactggggacggggtggcgcagtggcgggggggtggggacccgctagacctggcagggggtcgaggcttgcccgggtgctgcggctgcaggagagccagccgcctggcgggagggctgcccgcggtgggctaggagaagggccgctgagcgctcagcgggctggggtcgcccgggtctcacgtgtctctctcccccctctcctcgcacttgccccctcccctccctccagacgccccccgcacccgcaagaagcgctgcccttattcg

SEQ ID NO: 34423 - DNA, 75 bp, Homo sapiens
  misc_feature 1..75: note = chr12:54377164-54377239
  misc_feature 1..75: note = hyper
  source 1..75: mol_type = genomic DNA
ctcgcccgtttcccgcgggatgggcggtgggacaaatggctccctggattgactgctgcccggactgtcccaagt

SEQ ID NO: 34424 - DNA, 157 bp, Homo sapiens
  misc_feature 1..157: note = chr12:54378041-54378198
  misc_feature 1..157: note = hyper
  source 1..157: mol_type = genomic DNA
tggtgacccaggagccgcccaccctgccaggcccaggccacagctctcgggtcggggatcgggtgcctctggtctctggcttcctctttcccctaccccgcgtccattcggaacctccttttccgagcagccatgaagtgaccgtgaccccctccct

SEQ ID NO: 34425 - DNA, 1117 bp, Homo sapiens
  misc_feature 1..1117: note = chr12:54378814-54379931
  misc_feature 1..1117: note = hyper
  source 1..1117: mol_type = genomic DNA
cgctgacgtcacggccgtctgaatcatcaaggccattttcaaatcccattggtctagccgtcacatggtgagaaccgaatgcgcggataattacggagctgatatttccccccctccccttctttttcctccctcccctccaaccgcgccccccctcccggatggggaaaaaaaaagatgtcagctcctccgctgtagtattgctccttaaaaacccctctctctgaaaatgacatgccctcgcaatgtaactccgaactcgtacgcggagcccttggctgcgcccggcggaggagagcgctatagccggagcgcaggcatgtatatgcagtctgggagtgacttcaattgcggggtgatgaggggctgcgggctcgcgccctcgctctccaagagggacgagggcagcagccccagcctcgccctcaacacctatccgtcctacctctcgcagctggactcctggggcgaccccaaagccgcctatcgcctggaacaacctgttggcaggccgctgtcctcctgctcctacccacctagtgtcaaggaggagaatgtctgctgcatgtacagcgcagagaagcgggcgaaaagtggccccgaggcagctctctactcccaccccttgccggagtcctgccttggggagcacgaggtacccgtgcccagctactaccgcgccagcccgagctactccgcgctggacaagacgccccactgttctggggccaacgacttcgaagcccctttcgagcagcgggccagtctcaacccgcgcgccgaacatctggaatcgcctcagctggggggcaaagtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaaggtaaggccgcctgggccgcgggcgccactgggacgttccggcacttggtcttcgcggccggggaggggggcaggggagagggttgggcccaggaggccccagaccatttcgggaatgcgaccctggctttcgactag

SEQ ID NO: 34426 - DNA, 434 bp, Homo sapiens
  misc_feature 1..434: note = chr12:54379958-54380392
  misc_feature 1..434: note = hyper
  source 1..434: mol_type = genomic DNA
cgtcacttagctggggaaggtaagcggcgacgtggaggtgtcggccctgccccggccatgggtgctaaggcgggggcggtgcgcaccgcgggccgcctgcaggcgcagtgtgctgcaccggacgggtggctgctcccaggcgcgtgctggctgtggtttgctttctcaatgctggtgtcctggggagctgacgtcccccagctcaggtcaggggcttgcaaaaagcctaaaatggcgatcttgggccagggactagggaaggctggggagatggggggagttctctttactgcgttttcccagttgaaaattgtttcctgcgaaacgcgatttgttgtttgtgggtctgatttgtgcgtgcggcttgggctcctgcggcttttggctcggccgggggccttgggcagcgaggctggagccggaagaggtggagg

SEQ ID NO: 34427 - DNA, 505 bp, Homo sapiens
  misc_feature 1..505: note = chr12:54387842-54388347
  misc_feature 1..505: note = hyper
  source 1..505: mol_type = genomic DNA
gtctctgagatctctcgtcggctgctggggctccggctcagcctggcagatccgctgtggcctctctgggacctcgccccggcccacggcctgacttcggctcggagatgcagcccttcccgagaacaggtgaagaagacggcggcagcggggactgggggcttcgggtgggaacgccagggctcagggctttgtgtgggtcgtgcagggggcgaggttcgaagtcctgggctggaccgcagcacgagtgtggcccggacggctgcgtggccagaaggggtgttcgggcagggtgcgagagcaccggcaaggtggattgtgtatggactttggccgcagacagagcagagcgggctcccgggctgtggccggcggcgaggcgggcaaccgcatgttgagtctatagaaaggaccttgaggtctgctgggtgtttgggctgccctgggggcggcggcccagagtgtggagcaagcggcgcgcggggcgcggcggtcagcgtgggag

SEQ ID NO: 34428 - DNA, 208 bp, Homo sapiens
  misc_feature 1..208: note = chr12:54388627-54388835
  misc_feature 1..208: note = hyper
  source 1..208: mol_type = genomic DNA
ggcggccgtggtggccggggcttccctccccaggcgggagccgcctgtcctgtatctatggccgtggggagcgaaggaccaggtaacgaaggcgcttccgaagcgggattggaccaaaccagagggacagagtcttctgggtctctctgcctgaggccctggagggagagaaggtagggagatcggcgcccgccgggcctggcaaaga

SEQ ID NO: 34429 - DNA, 95 bp, Homo sapiens
  misc_feature 1..95: note = chr12:54389157-54389252
  misc_feature 1..95: note = hyper
  source 1..95: mol_type = genomic DNA
tgaggccagacagctcgcagtcgggcagggagggcgggggagagacgagcggctctggccccttaattgtacttcgggctcgtattgtctctcct

SEQ ID NO: 34430 - DNA, 26 bp, Homo sapiens
  misc_feature 1..26: note = chr12:54391298-54391324
  misc_feature 1..26: note = hyper
  source 1..26: mol_type = genomic DNA
cccgcggcaaaggcccggcaagccag

SEQ ID NO: 34431 - DNA, 260 bp, Homo sapiens
  misc_feature 1..260: note = chr12:54391399-54391659
  misc_feature 1..260: note = hyper
  source 1..260: mol_type = genomic DNA
cgcctccctctctgcacgcctgcctttcccggctctcctatctcttttcatcttgccttccttcttttaattctcccccttttttccctttattctaatgctccgcttccttctttcctctcttgggcctgactccatgtttcagttggtctgtcccaggctgtctcgggttcagtctctctcaggctctgtcccctgatgtcctcttggtctcagtctggccccgggccccgctgagggctaaacgtctctgctcatcg

SEQ ID NO: 34432 - skipped

SEQ ID NO: 34433 - DNA, 263 bp, Homo sapiens
  misc_feature 1..263: note = chr12:54393461-54393724
  misc_feature 1..263: note = hyper
  source 1..263: mol_type = genomic DNA
gattacgtcaagaaatagttcctccacctacctcggtcggcctccccgcccctgcggggctcccgcgcccagctcggccctgggggtccgagaaccctggcttcggggactggcattttcaccccattaaaaaatcctcatggttggggggaggccatctgcttatgggtggacatgggcacaggggcttctcagatgagctaggagccgtcctgagggggtgaccggtgccttgggtccagagttccggacccccaggaaat

SEQ ID NO: 34434 - DNA, 621 bp, Homo sapiens; identical to SEQ ID NO: 11268
  misc_feature 1..621: note = chr12:54393798-54394419
  misc_feature 1..621: note = hyper
  source 1..621: mol_type = genomic DNA

SEQ ID NO: 34435 - DNA, 195 bp, Homo sapiens; identical to SEQ ID NO: 11269
  misc_feature 1..195: note = chr12:54394466-54394661
  misc_feature 1..195: note = hyper
  source 1..195: mol_type = genomic DNA

SEQ ID NO: 34436 - DNA, 77 bp, Homo sapiens
  misc_feature 1..77: note = chr12:54398709-54398786
  misc_feature 1..77: note = hyper
  source 1..77: mol_type = genomic DNA
cctctctcccctggtcgggagcgctgggatgcgggcttctctcccagaccgagagcggcgtttccgggcttccaccc

SEQ ID NO: 34437 - DNA, 208 bp, Homo sapiens; identical to SEQ ID NO: 11270
  misc_feature 1..208: note = chr12:54398888-54399096
  misc_feature 1..208: note = hyper
  source 1..208: mol_type = genomic DNA

SEQ ID NO: 34438 - DNA, 312 bp, Homo sapiens
  misc_feature 1..312: note = chr12:54399355-54399667
  misc_feature 1..312: note = hyper
  source 1..312: mol_type = genomic DNA
tttgtctatggcccacggagaacaggacctcactggctgagagggagaggtggagagcgcgcgcgcgagagggatgggctacaaaccaggggtcaaacagcctggagaagtccgagtcccaccccaaagtcctgcaggcggcggcggaatagtcggtgcggggccagcatcagggtaagaggagggaggactttagggtgcgcgccgcgggcaagccgtcgtgggagcctcggagcgtgcatccgcgttcgcggagatgttccaagcccagaaatgcgcctgaatggggggagatcgcggcagttgctttgc

SEQ ID NO: 34439 - DNA, 120 bp, Homo sapiens; identical to SEQ ID NO: 3895
  misc_feature 1..120: note = chr12:54402676-54402796
  misc_feature 1..120: note = hyper
  source 1..120: mol_type = genomic DNA

SEQ ID NO: 34440 - DNA, 624 bp, Homo sapiens
  misc_feature 1..624: note = chr12:54402856-54403480
  misc_feature 1..624: note = hyper
  source 1..624: mol_type = genomic DNA
ccgcgccccagccccgggagctctgctgatccggccgagctcagcaccgaggcgccccccaacctgcccagcccccagcccaccagcccagcccagtcccggggagccagctggcctggggttcggtcccggggggaggggagtttcgggggtactgggcggggtactcgtgagccagaggggagggggccgcgggttttcatgtacccagcatgagctcctacttcgtcaaccccctgttctccaaatacaaagccggcgagtccctggaaccggcctattacgactgccggttccctcagagcgtgggcaggagccatgcgctggtgtacgggcccggcggctcggcgcccggcttccagcacgcttcgcaccacgttcaagacttcttccaccacggcacctccggcatctccaactcaggctaccagcagaacccgtgctcgcttagctgccacggagacgcctccaaattctatggctacgaggcgctccccagacagtccctttatggggctcagcaagaggcgagcgtggtgcaatatcccgactgtaaatcctccgccaacactaacagtagcgaaggacaaggccacttaaatcaaaactcgtctcccagcctca

SEQ ID NO: 34441 - DNA, 410 bp, Homo sapiens
  misc_feature 1..410: note = chr12:54408316-54408726
  misc_feature 1..410: note = hyper
  source 1..410: mol_type = genomic DNA
ggcccagtagcctagcggaatgaacccagcattaaatggctccgaagggcctcgccgccttttccccacaccaaatgtgccatttatcccttgtcctgttcagcaatgtccgtggccccaagcccggcgcgtcggagggcggggtgcgtctggcgcccggctttactcgagatgccaggcatggagagggctaagccgagggagccccagccaccccctcatgcagtacccgctcccccacccctcctgcccaccgcctctgttttctcgtttggaaagaaatggaggtaaaaacccgttttatgggggaacgtaattgtgagcgggatgcgctctctttagaatcgcgtcctcccaaatgctcccgccgtcccattaccggaatggggaccattcggctgctgcagata

SEQ ID NO: 34442 - DNA, 61 bp, Homo sapiens
  misc_feature 1..61: note = chr12:54422441-54422502
  misc_feature 1..61: note = hyper
  source 1..61: mol_type = genomic DNA
agaaccggatctactcgactcccttttattcgccacaggagaatgtcgtgttcagttccag

SEQ ID NO: 34443 - DNA, 110 bp, Homo sapiens; identical to SEQ ID NO: 11275
  misc_feature 1..110: note = chr12:54425031-54425141
  misc_feature 1..110: note = hyper
  source 1..110: mol_type = genomic DNA

SEQ ID NO: 34444 - DNA, 300 bp, Homo sapiens
  misc_feature 1..300: note = chr12:54440853-54441153
  misc_feature 1..300: note = hyper
  source 1..300: mol_type = genomic DNA
cttctcgcccgccagcgcagggcccaggtgtttgaggcgaaggggctctagctccccgcaagcctggagccaggcgtcgcgcttcctccgggcttaatccagacctttcaacacacacctcattcgggggaggagaaaagcacaggaccgcggagagcccagctttgaggccaggcctgaagggataacccacacagggaacgttttcctatcagagaataatggagcacaaaataattcagaaagcgaatgggcaggaccacagcctgagagtcccgcgccgcggggccgctgcagagc

SEQ ID NO: 34445 - DNA, 30 bp, Homo sapiens
  misc_feature 1..30: note = chr12:54446784-54446814
  misc_feature 1..30: note = hyper
  source 1..30: mol_type = genomic DNA
cagaaaatagcaggccgggctgaatgggga

SEQ ID NO: 34446 - DNA, 124 bp, Homo sapiens
  misc_feature 1..124: note = chr12:54447898-54448022
  misc_feature 1..124: note = hyper
  source 1..124: mol_type = genomic DNA
cgccagtatagctgcaccagtctccaggggcccggcaattcgcgaggccacgggccggcccaggcgggccaccaccaccccgagaaatcacagtcgctctgcgagccggcgcctctctcaggcg

SEQ ID NO: 34447 - DNA, 68 bp, Homo sapiens
  misc_feature 1..68: note = chr12:54500146-54500214
  misc_feature 1..68: note = hyper
  source 1..68: mol_type = genomic DNA
tcgctccatccttcccgcctgacggatgcgtctgctgcgcaggcacaagctgtcgggccaggccctgc

SEQ ID NO: 34448 - DNA, 193 bp, Homo sapiens
  misc_feature 1..193: note = chr12:54520001-54520194
  misc_feature 1..193: note = hyper
  source 1..193: mol_type = genomic DNA
tggggcacaccagcacggcagaaactggagaaagcgagagacgtcgccagggacccagggacctctccctccagttccccgggcccgcccggccctgatggccactcacgctatagcgcccactctgtcctgggccatcccgcgccagcagtgtagcccccagcccgggcgcctgaatgctctccctccggat

SEQ ID NO: 34449 - DNA, 790 bp, Homo sapiens
  misc_feature 1..790: note = chr12:54520221-54521011
  misc_feature 1..790: note = hyper
  source 1..790: mol_type = genomic DNA
cgtgcccccgagtcctgcttccccggggcctgctctgtatcaggcgcctgcgccttcaagggtacccggcccgcctgccctccccaagagccgagtttgcgctcctcccggaatcgtttgagagaaggacaaacttttggcaggatggaaatctagatgagcctgtccggagcaggtaagctgggcccgggacgggtgcgattcagcccgagaacaatctgtctctccccgtcccggtctctccctccccttacccctgtttcccctgcaggctgacatattaatctgccttcccccgggagaaatttgggctggggttgggcttctgtcagatgcatggggtcagagcagctttcctccccgagtttagggactaaggtggtagctggcaggggagggggagggttgcttccgaaactgaggattgaggggagggttaggggccgagaaacccagagtctgagggagacgacttctttcctcaaacgcaacttgggggaacttcggaaaagttttttgaggggagatggagaagggagcggagttggggtttcgagggctaaagtgggagagagggtgctccgcttcccgtactgaaggaaggatgtgtgtgcttattccccagtcgggaccgattaccagcctagaaaaacccagccgcgtcccaaacccgctcaccccagcaggcccttagagacgcttggagatccccagacacgccccgcggaaagggaaggaaatgccagcccgagttgccgactctgccgggacggggcgggggatccgccca

SEQ ID NO: 34450 - DNA, 85 bp, Homo sapiens
  misc_feature 1..85: note = chr12:54611458-54611543
  misc_feature 1..85: note = hyper
  source 1..85: mol_type = genomic DNA
gcagtgaaggaaggacgctcagaccaacaggggctcaggtattctgggtgtcaggacccttcctcctgcacgcatcttacgcagg

SEQ ID NO: 34451 - DNA, 588 bp, Homo sapiens
  misc_feature 1..588: note = chr12:54812034-54812622
  misc_feature 1..588: note = hyper
  source 1..588: mol_type = genomic DNA
gcccttggctgagttcgcccccagccccagggccccagtgccagggtccccgcactcgcccccagttctcggatcccctcgcctgaacagagattgggggcggagggaggagtaggagacagaggagaaaggagagggagccgccgtcctctctcgggtctttccccggtctgagttgaggggggaggggaggatgaggctggcccccatttaaccttccgaccccctcagtctttgactttcctcctactacacgtagctcattcggcttctacccgttctctcgccgcacaatggcccctacggatcccgaggtctcctggagcccccaaaagcccttcccggcctctgcgccccctctgcgcccccacccgccccaggtcccagcagcccacagacttcagccagagaccctcagctctccattcacgcgctctcctctcccttggcccggagacccctgcccagacttctccagctccgtgtcctctccccaccggacacatgtctccccactgatctcaaacgccagggcccctcctcacccgccacggtgccctccctactccagcgcgggcccccaactct

SEQ ID NO: 34452 - DNA, 30 bp, Homo sapiens
  misc_feature 1..30: note = chr12:54943058-54943088
  misc_feature 1..30: note = hyper
  source 1..30: mol_type = genomic DNA
gaaactcaaaacacacggagagaacccaca

SEQ ID NO: 34453 - DNA, 52 bp, Homo sapiens
  misc_feature 1..52: note = chr12:54943371-54943423
  misc_feature 1..52: note = hyper
  source 1..52: mol_type = genomic DNA
aggcggctctggcagcgcgcggcggcggcggcggtagcggcagcagcagcgg

SEQ ID NO: 34454 - DNA, 30 bp, Homo sapiens
  misc_feature 1..30: note = chr12:54982627-54982657
  misc_feature 1..30: note = hyper
  source 1..30: mol_type = genomic DNA
gagttttgggcagggcgttggggtggggag

SEQ ID NO: 34455 - DNA, 166 bp, Homo sapiens
  misc_feature 1..166: note = chr12:57613840-57614006
  misc_feature 1..166: note = hyper
  source 1..166: mol_type = genomic DNA
aagatgtgtgggatccgtgagggacagggcaacagagagggggcagggtcataggagagggtcccagggctcaggcgcaggaggagtcgcagggcgtggggtgggaagcagctgcccagtggggatggggagcagggagcgctgccttgagcgctggaaattggcg

SEQ ID NO: 34456 - DNA, 30 bp, Homo sapiens
  misc_feature 1..30: note = chr12:57614370-57614400
  misc_feature 1..30: note = hyper
  source 1..30: mol_type = genomic DNA
cccaccagcggtccccgccccctcatgcag

SEQ ID NO: 34457 - DNA, 64 bp, Homo sapiens
  misc_feature 1..64: note = chr12:57618647-57618711
  misc_feature 1..64: note = hyper
  source 1..64: mol_type = genomic DNA
tcttcgtgcacaggccgtcagtgcccagataccagagtccggaaggccgcagtacctggggctg

SEQ ID NO: 34458 - DNA, 47 bp, Homo sapiens
  misc_feature 1..47: note = chr12:57619110-57619157
  misc_feature 1..47: note = hyper
  source 1..47: mol_type = genomic DNA
gggcctgtcccccaccctctgcagtctacgctcgccctggagggggt

SEQ ID NO: 34459 - DNA, 33 bp, Homo sapiens
  misc_feature 1..33: note = chr12:57632036-57632069
  misc_feature 1..33: note = hyper
  source 1..33: mol_type = genomic DNA
tctcgctgatacttccgccgccccctactctga

SEQ ID NO: 34460 - DNA, 64 bp, Homo sapiens
  misc_feature 1..64: note = chr12:57632479-57632543
  misc_feature 1..64: note = hyper
  source 1..64: mol_type = genomic DNA
ctttgttctgagttccggtgaccccggccaggtcccaaattctccgtcgcgctccttttccaga

SEQ ID NO: 34461 - DNA, 60 bp, Homo sapiens
  misc_feature 1..60: note = chr12:57635046-57635106
  misc_feature 1..60: note = hyper
  source 1..60: mol_type = genomic DNA
gagcagcagaccgggcggaccccactgacccaaatcgggcagtttcgtggagggagagcc

SEQ ID NO: 34462 - DNA, 256 bp, Homo sapiens
  misc_feature 1..256: note = chr12:57869962-57870218
  misc_feature 1..256: note = hyper
  source 1..256: mol_type = genomic DNA
aggaaactgaggccacggtgttgtttccttcactgcttccctctccccggtgggctgtgaggaggtgggaggcttcctcacttctttactttcctctgcaccgccctccccgctgccgcccccacattggcgtgaggcggtaggcagcgcccgcacccatcctgcgcctctcgctcacactcacccagcctgaggagggcgctgtcggcggtggctctcggtagaacaccaggctgttacccgttaacaccaccca

SEQ ID NO: 34463 - DNA, 405 bp, Homo sapiens
  misc_feature 1..405: note = chr12:57943780-57944185
  misc_feature 1..405: note = hyper
  source 1..405: mol_type = genomic DNA
cgcccaggcccgcagcgcggcgctgcagcgcgaggggcggagaggcagagagcccgaaaggaccagacgcccaggtcgcccgcatcccgctgccgcaggagagagacagcgcgccccggccctgctccccaggcttcgcccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggt

SEQ ID NO: 34464 - DNA, 30 bp, Homo sapiens
  misc_feature 1..30: note = chr12:58004572-58004602
  misc_feature 1..30: note = hyper
  source 1..30: mol_type = genomic DNA
tgagacccatttaatcgcagagacctccac

SEQ ID NO: 34465 - DNA, 133 bp, Homo sapiens
  misc_feature 1..133: note = chr12:58004814-58004947
  misc_feature 1..133: note = hyper
  source 1..133: mol_type = genomic DNA
aagactccccatacacgcaccccgtaccagggggcctctgtccactcggccggggacagccccaaacccagaacatcttcgcacaggccaaggccccatccactgagtcctccttcatcgcagaggccaaggg

SEQ ID NO: 34466 - DNA, 383 bp, Homo sapiens
  misc_feature 1..383: note = chr12:58014820-58015203
  misc_feature 1..383: note = hyper
  source 1..383: mol_type = genomic DNA
cgctcaacgggttggggtagccgcggccgtggccttcgggagcggggcgttgatggtgagggaggacccggggaggaacccggggggatccctgctgaggggccagggaaattgggccggggaagagggagggaccagctttcggcttgggttcgggagggcggaggtgcgcggggttggtttgctcctcctctagatggtgacagcgcgtcttctcccccacagctggggatgttcgtgctgcagctcggcgtcttgtccacctttttgtccgagcctgtggtcaaggcgctgaccagcggggccgcgctgcacgtgctcttgtcccagctgccgagcctcttggggttgtccctcccgcgccagatcggctgcttctctct

SEQ ID NO: 34467 - DNA, 166 bp, Homo sapiens; identical to SEQ ID NO: 3900
  misc_feature 1..166: note = chr12:58021293-58021459
  misc_feature 1..166: note = hyper
  source 1..166: mol_type = genomic DNA

SEQ ID NO: 34468 - DNA, 263 bp, Homo sapiens
  misc_feature 1..263: note = chr12:58021713-58021976
  misc_feature 1..263: note = hyper
  source 1..263: mol_type = genomic DNA
ggtgccttcgggggtacccctgccccatcctcttccgcttcacccctgcaggacccagacagttcccaggccccacttcgtggttctctctttgtcctagggctggccgttcctggccgcagcgcccccgctgtggccttagcctgttcaaggcccttctccacccccacatcctgcagcccctgccctaccaggtccagcggcgtccgctccagcacgtccacaagcctctccagccgcgtccgcgccgtgaagacgaagtc

SEQ ID NO: 34469 - DNA, 154 bp, Homo sapiens
  misc_feature 1..154: note = chr12:58025580-58025734
  misc_feature 1..154: note = hyper
  source 1..154: mol_type = genomic DNA
tcactccacacagcccgttaggagaatgcaggcatctgagcccagcagtggagaaaacaaaagcccccagaccacccccagcgagcgctgcgctgcgccgccgcggtcggcactcaccccactacttgctccttgatcctgaccgggatgtgtg

SEQ ID NO: 34470 - DNA, 140 bp, Homo sapiens
  misc_feature 1..140: note = chr12:58025869-58026009
  misc_feature 1..140: note = hyper
  source 1..140: mol_type = genomic DNA
cgagcagaaggaccagagcgcacagggcccggcggcccagccacatcctaggtgggggtagggtggggagtgagaaagggagggaagaagggagggcaagggatggggcccttggcccccgcgtcctcagaggctcctgc

SEQ ID NO: 34471 - DNA, 230 bp, Homo sapiens
  misc_feature 1..230: note = chr12:58026065-58026295
  misc_feature 1..230: note = hyper
  source 1..230: mol_type = genomic DNA
cgcggttttcccggtacccctcccctcacttcccaggccccagggtctcccggcctcctttcttctcgccctctcctgcatctcggtttcctcacacacccgaggcctggcatcttaatgctgaagacatttggatgccgcggtttcgacgcggccgtgcgtaagcggaaaagccccgctctatcagggcagtggcagtccccaagcccgccgcccgccctggccggcgc

SEQ ID NO: 34472 - DNA, 97 bp, Homo sapiens
  misc_feature 1..97: note = chr12:58159773-58159870
  misc_feature 1..97: note = hyper
  source 1..97: mol_type = genomic DNA
ggcagagaagactcacgcagtgagcagtccgcaagcccgctggcggcagcggcggtgctccgtccagggcgagaagctgcagcgctcgggccggggt

SEQ ID NO: 34473 - DNA, 82 bp, Homo sapiens
  misc_feature 1..82: note = chr12:58160215-58160297
  misc_feature 1..82: note = hyper
  source 1..82: mol_type = genomic DNA
cctctctgatcatctcggtcgaggagaaatctctaaaagttccatgtctggactgtccatctcaggacgagtcctcagtgaa

SEQ ID NO: 34474 - DNA, 48 bp, Homo sapiens
  misc_feature 1..48: note = chr12:59313895-59313943
  misc_feature 1..48: note = hyper
  source 1..48: mol_type = genomic DNA
ccccagagggctgcccgagttccccgcgaccgccgctgtctgaccggc

SEQ ID NO: 34475 - DNA, 243 bp, Homo sapiens
  misc_feature 1..243: note = chr12:59990053-59990296
  misc_feature 1..243: note = hyper
  source 1..243: mol_type = genomic DNA
aggaggaggaggtgccggctaagaggagggcgagcctgcgtctgcgacccgagctgcccgcggagccgcacgcgtgtgtgcaaataatggccagcctgtgacaaacgtgccaacgcagagttggccagcgagcccttatatagacaaaaaaatcccgaagcggccgcgggagcagagctcgcgtcagccagtgcgcgccgacagctgcccgggaactgagggggcgcgcggggtcctgggcaa

SEQ ID NO: 34476 - DNA, 30 bp, Homo sapiens
  misc_feature 1..30: note = chr12:62584322-62584352
  misc_feature 1..30: note = hyper
  source 1..30: mol_type = genomic DNA
attctgaacgctgttcgttaagagaatcat

SEQ ID NO: 34477 - DNA, 336 bp, Homo sapiens
  misc_feature 1..336: note = chr12:62584677-62585013
  misc_feature 1..336: note = hyper
  source 1..336: mol_type = genomic DNA
gtctgggtgaggaatcgaattacaacccacttcaatcctcgacctggtcgtttgctgttattaggagaaatggggcagagagggagggcaccgctcacggagcctcatttcgcatgctccgatcccctctcggcgtccctctactccgcccctaccctgaccgcccgcgagggagacgccggccgatggacccgcatctgccctcacctctcgccttccccgggcgatccctctacagtcccggacccccgagaaaggggaagggagacgtgtgcacacgggggcttccgggaccgcggtcctgcagttgccgctccggtccccagcgctggccgg

SEQ ID NO: 34478 - DNA, 1172 bp, Homo sapiens
  misc_feature 1..1172: note = chr12:62585030-62586202
  misc_feature 1..1172: note = hyper
  source 1..1172: mol_type = genomic DNA
cgcacctacctgcagccccgcttcccggtggcggcaacacctagcgatgctcctgcagcttttgcgggccggcgccagccttatcgctctcgcatcgcttccaagatgccaatccgccgtcaccatccaggggcatagggaaccgaagtctggtgctgtgtgatcgtggagggcggcgtgtgagtgtggccctgagcgtgcgagtgtgcgcgcgcgtgtgtggatgtgtttcctcctccgatggcaaagacggttcaggaatctgacatccaagctggaatccccctgaagcgggtgaaggtgagcctgatccttctccccgcttctttattccacagtgtcaaagtaatcaaaagatttgtttactgaggaaaagccaaagtcccgcagcccttggcagcgcccgcggtcgcctcctgtcctcgccggatgcgcgcggtgcgctcagctccctggactgcaagaatcaaggcggtcttgctgcaattaccgctcttattccatctctgatttgtttgcttttaaggccgactaaagacttttcctctcgcctcacgtcgtctctccctctcacacacacacacactcacacatcctccgttccctctctcccgccctccctcttgttctctggggaaaggcaattggacagaatgattcaccttcaggaaagcagcctcggccacgcacttctcgagttccctggctctcgcaggtaccgggtctccaacgtggcggagttgctgggaagctcgggacaggaaggaggagaggctctgagctcagccgatgtcccccctccagacgcccgcgttcctccgtccaggtgcccctgttcccactgctcgcagataggtccccgctggtgccctcgcggagacttggcgccttccactcgaatccacttagcagcaactcctggccagcttcagcccctcaatcccgcctcgaagtgctgcgggcagagccccacgcagcccacccgctgcccttctaggcatcgtgggctggaaggaagggaaacccgccgatgtccccctggtagcagtgccctggcaccgtcaccaccgaggaggtgcgagttccaacatcgaacacaagcgagcaggtgtcgcctgtgtcactttgctaaaggcgggaggggagaaagaaaggagcggggggagggggcc

SEQ ID NO: 34479 - DNA, 140 bp, Homo sapiens
  misc_feature 1..140: note = chr12:62829159-62829299
  misc_feature 1..140: note = hyper
  source 1..140: mol_type = genomic DNA
gtctgcatccctaagcgaactgctgcgatcctaagcgcggggagctcccccacccagaggtacccaggcggtgcttgggcggtagtttggagaccctgagagggcaatgcaccagacaggaaactcgccctgggtctctc

SEQ ID NO: 34480 - DNA, 422 bp, Homo sapiens
  misc_feature 1..422: note = chr12:63025738-63026160
  misc_feature 1..422: note = hyper
  source 1..422: mol_type = genomic DNA
actggcgctgcctcccgggtccaggttccagccgctcccagctgttggcggcgctgctgagatgatggcctggatcccccaggttccgggactccccaggtggctccccgaggctatttacagctgaggttcggccggtgattgctgggacggaaaactcatttctcagcctggcttttatttacactcttattaaggaggctttcattcgtgttggaatggcagcgagaggctgcgggccaggcggccgaatgggtcgtgcccgagcgacagcggccgcctgcgccgcgaccttgagggcagaggagcgtgggcggcgtgcggggacaaaggcgcgcggggagcctgggtcacggctctgcagcagacacgggacctccacgtttctaccaccccggaaagttgagcgccttgggggctgc

SEQ ID NO: 34481 - DNA, 86 bp, Homo sapiens
  misc_feature 1..86: note = chr12:63327187-63327273
  misc_feature 1..86: note = hyper
  source 1..86: mol_type = genomic DNA
gagctgattggttcccggacgaaccaatcaaccagcgaggccgtgcacggataggggagggccaaaactaccgaggggatggggtt

SEQ ID NO: 34482 - DNA, 562 bp, Homo sapiens
  misc_feature 1..562: note = chr12:63543840-63544402
  misc_feature 1..562: note = hyper
  source 1..562: mol_type = genomic DNA
gcacccttgctctggcgcgacgccgtcttcccgcggacgttgcaccagatgttgtagcagatgaagccgtagcaggtacccaagatgaccacgggcgccacaaagatgccgcccgtcatccaggtcacgtaggcacgagaaccccagggctggatgaaggtggcccagcagtcgcgggccttggtgacattgttcacctcgatcatggagaagacgaagtactgcggcgtgctcagcacgaagctcagcacccaggcggccgcgatcatgaggcgcgagcggcgcgcgggctgttgcagagtcttgagcgggtggcacaccgcgatgtagcggtcggctgtcatgactaccagcatgtaggccgacgcaaacatgccgaacacctgcaggtgcttcaccacgcggcacagccagtcggggccgcggaagcggtaggtgatgtcccagcacatttgcggcagcacctggaagaatgccacggccaggtcggccaggctgaggtgtcggatgaagaggtgcatgcgggacgtcttgcgcggcgtccggtgcagagccagcagta

SEQ ID NO: 34483 - DNA, 102 bp, Homo sapiens
  misc_feature 1..102: note = chr12:63544498-63544600
  misc_feature 1..102: note = hyper
  source 1..102: mol_type = genomic DNA
cgttgccctccccgagggcttcggcctcccggcttgtgttgccagcgccggtggccagaggccaccatgggctggagttgcccgagggccccgcgtcgggac

SEQ ID NO: 34484 - DNA, 152 bp, Homo sapiens
  misc_feature 1..152: note = chr12:63544728-63544880
  misc_feature 1..152: note = hyper
  source 1..152: mol_type = genomic DNA
cgctcgcagcttgccgggctctgcgatccctccagtgggcgtctcccggagcagcgtcccgcctgcccactgagcagctctcagcagggtgagctggcccctctccctgctctgccttttttcaacttcggcgaggtcgggaaggtgagctc

SEQ ID NO: 34485 - DNA, 50 bp, Homo sapiens
  misc_feature 1..50: note = chr12:63545313-63545363
  misc_feature 1..50: note = hyper
  source 1..50: mol_type = genomic DNA
cctgaacctggctctcgacctcacctcctccagtccgggtttcttccttc

SEQ ID NO: 34486 - DNA, 720 bp, Homo sapiens
  misc_feature 1..720: note = chr12:64061778-64062498
  misc_feature 1..720: note = hyper
  source 1..720: mol_type = genomic DNA
aagactcaagaaaagcgccatgcggctccctcctagggctctcctgccctctcctcaccgatgccgagagtggttctgctggagaaccgccgcgcctgcagttcctgcaccttttcccggagctgcgccagggaattacggacgaactggaaggggccgagaagaaaggtcttggccaccacctctagctccaagccttttcgctctttcagactttggatcctccccggggaggacctccaggagccccttggcagtttcccgccgcctagggccgacttttccatctcctcctctacctccggctcccgggcgagggaggccccgcgccgccccttagactggctgcggccggaagattgcagccgctttgagcttactccttgttttctcataatcaaggagtatggtggagctgggtcaatttcaggcacagcccagccgagtcaggcgaggtccagagagacctgactcgcctggcagcctcaacggacttgtccccgcagccgttgcggacctcccggtcgtcatggcgactgtgaaatgtggggtggggcgcatgcgttggaagccattcgcgcgggcagtccctgagtgtcccctcacgtgctccccagcgcgagcagcacccccgcctctgcgcttcccagagcgtgcagcttccggtgagggcagccccacgcacagccccccacaccctccccagcgcctgcagcctcc

SEQ ID NO: 34487 - DNA, 27 bp, Homo sapiens
  misc_feature 1..27: note = chr12:64062499-64062526
  misc_feature 1..27: note = hyper
  source 1..27: mol_type = genomic DNA
gtgcgcgcaggccccaagcccacatgc

SEQ ID NO: 34488 - DNA, 624 bp, Homo sapiens; identical to SEQ ID NO: 11301
  misc_feature 1..624: note = chr12:64062527-64063151
  misc_feature 1..624: note = hyper
  source 1..624: mol_type = genomic DNA

SEQ ID NO: 34489 - DNA, 570 bp, Homo sapiens
  misc_feature 1..570: note = chr12:64784107-64784677
  misc_feature 1..570: note = hyper
  source 1..570: mol_type = genomic DNA
cgacgtcccgcagagccactacccgccggatggacttgggcgggttctcggttaggtagacgagccggtcgcttagcaccacatacttgaggatgtggttctcagagttggacaccacgatgcatggctcgtaggcgcggaccgcgtcgtagacctcgggcggcagatgccgccgcaggaacacatccaggcggctgttcctgcgcgcggggaagccggacggcaaggggctggccatgcccggcgcccgcagcgtggcggagtgctgggactcgaggccctcagctcgccctctccccgcccccgcgctggaacccgcgcgccacaaagccgccggccacgcgtcgcctcctctccaggcgcggggacccgggccgcaactgcaggaatcgacgctaggtcggcttccctggagcgccctccccagccctgtccagcctctcgatctttgtcctaacctcagacggcgatgggcggggcaagacgctggtccttcaggcccgagttgatgggcacctcgggctcatcaccgtgaagtcccctgcggccgaagggcggtggatttttagg

SEQ ID NO: 34490 - DNA, 232 bp, Homo sapiens; identical to SEQ ID NO: 1051
  misc_feature 1..232: note = chr12:65218319-65218551
  misc_feature 1..232: note = hyper
  source 1..232: mol_type = genomic DNA

SEQ ID NO: 34491 - DNA, 317 bp, Homo sapiens
  misc_feature 1..317: note = chr12:65218900-65219217
  misc_feature 1..317: note = hyper
  source 1..317: mol_type = genomic DNA
ggggagctctggggaaagtccgcgtgccacctggtgcggggcaccgcgttggcacctgcagggagcgattggtctggaagggtagagggcagacgggggcctgggtggggcagcggccaccccaggcgcggagaacccgctgcttccaccctctccccgcggacccccaccctgcggcctgtgtgctcggctttctccgcgtggcggggaagtgcgggtggctgcccgggccctcagaggccgcaccacctattgtgttccaggctcgcaggaagccagaccttgcgagaggtgtgtgggggcggagagtggcacag

SEQ ID NO: 34492 - DNA, 71 bp, Homo sapiens
  misc_feature 1..71: note = chr12:65219457-65219528
  misc_feature 1..71: note = hyper
  source 1..71: mol_type = genomic DNA
cagactgcataactccgtgtcggctccatcacccggcatccctccccgggattttaagagcctggccctag

SEQ ID NO: 34493 - DNA, 288 bp, Homo sapiens
  misc_feature 1..288: note = chr12:65219605-65219893
  misc_feature 1..288: note = hyper
  source 1..288: mol_type = genomic DNA
cgctcacctgttccctggagtggcaccggctgcgttccaggcgggttcacggtccccggcccccgccccccagcgccagcgccttggggacctgctgtagagccgcaggagaatcgagctgcagagtcccaaagggtgggatgcggcactgcctttcccaacctcgtggtttctttgttgttctcccctaggaagtgtctagttgcagaggctgtagtatttattcaccatcttcctttacctcttttttttttcttttaaatctccttcccacgttaaaagtaagtg

SEQ ID NO: 34494 - DNA, 327 bp, Homo sapiens; identical to SEQ ID NO: 3911
  misc_feature 1..327: note = chr12:65220112-65220439
  misc_feature 1..327: note = hyper
  source 1..327: mol_type = genomic DNA

SEQ ID NO: 34495 - DNA, 715 bp, Homo sapiens
  misc_feature 1..715: note = chr12:65514835-65515550
  misc_feature 1..715: note = hyper
  source 1..715: mol_type = genomic DNA
ttgcctggtgagcatcgatccataggtacaggctctcctcctgcggcggcccggcctccgcccgcagtgccagcaggcacaggaggatgctccagagccagagcgcggcggcagggaaggcgctcctccgggccatgctgctcaggacctcctcgctgccgggaaaactcctcgtgccgcacctacgcaacctggcgccgtcagatactctgctgcgctgcagctccctcagccagggctgttcccgtttagacggctgggcgcgtcgcctcccggcctgggtgccaaggagcctgcgagagcaggaggagggggcaggcaggacgcgggaggaggagggggggaccagcgggcgcgagtcgcgcaagaagatggggcgcgggcgggagtgggggcggcagagacgtaagactggcaaagctggcgaggccagcagtcagcggggcaaatagagcgagaacagaagagcgggaagggctggcgcgagcgaggtgcgagcgaggagtggggcccgcgaggcctgggcggccgccacttgggggcgctgtggggcccccccgggggcggggccgcgagggacccccgaggctgcattcacagtgcggtgcgcccagtggagcgcccgcgaagtgggcgtgtagggctggcggacccggagaagggcactcagagacccctgggacatcactcgccacctcctcgggccaagggaggc

SEQ ID NO: 34496 - DNA, 73 bp, Homo sapiens
  misc_feature 1..73: note = chr12:65673227-65673300
  misc_feature 1..73: note = hyper
  source 1..73: mol_type = genomic DNA
tgggccagactccagcgggcccgcctggcatttcacaggccaaaatcgaacagaaccccgagtttgccaggta

SEQ ID NO: 34497 - DNA, 151 bp, Homo sapiens; identical to SEQ ID NO: 11310
  misc_feature 1..151: note = chr12:66122419-66122570
  misc_feature 1..151: note = hyper
  source 1..151: mol_type = genomic DNA

SEQ ID NO: 34498 - DNA, 208 bp, Homo sapiens
  misc_feature 1..208: note = chr12:66122788-66122996
  misc_feature 1..208: note = hyper
  source 1..208: mol_type = genomic DNA
cgagaggtgtctgggcgcaatactctccggcccgaagcaaggggacgtttgcgaggagggagaaatttaaacccccttcgctccgcgccacctgggagcactttggcgccgcagactcaggagccgacgccatctccaggacggcctcggtggcctcggcaggaggcaccttcggggagcggtcccgcactcctccttcctcagtccc

SEQ ID NO: 34499 - DNA, 139 bp, Homo sapiens; identical to SEQ ID NO: 3913
  misc_feature 1..139: note = chr12:66123380-66123519
  misc_feature 1..139: note = hyper
  source 1..139: mol_type = genomic DNA

SEQ ID NO: 34500 - DNA, 196 bp, Homo sapiens
  misc_feature 1..196: note = chr12:66135151-66135347
  misc_feature 1..196: note = hyper
  source 1..196: mol_type = genomic DNA
tctctggcccagctgcggagggggaaaggtgatcgatcttgctgggggccaccgctagcccaccgcttcctgccgcgacctgccgcggcggccggagcccgggagcttcccattggctcacgggccgacgccatgcagtctgggggggcgtggccgggcggcggggcgtggccaggcggtgcggggaactgcggag

SEQ ID NO: 34501 - DNA, 195 bp, Homo sapiens
  misc_feature 1..195: note = chr12:66135407-66135602
  misc_feature 1..195: note = hyper
  source 1..195: mol_type = genomic DNA
aggggagggcaggggcggggcggggccgggcggcgggggcgcacaccccaatctccctagcgctgtgggggtggctgcagctccccgcgcgctccctcctttgggggggtttctgggctcgtgacttttttttaaataaagaatgagcggatgcccgtgacaagttaatagctctcgccgcgctctaaagttaag

SEQ ID NO: 34502 - DNA, 330 bp, Homo sapiens
  misc_feature 1..330: note = chr12:66135863-66136193
  misc_feature 1..330: note = hyper
  source 1..330: mol_type = genomic DNA
cgcagggcgcacgcacgcatcccggccccctcacactcacactgcgtcttctgtcacaccccctgtcgcacacacactgttctctgactcccaccatctcctgtctcacacccactccagtttcgtgttgagcggccgccagttctccctcggtcgcgccggcgcacgctcgtccccttctgccccggagcccgcccgcgccgcacggtggccccttgcgctggcctgatcgtgggaaccaggcggggccccagcgtccctgcccctgcccggtcatccatctccctcccggtcggccagccgagacttcaaaggcgcctcctccggccg

SEQ ID NO: 34503 - DNA, 72 bp, Homo sapiens; identical to SEQ ID NO: 11316
  misc_feature 1..72: note = chr12:66217530-66217602
  misc_feature 1..72: note = hyper
  source 1..72: mol_type = genomic DNA

SEQ ID NO: 34504 - DNA, 410 bp, Homo sapiens
  misc_feature 1..410: note = chr12:66218917-66219327
  misc_feature 1..410: note = hyper
  source 1..410: mol_type = genomic DNA
cgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagtcagtacgagggcgcggtgggggcaccagcccaccccgtccccactgccggggcccagacacgcgcggggcggccggagtgcgggagcccagtcgccgcggccgtcgcacactgcccgccggccggccggggggagcggcgcagaccccacgagtgcgccgcgcg

SEQ ID NO: 34505 - DNA, 30 bp, Homo sapiens
  misc_feature 1..30: note = chr12:66219897-66219927
  misc_feature 1..30: note = hyper
  source 1..30: mol_type = genomic DNA
cagggtagccagggtcgcttccttgtcagg

SEQ ID NO: 34506 - DNA, 232 bp, Homo sapiens
  misc_feature 1..232: note = chr12:66582816-66583048
  misc_feature 1..232: note = hyper
  source 1..232: mol_type = genomic DNA
agaggtgtgaaggggcgcaaagccagcgaagggagaacccgggtcgggtaacccccaggcctggccaggcggacgcaggggcatctcgggcgaggcgcgccttgcgtcacgtgggcaccgcccctgcagtgaccggagaacggcgtgttcctagggctctgctgccgtcgtggaagcaggatttccgcggttgtgtaacggcctgtcgcaggcgtgcagggacctggactcc

SEQ ID NO: 34507 - DNA, 280 bp, Homo sapiens
  misc_feature 1..280: note = chr12:66583049-66583329
  misc_feature 1..280: note = hyper
  source 1..280: mol_type = genomic DNA
cctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctgggtgagtcggcggggaccggccgggggcggcgggggagcccagcgcgccgcggggcccgctcggcgtcgccctgcatggctggggtccctcgcggggctggcgcggcctccgggaagt

SEQ ID NO: 34508 - DNA, 144 bp, Homo sapiens
  misc_feature 1..144: note = chr12:66629273-66629417
  misc_feature 1..144: note = hyper
  source 1..144: mol_type = genomic DNA
gcgcggggcgagactcgagcagctcgggcagccgccgctctgcgtgccatggacgggagttcgcgcgcggagctggcggcgtcgccgactctcccggcggcagcggaggagcagcgccgccgcgtcctccgatattattaagtt

SEQ ID NO: 34509 - DNA, 30 bp, Homo sapiens; identical to SEQ ID NO: 11320
  misc_feature 1..30: note = chr12:68759101-68759131
  misc_feature 1..30: note = hyper
  source 1..30: mol_type = genomic DNA

SEQ ID NO: 34510 - DNA, 61 bp, Homo sapiens; identical to SEQ ID NO: 11321
  misc_feature 1..61: note = chr12:69326653-69326714
  misc_feature 1..61: note = hyper
  source 1..61: mol_type = genomic DNA

SEQ ID NO: 34511 - DNA, 507 bp, Homo sapiens
  misc_feature 1..507: note = chr12:69327014-69327521
  misc_feature 1..507: note = hyper
  source 1..507: mol_type = genomic DNA
ccccggacgtccctccggcccactccggagccgcgcgggtgcctcccgggcggggcctcagccgccttcgcacctaggagagacggcgcccgcgcggtgcgccctttcgtggcgcggctgctggtgcccgcggccgggcggctgagctgggcggagggctgcgggcatggagtcgccgctcgcggacagtctttgctggagccccaggtcagaagtgtgtcctcgcctcggccacggctgtagcctgggcagccacagggcgctccaccgagggacactctctgtcgcagactgcagccgcttgggagacgtttagggctcggcgggtttcctgcggttggcggtgccggggcccacctggagccgggacgcatgcggagtcctgagtgccctgagccccgcgcgggctcctgcgggacgggcggcgtcggccccggcagggcgagccaagctcccagcagtgccaagctgcccagcgaggctaagcaatcacggggcttcgagaaa

SEQ ID NO: 34512 - DNA, 55 bp, Homo sapiens
  misc_feature 1..55: note = chr12:70761007-70761062
  misc_feature 1..55: note = hyper
  source 1..55: mol_type = genomic DNA
ggagccccagggctccggtcttttcaggtgggtttacgcgcggcgaccagtggtg

SEQ ID NO: 34513 - DNA, 411 bp, Homo sapiens
  misc_feature 1..411: note = chr12:71003634-71004045
  misc_feature 1..411: note = hyper
  source 1..411: mol_type = genomic DNA
ggacgtgggacggcccgagggccggggcagggggtcacctgttgcgcgcgctcagcgcgccccgtgggcgcagcgcgcttccctcggggctggcgacgcgcaggggccactgcggccaccgctgctgctgctgctcctgccgccccgggcgggctgcggacgcgagaggcggcggggacaggcagcgcgccgcccttcccacgctgccattctgacccgcgctgcctcgccccagccccgtccgctgacttccgcaatcaaaaggcaatttcctcgtctcccggcaaaggaacaatgcgccggcgagggagggagccccgaggagccaacgcctgagcctgccaaggggcccgatgtgggccaagctgcccccgctgccccgcgccgataccttcccggccaggggtccgg

SEQ ID NO: 34514 - DNA, 176 bp, Homo sapiens; identical to SEQ ID NO: 11323
  misc_feature 1..176: note = chr12:71314436-71314612
  misc_feature 1..176: note = hyper
  source 1..176: mol_type = genomic DNA

SEQ ID NO: 34515 - DNA, 63 bp, Homo sapiens; identical to SEQ ID NO: 11324
  misc_feature 1..63: note = chr12:71314613-71314676
  misc_feature 1..63: note = hyper
  source 1..63: mol_type = genomic DNA

SEQ ID NO: 34516 - DNA, 30 bp, Homo sapiens
  misc_feature 1..30: note = chr12:71832897-71832927
  misc_feature 1..30: note = hyper
  source 1..30: mol_type = genomic DNA
acaaatgagtcacttcgacttcctcacccc

SEQ ID NO: 34517 - DNA, 554 bp, Homo sapiens
  misc_feature 1..554: note = chr12:71833313-71833867
  misc_feature 1..554: note = hyper
  source 1..554: mol_type = genomic DNA
gggggtcccctattccggcgcgcggcgttgagcactgaatcttccaggcggaggctcagtgggagcgccgagaactcgccagtaccgcgcgctgcctgctgcctgctgcctcccagcccaggacttgggaaaggagggaggggacaagtggagggaaagtggggccgggcggggggtgcctgggaagccaggctgcgctgacgtcactgggcgcgcaattcgggctggagcgctttaaaaaacgagcgtgcaagcagagatgctgctccacaccgctcaggccgcgagcagcagcaaggcgcaccgccactgtcgccgctgcagccagggctgctccgaaggccggcgtggcggcaaccggcacctctgtccccgccgcgcttctcctcgccgcccacgccgtggggtcaggaacgcggcgtctggcgctgcagacgcccgctgagttgcagaagcccacggagcggcgcccggcgcgccacggcccgtagcagtccggtgctgctctccgcccgcgtccggctcgtggccccctacttcgggcaccatggaca

SEQ ID NO: 34518 - DNA, 30 bp, Homo sapiens
  misc_feature 1..30: note = chr12:71834228-71834258
  misc_feature 1..30: note = hyper
  source 1..30: mol_type = genomic DNA
gaaatgcacgtgtctcggggagtagcgtgc

SEQ ID NO: 34519 - DNA, 55 bp, Homo sapiens
  misc_feature 1..55: note = chr12:72332641-72332696
  misc_feature 1..55: note = hyper
  source 1..55: mol_type = genomic DNA
cagggttctggacagcgccccaagcaggcagctgatcgcacgccccttcctctca

SEQ ID NO: 34520 - DNA, 160 bp, Homo sapiens
  misc_feature 1..160: note = chr12:72665266-72665426
  misc_feature 1..160: note = hyper
  source 1..160: mol_type = genomic DNA
tgtacttcttgcaggcggctcagcaaccccctctgtggctgtgggtgtctggtgtgacagagcggagaaaagctctctaatctcccagtgcctgcctctgccgctcagtcgctcccctccctcccgcctttcctgcctcctcgcgcgctccctctccttt

SEQ ID NO: 34521 - DNA, 62 bp, Homo sapiens
  misc_feature 1..62: note = chr12:72665709-72665771
  misc_feature 1..62: note = hyper
  source 1..62: mol_type = genomic DNA
gtttgccgccaccgccgcttaaagtgcccagggtggagaaggcttttccaggacggatctcc

SEQ ID NO: 34522 - DNA, 26 bp, Homo sapiens
  misc_feature 1..26: note = chr12:72665772-72665798
  misc_feature 1..26: note = hyper
  source 1..26: mol_type = genomic DNA
tcgtagcttcgcggccctgggacttc

SEQ ID NO: 34523 - DNA, 52 bp, Homo sapiens
  misc_feature 1..52: note = chr12:72666342-72666394
  misc_feature 1..52: note = hyper
  source 1..52: mol_type = genomic DNA
gatgcctgctctggctgtggcccgggtggcccgcccgcggggggtgccagag

SEQ ID NO: 34524 - DNA, 134 bp, Homo sapiens
  misc_feature 1..134: note = chr12:72666674-72666808
  misc_feature 1..134: note = hyper
  source 1..134: mol_type = genomic DNA
gcttgtgctggccttcgctgtgtccctcgtggcattgctcgcggtcacaatgctcgctgtgctgctcagcctgcgcttcgacgagtgcggggcgagtgccacgccaggcgccgacggtggcccctcaggctttc

SEQ ID NO: 34525 - DNA, 389 bp, Homo sapiens; identical to SEQ ID NO: 3915
  misc_feature 1..389: note = chr12:72666997-72667386
  misc_feature 1..389: note = hyper
  source 1..389: mol_type = genomic DNA

SEQ ID NO: 34526 - DNA, 38 bp, Homo sapiens; identical to SEQ ID NO: 3916
  misc_feature 1..38: note = chr12:72667387-72667425
  misc_feature 1..38: note = hyper
  source 1..38: mol_type = genomic DNA

SEQ ID NO: 34527 - DNA, 41 bp, Homo sapiens
  misc_feature 1..41: note = chr12:75601190-75601231
  misc_feature 1..41: note = hyper
  source 1..41: mol_type = genomic DNA
gcccagcctcttggccgccaggtcctcgtcgtcgccggggt

SEQ ID NO: 34528 - DNA, 122 bp, Homo sapiens
  misc_feature 1..122: note = chr12:75601378-75601500
  misc_feature 1..122: note = hyper
  source 1..122: mol_type = genomic DNA
cgtctgcggggcagtgcagcttgccggtgcggtagtaattgagcacataggcgaagacgcccgggtgccggtcgaagaagaactcgcggccgccaccgggatggtcgctggccctgccgccg

SEQ ID NO: 34529 - DNA, 345 bp, Homo sapiens
  misc_feature 1..345: note = chr12:75601695-75602040
  misc_feature 1..345: note = hyper
  source 1..345: mol_type = genomic DNA
cggtaggtttcgtgccgggtgcccccgacattgaggatcaccctctcgttgttctcgatcttgcccatctctgtgactcagacatgactagggggaggcaaacacagcgccgagttaaagatcttagccgtcaaagacacaccatgacccccaccaccaacccagagcgagtccagggatgcagagttggcagacaggcacggggcaaagaccctccccgggaggggatcagcgtccagcgctgtccccgcctcttgcatcaaacctttcccaggtttccagagaactacagagatagcagtcctagtctttcttgacctttcatgacaccgttttccctgcctc

SEQ ID NO: 34530 - DNA, 619 bp, Homo sapiens
  misc_feature 1..619: note = chr12:75602875-75603494
  misc_feature 1..619: note = hyper
  source 1..619: mol_type = genomic DNA
tctacattcctattgcggaaaggcggagcggggggatgctggcctgcagggtcaacatgccctttccaggaaatcgcccctttcaccacccccgcccccatttccagataccttaacgagaccgagagaaaagtggttctgctttggtttccgagtggacgaggttctctgggcagcgggactgagtcttggcgcccaggtgagccgcccttctccgacgagaaactacttgttggcgttttccggattcaggtggttgagccgcttccctgggcgctggggtgggggagaaagcccccgccggccgccggccgcgctccccgccttcattctgtgatctgcggatttgccagtcgccaacctccgcgcccagagtcaccatcgcgcagggttgggcaaaccatggagctcggggcgggtccagccggcactgcccgacccctccgggagcgggcagatcggctggccgtgaatggagtggagactggccgcaggtcaggagagctcaccacttgaaggtgaagtcgccctgctcggattccatctgcagattttgtttctcccccaaatcagccactgctggagctgtcccttcagcaccactcgccatcaacctccc

SEQ ID NO: 34531 - DNA, 393 bp, Homo sapiens
  misc_feature 1..393: note = chr12:75728110-75728503
  misc_feature 1..393: note = hyper
  source 1..393: mol_type = genomic DNA
atagtgctttgcactcgactggcccattgtcagcatcccgcacttgttctttacctaacttgtgtggcttgcatattgcaatctgtattacaatccagacgcgctctgcagattacagattggatccacagaaagcagtttggatggttgaaattccctccaccagagggcgactcagagctttcccctgtagctcagagctttgtggaaggggaaccctgctgcctgttcttccccacagcgacactgacaagttgatccagccgcgctgggctcgagcctgtgcggcaggatggagccaagggagagcgtggtgcgggggcgtggggaaatcgggttgccccagccgttactggtccgcgcagtcagggcatcctccgcatcctccacatc

SEQ ID NO: 34532 - DNA, 287 bp, Homo sapiens
  misc_feature 1..287: note = chr12:77719293-77719580
  misc_feature 1..287: note = hyper
  source 1..287: mol_type = genomic DNA
gatgggggtggccagcgcggtcctgggagtggcgggttcggatgggctggctgcggtgggccactttgggcatctcggcgtggcctgcgccggggtcacggggagggctgtcagcgccagggcggcggaacccgaggtctccagacgagtgagggagggatgcaggcttgggggtgatggagcgcttggctggtggctggtgagcgtccatacatcatagctctccttcccactcccccgcccctcttcgggattctctctttctctttccccgtcctcatttcttt

SEQ ID NO: 34533 - DNA, 212 bp, Homo sapiens
  misc_feature 1..212: note = chr12:79257259-79257471
  misc_feature 1..212: note = hyper
  source 1..212: mol_type = genomic DNA
ggaaatagttctctccgttttgaaatcctttcacctgtggagcagataatggacgggcccctctcccagctgggctccgctcccgcccctagcctggcgcgcggtcccttcccccacccgctgagccttcctgttcggtatttcggtattaccaagctataaattgcctgagagcttagagacaatcaggtcaccaccgccctcacaagaga

SEQ ID NO: 34534 - DNA, 375 bp, Homo sapiens
  misc_feature 1..375: note = chr12:79257722-79258097
  misc_feature 1..375: note = hyper
  source 1..375: mol_type = genomic DNA
gtggagtcgcgctcccggccccacctatgggacggagctgcttctcccgcatctcggctccaccgcacccttcgcgggaagtccccaggcttccagcaaagctcagcttatcccgcccccgcttccaacccggaaccccagaagaacagcatgatgagcctccggcagccaggtgggccacctccccgcggctcagtttgaggacacttgtgcggaaccctttcacatccccaccctacccagctttcacaactccgccgggttaaatggccaaagacaaacttctacctctcctgtccccggtcccagcttttcaaaaacccacagctggcgaacccacacacatcgaaactcctaggtcgctgttgcagtctg

SEQ ID NO: 34535 - DNA, 141 bp, Homo sapiens
  misc_feature 1..141: note = chr12:79258297-79258438
  misc_feature 1..141: note = hyper
  source 1..141: mol_type = genomic DNA
aacccgcctccaccccgcttcccaggtccctgtccgctgtggggatggagagacactaacagaactgggatgggcgatgttggctgaacggatccacctattattagtgcgcggggattggctccttggcgcagcgtaccc

SEQ ID NO: 34536 - DNA, 437 bp, Homo sapiens
  misc_feature 1..437: note = chr12:79258439-79258876
  misc_feature 1..437: note = hyper
  source 1..437: mol_type = genomic DNA
aggtggagccaatcaggatgctggggctcggagatgatgggcggccgcctcctcactggagggattcctggagaagctgcagtgtggggatgctctagaccgagtactgcccccagtgtctttccacctcctcctgcagcagcggcagcggcagcagcagttagcagcggcaacttgaggctgcaccccgggcaagtccccagggtggtgctcagccgagaggggggcttggcgccccgaaggggtgtgtgtagggtgggggcgaccacgtgggaccagctggtggccctggaaaacctcccacacacccacacccacacaccccttttgtgttgcaggctgcccctccaagagcggaggcagcgagagtacgcgtgtgcctcgcgccggtccacgcggggagagcactggggaccgagacccggcaccacctcccg

SEQ ID NO: 34537 - DNA, 261 bp, Homo sapiens
  misc_feature 1..261: note = chr12:81102185-81102446
  misc_feature 1..261: note = hyper
  source 1..261: mol_type = genomic DNA
aataggcaggaaatgcgtacccggcccgaggaagcaggaaagccgccccccaccccaccccaaccccggaaccgatgtttctttcctaatctgccgctgccttggttttccctccagcttgagggtgcggatttcctgcgcacctgcagctcccagtggccaagtgtttccgatcattccagggggctcgtgataacggctaaggaaggtaaagtaaaagggctctgggccgcaccagagaaaatccgggaggtggatagg

SEQ ID NO: 34538 - DNA, 30 bp, Homo sapiens
  misc_feature 1..30: note = chr12:81330218-81330248
  misc_feature 1..30: note = hyper
  source 1..30: mol_type = genomic DNA
ttttgccttgcccatcgttcagtttaatcc

SEQ ID NO: 34539 - DNA, 573 bp, Homo sapiens
  misc_feature 1..573: note = chr12:81330746-81331319
  misc_feature 1..573: note = hyper
  source 1..573: mol_type = genomic DNA
gaccctcgccgctttcgatctcgaagccgcggagagccgatctcggctgctggggctcggctccccgcgctctgccttgccctttcggcagagggcagctccctgcctgctgcagccccgccactgtgcgcccggcagcccaggggtgcgcccagcccgccccccgagtggccgccgggactccagcagttggaccgaccctcgccctccggcgcctggacaaacttccttcctcccgggcccctgcgccaagcaagctgacaggcggctccctcgccggtctcctctgggctctggccgggcgagcttgctctctgcccctctccaaccccgagcccctggcgcctatagccgtccccgcgcagcggctccaacaaagccagaggaccggagacgacccggcgaggggctgggagtggcagcggggaccccagagccagaaggaggcgtcccctcggcggggcgagtacagtgggaaggggcagcgggaacgtagcggggagagaaaggggaagaaagtgttctgttctcggcgcgaacgccttcctggctcgtcctcgttccccttctcct

SEQ ID NO: 34540 - DNA, 48 bp, Homo sapiens; identical to SEQ ID NO: 11341
  misc_feature 1..48: note = chr12:81331829-81331877
  misc_feature 1..48: note = hyper
  source 1..48: mol_type = genomic DNA

SEQ ID NO: 34541 - DNA, 160 bp, Homo sapiens
  misc_feature 1..160: note = chr12:81471455-81471615
  misc_feature 1..160: note = hyper
  source 1..160: mol_type = genomic DNA
tgccacctccaccaacgaccttccaaagattaaaccagccgtgtacaaactgctggattgaaaattgagagatgggccgttggcctcctcctaggagtacttgtgtgttgaaatcggaaggacgttctggagtttgagcgcgatttttcccggaaggctg

SEQ ID NO: 34542 - DNA, 18 bp, Homo sapiens
  misc_feature 1..18: note = chr12:81471753-81471771
  misc_feature 1..18: note = hyper
  source 1..18: mol_type = genomic DNA
cggcgactctagtgtggc

SEQ ID NO: 34543 - DNA, 109 bp, Homo sapiens
  misc_feature 1..109: note = chr12:81472010-81472119
  misc_feature 1..109: note = hyper
  source 1..109: mol_type = genomic DNA
gtggtcccgggcccgcggggcggtctcgggggccggggatgcagggcactgtcctccggcagtggcagcgagtacaagacccacttcgcagcctcggtgaccgaccccg

SEQ ID NO: 34544 - DNA, 44 bp, Homo sapiens
  misc_feature 1..44: note = chr12:82153211-82153255
  misc_feature 1..44: note = hyper
  source 1..44: mol_type = genomic DNA
tgcagtggtttccaccggcccttaaataaattctgaagtaatca

SEQ ID NO: 34545 - DNA, 195 bp, Homo sapiens
  misc_feature 1..195: note = chr12:82153283-82153478
  misc_feature 1..195: note = hyper
  source 1..195: mol_type = genomic DNA
cgcccgcggatacactcgtctcccccagagccgctcccgggctgccgaggctcgctctgctcccagtgccccctgcgaaggcgagggccagggatgggcaaagtgggaagggggcacacgcttccccgcctgggcttctttcacacaatgggctctacagccttcgcttgtgtcagcctgcgctggtggggatgg

SEQ ID NO: 34546 - DNA, 191 bp, Homo sapiens; identical to SEQ ID NO: 11344
  misc_feature 1..191: note = chr12:85305054-85305245
  misc_feature 1..191: note = hyper
  source 1..191: mol_type = genomic DNA

SEQ ID NO: 34547 - DNA, 156 bp, Homo sapiens
  misc_feature 1..156: note = chr12:85305657-85305813
  misc_feature 1..156: note = hyper
  source 1..156: mol_type = genomic DNA
cagccacgtgcctttcgtacggcgaaaggccccctttcgggccatttatcacaggatacctcaagcaaaggggaactgtggtcacgtgaaaacactctgtcctcggtagtcgccttctgcctttgctaaagcgaacggaagcgaatgaggaataaa

SEQ ID NO: 34548 - DNA, 99 bp, Homo sapiens
  misc_feature 1..99: note = chr12:85306458-85306557
  misc_feature 1..99: note = hyper
  source 1..99: mol_type = genomic DNA
ggttttgggggtcgccgccctgcaggctggcaaggagagactcgtgagcgcctgtgtgtctgccagggaaacagcacgggatacaggcgcgcgggtgcg

SEQ ID NO: 34549 - skipped

SEQ ID NO: 34550 - DNA, 158 bp, Homo sapiens
  misc_feature 1..158: note = chr12:85306798-85306956
  misc_feature 1..158: note = hyper
  source 1..158: mol_type = genomic DNA
tcttcccagagcccggggctgtgcccgcccgatgcaggatgcaactgaggaagcccgctccaaagcaaaacaaaacaaattcctccagccatgccgtctttctccaacccactcaagcgaaagaatggacaccagttaccagccgctgacttttgtct

SEQ ID NO: 34551 - DNA, 505 bp, Homo sapiens
  misc_feature 1..505: note = chr12:85667226-85667731
  misc_feature 1..505: note = hyper
  source 1..505: mol_type = genomic DNA
agtttccatgagaagcgaaacttcattctctttgctcagaatagagactcctccacctatgcgcgtttaaccacagagttgttcttgattgtaagggacttcgcccacttggttgaagtggagagccggtcctcattccagacgtcccgcacggcagtcgctcatggctccctccaggccgggagccaggaaggtggtccttcaccgaggtgcgcaccaagcggcggtccacccaggcaatggggtgcaccaatttgcctccaaaaatttgctgcgcacacaacctgttcacagttcctgatcagaaagggctaacgagatgtctgtctacagctgtctctgggcgagggcgcaggctttgggaagtggttcagcgcgatcggggacaccgcttgcagcccttggtcctgcacccctaggaggggtgtcccacaagctcggcttcccttttgcgagccacagagagctttttgttccgaaactctcattacgacagatagtattt

SEQ ID NO: 34552 - DNA, 848 bp, Homo sapiens
  misc_feature 1..848: note = chr12:85673067-85673915
  misc_feature 1..848: note = hyper
  source 1..848: mol_type = genomic DNA
aggcactgatcctaacgggttttcttaaaataatttgggtctaatgataaaatcgtggaccaaagggaagggtggcgaagagggtgtagggaattggttggcattagtataatggcttcattgcctcttgctcggcttctctctcccacccatcgccaccgcgtccacactccgccgcattccagagaaaaagaaaaggccacggcctcgtaaagctcccagctggcccggaccccgagctcctcccggttagaagccgaagcggcccctctactacggcggctgcgattaacagttgccaatgcatctggttccttgggcttcggattaatgtgaatcttccacgtaaacgatttacggatgaaataaaagccttttagagcaatatttcctttcaagttcttaagacgcctctaaatctttctggtagtgagtggccggcatgggggcggggtggggacgggtggctcaggaaggcgcaggcagtagggagtggaggtttaactgctttgcgatctcaccaagatcttccgaaatgccagtccactgtcacggcggcaatgaatctgggtgtcaggggctcgtctctcctggcatttgtctgaaatggagctgtctgtctgtctatcctaggcctggacgccctctgcccgggtaagtggggaaaatgggggtggggtaggggcggagggggacctggggtggagttagtcgcccgcctattttcatattcattagaactgggaggctgcccgaggaggccagctgagtttcaagatataaaagcaacttcgggtgctccttttccagccgggacgtattaaagggaccggagcggggcagttccc

SEQ ID NO: 34553 - DNA, 968 bp, Homo sapiens
  misc_feature 1..968: note = chr12:85673916-85674884
  misc_feature 1..968: note = hyper
  source 1..968: mol_type = genomic DNA
acgccgcagcgctcgctttcccttccctcctctctggccctccctcctcccacccactggctccctcccccagcgctctccagtttctgtgccccaggagctacgcgacagtcttccaggattatggagtttctgagcgagaagtttgccctcaagagccctccgagtaaaaacagtgacttttacatgggcgcaggaggtcctctggagcacgttatggagacgctggacaatgagtccttttacagcaaagcgtctgcaggcaaatgcgtgcaggccttcggacccctgccccgcgccgagcatcacgtgcgcttggagaggacctcgccctgtcaggacagcagcggtgagtcgctagcgccccagccggagccgccgcagcccttccgcaatcgaaaatgcaggatcggtctgatcaggcagggagggagaaaggagaaaagtgggagcgagggacctggaaggtggaggaaggtagtggaaggtgctcgctttatgaagcggtgttactgctgctgcagcctttgggggcggagggcggagggagggagagatccagcaccgggttgcctctgagcgattctcctttcgctgtagggtctggtcgcctacggatccctgagtccttctgtaatattggttcctggagtaaactgatagggcgctaaatagagcgtaattgagtcaagacagaacgcttcctctgcgagcccgccttgcagtccgggcggtaggaactgaaatcgatcacagctcgttagagtacgtcactgtcgtcacgagtagggaaaaaaaaaccggaaaacaaaaacaaaaaacaaaaaaccctttgagctcctttaggtaaagataaatctttttaattttccaagacgtggcgatatattttcaaagtttgaggatccctagatttctagcgtgtgtgaatttgtaatttctgcttttttttgcgtttgcaatacaac

SEQ ID NO: 34554 - DNA, 16 bp, Homo sapiens
  misc_feature 1..16: note = chr12:93966301-93966317
  misc_feature 1..16: note = hyper
  source 1..16: mol_type = genomic DNA
agagctgggccagggc

SEQ ID NO: 34555 - DNA, 898 bp, Homo sapiens
  misc_feature 1..898: note = chr12:93966318-93967216
  misc_feature 1..898: note = hyper
  source 1..898: mol_type = genomic DNA
ctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccggg

SEQ ID NO: 34556 - DNA, 426 bp, Homo sapiens
  misc_feature 1..426: note = chr12:93985172-93985598
  misc_feature 1..426: note = hyper
  source 1..426: mol_type = genomic DNA
ggagcgaggagaaagcgtgtgtgcgttcgtgtgtggctgtctgtctgtctgtctgcggcaagaggaatctcagagtttcggttatttctccttgaagaattttcaaacggagttcctgcaggggctggctctagcgtctacgatgtgcacacactgtctctcaagagggaagtgatcctggcgccacggggtgatgcagcagaagttctttttgtctgtggccagggtagagtgcggagccccacggagctgtggcgtggcggctcctcccagacgcgtccggggcgccgctcgggtctcccaggaccttatgtaacccagcgtcggcagcaaggagccggtcacaggctgaccaacgtcaaggcgtttcactttggaagcgcaccagatgagtgtggtattgagagcagacggctgggtgcaatg

SEQ ID NO: 34557 - DNA, 829 bp, Homo sapiens
  misc_feature 1..829: note = chr12:94543118-94543947
  misc_feature 1..829: note = hyper
  source 1..829: mol_type = genomic DNA
caccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcgtaagtcctgcccccggggcgccgcggagagcgctgctgccggggagccgccgccgccgccgaggcagaacgagctgggggcgagcggcggggcgggggtacagccgggtgacatttaccaggtctcaggttcacacc

SEQ ID NO: 34558 - DNA, 23 bp, Homo sapiens
  misc_feature 1..23: note = chr12:94543948-94543971
  misc_feature 1..23: note = hyper
  source 1..23: mol_type = genomic DNA
cgggcggccgtccgaaggctcct

SEQ ID NO: 34559 - DNA, 332 bp, Homo sapiens
  misc_feature 1..332: note = chr12:95266862-95267194
  misc_feature 1..332: note = hyper
  source 1..332: mol_type = genomic DNA
agcagccgcagcccccgagggcgccccaggccaggagctgcgcgccgtcggcgggccgtgcctggaggaggctcgcgccttccaaatgccggagtgcaggcatccttcctctccccaaccccagccccggcctcgacctgtcgcccacctggcccggacctggggctggctccgtctctggggtgtgcgccaagggagccccaccgacgcccagcagagctgcccgggctcccaaagaaggaccggggctttgggcagaattctggcagccaggcgggcgtcaggggagccggagaaggggctcgccagcaggcgtggggcggagtgccggg

SEQ ID NO: 34560 - DNA, 44 bp, Homo sapiens
  misc_feature 1..44: note = chr12:95267247-95267291
  misc_feature 1..44: note = hyper
  source 1..44: mol_type = genomic DNA
cgaagagtgcgggcccggggtccccgcggcgccccttcccctcc

SEQ ID NO: 34561 - DNA, 114 bp, Homo sapiens
  misc_feature 1..114: note = chr12:95267567-95267681
  misc_feature 1..114: note = hyper
  source 1..114: mol_type = genomic DNA
cggggtagcgctggccgcggggtccccggggctctcccgggctgcggcggaggcgcggagccggccaagggcgcactgagctcgcggagctccggggccccggggcctttctgc

SEQ ID NO: 34562 - DNA, 92 bp, Homo sapiens
  misc_feature 1..92: note = chr12:95267706-95267798
  misc_feature 1..92: note = hyper
  source 1..92: mol_type = genomic DNA
cgggccgcttcgcccctctcctcttcctcgagttctggccccaccaggagcggagcgagtctccgatgcctgccccgcggcccccagaactg

SEQ ID NO: 34563 - DNA, 16 bp, Homo sapiens
  misc_feature 1..16: note = chr12:95942964-95942980
  misc_feature 1..16: note = hyper
  source 1..16: mol_type = genomic DNA
gcgtggcaaactccgt

SEQ ID NO: 34564 - DNA, 311 bp, Homo sapiens
  misc_feature 1..311: note = chr12:96883403-96883714
  misc_feature 1..311: note = hyper
  source 1..311: mol_type = genomic DNA
ccccctcgagctctccgtcagacgactctaccacctcggggtctctgccagaactgccgccgacctccaccgcgacttcgaggtcgcccccagagtcgaaggggagctcccggagctcgctgcttcagtggacctgccccgaggactcattgcccctagccgtgttttatgggccgctggacgcgaaaaacccgctcctggcctcttgtgagaaggagatccaggagttgttaggctttatgaggaaaaagaaggctttagccaccacggaggaagagaagcacgaattccgccggcgttggtaagcgctg

SEQ ID NO: 34565 - DNA, 32 bp, Homo sapiens
  misc_feature 1..32: note = chr12:97380005-97380037
  misc_feature 1..32: note = hyper
  source 1..32: mol_type = genomic DNA
aggccgtgcactccccgcgcttccgggaacct

SEQ ID NO: 34566 - DNA, 30 bp, Homo sapiens; identical to SEQ ID NO: 11363
  misc_feature 1..30: note = chr12:99287423-99287453
  misc_feature 1..30: note = hyper
  source 1..30: mol_type = genomic DNA

SEQ ID NO: 34567 - DNA, 258 bp, Homo sapiens
  misc_feature 1..258: note = chr12:99288150-99288408
  misc_feature 1..258: note = hyper
  source 1..258: mol_type = genomic DNA
aaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacc

SEQ ID NO: 34568 - DNA, 316 bp, Homo sapiens
  misc_feature 1..316: note = chr12:99288621-99288937
  misc_feature 1..316: note = hyper
  source 1..316: mol_type = genomic DNA
cgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagag

SEQ ID NO: 34569 - skipped

SEQ ID NO: 34570 - DNA, 93 bp, Homo sapiens; identical to SEQ ID NO: 3927
  misc_feature 1..93: note = chr12:99289161-99289254
  misc_feature 1..93: note = hyper
  source 1..93: mol_type = genomic DNA

SEQ ID NO: 34571 - DNA, 128 bp, Homo sapiens
  misc_feature 1..128: note = chr12:101110941-101111069
  misc_feature 1..128: note = hyper
  source 1..128: mol_type = genomic DNA
gcgctgggccaaatccgcggcgcgcctctgccgggcacctcccacctccagcttcgcccctcccctctcccggccgcgcgtcctccgcggctggttcaatccccgcggggacccggagcgcggctgcc

SEQ ID NO: 34572 - DNA, 161 bp, Homo sapiens
  misc_feature 1..161: note = chr12:101111277-101111438
  misc_feature 1..161: note = hyper
  source 1..161: mol_type = genomic DNA
ccagtctgggcaggacgcgggccaggatggcctccctcaccgcatacggtaactggggccgtcgcgggttcctggggcggcggggcggaagggaggggcccagggagccgtcgaaacacccggggaaacttcggggttcgcctctgcggaggggtctggaa

SEQ ID NO: 34573 - DNA, 32 bp, Homo sapiens
  misc_feature 1..32: note = chr12:103218533-103218565
  misc_feature 1..32: note = hyper
  source 1..32: mol_type = genomic DNA
gttttaattaacccacgcgcaggcaaggtctg

SEQ ID NO: 34574 - DNA, 106 bp, Homo sapiens
  misc_feature 1..106: note = chr12:103311184-103311290
  misc_feature 1..106: note = hyper
  source 1..106: mol_type = genomic DNA
caccacttcgctgcccgccctgggtaaagggaagaagccagggagcgacgggccacccaagccccgtcgattagacaggtttaggcacttccgggactctcagaag

SEQ ID NO: 34575 - DNA, 32 bp, Homo sapiens
  misc_feature 1..32: note = chr12:103344621-103344653
  misc_feature 1..32: note = hyper
  source 1..32: mol_type = genomic DNA
tcagaatgaactttccgcgcaggtcagatata

SEQ ID NO: 34576 - DNA, 60 bp, Homo sapiens; identical to SEQ ID NO: 11370
  misc_feature 1..60: note = chr12:103350244-103350304
  misc_feature 1..60: note = hyper
  source 1..60: mol_type = genomic DNA

SEQ ID NO: 34577 - DNA, 239 bp, Homo sapiens
  misc_feature 1..239: note = chr12:103350383-103350622
  misc_feature 1..239: note = hyper
  source 1..239: mol_type = genomic DNA
cgccatcactcaacccccgccccgcatctttcttctccgagggtctgggagtatcccagagcactcccttctttatgatatccgctaagctggtccggaaataatctttatggggagggggtggcggtagggggcgatggtacagggggccagaggtcatcctagggggacgtccctgccatatacacccacctacaggacggctcacaaccactcctcggtgtcgcttccccgcggcc

SEQ ID NO: 34578 - DNA, 509 bp, Homo sapiens
  misc_feature 1..509: note = chr12:103351477-103351986
  misc_feature 1..509: note = hyper
  source 1..509: mol_type = genomic DNA
acgtggaaggcgcaccgacagggatccggccagggagggcgagtgaaagaaggaaatcagaaaggaagggagttaacaaaataataaaaacagcctgagccacggctggagagaccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcactttttttgctcccactctaagaagtctcccggggattttgtatatattttttaacttccgtcagggctcccgcttcatatttccttttctttccctctctgttcctgcacccaagttctctctgtgtccccctcgcgggccccgcacctcgcgtcccggat

SEQ ID NO: 34579 - DNA, 104 bp, Homo sapiens; identical to SEQ ID NO: 1058
  misc_feature 1..104: note = chr12:103352051-103352155
  misc_feature 1..104: note = hyper
  source 1..104: mol_type = genomic DNA

SEQ ID NO: 34580 - DNA, 38 bp, Homo sapiens
  misc_feature 1..38: note = chr12:103352229-103352267
  misc_feature 1..38: note = hyper
  source 1..38: mol_type = genomic DNA
gccgacggccagccctcagggggcggtcacaagtcagc

SEQ ID NO: 34581 - DNA, 15 bp, Homo sapiens
  misc_feature 1..15: note = chr12:103352268-103352283
  misc_feature 1..15: note = hyper
  source 1..15: mol_type = genomic DNA
cccaagcaagtcaag

SEQ ID NO: 34582 - DNA, 368 bp, Homo sapiens
  misc_feature 1..368: note = chr12:103352313-103352681
  misc_feature 1..368: note = hyper
  source 1..368: mol_type = genomic DNA
cgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacga

SEQ ID NO: 34583 - DNA, 302 bp, Homo sapiens
  misc_feature 1..302: note = chr12:103358661-103358963
  misc_feature 1..302: note = hyper
  source 1..302: mol_type = genomic DNA
gttctttacccactgcgaaagcgaatggcttggatctagcgcaggtcgaagttatattccttcttcctttgtatgcaagattaggttgttacaaaagagggtgtgtaggttaatggcaggaagcaagttgcagcgcggagcgcgggccctgagcgcgtgtcaggcttaatgatttattcaagctgcagcgcatccgggcgttgattggctgcaggcatgcgtccgctgtcagctgcgcgcgccgggaactctccaggctacctgaagctggggggaggaagaggaggcgtggggacccgagg

SEQ ID NO: 34584 - DNA, 220 bp, Homo sapiens
  misc_feature 1..220: note = chr12:103359352-103359572
  misc_feature 1..220: note = hyper
  source 1..220: mol_type = genomic DNA
gagatgggggaaagccgccaacccacactccttggagggagtcactttctgcaaagtgcgttggagaggactgggccctgggtccgggctgtcgaagcaggaagtggatgtaggggacaaaagctccgcacctgccaaatgcgagaccttagagagagcctccccctcgccgctccctgctcccccgcgggcccgggaagcttgcactaccgggctcagc

SEQ ID NO: 34585 - DNA, 145 bp, Homo sapiens
  misc_feature 1..145: note = chr12:103359573-103359718
  misc_feature 1..145: note = hyper
  source 1..145: mol_type = genomic DNA
cagccagccccaccgcctccggactcgaccccaccatagccccgccgtccgaatcgtctctgaaccaaactacttctgcctgcctttctttggatctgtctttctctgtcatctgagtcactttctctctcgcctctcttttctt

SEQ ID NO: 34586 - DNA, 288 bp, Homo sapiens
  misc_feature 1..288: note = chr12:103889228-103889516
  misc_feature 1..288: note = hyper
  source 1..288: mol_type = genomic DNA
ttagcatgcgggcggcggcgagccggccgggtggggagggcggcggtggcatcgctgcgcggggcgcattgtgggccgcgctcgcctccgcgggggaccatctgctcgctgtcaatgcatcacctgctcgtctgggccgtcgccggggcaacggggggcgggggattaaggagcgtgtgcgtctcggtccgggccgaggcggcgaggtgggggttggggcgggggaggagagctccttggccccccacccccctgccccgagacgggtcgacccgctcgggggccggc

SEQ ID NO: 34587 - DNA, 197 bp, Homo sapiens; identical to SEQ ID NO: 1063
  misc_feature 1..197: note = chr12:103889517-103889714
  misc_feature 1..197: note = hyper
  source 1..197: mol_type = genomic DNA

SEQ ID NO: 34588 - DNA, 237 bp, Homo sapiens
  misc_feature 1..237: note = chr12:103889788-103890025
  misc_feature 1..237: note = hyper
  source 1..237: mol_type = genomic DNA
cgcagtcgccgggcaaccacaatggggctgccttgccgtgagaccctcccccgcgactgccaccaaagtcacagaaaactttcacacctctcatctgacactgtggcctgtgcacgactccaagcactggggaagccttcgacatcagaatatgaatggcacctgttcttccgggggcggcaagggggatcccgatgtttatcaaaatgggttgattttccacggagggggtacttc

SEQ ID NO: 34589 - DNA, 112 bp, Homo sapiens
  misc_feature 1..112: note = chr12:104322966-104323078
  misc_feature 1..112: note = hyper
  source 1..112: mol_type = genomic DNA
gcatcctcctgcactcgttaaactaagggttttccttttctgtgctagacccgcttttacgaccacgctctccacctgattcacagaaagggttctacgaccgtcaggtcac

SEQ ID NO: 34590 - DNA, 190 bp, Homo sapiens
  misc_feature 1..190: note = chr12:104609336-104609526
  misc_feature 1..190: note = hyper
  source 1..190: mol_type = genomic DNA
ggattttgggtggtgcgctcttttctcctttccatttctgcattttccaatttacctttagcgaccgttctttcctgttaaaaaaaaaaaattcacgaccttgaagaagatacacgggctatgacttcgctgttgtcaccgagcgccccgcccaccgcgttctccgacccgcggccggcagggggctcgc

SEQ ID NO: 34591 - DNA, 270 bp, Homo sapiens; identical to SEQ ID NO: 1066
  misc_feature 1..270: note = chr12:104609527-104609797
  misc_feature 1..270: note = hyper
  source 1..270: mol_type = genomic DNA

SEQ ID NO: 34592 - DNA, 293 bp, Homo sapiens
  misc_feature 1..293: note = chr12:104850244-104850537
  misc_feature 1..293: note = hyper
  source 1..293: mol_type = genomic DNA
aaagaaaaacgaaaccgcccagttctgagcgtcggaaaatgggcactcgctccctgggggtttggggcaacttccccgctacgtcgcccagggattttaaataattgccagccaccagaaaccccctaacccttaattcttccctccgagacccagcccgctgcttgccacttccctctccaaacgctggcgggggtgggtggcagcaccgaggcgattttcttcgtctttttttcctccgggttttgtcatggaaacgctgacacaacctccagacggcggccgagcccggc

SEQ ID NO: 34593 - DNA, 672 bp, Homo sapiens
  misc_feature 1..672: note = chr12:104850577-104851249
  misc_feature 1..672: note = hyper
  source 1..672: mol_type = genomic DNA
cgcacaccgcactccccgggcaacagctggacgcgaccatatcccgggtaggggcggggggagcgcgacgctccgccccggcgctagggtccctccctcctcccggctctccgcaggcgccctcccctcgccgggggccgcgagttgcatttggtaaaacccagccccggaatatatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggcc

SEQ ID NO: 34594 - DNA, 231 bp, Homo sapiens
  misc_feature 1..231: note = chr12:104851920-104852151
  misc_feature 1..231: note = hyper
  source 1..231: mol_type = genomic DNA
gttgcccctccaccacgcgccggccgtttgcccccggggtccgggtccgcagtgaccttgcggctggtgccccggggcctgctccagcccccagccctgagctggaaactccgagctcctgggtcacgccttgaccactgcagttttggaggaaactttggccaggtcctgggctgaccgtccgtttgcatcccccacttctgggatccgagcaacgggaatcccccgggc

SEQ ID NO: 34595 - DNA, 287 bp, Homo sapiens; identical to SEQ ID NO: 11387
  misc_feature 1..287: note = chr12:104852152-104852439
  misc_feature 1..287: note = hyper
  source 1..287: mol_type = genomic DNA

SEQ ID NO: 34596 - skipped

SEQ ID NO: 34597 - DNA, 61 bp, Homo sapiens; identical to SEQ ID NO: 11389
  misc_feature 1..61: note = chr12:104852447-104852508
  misc_feature 1..61: note = hyper
  source 1..61: mol_type = genomic DNA

SEQ ID NO: 34598 - DNA, 107 bp, Homo sapiens
  misc_feature 1..107: note = chr12:104852725-104852832
  misc_feature 1..107: note = hyper
  source 1..107: mol_type = genomic DNA
cagattccttgacagcgcagggacagacggcccctttgccccactcggtctggagcagttgttaaggcagccacactgccaaggatatggtccgactctaccacatg

SEQ ID NO: 34599 - DNA, 43 bp, Homo sapiens
  misc_feature 1..43: note = chr12:105478265-105478308
  misc_feature 1..43: note = hyper
  source 1..43: mol_type = genomic DNA
gcggcgcagcctgggcgcggcctgggcgcggcctgcagtctgg

SEQ ID NO: 34600 - DNA, 30 bp, Homo sapiens
  misc_feature 1..30: note = chr12:106532217-106532247
  misc_feature 1..30: note = hyper
  source 1..30: mol_type = genomic DNA
cccgcttgactttgccgtaggtgcctttgc

SEQ ID NO: 34601 - DNA, 640 bp, Homo sapiens
  misc_feature 1..640: note = chr12:106974353-106974993
  misc_feature 1..640: note = hyper
  source 1..640: mol_type = genomic DNA
cccacctccactctgcgtgcaaaaattataataataatagcaacaataatagtctcatccgccctggagaccacccgtgcccccgtggcatccctcaaggactctccgggcggtggcagccgcccaccctggggacgcgctccttgctgccaccggaacgcccctggccaggctccatctacgcgctgtcagaccctcccgccgtctgaagaaggcttttactcttcagcctattccagtggcagagaagctaaggctacaaaggcgaacgcgaacagtcagatctgacttcgaattccgctgtcattgctgccaggcgcaccacgaggacgcgcggtgaccgccaccatggcattcggctgccaaaggtttccatcgacctctttcccatcaccagcatcgcagcgggaaagaatgtgcctggcgcccttctgggcactgggcatggggtggtgaacaaagtcctccagaaataaaccgggtaatgagcccggcagcggccggggcaggaagggaccttcgcagagagtggtcaggcacagcccctccgaggaggcgacgctcagctgagaccagggtgacgcaaaggtgtcggccggttaggcacctgtgaggaaggaggagccggcagagtgccaag

SEQ ID NO: 34602 - DNA, 439 bp, Homo sapiens
  misc_feature 1..439: note = chr12:106975246-106975685
  misc_feature 1..439: note = hyper
  source 1..439: mol_type = genomic DNA
gggctccccagtctccgtacattgtcccactcagctctgattgtggggagggggcggaccgagggggcggggggcgtctttccgaaggatcgcggaaagccgcgcgctgccaggggcccggggttagagacccccactcccgcacggcgttagggactccgcgcttccccgcccccgccgcggcccgccggctctgcctctgtccatggtcaaagcacccggggtaatccgcctttctcttccgcccgccgggccccattcatattctaatcacagcgcggccgacccgcgaacggccactttatcggggcccgcaggagacgcagcttgctccccctcacttccacttccagcaccccccggccctcgcccccctctttctgcactttcaactccgccgaggagggggtccctgggaaaaccgcgtccccacttggat

SEQ ID NO: 34603 - DNA, 119 bp, Homo sapiens
  misc_feature 1..119: note = chr12:106976403-106976522
  misc_feature 1..119: note = hyper
  source 1..119: mol_type = genomic DNA
cccggcctgccagcacggcgcggggcccgatggtggggaagggccgggagggggagggggccacatctaagccaattttgatttcgcctataatgagtgccgggcgaaggctggagaag

SEQ ID NO: 34604 - DNA, 55 bp, Homo sapiens
  misc_feature 1..55: note = chr12:106976725-106976780
  misc_feature 1..55: note = hyper
  source 1..55: mol_type = genomic DNA
tgacattgctcccatcggggctcctataaaatgatgctttttcccatgaaacatc

SEQ ID NO: 34605 - DNA, 11 bp, Homo sapiens
  misc_feature 1..11: note = chr12:106976842-106976853
  misc_feature 1..11: note = hyper
  source 1..11: mol_type = genomic DNA
cgctttttctc

SEQ ID NO: 34606 - DNA, 479 bp, Homo sapiens
  misc_feature 1..479: note = chr12:106977373-106977852
  misc_feature 1..479: note = hyper
  source 1..479: mol_type = genomic DNA
gcgcgcgcgaaggagcgcgctttcgcttgccctggacacaaagttacgtaaagatgcgctggctcgcggcgagctcgaggtgccacttgcagaaactttgccagccgaccgccccctcccggacccaggtcctcctagggtatgggggcctcggaatagcggtgcgctcggggtctggcggccagggccgggaagccgagcggaacgccccgaggcgggggagggtgacggcttcgcactgcgcctgggaggtggggaccgaggctccggctggtagagacgcgcagctggagggagtggcggcggcgaacccggtggtccgggggaatccgcagaaacgggaggtgggagtcctgggctgtggggtcgggcttttagcttttctgccaggaaggggcacccaacgccgggctccactagggagctgtgaccttgctggagggagggcaggacgcagactggcccgctaaactcggcgt

SEQ ID NO: 34607 - DNA, 30 bp, Homo sapiens
  misc_feature 1..30: note = chr12:106978736-106978766
  misc_feature 1..30: note = hyper
  source 1..30: mol_type = genomic DNA
tgaggtctctactggcggtaaagcgggagc

SEQ ID NO: 34608 - DNA, 30 bp, Homo sapiens; identical to SEQ ID NO: 11398
  misc_feature 1..30: note = chr12:106979261-106979291
  misc_feature 1..30: note = hyper
  source 1..30: mol_type = genomic DNA

SEQ ID NO: 34609 - DNA, 86 bp, Homo sapiens
  misc_feature 1..86: note = chr12:106979504-106979590
  misc_feature 1..86: note = hyper
  source 1..86: mol_type = genomic DNA
gttattatatcattccgaaaggactggaacaaccgactcacagcaagtgctggggcgaagtaggaaacgtccaggataagagaggc

SEQ ID NO: 34610 - DNA, 238 bp, Homo sapiens
  misc_feature 1..238: note = chr12:106979636-106979874
  misc_feature 1..238: note = hyper
  source 1..238: mol_type = genomic DNA
cgaagtgcctcgggcccgggagaacagttttgcaggggccagggctctagtggcctgctttggggccacttcagcatgacctgcggaaacgcgcccctttgttccgcacactgagccagtaatatattcctcgggtttccccaaaatactcaacaagtgtggagctaagacaatggcccggtcgggggaagctgggcagccggcgcgcgcctcctgggccctaggcgctctcgctgcc

SEQ ID NO: 34611 - DNA, 120 bp, Homo sapiens
  misc_feature 1..120: note = chr12:106979875-106979995
  misc_feature 1..120: note = hyper
  source 1..120: mol_type = genomic DNA
agcccgacaaagcaaagcccctctcggaggcaaagccccagcttgccgcgcgccgcggtgctccggcaggaggcaaaggcgacaggcgcgcgcaggggcagtcgacgcaccttctggccg

SEQ ID NO: 34612 - DNA, 257 bp, Homo sapiens
  misc_feature 1..257: note = chr12:106980223-106980480
  misc_feature 1..257: note = hyper
  source 1..257: mol_type = genomic DNA
agaattttaggccaccgagaacttgtgcaaagtgggccgggccgggtcggtcgcctacgcaacagaaggatcatttcttttaaaacgggatggcgcgttagagagggccactgccaagctggagctggaaacttctgcctccatccactttccgctcccatctccagaacccagagctgaggcggccaaagtacttcctggagccggatttgagttccccgggccgcatcggtgggagggcacgctagtttacaggc

SEQ ID NO: 34613 - DNA, 28 bp, Homo sapiens
  misc_feature 1..28: note = chr12:106980719-106980747
  misc_feature 1..28: note = hyper
  source 1..28: mol_type = genomic DNA
caaaccagacagtctcgccctccccggg

SEQ ID NO: 34614 - DNA, 628 bp, Homo sapiens; identical to SEQ ID NO: 1067
  misc_feature 1..628: note = chr12:106980911-106981539
  misc_feature 1..628: note = hyper
  source 1..628: mol_type = genomic DNA

SEQ ID NO: 34615 - DNA, 42 bp, Homo sapiens
  misc_feature 1..42: note = chr12:107297268-107297310
  misc_feature 1..42: note = hyper
  source 1..42: mol_type = genomic DNA
tgactgggaagcttccgcagggaattccgccccggacccctg

SEQ ID NO: 34616 - DNA, 146 bp, Homo sapiens
  misc_feature 1..146: note = chr12:107486450-107486596
  misc_feature 1..146: note = hyper
  source 1..146: mol_type = genomic DNA
cctaaaattcgtaagcggtataagcaagacagtcccacgtctaaattcacagatttggcggatcgcatggaattcattaacatcagactcattaaacacccaaatccatttcccacgggcttgtgactcaccgccacctgttgatg

SEQ ID NO: 34617 - DNA, 209 bp, Homo sapiens
  misc_feature 1..209: note = chr12:107487646-107487855
  misc_feature 1..209: note = hyper
  source 1..209: mol_type = genomic DNA
gcggccaccattggccgaggctcgctgagacccggatgagcacggggatgcggggagcttgcgggcgcgcgcgctgctccgttaggcgcgcgtgcgctctcgctgcgttccagagggtaagggggcggggccggcgggcaggagcgcgctcggcgattcctcccgtgggatttggggagggcctggaaattgtccggtttccttcagga

SEQ ID NO: 34618 - DNA, 38 bp, Homo sapiens
  misc_feature 1..38: note = chr12:107711950-107711988
  misc_feature 1..38: note = hyper
  source 1..38: mol_type = genomic DNA
agggggcagcatccacgtctctacgcttgcaagggttc

SEQ ID NO: 34619 - DNA, 30 bp, Homo sapiens
  misc_feature 1..30: note = chr12:107713205-107713235
  misc_feature 1..30: note = hyper
  source 1..30: mol_type = genomic DNA
gagcgccatggagatcgtgctgtcctgggg

SEQ ID NO: 34620 - DNA, 530 bp, Homo sapiens
  misc_feature 1..530: note = chr12:107714660-107715190
  misc_feature 1..530: note = hyper
  source 1..530: mol_type = genomic DNA
gttagtttagggcgtcgtttccagcaggttctatcatcgtctcttcatgccccactgttttgaaggcctgacttgggtaggtttgaacccgcagttctgtccttgaagggggtggggccggggcgcttgttttcgagagctcgcgctggcggtgctgcccgtctgcgaaagccggagctagacacttcaaagcttcaattttccacaggaaatggtagaaacgtaactggagactctaaaggcgaaataaaactttgttacatattcggcggtttggccagaggttgcgcggttggagctgaaatgcagtctttctgggcagatttcattcatgttgctgcctgtctgtttcccgggggctggaggagcactgcggtgggcggtgccaagggtgtgcatgtgcgtgtgagagtctgtgtgcgcgcgcgtctgtgcgtgtgtaagtgtgcttgtgagtgtgcgcaggaacaagcgggcgcgcagggcgcccggctccagccgaagcctttggaaaccgaccctgccgccct

SEQ ID NO: 34621 - DNA, 492 bp, Homo sapiens; identical to SEQ ID NO: 1068
  misc_feature 1..492: note = chr12:108168922-108169414
  misc_feature 1..492: note = hyper
  source 1..492: mol_type = genomic DNA

SEQ ID NO: 34622 - DNA, 55 bp, Homo sapiens
  misc_feature 1..55: note = chr12:108169549-108169604
  misc_feature 1..55: note = hyper
  source 1..55: mol_type = genomic DNA
cgcacagcgcgcagccgggcgctcaacctaaggtcctcttcgaaggtggtttgca

SEQ ID NO: 34623 - DNA, 103 bp, Homo sapiens
  misc_feature 1..103: note = chr12:108237422-108237525
  misc_feature 1..103: note = hyper
  source 1..103: mol_type = genomic DNA
aaacagcttcttcatcgcggcagcttcggagaagcctcagctaccctgcagctccccttcgccttttcgcggaatccggagtccagtcacaattagctaagcc

SEQ ID NO: 34624 - DNA, 307 bp, Homo sapiens
  misc_feature 1..307: note = chr12:108238207-108238514
  misc_feature 1..307: note = hyper
  source 1..307: mol_type = genomic DNA
tcaggatactgaggccgcccagagcacgccccgccaacccacctaggcgcctgagctgcagcctctgcgccgtctctgccgcggtccggcaggccgcctggattggccgccgccgctgctgccaccacggtgtccacccaacgactctaatgtgggaagtctggcggtggagggtgtcgcgggctctccggcagacccgtagctggtggtggagctgagggccctggggcatggcgggcagggacttgaggcccgcaggaggagggggccgtgccgatgctggctgtgccggggctgcctgagaacc

SEQ ID NO: 34625 - DNA, 433 bp, Homo sapiens
  misc_feature 1..433: note = chr12:108297323-108297756
  misc_feature 1..433: note = hyper
  source 1..433: mol_type = genomic DNA
aagttggagatacaccgattctcctgtttctggggaaggattctcagaaggtggctcatatgagtaaaaatcatttttcctgggtagctgattcctagaaactcgcagggcggcacagcacggcggctcgtggcagcagaagaggaagatgccgcggtggaaggcgtcttcgcggccgggcagcgacgcgtacacctgccgccggaagaagagcgacggtcgcacagctctcaggccgggggccggagccccggcagcccggccgcgcccatccacgcccagccacgcccagccacgttggccgcccgcccagcctgctgggaaactgctcgctgcgcattcgcccgccggcgccgacttggcgatggccagctacacaggtccggcgggggcggcagccatgtggggcgcgggctggcgtggggagcagccc

SEQ ID NO: 34626 - DNA, 79 bp, Homo sapiens
  misc_feature 1..79: note = chr12:108523360-108523439
  misc_feature 1..79: note = hyper
  source 1..79: mol_type = genomic DNA
cccgcctccctggctcgccggctggcgtcgccaccgcctcctcgtccccggccaccgctgtcgccgctgctgcaattca

SEQ ID NO: 34627 - DNA, 30 bp, Homo sapiens
  misc_feature 1..30: note = chr12:109746889-109746919
  misc_feature 1..30: note = hyper
  source 1..30: mol_type = genomic DNA
aggagggagcaaagccgaccctgcaaggcg

SEQ ID NO: 34628 - DNA, 100 bp, Homo sapiens
  misc_feature 1..100: note = chr12:110271088-110271188
  misc_feature 1..100: note = hyper
  source 1..100: mol_type = genomic DNA
agatgtccccaggggcgcgaggggacctcggctgagccgcccctcccgggcccgggccccacttacctccgggacggctgggcgccggcggccgggagat

SEQ ID NO: 34629 - DNA, 148 bp, Homo sapiens
  misc_feature 1..148: note = chr12:111127212-111127360
  misc_feature 1..148: note = hyper
  source 1..148: mol_type = genomic DNA
acaaaaatcctgccccgggccagcctaagggaagggtgggcgggggaaccacttccttcctccgccggctggagcggggcgaatccaccccgccaacccctttcggggagcttctgctccatcccaccgtctccgggccacccctgcc

SEQ ID NO: 34630 - DNA, 372 bp, Homo sapiens; identical to SEQ ID NO: 11409
  misc_feature 1..372: note = chr12:111284662-111285034
  misc_feature 1..372: note = hyper
  source 1..372: mol_type = genomic DNA

SEQ ID NO: 34631 - DNA, 144 bp, Homo sapiens
  misc_feature 1..144: note = chr12:111471165-111471309
  misc_feature 1..144: note = hyper
  source 1..144: mol_type = genomic DNA
tggtgacatttcccacgactcagtggcgcccccgggcggctcccaccctccctccggccggcgcgtctacgcagccccaagtgctggctgcgaccctcggatcccaagcatatctggcgatggagcggcggcagcccgaggcac

SEQ ID NO: 34632 - DNA, 650 bp, Homo sapiens
  misc_feature 1..650: note = chr12:111471310-111471960
  misc_feature 1..650: note = hyper
  source 1..650: mol_type = genomic DNA
tgttgtgtgtgctccgattgcaaaagaaaaaaaaatgcatttcaaactattaacttttttttaagcgtgcaatgccgggagctgggggtagacaggtgcaagcgggggtaggcgccccgcgcgcccgcctcccgcagcgccccctcccaaacttccctttgcattgatcagcacgttacgtcagtattgataagtttgcaaaaagccaaagtcaagtgcaatcgcgcggcacaccgaccccggacttgggggggagatgcagcgagcgctccgcgggcccgggagccggcggcaggcagggcagcggcggcgccggcgcctctcggagaggctgcctccccccaacccctcccctcccaccccatccccggctgcctcccccgggcgggcgccgagctccccgcccggcgcgctccgcccgcgccctccgggggtcgggggggcgcacggctcccgggcccgttggcggcggcggcggcggcggcgcggcggcggcgaggggcagcgggtggcaggaggccggagggcgcccgaggggccccgggccgcggcgctcagggcccgggcggccggcggcggccccggggctggggggagtccagcccggatattgagtgcagccattgagaaaagccaaactcttgtgtgtg

SEQ ID NO: 34633 - DNA, 138 bp, Homo sapiens; identical to SEQ ID NO: 3943
  misc_feature 1..138: note = chr12:111472058-111472196
  misc_feature 1..138: note = hyper
  source 1..138: mol_type = genomic DNA

SEQ ID NO: 34634 - DNA, 155 bp, Homo sapiens
  misc_feature 1..155: note = chr12:111472356-111472511
  misc_feature 1..155: note = hyper
  source 1..155: mol_type = genomic DNA
cgggcagggggctgctggcgggaacccccggcggtcccccctgagccgcactttgcgcgcctcccaacttcgcggcgcccggggaggccgcggagcgcgccgcttgccagtccgcacccggctggggctccggcgagggagggagggagctggcg

SEQ ID NO: 34635 - DNA, 101 bp, Homo sapiens
  misc_feature 1..101: note = chr12:111472571-111472672
  misc_feature 1..101: note = hyper
  source 1..101: mol_type = genomic DNA
ggcgaggaggcggctccgcgccccgccgctcgccggcacctcagccttcgccgcccgcctggctgcgcagcccggacgcgccgccacccgggggccgccgc

SEQ ID NO: 34636 - DNA, 166 bp, Homo sapiens; identical to SEQ ID NO: 3946
  misc_feature 1..166: note = chr12:111472851-111473017
  misc_feature 1..166: note = hyper
  source 1..166: mol_type = genomic DNA

SEQ ID NO: 34637 - DNA, 67 bp, Homo sapiens
  misc_feature 1..67: note = chr12:111844623-111844690
  misc_feature 1..67: note = hyper
  source 1..67: mol_type = genomic DNA
accgggccaggcccccgcatgctgctgaattgggcggttcaccagggctaggcgtcccagagacagg

SEQ ID NO: 34638 - DNA, 325 bp, Homo sapiens; identical to SEQ ID NO: 1070
  misc_feature 1..325: note = chr12:113012954-113013279
  misc_feature 1..325: note = hyper
  source 1..325: mol_type = genomic DNA

SEQ ID NO: 34639 - DNA, 30 bp, Homo sapiens
  misc_feature 1..30: note = chr12:113229420-113229450
  misc_feature 1..30: note = hyper
  source 1..30: mol_type = genomic DNA
cccaacctcccctcccggcctcccaccttt

SEQ ID NO: 34640 - DNA, 77 bp, Homo sapiens
  misc_feature 1..77: note = chr12:113494339-113494416
  misc_feature 1..77: note = hyper
  source 1..77: mol_type = genomic DNA
ccactccctgcctcacgctctgcttggggtcagaaggccccttggggtctcgggagggcctggccgaggatttgggg

SEQ ID NO: 34641 - DNA, 607 bp, Homo sapiens
  misc_feature 1..607: note = chr12:113494430-113495037
  misc_feature 1..607: note = hyper
  source 1..607: mol_type = genomic DNA
cgtgtcagcgccggtggcgctcagggccgagatctgtctcctccccttcctcctcctccgccccctcccctctccctcccggagcacggccgaggcctcctcccacccgcgagatcccggcggccgccagccggctcctgcgtccgtccgtcggccgggcagtctgtccacgcgcggaaagctcggcgcggcggccgaggggcctgggagggaacgggcgcggaggcgggaccgcggctccctcccactccggggggagcccaggaggcggcggtgctggagcgcgagccggagccggagccggagacgaagagaggcggtgagaacgcgggtgcttagggaccccacccccggctcccgctgggggcccgcgagcggctcggggacgtctgggctggggaagcggggctgttacccccagggcgggaggcagagacgatccagctcctggcttcgccccctccgcgacgcgacccccgaggggccctgggccgcgcctgcagcgccgcgcatccccgtgcttcccggcgcaccccagcgcacccggcatccccccggcagggcgagggccccgggggaagggaaggctccgggagccaaggagggc

SEQ ID NO: 34642 - DNA, 50 bp, Homo sapiens
  misc_feature 1..50: note = chr12:113495038-113495088
  misc_feature 1..50: note = hyper
  source 1..50: mol_type = genomic DNA
ccccccaggcggagagtctcggaaaaccgcgcccccggcccctgccttcc

SEQ ID NO: 34643 - DNA, 593 bp, Homo sapiens
  misc_feature 1..593: note = chr12:113541506-113542099
  misc_feature 1..593: note = hyper
  source 1..593: mol_type = genomic DNA
ttagaaataacacgtcgcatacgccaagcagcgtcctatgctctttgtgtaaatcaagtcatttaattatcacaactccacgagataggcactgttatcaacctcatttcacagttgaggagactgaggcatagagaggttgagtaacttgcccaaggttgcacagccagcccaggcggaagtgggacacccgctgattgacgggtggggagggcggagcctgcagtccgccctgccccctcacctgagcgctcagcctggaggcagcaggtccagcgcgcgctgcggaaggcaccggggtggcaggcggccagcttgttcgggttgggggcgctggccttgcgcaaggccgagagccactggttgagctcattcacattctgcagcgggtgggaggcgatcagggggcgggtgggaacagagggacgccccccgctccccatcgcggtggggtctcaccttgcactggaggtaggtggtgtgcagcgcccccgtgccgtcctgcgtcaccacctgcatcacgtggggcagttggaaggcgccctcgtctacgcgctccacggcgcggatgtgagacacggggatggagtgac

SEQ ID NO: 34644 - DNA, 271 bp, Homo sapiens; identical to SEQ ID NO: 11420
  misc_feature 1..271: note = chr12:113592127-113592398
  misc_feature 1..271: note = hyper
  source 1..271: mol_type = genomic DNA

SEQ ID NO: 34645 - DNA, 140 bp, Homo sapiens
  misc_feature 1..140: note = chr12:113900538-113900678
  misc_feature 1..140: note = hyper
  source 1..140: mol_type = genomic DNA
acggggaaagcacagcgagaaataagattacaaaatgccactcggattgcagagagagggaaaaacaccgtctccgccccttggcctcaccctctctcagtccaaagaggtggcggtggctgggtgggtgggtgggggcc

SEQ ID NO: 34646 - DNA, 407 bp, Homo sapiens
  misc_feature 1..407: note = chr12:113900752-113901159
  misc_feature 1..407: note = hyper
  source 1..407: mol_type = genomic DNA
cggttgctgggagagtactggcggtgggctgaggctcctggagagcccgcggggtggagatgggggtcggccccccctcggcgcccagccgaggagcagctgccagttgagtgcggacccgagagagaacccccgagggacacccacgtctcccaccgcgtctgcgtcgggcgttttggtttcaggaggctgcttcggggcggggcccccgggggccgagcgcggggggcggcccggcggccttaccacacggcggcttcgttgagctcggggttgggatgcgacaggggtccgctgtagccgctggtgccgctcattgggaagggcgggctgggcccgccgctgaatacctcgccgggcatggggtgcagcgtgcccggcaggcctggctcggggctcggtgtgtc

SEQ ID NO: 34647 - DNA, 611 bp, Homo sapiens
  misc_feature 1..611: note = chr12:113901407-113902018
  misc_feature 1..611: note = hyper
  source 1..611: mol_type = genomic DNA
cgaagtaggcgggggacccgggacccggggaggggacccgggcgggcgagagaggggagcgcgcgacaccgacccaaggttagagagacctgcggaggccggcgccccttgagacggtggacgtcgcaggctcacggggagggttggggagagagacaatgagagatctcgaaagggcaagagactcagactgccagagaccacacacagagacgggagagactccgagaccgtgggggacacacgcggcaaaaactcggagacttcagtcacaggttccctgacacctagagatggagagagacagaggcggccagagacgcagagacagacaatgattcctaagtgtcttagggtcggtgagagacacagagatgcgggacagcgagagacagacggagagatcggcagaggggcagagagaaaggcggaaaagagacccagagacgcggagtccgcggctgagacccgaaagcccgagacatcggagggtcgcggaggagtcgaggagacgcagagagaggaaagacggccgcggttagagacacgcgtggaaacccccgggggcggcagcgagggagtcaggagtgagcccgaagatggagagaagt

SEQ ID NO: 34648 - DNA, 312 bp, Homo sapiens
  misc_feature 1..312: note = chr12:113902041-113902353
  misc_feature 1..312: note = hyper
  source 1..312: mol_type = genomic DNA
cggtggatcagagatgagtcccaggaacctccagagaagcggaggctgacaggcccggggagaggaaccgggcagggacaaaccagcggacagagcagagcgcgaaatggttgagaccgggaagcgacctggccgggggaaactggatccgggccgcggcaggagcgactggtgggttgggccgggcggggcggccttggcgccctaaactcggtccctgcgccctaccaacccagtccaagtccttcgcctcgccaagtacggccgccgcgtcgatcccggtgagaccatttgtaccggcctagcctagcc

SEQ ID NO: 34649 - DNA, 79 bp, Homo sapiens
  misc_feature 1..79: note = chr12:113902608-113902687
  misc_feature 1..79: note = hyper
  source 1..79: mol_type = genomic DNA
gaggtgtagggactccggattgcaaacccattctgcctcaacaaatctgtatcaactctctgaccgccccacatagccc

SEQ ID NO: 34650 - DNA, 522 bp, Homo sapiens; identical to SEQ ID NO: 11424
  misc_feature 1..522: note = chr12:113903021-113903543
  misc_feature 1..522: note = hyper
  source 1..522: mol_type = genomic DNA

SEQ ID NO: 34651 - DNA, 273 bp, Homo sapiens
  misc_feature 1..273: note = chr12:113904756-113905029
  misc_feature 1..273: note = hyper
  source 1..273: mol_type = genomic DNA
gcgatcgtgtctagacgtgtgtccctggagtctctgaacgcaagtgtgagtgcaccttgtgccctgcgtgggtgaatgtgtcactgtatctcgtgtgtgcttctgtgtgcatcactgtatgggtgagaccatgtatctgattttgtgtccaggacatgtgggtgagtgtacatgtgtctgtgatcgtgtgtccagcgagtgggcgatgttctggagcggcggaaagcgtgctggccgggacccttcgccctcagctcccggaataggacaggt

SEQ ID NO: 34652 - DNA, 33 bp, Homo sapiens
  misc_feature 1..33: note = chr12:113905380-113905413
  misc_feature 1..33: note = hyper
  source 1..33: mol_type = genomic DNA
ggtggagagaggcttcggcgaaccagccaaggg

SEQ ID NO: 34653 - DNA, 761 bp, Homo sapiens
  misc_feature 1..761: note = chr12:113905673-113906434
  misc_feature 1..761: note = hyper
  source 1..761: mol_type = genomic DNA
aagcaaggcggggggcggaattcagagaggtaaagtgacccgcccccaaatcgcaataccaggaggacagcagggctagatggaatctttcggttcacagtccccgacctcgggcaagtgccccactcgggcgcacggtctgctcccagaccagaaccaggcgcgctcgtagccaaggaagcttggcgggagactcctccgaggctcccggctcccaggccagcggggctaaggagctgtgcccgccccgggccgcacctggatgacgcgcatgttgaggccggtctcctgcgccagctgctcgcggatgtggcgcgtgggcttgggcgtggcggcgaaggcagccttgagcgtctccagctgcttggccttgatggtggtgcgggggccgcgccgcttggtgcccgagttctgctcctcgttctcgttgttggccgtctccttgtccgacgaggtcgagttgtccgtctctttggggtcgtcctgcagtgcgtcctggaggtccggggacaaactgcggtccgtacaggatgacactgcgggcggacggatcgggaaggggacagcggcgtcagcgacggccagacgcctcttcagtccagtggcgggttcccgccggcccaagctacggcctgcccaggctacggccagccccgctggattccctcccaaacctgcgacagcccctcccccagggacccggtgcccgcccactctctccaggcggggctgggcctttggaggggcgctcttaagccctc

SEQ ID NO: 34654 - DNA, 32 bp, Homo sapiens
  misc_feature 1..32: note = chr12:113907104-113907136
  misc_feature 1..32: note = hyper
  source 1..32: mol_type = genomic DNA
gggcgagatgccttgcgcgcagccggcgcatt

SEQ ID NO: 34655 - DNA, 163 bp, Homo sapiens
  misc_feature 1..163: note = chr12:113909055-113909218
  misc_feature 1..163: note = hyper
  source 1..163: mol_type = genomic DNA
tatccccttccccagcgccccagtggagcgcgcgcagggtgggcgcgcaggcagcagagcggcgcggcctcttacctgaaaaagtcatttttgcagtagagcttgccctcgcgcgagaagcacttctccgagaggttggttttgcactcgcagcactgaacac

SEQ ID NO: 34656 - DNA, 35 bp, Homo sapiens
  misc_feature 1..35: note = chr12:113909468-113909503
  misc_feature 1..35: note = hyper
  source 1..35: mol_type = genomic DNA
tggcgctgggctgcccggagtggggtggtgggggg

SEQ ID NO: 34657 - DNA, 123 bp, Homo sapiens
  misc_feature 1..123: note = chr12:113909534-113909657
  misc_feature 1..123: note = hyper
  source 1..123: mol_type = genomic DNA
cgcacgccccggcgcctgttccgggcttccccaggtatctcgggtggctgctggcctcggcgctgcggagcggctttccccggtggcggaggcgccggcactttcccccactttcaagcggtc

SEQ ID NO: 34658 - DNA, 449 bp, Homo sapiens
  misc_feature 1..449: note = chr12:113909717-113910166
  misc_feature 1..449: note = hyper
  source 1..449: mol_type = genomic DNA
cgtggcgctgcacgtagggggcccagcggccaatgggcgcaccgtggccatggcaacctcttaaatttatagcatatctaaattggctacagcgttgctgtccggacagagcaaaaaaaacaaggcatcagtattgttgagtattagcttgtacctggttcggaggctaagtaagtatttaccttccagtttggggctgacggggcgggggcagcgcgaaacgaaaattgcgtctctcttcctctctctttctcctcacaaatatttgggggtcacgggttccaaggcctagtccgggaggtacccctgcccccttcgccatccctggaacttgcagaagttgccccacgccccacacttcgctccccttctccagcccagccagcccagattggattcccccacccccgcgccccctctgcgccctgaagctgcgtcagcgcggttct

SEQ ID NO: 34659 - DNA, 157 bp, Homo sapiens; identical to SEQ ID NO: 11429
  misc_feature 1..157: note = chr12:113910529-113910686
  misc_feature 1..157: note = hyper
  source 1..157: mol_type = genomic DNA

SEQ ID NO: 34660 - DNA, 814 bp, Homo sapiens
  misc_feature 1..814: note = chr12:113912868-113913682
  misc_feature 1..814: note = hyper
  source 1..814: mol_type = genomic DNA
agctcagccccagttcgagaactccctggacctgggctcagccaagctgcccagaacccgcccggccttctctagcccaccaccttccccggtgcacagcatcggaaaatgccagcagaccagctattagactcatcccgacctaacagcgctaacagatggcgaccaggcagcgaaatcccctcctatatgtaactaataaaccgcttgtgtcttaacagggtaatgcatggagacgcaatgtcacttatacaagatgttgatggaatttactatataaaaatcttcctcctagagtaaagagtatcaacattacaactcgacagacggcggcgggataagtaaaacagacaaaagacaaacaagataataatctgtttccaatcacttaagccctgtagagttagtaatatgcggtttgcatattcccccttgagttcggtaattaattactggcgaggaggcgcacactagcctggggtgggagttttggggagcgctgagctggggcgtggggcatacctctcttgagttctccagcccgggacaccgggcagcggccggaatgagggcgcttccagaggtttggagctgacccacccgcgggttgaagaggtcgtttcagttgcacctccctattcctcaccggaaagcctccggcctgggagattctgcagccaagcaggaaagggggtcttctctggcagccagtgtctctcctggctcctcttaaagcatcctctccttcgaacggccgggagtggcagctttattgggaaacgcgcgctctgggggcccaggtggctggggggac

SEQ ID NO: 34661 - DNA, 204 bp, Homo sapiens; identical to SEQ ID NO: 11432
  misc_feature 1..204: note = chr12:113914020-113914224
  misc_feature 1..204: note = hyper
  source 1..204: mol_type = genomic DNA

SEQ ID NO: 34662 - DNA, 228 bp, Homo sapiens
  misc_feature 1..228: note = chr12:113914300-113914528
  misc_feature 1..228: note = hyper
  source 1..228: mol_type = genomic DNA
cgggccagagaggacgccggcggggtgcaatgggtgctcaggcctagacatccgggcagggatgcgagagggatggcgggggtgggagtggggtgggtggggggtggtggtgaattttctggggaacccttgggggtggccgtctgagagcggcccggagcccaggcggggagagtgtcctggcctgggtggaaccctgggaggcgggggcgtcgtggctggtgtgcc

SEQ ID NO: 34663 - DNA, 44 bp, Homo sapiens
  misc_feature 1..44: note = chr12:113916222-113916266
  misc_feature 1..44: note = hyper
  source 1..44: mol_type = genomic DNA
tttgttagcctaatacgggttactttagaattggcccgactttg

SEQ ID NO: 34664 - DNA, 404 bp, Homo sapiens
  misc_feature 1..404: note = chr12:113916326-113916730
  misc_feature 1..404: note = hyper
  source 1..404: mol_type = genomic DNA
gtgtgcctgcgcgtgtatttctcgcttgctaatgattgtgtgttgatagagtgatgcagtggcctcattagcctttgtttagaaggtgttaaaagggaaatctgcatcgggaaagcggcggtttacgcagcagcccggctgaacaccgcgagccaaggggctggggggcggggacggtgcccaccccccaggcccccactcttcccccaggcgcccaccgccgcggaccccgggagggaggaggggtccggggaaagcgaccccagctccttcctcccaaggcgagtatgtttaccctgctgggcacccttccgctccgcggggaccactgcgggatcgcgctctctaaaactcctctcaactgccccgcagtgcgcggcggccttttccgccaggttttttgg

SEQ ID NO: 34665 - DNA, 285 bp, Homo sapiens
  misc_feature 1..285: note = chr12:113917232-113917517
  misc_feature 1..285: note = hyper
  source 1..285: mol_type = genomic DNA
agtgagcttcgtgcacggcatttttcaccctctggaagaagccagatttcgggcaaggtagaacgtgagaagaatcccttttatactggctcctacgaaaggaaccagaaaaaaaaataatacacattttgagcagcctctgtgggtgcagcttgttgaactcggagccagacgctttttctggcgaaacggagaaaaaacgccgcggaaacggtgcgcagggttggggagtataggttctgattgcaacataattccgcaagcttttttattttttatttttcc

SEQ ID NO: 34666 - DNA, 121 bp, Homo sapiens
  misc_feature 1..121: note = chr12:113917580-113917701
  misc_feature 1..121: note = hyper
  source 1..121: mol_type = genomic DNA
cgggtcttggggcgaggcttagctggtctgggggtccttgcgtgtccacagccccggatacgcacccgcgaaacgttcgacatcgccgcttttttgttttgttttgctttgtttttttagt

SEQ ID NO: 34667 - DNA, 160 bp, Homo sapiens
  misc_feature 1..160: note = chr12:113917730-113917890
  misc_feature 1..160: note = hyper
  source 1..160: mol_type = genomic DNA
cgcggccggctggggcctcgggcagtgacagtgaaacgaattccaaacccattctgaactcgccatggcgctctcctgccctccaacacccaccccaaacaccgtgtaggcagaagcgaggttccccgtgaagccgggttaaaatcggcagctgagatgc

SEQ ID NO: 34668 - DNA, 136 bp, Homo sapiens
  misc_feature 1..136: note = chr12:113918155-113918291
  misc_feature 1..136: note = hyper
  source 1..136: mol_type = genomic DNA
cttctagctccccttcgctctgtgactcttgccttcccctgaatttatttcccttttgggggactcaccttagaacctgcgccctgtacacaggtgtatatacatatatcaaagaacaaaacgattgattgaaaac

SEQ ID NO: 34669 - DNA, 192 bp, Homo sapiens
  misc_feature 1..192: note = chr12:113952930-113953122
  misc_feature 1..192: note = hyper
  source 1..192: mol_type = genomic DNA
gaagtaactctaaaacgcgtgatggaggccaaggggccgccgcccgggctgcagctgaaacggcgctttcacaaacaagacgtaaattggatgcaaacatctaattaaccttctccctcagttccctccgcagagggggaggtgggcctcctagggctcccagcgcctgtcttccctcgggggatggatttg

SEQ ID NO: 34670 - DNA, 42 bp, Homo sapiens
  misc_feature 1..42: note = chr12:113953467-113953509
  misc_feature 1..42: note = hyper
  source 1..42: mol_type = genomic DNA
ggacaccgagcatcccgggccatcggacgcagcaggtgcaag

SEQ ID NO: 34671 - DNA, 368 bp, Homo sapiens
  misc_feature 1..368: note = chr12:113957639-113958007
  misc_feature 1..368: note = hyper
  source 1..368: mol_type = genomic DNA
ccatttgttaaggggcgaaagtcctcaggtgcatcccgaggctggacaatttgtctctgtgaaaaggacgctattatcagagaggctggatgcaggcggagggcgggcccgaggggcggcttgggagggggaggctcggaggagcgaaggggctcaggcaggggtgggggggcggaggccgagacaatggggggaaaaataataaatacatcggagcgtgccagccgcggggatcctggctggagaggcgcgaggggcaggggggctgcttggggctggaggagctcatgtgctcgggcctcggaagccaattcctttttcatgacccttgtccaggaccagaagggtgtcgccggggagctctgccg

SEQ ID NO: 34672 - DNA, 207 bp, Homo sapiens
  misc_feature 1..207: note = chr12:114029630-114029837
  misc_feature 1..207: note = hyper
  source 1..207: mol_type = genomic DNA
acctgcagctcaacccgcctaggagaggcgctcgccgagctcgattctccgggtgccataaattaggacgccagtcgccggcgaacgctgggggcttccagtataccttccagcgcagcccgcaggctatttttatctccctcagcacctcggcacctcggaggagcttctgctaattcactaccccgacaccgtctcatctcccct

SEQ ID NO: 34673 - DNA, 96 bp, Homo sapiens
  misc_feature 1..96: note = chr12:114075780-114075876
  misc_feature 1..96: note = hyper
  source 1..96: mol_type = genomic DNA
gctcgagttcaaggacgcagagaggacgggagggggttaaagcccattcaaacgcgcagccccccgcccccggctcgccccccactccccgccggc

SEQ ID NO: 34674 - DNA, 184 bp, Homo sapiens
  misc_feature 1..184: note = chr12:114075909-114076093
  misc_feature 1..184: note = hyper
  source 1..184: mol_type = genomic DNA
cgcgtttcacacagcgcacaatggccgccctcaaaggcgcgccgcccgcattgttcgggccggcgcccgcgcgtcctacctccgcgcgcgaattaacccccgtcaccccgccattgtcaccgcgcacttcggggccggccacaaaggcgccagaaaaccctgccgtgttcggaagggtgggggg

SEQ ID NO: 34675 - DNA, 359 bp, Homo sapiens
  misc_feature 1..359: note = chr12:114833767-114834126
  misc_feature 1..359: note = hyper
  source 1..359: mol_type = genomic DNA
tccccaccgaacttgcgaatcgccgcgtttaacagcctgaaaatctggcctgctttttcccgggaactgcggaggttgtctctgtgactttgattatttgcattgatgaccctggggcaagattcttggaccaaccctggagtccggccccgatcgagtggaggtagttgggggaggcgagccgcggccgggggcgggggagggacgaggaactcgcgggccccgcggctgcccgaccccgggccgcgcgtctctaatctccggccgccgtggcccggccgcctccccggccgatagcgacgccgaccggggcggcgtggcgacagagagacgcagcggggccccgctggccgccacag

SEQ ID NO: 34676 - DNA, 30 bp, Homo sapiens
  misc_feature 1..30: note = chr12:114834466-114834496
  misc_feature 1..30: note = hyper
  source 1..30: mol_type = genomic DNA
cgtcccacttcccagcgtcaaggaccacgc

SEQ ID NO: 34677 - DNA, 477 bp, Homo sapiens
  misc_feature 1..477: note = chr12:114838373-114838850
  misc_feature 1..477: note = hyper
  source 1..477: mol_type = genomic DNA
ggaggcctctccctccgagccccggagccaaagcctcgcagtgtttatcagcctgagcgagcgcgcccggaggcggaggcgcagaagacttcgcaggccttttatagttaaatcctcacggctcaggctcggggggaaagagggactcggacgtgtctttccttcctgggggaataggaagaggactgcagttcgttgatataaacagaacgcgcctcctagttcactcaggccttgggccgagcggggagcagactttgtttaattttaaataataataaatgtcactgttgtcagtttattgagggaggcttcggctggagaacgggggcggggggcgtctggaaaggcggctccaccctcccccttcacacactcggtggcttgggcctaccgttcgcctgctccacacgcctgctcggggcatcctctggctttttgctttgcgggacgcggaagacccgtccagcacgggta

SEQ ID NO: 34678 - DNA, 149 bp, Homo sapiens
  misc_feature 1..149: note = chr12:114841034-114841183
  misc_feature 1..149: note = hyper
  source 1..149: mol_type = genomic DNA
acaaatggtgcggcgcgcgggtctagtcggcggcgcggaggaggcaggaggaggcaggaggaggcgggaggaggcgaaggctacggaagatcagaagaggggtcaagccatcgctcatgccggcctgaatcggccgctgacctggccct

SEQ ID NO: 34679 - DNA, 30 bp, Homo sapiens
  misc_feature 1..30: note = chr12:114841854-114841884
  misc_feature 1..30: note = hyper
  source 1..30: mol_type = genomic DNA
agctaccagcacctccgttcccagccgaag

SEQ ID NO: 34680 - DNA, 72 bp, Homo sapiens; identical to SEQ ID NO: 11445
  misc_feature 1..72: note = chr12:114843007-114843079
  misc_feature 1..72: note = hyper
  source 1..72: mol_type = genomic DNA

SEQ ID NO: 34681 - DNA, 520 bp, Homo sapiens
  misc_feature 1..520: note = chr12:114843285-114843805
  misc_feature 1..520: note = hyper
  source 1..520: mol_type = genomic DNA
cggggagctccgagccgcgcaaaatctctgcaagctgtgctctgcagaatgcaaagccgggctggaatccgccattcccgccgccccagccgactcggccgacgagctccctcctgagcctcccgggccatctgccgggacggttacctcgttcggtgaagccggtgcattcaccacatcctctgctgctcctagcagggaagccggcggtgaggcgggggagcaggcatggtggctccggggtttatgcggggtttactgcttacccagaatagcggctactgctgcctactagggcgcacctaccgctggagcctccgcggcgactgcccacctccaacacacacctcctctgctgtgcgcttgctctccctaaatacttcccagttggcaagcgccaaagaacacaaaatagcctccaagagcaccggcaaccatataatctcagtgccccgctcctcctttacacccccagggagggaaagttggaagcccagtgaatggtcgaagtcctttctga

SEQ ID NO: 34682 - DNA, 190 bp, Homo sapiens
  misc_feature 1..190: note = chr12:114844184-114844374
  misc_feature 1..190: note = hyper
  source 1..190: mol_type = genomic DNA
acaaatcatttcaaacgcggtcggcttctaatcgggaagtaatctcagtgacgctggcggtgcagagaaccgagtctggacgcacacacacaaacacaccgcgggcctccgcagccttgcagacattctctccaacgctgacctcgagaaggagagctgcctgaccccgcctggccggcgctcgccttcc

SEQ ID NO: 34683 - DNA, 175 bp, Homo sapiens
  misc_feature 1..175: note = chr12:114845868-114846043
  misc_feature 1..175: note = hyper
  source 1..175: mol_type = genomic DNA
gactatctcaccagccgctgcacctataggacttggagacgtcacgagtcacgcaaccggcccgcgcgctgtcacgtttggctggggggcagcggcgggaggtaaatttctctccgtcttcgcctatcagtgccgggtctgcgcagccacaggttccggacgtcttggccccggg

SEQ ID NO: 34684 - DNA, 491 bp, Homo sapiens
  misc_feature 1..491: note = chr12:114846456-114846947
  misc_feature 1..491: note = hyper
  source 1..491: mol_type = genomic DNA
tccaagaatgcaattcgtcccagagtggcccggcaggggcggggtgcgagtgggtggtggagtaggggtgggagtggagagaggtggtttctgtagagaataattattgtaccagggcccgccgaggcacgaggcactctattttgttttgtaatcacgacgactattatttttagtctgatcaatgggcacaatttctaagcagcgcagtggtggatgctcgcaaacttttgcgcaccgctggaaacccactaggttgagttgcaaaacgtaccgcgtagacgcccctggtggcgccgagagaagagctaggcctgcccagcacagagccggagagcgtcgggccttccggaagggtaagttctccgccaaggggtcccgagggagctggacgtctgaatctggacttgcccccagcttcggggttcgattctgggttttgcgcgtccccaacccccagggctttccgaagcatggcctggctccaggcc

SEQ ID NO: 34685 - DNA, 122 bp, Homo sapiens; identical to SEQ ID NO: 3956
  misc_feature 1..122: note = chr12:114847042-114847164
  misc_feature 1..122: note = hyper
  source 1..122: mol_type = genomic DNA

SEQ ID NO: 34686 - DNA, 272 bp, Homo sapiens; identical to SEQ ID NO: 3957
  misc_feature 1..272: note = chr12:114847165-114847437
  misc_feature 1..272: note = hyper
  source 1..272: mol_type = genomic DNA

SEQ ID NO: 34687 - DNA, 78 bp, Homo sapiens; identical to SEQ ID NO: 3958
  misc_feature 1..78: note = chr12:114847577-114847655
  misc_feature 1..78: note = hyper
  source 1..78: mol_type = genomic DNA

SEQ ID NO: 34688 - DNA, 62 bp, Homo sapiens
  misc_feature 1..62: note = chr12:114852127-114852189
  misc_feature 1..62: note = hyper
  source 1..62: mol_type = genomic DNA
ccctcccaggcactgcgttctgcggccgggacagcacccgccaggcgcggcccttctcctat

SEQ ID NO: 34689 - DNA, 162 bp, Homo sapiens
  misc_feature 1..162: note = chr12:114877171-114877333
  misc_feature 1..162: note = hyper
  source 1..162: mol_type = genomic DNA
aaaaggccgccacagcggcggggcccagggagaaaaagcagcgttcccaattcccatgcttccagctccaggttgtcggtcttttgtcagcctccgaagccagggtgctcaacctggccccctttctttcctgctggtgaggccacccgctttgggacagaa

SEQ ID NO: 34690 - DNA, 227 bp, Homo sapiens
  misc_feature 1..227: note = chr12:114878367-114878594
  misc_feature 1..227: note = hyper
  source 1..227: mol_type = genomic DNA
ataattccatgcccacgagccgacagatttgcaattctcaagtacttctatgtgcatgtaattctacgggcaaattgttccgagtgcaagggatttggtgtgtgtgtcagtgattgcaccgctgaaaacaattctgtagatgtgtcgatgcctttagaagaaagggctccaaagaatcgtgtctcgatggttggtcagcgcgcgcatctgcggcactggctaaatcc

SEQ ID NO: 34691 - DNA, 204 bp, Homo sapiens; identical to SEQ ID NO: 11455
  misc_feature 1..204: note = chr12:114878808-114879012
  misc_feature 1..204: note = hyper
  source 1..204: mol_type = genomic DNA

SEQ ID NO: 34692 - DNA, 450 bp, Homo sapiens
  misc_feature 1..450: note = chr12:114881634-114882084
  misc_feature 1..450: note = hyper
  source 1..450: mol_type = genomic DNA
ctgggaggggagggtcgctggggtcgctgggcgcgcgcgcgcggagcaaatttgcccgcgcgcacccagaaacgatgacataagtggcgctgatgagcgctgcgcggctgaaacgcgactacataaagggtccgccggcagcgtgggccggagggattgcttcacactccggaattgggcccagacacatttagaaatgttttgctggacgtgtgccccgcaagggcgacagcggcagccggcagcctgggtgaagctgcgccgctggtcacaggctggcgcgcggcggcggccacagaggcgtcctaggtggagaatgcttctgcctttgcctgttctcccctaacccccacgtttgtatgcctcctggggacaggggtctgtctgcagcctgcagcgccccagctgtgaccagagaagcattaaggagcggcgcgggcaagaatttgg

SEQ ID NO: 34693 - DNA, 30 bp, Homo sapiens
  misc_feature 1..30: note = chr12:114882616-114882646
  misc_feature 1..30: note = hyper
  source 1..30: mol_type = genomic DNA
cccgtgccccaatttcgccagacttaacga

SEQ ID NO: 34694 - DNA, 83 bp, Homo sapiens
  misc_feature 1..83: note = chr12:114883452-114883535
  misc_feature 1..83: note = hyper
  source 1..83: mol_type = genomic DNA
ttgtttgaggatccccgcgccacataaatcctgcttcgagattaatctccctgctcgctcgcgctgggcgcagtgattttttt

SEQ ID NO: 34695 - DNA, 30 bp, Homo sapiens
  misc_feature 1..30: note = chr12:114883832-114883862
  misc_feature 1..30: note = hyper
  source 1..30: mol_type = genomic DNA
tgtgccattgtgggtcggctgttgggttgt

SEQ ID NO: 34696 - DNA, 39 bp, Homo sapiens
  misc_feature 1..39: note = chr12:114885145-114885184
  misc_feature 1..39: note = hyper
  source 1..39: mol_type = genomic DNA
ttggccagagcctggcgggttccgtgcttggctagccag

SEQ ID NO: 34697 - DNA, 15 bp, Homo sapiens
  misc_feature 1..15: note = chr12:114885371-114885386
  misc_feature 1..15: note = hyper
  source 1..15: mol_type = genomic DNA
cgctggaagaaacga

SEQ ID NO: 34698 - DNA, 61 bp, Homo sapiens
  misc_feature 1..61: note = chr12:114885605-114885666
  misc_feature 1..61: note = hyper
  source 1..61: mol_type = genomic DNA
ccgggtctccttctgcgggaacatacgccccagtcagctgaggtgccggctgactttcccc

SEQ ID NO: 34699 - DNA, 421 bp, Homo sapiens
  misc_feature 1..421: note = chr12:114917674-114918095
  misc_feature 1..421: note = hyper
  source 1..421: mol_type = genomic DNA
tgactttggccacctcgcagtcttttagggtcgccggaccggcttcctggaatacctgaggtcgcagattcaggtagtaaacagatgtggggtccaccctccgccaaatgggcggggcaagttcaacatcccgcctccccgaccttaagtgcgcagggcgcctggtgctcgcttgccgaaaacgttaaacatttttctttgatcccgctctttttttggggggaaaaatgtctggggaagagggaagtagtgggggagtgaggtgcctgcccaagcgaaattttgatgcccgcctgcctctggctccagctccgccctcacggaagggggagaacttcgaattccagaaccggaatccttgcctaatttttttttttttttttttttgaaattgatcgattttatccgggagcttcaaatc

SEQ ID NO: 34700 - DNA, 130 bp, Homo sapiens
  misc_feature 1..130: note = chr12:114918587-114918717
  misc_feature 1..130: note = hyper
  source 1..130: mol_type = genomic DNA
ggagaaggcaagatccggcaggcgacgctgattagctgggggtctccgatgcgaccccggactcggagcaggaaatcctgggtgctcctgaagctccgcctgccccgggttccagcgagagcacctcgtc

SEQ ID NO: 34701 - DNA, 38 bp, Homo sapiens; identical to SEQ ID NO: 11459
  misc_feature 1..38: note = chr12:115106464-115106502
  misc_feature 1..38: note = hyper
  source 1..38: mol_type = genomic DNA

SEQ ID NO: 34702 - DNA, 130 bp, Homo sapiens
  misc_feature 1..130: note = chr12:115121885-115122015
  misc_feature 1..130: note = hyper
  source 1..130: mol_type = genomic DNA
agagagagagagagacggagtcggagagggagggagcgagagaaagcgagagctcctcgccaccctccgccgcctctagaattcaccgggcgtctgctcggcggctctagaaggtcgggctgcgctgtgg

SEQ ID NO: 34703 - DNA, 40 bp, Homo sapiens
  misc_feature 1..40: note = chr12:115130675-115130715
  misc_feature 1..40: note = hyper
  source 1..40: mol_type = genomic DNA
caggctcagagagaacgcagccgagcgggggaatcttcgt

SEQ ID NO: 34704 - DNA, 73 bp, Homo sapiens
  misc_feature 1..73: note = chr12:115889703-115889776
  misc_feature 1..73: note = hyper
  source 1..73: mol_type = genomic DNA
gcccggggcgaggggcgagcggcgcgcggccgtgcggctcattctaccgccctgcgtgcgaaggggaggccgc

SEQ ID NO: 34705 - DNA, 105 bp, Homo sapiens
  misc_feature 1..105: note = chr12:116946095-116946200
  misc_feature 1..105: note = hyper
  source 1..105: mol_type = genomic DNA
tctcagcggctccagcgttttcaaggagcggggtcaaggtcaaagggcccctcccaggctgcccgggcggggctgtagtgggatgctggtccccaggctgcgcct

SEQ ID NO: 34706 - DNA, 118 bp, Homo sapiens
  misc_feature 1..118: note = chr12:116946250-116946368
  misc_feature 1..118: note = hyper
  source 1..118: mol_type = genomic DNA
cgccgccggagagggtcccagcgcgcccaggcctcccgcaggcgggacgcggcgtcggggggctgctgcgctgctcggccccagcgggcccgccgcgccgccgcggctctggctgcct

SEQ ID NO: 34707 - DNA, 291 bp, Homo sapiens
  misc_feature 1..291: note = chr12:117319805-117320096
  misc_feature 1..291: note = hyper
  source 1..291: mol_type = genomic DNA
ctaaagtgcccccagcgcccggtgggaggctggatgggcccacctgagctcgcgtggggcgcggacggaggcattctcgctgcccggcacccgcacccaaaagaccctcgcaaggggctttctaaagggaaacttcttgtctgctttctttgtgaacattattttcctgatggcgttacagttttctgcgatgaccccgatttaatgcgcagtggagaccctaaggggtcggcgagaggaggggcgcgggggactttaattcccccttttccaatccgacagccactcctg

SEQ ID NO: 34708 - DNA, 321 bp, Homo sapiens
  misc_feature 1..321: note = chr12:117798084-117798405
  misc_feature 1..321: note = hyper
  source 1..321: mol_type = genomic DNA
tggcgtcctctggggcgcagtcccgagagagccccttccgggacctcggacgcaaggcccctgagtggccctggaagttggatcccccggggaccctgctccgaaccctggccacctggaagcaacctcatcgagcgctccttccactgcccagccccgaaccgtggcggaacgcgcccctcggcctccctagagcctcctttgcgggagaagcacaactttcccaggttttggagacggcgctcttacaccccaatctcgcccagacggaagaagtgagaggtgcgggcggccccgccatgaccgcgggaggagagcgca

SEQ ID NO: 34709 - DNA, 193 bp, Homo sapiens
  misc_feature 1..193: note = chr12:117799086-117799279
  misc_feature 1..193: note = hyper
  source 1..193: mol_type = genomic DNA
ggttgcacccactcgcctcctggtaggagccgcgcgcgtccctccccttcccctccgctttgtgcctccaagatccctccccaccccctctcccctagcccccactcctcccttctcttcttccctccccttgcgtcccctccctcagcctcagcgaacccaagttcgggacggaggctgcgggcttccccgg

SEQ ID NO: 34710 - DNA, 208 bp, Homo sapiens
  misc_feature 1..208: note = chr12:117799330-117799538
  misc_feature 1..208: note = hyper
  source 1..208: mol_type = genomic DNA
cgctgctcgctgcccggccgcccctcggaggagccgcggcgctaagtagctcctcacccagcggctggaaacgcggcataaatatgtagggactgagccgtgagctcagcgagggtcgtgagggggaatttatttcttaatgtccctcctttatcctatcatcactgaaacgaattagcagtgacgtccaacccgactggtttatggg

SEQ ID NO: 34711 - DNA, 88 bp, Homo sapiens
  misc_feature 1..88: note = chr12:119212112-119212200
  misc_feature 1..88: note = hyper
  source 1..88: mol_type = genomic DNA
cggggcgtttgaacacgaatttggaggtccttgtttgtccttgaacgcggcagggagtggaggaaggcgccgggaggaggcacaaaat

SEQ ID NO: 34712 - DNA, 88 bp, Homo sapiens
  misc_feature 1..88: note = chr12:119212318-119212406
  misc_feature 1..88: note = hyper
  source 1..88: mol_type = genomic DNA
cgctgctgaaatgcaatggacaaaagggagaggaatggccgcatcttccggctgcccgttgctatggtttccgcggagctggtgaagg

SEQ ID NO: 34713 - DNA, 62 bp, Homo sapiens
  misc_feature 1..62: note = chr12:119417764-119417826
  misc_feature 1..62: note = hyper
  source 1..62: mol_type = genomic DNA
ctgcagagcaagtagcgctctcaggcactcaaataagcggacgcaggcgtgtcgaacacaca

SEQ ID NO: 34714 - DNA, 808 bp, Homo sapiens
  misc_feature 1..808: note = chr12:119418516-119419324
  misc_feature 1..808: note = hyper
  source 1..808: mol_type = genomic DNA
aaaagtggctgcaggcggattccccaggagtggatgggggtggggtggggtgagatgggaactctttcctctggacggggttggcggcggggacgctgggcaggccggctgtgagacacaaaagagatacccttgacagctccgcatgcacagatgtaacgctgcgccccttggcgggcgggggccctgctcggcagatggcgagaagccgaattggtgagggattgtctatcaaatggcactttctgggtggtggagacctcgctaacccccggcgcaaagaggaacgcagggcaccctctgtaccggcctaggccgtgtctcccaaaagtgagggtctgggggaggccggctggggtggatagattaagttttttacgagcccccccaaccccccccccccccccacgcagaagatcagctacaagacttgcgaaggggctggaaagaaaggtggcctggcccaaagggggcacccaggaaagggctgaggaaggccagcgatgatgggagaggagaggggcctgggaagcaggatctcctgcctggcgcagattggggtgccaggatggcttctcagagggatcagcgctgcaactcggtcgccgcggggccctggtgacaggcgcacgccccgccctttctcctcccaagacctgcgggcttttgttatgcagatggcggcaggaggctgagcctgaggaggagggggttggtggggaggaggagagacggagaggggggaggaaagtgcagctcgcgcgaccagcctcctcttccaacgtcacattgtgcgagagacaaaacc

SEQ ID NO: 34715 - DNA, 432 bp, Homo sapiens
  misc_feature 1..432: note = chr12:119419368-119419800
  misc_feature 1..432: note = hyper
  source 1..432: mol_type = genomic DNA
cgtcgcctcttctctcctggtgctgcccagaaagccagccctcccttcccttcttggggcgcagaggctcagccagctcagagcgcagcctggagccgacccagaagggcgaagaaagcccagcggacgagcctcctttctctgctgcctgcccgggctggggcgtcccatcccccgccctgaactccgatctctcccaccccacccctctctgggtttcacccggacagagccgggagctgggtgtcgcccccgtttggaatccacgtttcagcactttggacagcgccccggacgccccggcccctttgggttggcgatggcgagcgttcagcaaggcgagaagcagctttttgagaagttctggcgaggaaccttcaaagcggtggccaccccccgtcccgagagcatcattgtcgccagtatcacggc

SEQ ID NO: 34716 - DNA, 30 bp, Homo sapiens
  misc_feature 1..30: note = chr12:119446620-119446650
  misc_feature 1..30: note = hyper
  source 1..30: mol_type = genomic DNA
tgacactaattgatacggagtttccccctc

SEQ ID NO: 34717 - DNA, 91 bp, Homo sapiens
  misc_feature 1..91: note = chr12:119458719-119458810
  misc_feature 1..91: note = hyper
  source 1..91: mol_type = genomic DNA
aaggagatgccttctcgcccgtagagggcgctgtagaggcagcgggaaagtgattcctagagacggtggggggaggcgctgtgttctgctg

SEQ ID NO: 34718 - DNA, 119 bp, Homo sapiens
  misc_feature 1..119: note = chr12:119499184-119499303
  misc_feature 1..119: note = hyper
  source 1..119: mol_type = genomic DNA
tttcctagagcctgacggcggttcagcaccagggacagcgaccactgattaaataacaggctgcagtgaatccaaccatgaaagcactacctggctgttgcagccgtccttgcctattg

SEQ ID NO: 34719 - DNA, 30 bp, Homo sapiens
  misc_feature 1..30: note = chr12:120031836-120031866
  misc_feature 1..30: note = hyper
  source 1..30: mol_type = genomic DNA
atggtgagtgaatcacggccagaggcagcc

SEQ ID NO: 34720 - DNA, 29 bp, Homo sapiens
  misc_feature 1..29: note = chr12:120032345-120032374
  misc_feature 1..29: note = hyper
  source 1..29: mol_type = genomic DNA
cttctctctttgctgcgcccaagggcacc

SEQ ID NO: 34721 - DNA, 56 bp, Homo sapiens
  misc_feature 1..56: note = chr12:120032375-120032431
  misc_feature 1..56: note = hyper
  source 1..56: mol_type = genomic DNA
cttccgccactctccggggggtccccaggcgattcctgatgccccctccttgatcc

SEQ ID NO: 34722 - DNA, 153 bp, Homo sapiens
  misc_feature 1..153: note = chr12:120032454-120032607
  misc_feature 1..153: note = hyper
  source 1..153: mol_type = genomic DNA
cgctctgtccaggcaacagtttcctctcgcttcttcctacacccaacttcctctccttgcctccctccggcgccccctttttaacgcgcccgaggctggctcacacccactacctctttaggcctttcttaggctccccgtgtgcccccctca

SEQ ID NO: 34723 - DNA, 483 bp, Homo sapiens
  misc_feature 1..483: note = chr12:120032837-120033320
  misc_feature 1..483: note = hyper
  source 1..483: mol_type = genomic DNA
ctctctaggagtggccgctggggcctctagtccgcccttccggagctcagctccctagccctcttcaaccctggtaggaacacccgagcgaaccccaccaggagggcgacgagcgcctgctaggccctcgccttattgactgcagcagctggcccgggggtggcggcggggtgaggttcgtaccggcactgtcccgggacaacccttgcagttgcgctccctcccccaccggctcacctcgcctgcagctgggccacggaactccccggccacagacgcagagccctgattcagcgctgtgaaaatcgctagccacccgtcccccatcaagtccgcccacacttgcccacgggtggtggcaccatattcgattcgtgggcacctgcaaggctccatttgcacccgtaacttgccctttcccaaacccggtttgtggacagcgtctgcaccgatatgaaagcgtgcagccgctgaagttcagac

SEQ ID NO: 34724 - DNA, 32 bp, Homo sapiens
  misc_feature 1..32: note = chr12:120807600-120807632
  misc_feature 1..32: note = hyper
  source 1..32: mol_type = genomic DNA
acccactcagtgcctcgcgtcccgagtgggga

SEQ ID NO: 34725 - DNA, 193 bp, Homo sapiens
  misc_feature 1..193: note = chr12:120807844-120808037
  misc_feature 1..193: note = hyper
  source 1..193: mol_type = genomic DNA
ctctccctccctggccggtttttgtgagatccattcagactcctgtcctgattcgggaaacccggttccagacactcaccacccccaccacaccgaggctggaggaaaaggcagtgcctcttagagcctcctgtttccagtttaggagcccaacgcctcagctgtgcaccgtcccctccgaatgacccccttc

SEQ ID NO: 34726 - DNA, 30 bp, Homo sapiens
  misc_feature 1..30: note = chr12:120826930-120826960
  misc_feature 1..30: note = hyper
  source 1..30: mol_type = genomic DNA
gcggccctgggaacccgggaaggaggcgag

SEQ ID NO: 34727 - DNA, 191 bp, Homo sapiens
  misc_feature 1..191: note = chr12:121566850-121567041
  misc_feature 1..191: note = hyper
  source 1..191: mol_type = genomic DNA
gaggttggcccttgacgccctgtgtgattatggccccgcccacagccatagctgattggaccagggataaagaattaggccaatcagattcattccccttgagttctggaactgggcaggggatctgggcttgcatttgaactgtggaacctaacttggagagcattgctgaaccacgtgccctgggagaa

SEQ ID NO: 34728 - DNA, 36 bp, Homo sapiens
  misc_feature 1..36: note = chr12:122667836-122667872
  misc_feature 1..36: note = hyper
  source 1..36: mol_type = genomic DNA
gctgggtgcgggcgccggggccggaactctgggggc

SEQ ID NO: 34729 - DNA, 527 bp, Homo sapiens
  misc_feature 1..527: note = chr12:122688648-122689175
  misc_feature 1..527: note = hyper
  source 1..527: mol_type = genomic DNA
cggcccgggggtccccgcagagtgggtctctgctgccgtcagcccttcggagactgtcgcgttgaaagaatgaaccagagttcgccccctgcccgcgccagggcgttttgggtcaccgagtcctgtggggatccgaggcggctgccgcccaaggccgagcgcagcctcaggacccgcgccccaccagacggggtcgtgcgctccgcggcgggtggagagccgggctctggggtctccgcggctcggagggcggcggggcgaggccgtgcggccagcgcctggggacgcccgcggcgggacaggggccacccgggccgcggcgcagcctgggctgaaacctcctgggacggaaccaagccacctgctgtgcgcccttctcggtgaatggcaccgccgcccgcccgggcctctcgtccacagcccgcggtgctcgcacacctgagactcatctcgcttcgaccccgccgccgccgccgcccggcatcctgagcacggagacagtctccagctgccgttcatgcttcctc

SEQ ID NO: 34730 - DNA, 156 bp, Homo sapiens
  misc_feature 1..156: note = chr12:123920515-123920671
  misc_feature 1..156: note = hyper
  source 1..156: mol_type = genomic DNA
aagaaaaaagagaaaagagaagagaaaagaaaaggaaggcgtctccctgccagtaggtgccctcctacgccccgcaggcgccgtgggcccggaaccctcgctcccacactcacctccccgctggccggagggctctgtctccgcagcccctccacc

SEQ ID NO: 34731 - DNA, 42 bp, Homo sapiens
  misc_feature 1..42: note = chr12:124779516-124779558
  misc_feature 1..42: note = hyper
  source 1..42: mol_type = genomic DNA
ggagcgggagggcctcggcggaggcgccgggccggggctgtt

SEQ ID NO: 34732 - DNA, 416 bp, Homo sapiens
  misc_feature 1..416: note = chr12:125534006-125534422
  misc_feature 1..416: note = hyper
  source 1..416: mol_type = genomic DNA
accctcctttggcagcgcagaagtcaagctagaggtcgtgaccccctggagtctcggtggtttcgggttggggagcagagcgggtggggcaggaccgactcgccggtgccagtcaggatatcaaggtgacagcgcccggcactggccttggtcgaagggtgactccgccccattgctaagctccgattgggcacgcccttttctggttcttcttcaggattggctgggaggtgcggcctatgaaccggaacgcgtcgcgattggttggcgctcaggccgatcttccagacgcggaggcctgggccgatgtggcccaactctctgccagccaatcagcgctcgggctgagtgtggcgcgtgagtgtgtccgggatccctccgccgcccgggcgttggggtcgcgggaagggagggga

SEQ ID NO: 34733 - DNA, 159 bp, Homo sapiens
  misc_feature 1..159: note = chr12:125670102-125670261
  misc_feature 1..159: note = hyper
  source 1..159: mol_type = genomic DNA
ctggatggaagaattcgaccacctagtacccggccctgcgcaacacctccgctccgtcactgcctgaccctgcgctgggaactcattcccgggaccgccagggaatctgcccttcccaggagaactcctggctgcctccgcgtgctcctagggcctgcg

SEQ ID NO: 34734 - DNA, 111 bp, Homo sapiens
  misc_feature 1..111: note = chr12:125670334-125670445
  misc_feature 1..111: note = hyper
  source 1..111: mol_type = genomic DNA
cgccttcgctgtgtttcaggtcaccgcacccagcctgcgcacccctagcccccatcccggtgccgtgcagaggctctgcacacagcctcggcctcccggaggccctcccct

SEQ ID NO: 34735 - DNA, 369 bp, Homo sapiens
  misc_feature 1..369: note = chr12:125671544-125671913
  misc_feature 1..369: note = hyper
  source 1..369: mol_type = genomic DNA
gaacccaggagcccccggcgcgttcccctttgcctagcgcctggggagagcccgcctgccttctcccccaaacccttagcttccttgcggatcctttcgggacgcacgggggccacagaccggggcactcagcctctcgaggcgggtggggacgcgactgcaggaatcgagccccctccccgccctgccttgggccaaatcccccccaggtcccagttcctccaggggttttgctgggcgggggcgtcgacgcagcccttctccagtgtcttgctgcccgcggtcgcacagtggtgcgttcccgggacacctgcgggccccggagatgtctcggccggcgctgtctggcttgtccgcagcccctcccca

SEQ ID NO: 34736 - DNA, 268 bp, Homo sapiens
  misc_feature 1..268: note = chr12:125672764-125673032
  misc_feature 1..268: note = hyper
  source 1..268: mol_type = genomic DNA
tggcattgggcttaacgtggatgaatcttgcctgcttggctaaggagcagctatgatagctgttttgctttcggcattcctctgcggtccacgagaggggctgctgctggggccgaggctgttttctcttagctgaagccctgggacctgtttgcaaaagtgcagtccctcggacttgaaaattgcagttttgtctctattttgtttctccacgggggtcagcatttgcctggatgtgcttataagtgaatatcggaagtctctcaga

SEQ ID NO: 34737 - DNA, 244 bp, Homo sapiens
  misc_feature 1..244: note = chr12:126168427-126168671
  misc_feature 1..244: note = hyper
  source 1..244: mol_type = genomic DNA
gcacaggtggccccgcgcctctcacacaggttcagctcccgccggtccctgtgcagagcgccccctgccggtccctcttggaggctgggccagcgttgcgagtcttgccagggacgcgcgctctagcgccggaggctgggaacgcaccgcggtgccaccgcgtcctgcaggggcggggcgcgcacctggggatgcacctgtcctagaccccctgcgcctattcctcgcccgccccatccttccc

SEQ ID NO: 34738 - DNA, 267 bp, Homo sapiens
  misc_feature 1..267: note = chr12:126675639-126675906
  misc_feature 1..267: note = hyper
  source 1..267: mol_type = genomic DNA
aactctccagagctgcgccgcagacggcgaaaaccagaggtggttacagtcaagtttagggactgcaggagcgaattcccgaaggcttgcaggagccgcccggctctgcctccagcctttctctctgggcctagcgggactctcccaggcaggcccctccctgcccgcgggcgcactttccccgcctgcatctgaggcgtggcgcagctgggagcaaagcacaggtgggctgggcgcggtttggggttcgggcgtggcagagtggcg

SEQ ID NO: 34739 - DNA, 62 bp, Homo sapiens
  misc_feature 1..62: note = chr12:127211316-127211378
  misc_feature 1..62: note = hyper
  source 1..62: mol_type = genomic DNA
cgggcagtggcgggagctggagccgcggtggagacgactcgaggggacgcagcccgcctggc

SEQ ID NO: 34740 - DNA, 30 bp, Homo sapiens; identical to SEQ ID NO: 11481
  misc_feature 1..30: note = chr12:127212512-127212542
  misc_feature 1..30: note = hyper
  source 1..30: mol_type = genomic DNA

SEQ ID NO: 34741 - DNA, 291 bp, Homo sapiens
  misc_feature 1..291: note = chr12:127765158-127765449
  misc_feature 1..291: note = hyper
  source 1..291: mol_type = genomic DNA
ccctgctgagttctacgtgcttgcgcgcttcttcctcgggagagcttccactgatttaattggatatggggatggagagaggaaacagaaacagggaaagaagtgaaaaagggaaggacggggcgcgcgcggcaggggggcaggcggcctggtgcaggtgcatccccaggtgcgcgccacgcccctgcgggacccggcggcaccgcggtgcgttcccagccgccggcgctagagggcgtgtctgcggaaagactcgctgcgctggcccaggctccacgaggggccgacagg

SEQ ID NO: 34742 - DNA, 127 bp, Homo sapiens; identical to SEQ ID NO: 11483
  misc_feature 1..127: note = chr12:127865735-127865862
  misc_feature 1..127: note = hyper
  source 1..127: mol_type = genomic DNA

SEQ ID NO: 34743 - DNA, 310 bp, Homo sapiens
  misc_feature 1..310: note = chr12:128751133-128751443
  misc_feature 1..310: note = hyper
  source 1..310: mol_type = genomic DNA
cgcaccccgccttcacgctccgctgcgcgctgcttttccgcgctcagtgatccagttaggagctctccccgcagcagctgcgcgggactttgcattccagatgtccccagccctccaggctaaagcagcggccacctgaagttgaggaatggggcgtgacgaccaccaggtcccgcagtgaccacgggagggtggggagaaggagtccagctccgccttgagcgtcgggtccctgggcaggaccctccgggccacgggccgctgtccgttgggcacccgggcaggagtctgcgaacgctgagtttctctg

SEQ ID NO: 34744 - DNA, 184 bp, Homo sapiens
  misc_feature 1..184: note = chr12:128751694-128751878
  misc_feature 1..184: note = hyper
  source 1..184: mol_type = genomic DNA
aggctgcggaggctgcgggagaaaagttgtcccggccggagcgcgagcagcggcggagccggagccgccagagccagagccggagctgcggcggcgtggacccggcaggggcgggcctcggacagcagagacgcagcgggcccggccgaccgggctgcgggagtggccccgggcatggggcggc

SEQ ID NO: 34745 - DNA, 153 bp, Homo sapiens; identical to SEQ ID NO: 3963
  misc_feature 1..153: note = chr12:128752114-128752267
  misc_feature 1..153: note = hyper
  source 1..153: mol_type = genomic DNA

SEQ ID NO: 34746 - DNA, 741 bp, Homo sapiens
  misc_feature 1..741: note = chr12:128752499-128753240
  misc_feature 1..741: note = hyper
  source 1..741: mol_type = genomic DNA
ccaggagggaaggcccggttctttgcatcccctttccgcaaccgctagggtctctgtgcgggccctagaggaacgctcactcatcgcgcagctcaccagggaccccagcttggcagaaaccaggggctctctgcgggttctctcaaatgagtcctttgcggtgggggagcgcggatggggaggtgggtgcgtccctcgcgacgggaactacctcaccagcggtcctgtccggggctccttcacctcagtgtcctcttctctacaatgggagtgacggccctgctttgggttggaggaatttaaaggagttaacgtatggcgcccgcagggctcacgaaaggtagccgtgtggtttttccgaccttttttattatgtgcgtgtgcggccgagtggccgcgcggatgcggcggcgggaagggcggggagaggcggtctccagccccaggagccgcggggcaggcggggagcaaggcctaggctctgccagggcagcagctgcccgagtcccggggcgcgcccagggcgtagaaaaaggagagcgtcgctttcctgctccccgcgccctggcgaaggtctcgggttcatttggttaaacggaggtgcgcacatgggtgccctgagccttcgcgcggcgccgcgggtccagtatcggccccaggctctgagcagagaacactcaaagccacccttctcccgcctaatgctctgaggctgagctagaaatgcgttcagagagacaa

SEQ ID NO: 34747 - DNA, 84 bp, Homo sapiens
  misc_feature 1..84: note = chr12:129337826-129337910
  misc_feature 1..84: note = hyper
  source 1..84: mol_type = genomic DNA
agggactgtggtcaccgctggtcctggtccaggtggaaacagaccgcggctaccctggtgatggaccccacggggcacacccgc

SEQ ID NO: 34748 - DNA, 239 bp, Homo sapiens; identical to SEQ ID NO: 1076
  misc_feature 1..239: note = chr12:129338587-129338826
  misc_feature 1..239: note = hyper
  source 1..239: mol_type = genomic DNA

SEQ ID NO: 34749 - DNA, 79 bp, Homo sapiens
  misc_feature 1..79: note = chr12:129338851-129338930
  misc_feature 1..79: note = hyper
  source 1..79: mol_type = genomic DNA
cgctcggcctgtattagccggataaacatattccttgaggcgaagcctgggaagtgccaggattagagcctgcagctta

SEQ ID NO: 34750 - DNA, 30 bp, Homo sapiens
  misc_feature 1..30: note = chr12:130387483-130387513
  misc_feature 1..30: note = hyper
  source 1..30: mol_type = genomic DNA
tctcaagggtccccacgccctctcccttta

SEQ ID NO: 34751 - DNA, 129 bp, Homo sapiens
  misc_feature 1..129: note = chr12:130387796-130387925
  misc_feature 1..129: note = hyper
  source 1..129: mol_type = genomic DNA
cgtcctcacctttggaaaacagggcggccaggctgatgagtaccggcgaccagtggtgccacagcgtccccatctcagacgggcacatcctggagacccggagcgcagatcctccgctccccggcgccg

SEQ ID NO: 34752 - DNA, 156 bp, Homo sapiens; identical to SEQ ID NO: 3967
  misc_feature 1..156: note = chr12:130388279-130388435
  misc_feature 1..156: note = hyper
  source 1..156: mol_type = genomic DNA

SEQ ID NO: 34753 - DNA, 140 bp, Homo sapiens; identical to SEQ ID NO: 3968
  misc_feature 1..140: note = chr12:130389012-130389152
  misc_feature 1..140: note = hyper
  source 1..140: mol_type = genomic DNA

SEQ ID NO: 34754 - DNA, 30 bp, Homo sapiens
  misc_feature 1..30: note = chr12:130498725-130498755
  misc_feature 1..30: note = hyper
  source 1..30: mol_type = genomic DNA
ctgtgctcaagacctcgtccatccctccat

SEQ ID NO: 34755 - DNA, 42 bp, Homo sapiens; identical to SEQ ID NO: 11494
  misc_feature 1..42: note = chr12:130526846-130526888
  misc_feature 1..42: note = hyper
  source 1..42: mol_type = genomic DNA

SEQ ID NO: 34756 - DNA, 164 bp, Homo sapiens
  misc_feature 1..164: note = chr12:130526931-130527095
  misc_feature 1..164: note = hyper
  source 1..164: mol_type = genomic DNA
cggcagcttgcagggcccgctgtctccactagggggcggcgtacgcgcgtctctcgaagccgggacccgcgcggggaggctgcactggctggaaacagcgcctgggcgctcccgcggctcccacctcagagatgtccccaggtgccccacgccccccgcgcgag

SEQ ID NO: 34757 - DNA, 107 bp, Homo sapiens
  misc_feature 1..107: note = chr12:130589202-130589309
  misc_feature 1..107: note = hyper
  source 1..107: mol_type = genomic DNA
gagaggaaaatgactcggaaaccctgttgtgagaagcacgttgctatcccggatgaagggccatttcagccctaagctcaaagccggagctccgaccagcactctca

SEQ ID NO: 34758 - DNA, 564 bp, Homo sapiens
  misc_feature 1..564: note = chr12:130645186-130645750
  misc_feature 1..564: note = hyper
  source 1..564: mol_type = genomic DNA
ccccaagtttcttaccgatgtaaaaattgtagggcttgttttaattaaaagccaatactctccgaggaagtggccccctcctgcacggcgtgcagaaagctggtcagtgaggggggttcctggcgggccccatctccttcccgggcgcttcctagggagaccttgccccgtgcgcagcgtccccaccgcgggggcccgtgcagccgccccccacgccgggtggagcgccgccaacgcgggaagccccagcactgcctccaaagatgtccgcacactccaccctgctccctggaactatcctcaaacgggcagggggcaagcgaggccggtggacgcgggactcgctcctctgacctctccccggccccccgggaggtagcgggagattgcacacgcgatcctgcgagtttccgaactttggaagatcgtgacccggagagaccctgggaggagagggccggccacctcctaggggtgctgtttttttaagggtcaacccaggacgctacgggaagcacctggcgcatccttgggaacagtggggcttggcggtgggcgcccacc

SEQ ID NO: 34759 - DNA, 235 bp, Homo sapiens
  misc_feature 1..235: note = chr12:130646084-130646319
  misc_feature 1..235: note = hyper
  source 1..235: mol_type = genomic DNA
ataaataaactcagccgccaagaaggcatctccagccctgctggcgcgaggccccggctctgcggcttcggagggggcgggggtcaccgcggtacaaaccaagcccgcacttcccgcggggtgggaggcggtgttcaaagtcccgggacgcttcccgcccctcccccttcccgccttcttagaggagacctcggatgagcggccctaaaatccggattctcgagcccctccccct

SEQ ID NO: 34760 - DNA, 89 bp, Homo sapiens
  misc_feature 1..89: note = chr12:130646565-130646654
  misc_feature 1..89: note = hyper
  source 1..89: mol_type = genomic DNA
tctcccgccagtccccgaacttcccgtaacctcggcgtcctcggggtgccggggaccatcccggggaccgccgggaaagggggcgccgg

SEQ ID NO: 34761 - DNA, 128 bp, Homo sapiens
  misc_feature 1..128: note = chr12:130646945-130647073
  misc_feature 1..128: note = hyper
  source 1..128: mol_type = genomic DNA
gcggcccgggggcggggcctgtcagcgctcggcttttctgcccccctttgcctttttgcgagtcttctcatcccgggacgcaaacctcgaaacagctgccggctggtcccggccgaggccggcgcagg

SEQ ID NO: 34762 - DNA, 172 bp, Homo sapiens
  misc_feature 1..172: note = chr12:130647737-130647909
  misc_feature 1..172: note = hyper
  source 1..172: mol_type = genomic DNA
gcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaa

SEQ ID NO: 34763 - DNA, 120 bp, Homo sapiens; identical to SEQ ID NO: 1078
  misc_feature 1..120: note = chr12:130647950-130648070
  misc_feature 1..120: note = hyper
  source 1..120: mol_type = genomic DNA

SEQ ID NO: 34764 - DNA, 48 bp, Homo sapiens
  misc_feature 1..48: note = chr12:131199494-131199542
  misc_feature 1..48: note = hyper
  source 1..48: mol_type = genomic DNA
gttccccttagaaaccgggtgagtgagcctgcacgccagctcccctcc

SEQ ID NO: 34765 - DNA, 49 bp, Homo sapiens
  misc_feature 1..49: note = chr12:131199887-131199936
  misc_feature 1..49: note = hyper
  source 1..49: mol_type = genomic DNA
agtcctccctccctccggccagccgccaccccgacctcagccagcgtgc

SEQ ID NO: 34766 - DNA, 47 bp, Homo sapiens
  misc_feature 1..47: note = chr12:131199937-131199984
  misc_feature 1..47: note = hyper
  source 1..47: mol_type = genomic DNA
ctccccggggacaggagggaggctgcttccaccgaggcctctgctga

SEQ ID NO: 34767 - DNA, 169 bp, Homo sapiens
  misc_feature 1..169: note = chr12:131200355-131200524
  misc_feature 1..169: note = hyper
  source 1..169: mol_type = genomic DNA
ctgagaagcctggggcgcactccccaggcgagcggggccgtgtccatcgggtgccaaactttgcctggaggggcctttcttaaaagcctggggtgggggccatgacagagccacagcacccctgcagctgacacccggcacccaggaagaagcccgtcagcccttccct

SEQ ID NO: 34768 - DNA, 78 bp, Homo sapiens
  misc_feature 1..78: note = chr12:131400841-131400919
  misc_feature 1..78: note = hyper
  source 1..78: mol_type = genomic DNA
gccgcctctcagaatcgctgtgcaattggcgattgcgacattcatggaataaattccccttcgcgacacatggggacg

SEQ ID NO: 34769 - DNA, 150 bp, Homo sapiens
  misc_feature 1..150: note = chr12:132312680-132312830
  misc_feature 1..150: note = hyper
  source 1..150: mol_type = genomic DNA
tcagggtcagctccccgcaggcgccccgacccccgcctccgcgcccatcccgcgcgtccccgccgccccaagagcgtcctaagacacccggggaaacgccttccctgtgatgccgcggacccagtcccgtcgcggacacggcggggcggg

SEQ ID NO: 34770 - DNA, 730 bp, Homo sapiens
  misc_feature 1..730: note = chr12:132312856-132313586
  misc_feature 1..730: note = hyper
  source 1..730: mol_type = genomic DNA
cgggccctttaaggcggccggcctcgttagcatacatttgcatggccccgccccgccgcttgaggctgccgcgcggggctcagtccggcgggggcgccgcggagagcggagggcgccgggctgcggaacgcgaagcggagggcgcgggaccctgcacgccgcccgcgggcccatgtgagcgccatgcggcgccgcgcagcccggggacccggcccgccgcccccagggcccggactctcgcggctgccgctgccgctgctgctgctgctggcgctggggacccgcgggggctgcgccgcgcccgcacccgcgccgcgcgccgaggacctcagcctgggagtggtgagcgcgcgggcgggacgggcgcggagctcctgggccggagccgggggtctccgcgggccgggtggcggggaccgggaagaccccagcagtgcacgtcggcgtcgcgcgggagccctggcgccctggacccatttcctgggtggggagactgaggcagggacgcgggctgagcgaccgggcgagcgcacgcgagtcctggggaggcgccggctgccgtcccggctccgtgcgctgggagcgcgccgcagccgcaggagcccgtggagttgtgagggggtcgcccacccggagcccgggtcgccggcttgcagcagccccggagcagccgggctgggcgagagcaggcatcgcggccgccccgagctctgcgcgctgcgtgcgttcc

SEQ ID NO: 34771 - DNA, 30 bp, Homo sapiens
  misc_feature 1..30: note = chr12:132314800-132314830
  misc_feature 1..30: note = hyper
  source 1..30: mol_type = genomic DNA
ctcggctggtacctgcgcctcggtctctcc

SEQ ID NO: 34772 - DNA, 30 bp, Homo sapiens
  misc_feature 1..30: note = chr12:132315470-132315500
  misc_feature 1..30: note = hyper
  source 1..30: mol_type = genomic DNA
tctgtgttttgagtacgacatacagcgagc

SEQ ID NO: 34773 - DNA, 30 bp, Homo sapiens
  misc_feature 1..30: note = chr12:133174537-133174567
  misc_feature 1..30: note = hyper
  source 1..30: mol_type = genomic DNA
cgcctcctctccgcgcgcccctcctctccg

SEQ ID NO: 34774 - DNA, 122 bp, Homo sapiens
  misc_feature 1..122: note = chr12:133194939-133195061
  misc_feature 1..122: note = hyper
  source 1..122: mol_type = genomic DNA
gtctgctggcaaaggcgggagtgcaggttgcgctcgaagccccggcagccgcggcaggaaccggcctggacggggtggggggcgccgcggaggccggcgggacttcccatgtctttctcctc

SEQ ID NO: 34775 - DNA, 167 bp, Homo sapiens
  misc_feature 1..167: note = chr12:133195062-133195229
  misc_feature 1..167: note = hyper
  source 1..167: mol_type = genomic DNA
agctcggaaaaagttcccacccggggaatcccgaccctccaacttcgagaccgccggttccgcgctcggcccccacctggaccaagagctggggctgggctgccgcgcccccggctctgtccccgcgaggccccgctcccagccccacctgggacacccgggactcc

SEQ ID NO: 34776 - DNA, 140 bp, Homo sapiens
  misc_feature 1..140: note = chr12:133195488-133195628
  misc_feature 1..140: note = hyper
  source 1..140: mol_type = genomic DNA
gacgcccaaggtgatcgtggtgaggaaccggcgcctgggggtcctgtaccgcgccgtgcagctgctcatcctgctctacttcgtgtggtgcgcggggcgcggggtgcggggcgcggggtgcggggcgcaggggaggggct

SEQ ID NO: 34777 - DNA, 356 bp, Homo sapiens
  misc_feature 1..356: note = chr12:133463573-133463929
  misc_feature 1..356: note = hyper
  source 1..356: mol_type = genomic DNA
cttatacagttgtaacgaaggctaaatgatgtgcgtgaatcatgcgcaagaatcggtgggcagaacaccgaataaataccagttcttacatgacatttcactccacggaaaaatctggagcgcacactgcaccgccgcccgtgtggcctgcccgcaacccggtggctctgcccggccccggcccccggccccggcctcagccccgcacctcgtctccgcccgatggtccactcccgcttcctcaggaggacgtgcggctcgccctcctccgcgcccagacgcaggagccgtccccagggctgcggcggcggcgactgcttgccttcctcgggccgctccatcgggattcacatctg

SEQ ID NO: 34778 - DNA, 127 bp, Homo sapiens
  misc_feature 1..127: note = chr12:133464414-133464541
  misc_feature 1..127: note = hyper
  source 1..127: mol_type = genomic DNA
gggacggggaacttccggattggaagccccaaggattctgagagccccgctaatctggggatgactcctaggagtagaagacggtccatcttagttgtcacgaggtagtgcacgtggggaccctttc

SEQ ID NO: 34779 - DNA, 30 bp, Homo sapiens
  misc_feature 1..30: note = chr12:133464773-133464803
  misc_feature 1..30: note = hyper
  source 1..30: mol_type = genomic DNA
ctgaaagtgaaaggtcggcgaaagaggagt

SEQ ID NO: 34780 - DNA, 15 bp, Homo sapiens
  misc_feature 1..15: note = chr12:133481368-133481383
  misc_feature 1..15: note = hyper
  source 1..15: mol_type = genomic DNA
gaagcttttcctcac

SEQ ID NO: 34781 - DNA, 31 bp, Homo sapiens; identical to SEQ ID NO: 1080
  misc_feature 1..31: note = chr12:133481489-133481520
  misc_feature 1..31: note = hyper
  source 1..31: mol_type = genomic DNA

SEQ ID NO: 34782 - DNA, 134 bp, Homo sapiens; identical to SEQ ID NO: 1081
  misc_feature 1..134: note = chr12:133481521-133481655
  misc_feature 1..134: note = hyper
  source 1..134: mol_type = genomic DNA

SEQ ID NO: 34783 - DNA, 257 bp, Homo sapiens
  misc_feature 1..257: note = chr12:133484596-133484853
  misc_feature 1..257: note = hyper
  source 1..257: mol_type = genomic DNA
cagacgtttttctctaggtaaagccgcgggatgaaccagcccctgtggaaatttagaagtaacgacgtccgtcaatttctgtatgaaaaatatacagatcgtgtgacacgtcttctgggaatgaaagtctgctaaactcgccgtcacgagtagatgaacacatttaaagtttgtagttaagaggaaaacaacgccaacgacacaaatgccccaagcgctggatgaagcagcgacctaggatggggctggcctggaac

SEQ ID NO: 34784 - DNA, 187 bp, Homo sapiens; identical to SEQ ID NO: 1082
  misc_feature 1..187: note = chr12:133485161-133485348
  misc_feature 1..187: note = hyper
  source 1..187: mol_type = genomic DNA

SEQ ID NO: 34785 - DNA, 251 bp, Homo sapiens; identical to SEQ ID NO: 1083
  misc_feature 1..251: note = chr12:133485439-133485690
  misc_feature 1..251: note = hyper
  source 1..251: mol_type = genomic DNA

SEQ ID NO: 34786 - DNA, 15 bp, Homo sapiens
  misc_feature 1..15: note = chr12:133485815-133485830
  misc_feature 1..15: note = hyper
  source 1..15: mol_type = genomic DNA
cgtcatctggggtct

SEQ ID NO: 34787 - DNA, 30 bp, Homo sapiens
  misc_feature 1..30: note = chr13:20692885-20692915
  misc_feature 1..30: note = hyper
  source 1..30: mol_type = genomic DNA
cagctgagctggtctcggtctcccagctcc

SEQ ID NO: 34788 - DNA, 101 bp, Homo sapiens
  misc_feature 1..101: note = chr13:20734542-20734643
  misc_feature 1..101: note = hyper
  source 1..101: mol_type = genomic DNA
gcgatgctgaatgcccgtggacggctgggtgcgcgccgttagctggcgcggtgacatctgcttagagttttcaagcatttcagcatcgctaggagccctac

SEQ ID NO: 34789 - DNA, 94 bp, Homo sapiens
  misc_feature 1..94: note = chr13:20735438-20735532
  misc_feature 1..94: note = hyper
  source 1..94: mol_type = genomic DNA
cttccctgccgcctacgcactccggggcatgcccgcgcgggacgtgagaggagagccgagggctgttggggcgggcccgacccgcttgcggggc

SEQ ID NO: 34790 - DNA, 534 bp, Homo sapiens
  misc_feature 1..534: note = chr13:20735533-20736067
  misc_feature 1..534: note = hyper
  source 1..534: mol_type = genomic DNA
cccaccgcacgcagatgcgccagcccgcgccccgctcgcgcctgtcctgggcttcgcaggcccggcgaggtagctgctctccgggcgctcccacggtcggaggcgcgtgggcgtcgggcacctaggtctcgcccgcctgcagccgcctggggacgcgggttccggacggctggcgcggggcggggcggggaccaccgagcaggaagtccccgcggaagcgccgccgggcacagcgtgggtgctgtcgaggagtggcgcccgggcggggcgggaggttataaatagcggccgccatcctgcttctcttcagacacacttaatttagccggcaggcacacggatgcttatttttaaaaaaagaacttgttttattgcgctcgaggtgaccgggaaggtgtccccgcgggtcactcgctccatctggtcctggagacgagatgccagggcgaggcctaacctgcctgctggcgcccaacgaagattttaacgttttctgttcccttcggggtggttttaccacgcttgagagggacg

SEQ ID NO: 34791 - DNA, 62 bp, Homo sapiens
  misc_feature 1..62: note = chr13:20766251-20766313
  misc_feature 1..62: note = hyper
  source 1..62: mol_type = genomic DNA
cacaccacctcttcgcgaacaagggtcctaaaaattttccttctaggcggggagcacagccc

SEQ ID NO: 34792 - DNA, 534 bp, Homo sapiens
  misc_feature 1..534: note = chr13:20805970-20806504
  misc_feature 1..534: note = hyper
  source 1..534: mol_type = genomic DNA
agtcaaaggggaccacgctggggtaaaagtcaaaccagtccatcctcgttcctctgcgtacagagagagggtccagcgcgggcggcgcccactgccatcgggccggggccggggcgcgtggacaggagggtgcggatagaggcagatcgggggcccggtcgccccacgtgcggccagacacccatcccggccgcgctctgccggctctgatccggtgccagacaggagcgacaggggcgaggtggggaccagccgccgacctcacctgttttgttttcttggaggaaattcctccgctggggggccgaggtggcaccgcccgctcgccccccgcaagacccagccggtccgcgcccgcttacctgctctgcggccggcggccctggcgcgggctctgcgcggggcggcgcccttcgctccggctgggcaggcaggtcgggctcgggcgccgccggctgtcgggctctcgtcgggtttcgggtgaaggccccggctcccacctgctgcgccttttaaccgcgccccaccccgcct

SEQ ID NO: 34793 - DNA, 45 bp, Homo sapiens
  misc_feature 1..45: note = chr13:21520313-21520358
  misc_feature 1..45: note = hyper
  source 1..45: mol_type = genomic DNA
agggtgtgaagagatcgggagtcctctgcgaggctctggagcacc

SEQ ID NO: 34794 - DNA, 30 bp, Homo sapiens
  misc_feature 1..30: note = chr13:21634461-21634491
  misc_feature 1..30: note = hyper
  source 1..30: mol_type = genomic DNA
ggctggggagctaagcgcaggtgagcttac

SEQ ID NO: 34795 - DNA, 154 bp, Homo sapiens
  misc_feature 1..154: note = chr13:21634799-21634953
  misc_feature 1..154: note = hyper
  source 1..154: mol_type = genomic DNA
aggcggcgcagccaccgggggctgaggggcggcgcggcctcgactgcggcaccgccgtgggtccgtcggctcgcgggacgacggggcggccggcgggggccaacagggcgggctctgaaggactgattggcccgtgggacgatggcgcggccgg

SEQ ID NO: 34796 - DNA, 419 bp, Homo sapiens; identical to SEQ ID NO: 11520
  misc_feature 1..419: note = chr13:21649623-21650042
  misc_feature 1..419: note = hyper
  source 1..419: mol_type = genomic DNA

SEQ ID NO: 34797 - DNA, 591 bp, Homo sapiens
  misc_feature 1..591: note = chr13:22243273-22243864
  misc_feature 1..591: note = hyper
  source 1..591: mol_type = genomic DNA
caactggtcgaggaacgcccctgctgtacccatcactgctggctgcctcggagattaatgcgagcgactcgggtggtttatgagaagtgacacttaatacccagcttcttgtatctgccgccgagcagttaacgttaaagcccgctctgtaccaccgcggatgtgactgctgtaaataccacggggcagggctctcatgcttcagaaacacgtaagcaagacgcaccgagccagccccggacacccaatgaccctggactgcggcaaagggggggtgggaaaggaagaggggaggaccactcgctcttctctccttcctcctcgcccgggccggagcacgccttcctccccggagggcaggggaaggtcgctccaggtcgctggcacctccagcgcccccgaaatctgcaaattcatcgctccctttcgtcttcaggcgaagccctcccgtccggagtagggccagccccagttatgcatctccagcctttagctgactactaaggcggatccgacttctcccccataaccaggttttgattcgcttccccaccgcaggggttcagtctctgctttcgactttgcttctca

SEQ ID NO: 34798 - DNA, 69 bp, Homo sapiens
  misc_feature 1..69: note = chr13:22247111-22247180
  misc_feature 1..69: note = hyper
  source 1..69: mol_type = genomic DNA
gatttcatttttcagcggagggtatttgtgactcagcactgagggctgcagactcgagggctggtggct

SEQ ID NO: 34799 - DNA, 279 bp, Homo sapiens
  misc_feature 1..279: note = chr13:23489692-23489971
  misc_feature 1..279: note = hyper
  source 1..279: mol_type = genomic DNA
gcggagcgatgcccgcgccggcgcaggggcggataaaaagccgtagcgccacgggagtgggcgggagggagagggggtacccgagggccacaagagtatgacggggctgtaagagctggtgtggcgggtgctgcccccctgctctgtctgcaccgcaagctcacctcctggctccgcgttcggttcggcacttggaactggatctggcgactgtgccggcgcgccgcctctgccgcggtcctagcgccgctcggcttcacgctccgcaagtcccaggcg

SEQ ID NO: 34800 - DNA, 851 bp, Homo sapiens
  misc_feature 1..851: note = chr13:23733447-23734298
  misc_feature 1..851: note = hyper
  source 1..851: mol_type = genomic DNA
cactatttcccagctcgcctccaagagctaactaaagtgcagcataaactgcatgcagcattgttttcaccacagcaaacccttcggggtgcctcctagcggcggatggagaactagcattgcgcgagagtgagtaaactgtgataaacccaaggggtttgcgggggacaggctgggtggcaagacttttaaaggctcgcaaatggaaccactccctccagagggactatctaaatctcctcaggtgctgaccctttctgacagtaaaggacgagggccagaagtgtaaagattgtggtcccgcgctccaagcccaagatgcgttcagcaggagtagttgggttggaaagaaggcacccagcgtctgcagcgaaggactcgcgtgggagcgagaaatgtccctgcccagtgccccgcgcgctggatcgcgggggcgagtctgagggtggagaggccgccgggtggaggcgcgcaggggtgcgtgggtgggtgcggaaggagtgcagggtatggaggggaatcttggggcggcgcgaaggaggagcgcttggaaaggcgcggtgtttggtcacagaggggctcggagtgggagtgcaggggtgcggggagggagtgcagggacgcggggagggagtggaggggtggggacgtgctggaggggcgcgcctcgatagaactggagaaactggaaaagtggaggggcggggcagtggctggaggaacctctgaagcgacgcggggaatatgtgaaggagtgctatgttggaacttggaggggaggggggatgctggagaggcacacggtgatggacatggaaggacccgggaggtgtggagtggtgggcccggcc

SEQ ID NO: 34801 - DNA, 30 bp, Homo sapiens
  misc_feature 1..30: note = chr13:24007814-24007844
  misc_feature 1..30: note = hyper
  source 1..30: mol_type = genomic DNA
ccagcgtgactgtcccgcagccgcactggg

SEQ ID NO: 34802 - DNA, 209 bp, Homo sapiens
  misc_feature 1..209: note = chr13:24040780-24040989
  misc_feature 1..209: note = hyper
  source 1..209: mol_type = genomic DNA
gcctagaagtggccccgaagccgtgcctttcccgatagccaagcagaagtaggacttgaagcaccgaggctgggatgcccatgctggtgacgccttggggctcgcagttatacttggtgaccggtctacacggcgattcggtgctttccggagtagcagattcatctatctttagacccaccttcgtccttcggcggtttagcacggcc

SEQ ID NO: 34803 - DNA, 30 bp, Homo sapiens
  misc_feature 1..30: note = chr13:24153182-24153212
  misc_feature 1..30: note = hyper
  source 1..30: mol_type = genomic DNA
tggggaacaccccggcggaaaggaaccctc

SEQ ID NO: 34804 - DNA, 178 bp, Homo sapiens
  misc_feature 1..178: note = chr13:24153573-24153751
  misc_feature 1..178: note = hyper
  source 1..178: mol_type = genomic DNA
caaccccgcgccctgcgccttaaccaggactgctccgcgcgcccctgagcctcgggctccggcccggacctgcagcctcccaggtggctgggaaggtaggtgcgtcgctgtccccggcgcgcggcgtcccgcgaggtcttcagccctcgccctggtggatccccgctgggtgggagcc

SEQ ID NO: 34805 - DNA, 70 bp, Homo sapiens
  misc_feature 1..70: note = chr13:24154053-24154123
  misc_feature 1..70: note = hyper
  source 1..70: mol_type = genomic DNA
ggtcccctgagccagcgcgcggctgcaggggtctcggggccgcatcccggaccagcgccagcggcgggag

SEQ ID NO: 34806 - DNA, 427 bp, Homo sapiens
  misc_feature 1..427: note = chr13:24477590-24478017
  misc_feature 1..427: note = hyper
  source 1..427: mol_type = genomic DNA
tgccgaggtcccaggcgggcggcaggatccaattagtccgtgtaaaatgagaggcatctggcttctcccgggcaccccgcagcctgccccgcctcttagtggctaaaggcagggagcccctgagtcccagcgcggctgggggctctcagcagttctggccgagctccctcccgcccgcgtcgcctggcctcgaaccgctgcaccgcgggcggccccgacgggttcccgacctcccgctggggacacctgtcccgccgcccggcccttccccgcctcccgcgcctccgccccaggggagctccgggacaggcccacctaggcagcctgccggcgcagacccagcgagggaaggccagtctcgggcctccaaccggacacgcgctccccattccgggctctcccacgtctgcacactccagcccagcca

SEQ ID NO: 34807 - DNA, 243 bp, Homo sapiens
  misc_feature 1..243: note = chr13:25254954-25255197
  misc_feature 1..243: note = hyper
  source 1..243: mol_type = genomic DNA
caggctgacgggaagcgaggaaaaggcgaagaggagaaacgccccgtcccggggcaaggggaggccgcctttcctctgagcgccccccggcctgggcaccgcttctctgactccccgccacggctccgtgcggccgccggggctggctggggaaagaagccagtccagaggagcgagaaggggccaaggggtcctaggccagctccatggcacctgcgggctccgactcggaggatggggtga

SEQ ID NO: 34808 - DNA, 75 bp, Homo sapiens; identical to SEQ ID NO: 1085
  misc_feature 1..75: note = chr13:25319830-25319905
  misc_feature 1..75: note = hyper
  source 1..75: mol_type = genomic DNA

SEQ ID NO: 34809 - skipped

SEQ ID NO: 34810 - DNA, 153 bp, Homo sapiens
  misc_feature 1..153: note = chr13:25320387-25320540
  misc_feature 1..153: note = hyper
  source 1..153: mol_type = genomic DNA
cgcagctcctgatgccaagttcacttggaccccggctgagattagagaggcctggcgaggtgtgggggtgcgcagggagaatgggctgtggtcgccatggtgcgtgttggtcttgtggagatggatgctcctccgggtcaatctctgccttct

SEQ ID NO: 34811 - DNA, 416 bp, Homo sapiens
  misc_feature 1..416: note = chr13:25320613-25321029
  misc_feature 1..416: note = hyper
  source 1..416: mol_type = genomic DNA
cgcgttctccttgaggggccggcgggcgttggcgaaggtggtggggactgtcgtgaggatcatcatgggcagggaagggcgcgcggcagtggcctcgagccctgggtcttctccttcctgaatttgcaaagccaggcgaaggccctcgtgctctcccagagagctgcgctccacccgcgggcctgcctgcgcgtggggagagcggggaggcggggacaggagacctgagcccctgggcgcccctaccacgtgtcccccgtcccaacactggacctcttcagattccttgccgagaggggcctcgtcccaaggctggatgcgccgcgcagcggtgaaagccgccctcgcagcccgcaggcgaccagtgggtgctgttggctttcgccccggggagggaacgggcttgggggcactgg

SEQ ID NO: 34812 - DNA, 1082 bp, Homo sapiens
  misc_feature 1..1082: note = chr13:25321112-25322194
  misc_feature 1..1082: note = hyper
  source 1..1082: mol_type = genomic DNA
cgagctgaggagaccggagtttttccccaggagggagccgcgcaggccggcgacctcttcccaaggctctactgctggaccgcgcccgcggcgccgctcccgccccccttcagcgcactctgcgcctctcgctgggtatggccagctcgcagtgcgcgtttatgctgcggtaaacgcattgaaggaacgcacagcttatctaatagggttttgaaataattttcggtatgccagctggggtgtggtttgcccaattctgatcctgtttccagagaacacagctgcttagacaatctgttatcttcgcgtcctgtcttccttttgacgccagaacatcctagggatcaggggcctctcccatgccctggaaccatcctctcacggtgctgctcttcactggtgccaataacagagctcccgcaggcaggcctggatcagtggggactggggccctgaagtgagatggagcaagacagagcggcccttgggagaggggcatggggcggccctgtgctttagactcggcaccctatggcttgaggaggtgacactgtgtcgacgtgcgtttgaagggaggacggctgaaggtacatgcagtctcccggacgtcacaaactccgcggacgcgggtcacacccgcgcgcacgcgcagcaggggtcttagccacacaggcgcacggcggggcacggcggggcacgggccctgctgcaaacgggcgcgctcccttctgggcaagcaggtgcgaggcgcgcgccatggaacagcccttagctgagtttcggtttgcgcgcaaacggccggcctggccgcccaacgcagcatttccagccagggcgcacaaacctcgggagagaaggtggaagccgcaggggctctaaaggcagccccaggttggctaaagcggttcctggtacggacaccaaggcccccgtgctcgggccctacccagcctggttcaggtgagaggaggcaagcctcggcccggtaccggcgtcggaaccacagtcgggcctggccctgctgccggggcggggctgctggacttccctcccgctccgggctggacctgacatctgtctct

SEQ ID NO: 34813 - DNA, 72 bp, Homo sapiens
  misc_feature 1..72: note = chr13:25592968-25593040
  misc_feature 1..72: note = hyper
  source 1..72: mol_type = genomic DNA
gctgctcctgacccgcgcccagagagcaggacctggcgcttggcactgtgcagccacggggatgaggctgag

SEQ ID NO: 34814 - DNA, 15 bp, Homo sapiens
  misc_feature 1..15: note = chr13:25593061-25593076
  misc_feature 1..15: note = hyper
  source 1..15: mol_type = genomic DNA
cgccactggggccac

SEQ ID NO: 34815 - DNA, 55 bp, Homo sapiens
  misc_feature 1..55: note = chr13:25620899-25620954
  misc_feature 1..55: note = hyper
  source 1..55: mol_type = genomic DNA
attgagaaagagacccgggtccagtgaagcatcagacacgctggcgcatggggac

SEQ ID NO: 34816 - DNA, 95 bp, Homo sapiens
  misc_feature 1..95: note = chr13:25620955-25621050
  misc_feature 1..95: note = hyper
  source 1..95: mol_type = genomic DNA
aggagccctggagactcagggcccgtctggtgcggcccgggctttgctccgcgctcgccccctgcagctgccggggccgccgcaacttttcaaac

SEQ ID NO: 34817 - DNA, 69 bp, Homo sapiens
  misc_feature 1..69: note = chr13:25621342-25621411
  misc_feature 1..69: note = hyper
  source 1..69: mol_type = genomic DNA
ggaaactgtcctgggcgcgcaccgcccccgtgccctgcgccctcctcatttgctcggccagcgcgggac

SEQ ID NO: 34818 - DNA, 98 bp, Homo sapiens
  misc_feature 1..98: note = chr13:25744637-25744735
  misc_feature 1..98: note = hyper
  source 1..98: mol_type = genomic DNA
ttttcagtgaagtcacgtcagaaaacatcaaacaaatacgatctgccgacgggtctgagggtggatcgacagaggcagggtctggggcggcgggcgcc

SEQ ID NO: 34819 - DNA, 295 bp, Homo sapiens; identical to SEQ ID NO: 1089
  misc_feature 1..295: note = chr13:25745300-25745595
  misc_feature 1..295: note = hyper
  source 1..295: mol_type = genomic DNA

SEQ ID NO: 34820 - DNA, 221 bp, Homo sapiens; identical to SEQ ID NO: 1090
  misc_feature 1..221: note = chr13:25745726-25745947
  misc_feature 1..221: note = hyper
  source 1..221: mol_type = genomic DNA

SEQ ID NO: 34821 - DNA, 84 bp, Homo sapiens
  misc_feature 1..84: note = chr13:25945934-25946018
  misc_feature 1..84: note = hyper
  source 1..84: mol_type = genomic DNA
tcctggaagagcccccgaaagtacaggcccaatctcccaccccaccaagccctccccatcgccttccccgacacctaaaagccc

SEQ ID NO: 34822 - DNA, 76 bp, Homo sapiens; identical to SEQ ID NO: 11538
  misc_feature 1..76: note = chr13:25946300-25946376
  misc_feature 1..76: note = hyper
  source 1..76: mol_type = genomic DNA

SEQ ID NO: 34823 - DNA, 75 bp, Homo sapiens
  misc_feature 1..75: note = chr13:25946599-25946674
  misc_feature 1..75: note = hyper
  source 1..75: mol_type = genomic DNA
gcgtcgctgcacctgcggggccaaaaggctccaggccggggcgaggtgagcggcgggcgtcagagacccccggct

SEQ ID NO: 34824 - DNA, 51 bp, Homo sapiens
  misc_feature 1..51: note = chr13:25946801-25946852
  misc_feature 1..51: note = hyper
  source 1..51: mol_type = genomic DNA
cggcgcagagaagatgcagccttccctgccggcggccggcaccgctgtgct

SEQ ID NO: 34825 - DNA, 403 bp, Homo sapiens; identical to SEQ ID NO: 3985
  misc_feature 1..403: note = chr13:26042768-26043171
  misc_feature 1..403: note = hyper
  source 1..403: mol_type = genomic DNA

SEQ ID NO: 34826 - DNA, 159 bp, Homo sapiens; identical to SEQ ID NO: 3986
  misc_feature 1..159: note = chr13:26043340-26043499
  misc_feature 1..159: note = hyper
  source 1..159: mol_type = genomic DNA

SEQ ID NO: 34827 - DNA, 183 bp, Homo sapiens
  misc_feature 1..183: note = chr13:26624710-26624893
  misc_feature 1..183: note = hyper
  source 1..183: mol_type = genomic DNA
ctcccaggtccctgacgtccaggcaacgccaaccgtcctccctttcgcgctgggcgcaggccgccctacctgccgagccgtcggggccgtctttgtccgcccggccaggctcgccagcgccctgctggcggtcattgtcgcagccgccctggtccaggcgcgcctcggcgctggagcagcagt

SEQ ID NO: 34828 - DNA, 391 bp, Homo sapiens
  misc_feature 1..391: note = chr13:26625266-26625657
  misc_feature 1..391: note = hyper
  source 1..391: mol_type = genomic DNA
cgacgccgggccctaggtccaggagctcctaagccatccccgtcctcagccggtggcccggtccccttagggactgccttatgagttgcactcgctgatggaaatctcgggatgcagtcagaaggcccccggggctgtcgtccggaagcctctggaggtttcactggcaaccggaccctccctgagcatccccgaagggatgctcactcgagccgaatgaccgctgggcgcgccgccgcggacctggagccagggctctgcgcagggtttaagcctcagggtcccgcgcgcgaatcagggcccgtctcccctcctttattccctcctcgggcgggtagaaggggcgaaggcgggcagtgcacgcaaggctctgggcagcaagtgacgcagc

SEQ ID NO: 34829 - DNA, 39 bp, Homo sapiens
  misc_feature 1..39: note = chr13:26626239-26626278
  misc_feature 1..39: note = hyper
  source 1..39: mol_type = genomic DNA
gacctcagggacgcccgcgggcgccgggcagcccctcac

SEQ ID NO: 34830 - DNA, 86 bp, Homo sapiens
  misc_feature 1..86: note = chr13:27050496-27050582
  misc_feature 1..86: note = hyper
  source 1..86: mol_type = genomic DNA
acctagggagggcagcgggcaggctgggctgagccctcttccgtcacacaggaagctgcagggctttcctgcggcattcatgcttt

SEQ ID NO: 34831 - DNA, 276 bp, Homo sapiens
  misc_feature 1..276: note = chr13:27131553-27131829
  misc_feature 1..276: note = hyper
  source 1..276: mol_type = genomic DNA
atccccacctctcctcgctggaaaggacgctgcctaagcctcatcccgagctgggggcggaggaccaagggtgagagccaccgcctccgcaatcccccgcccctcggcaccgtcgctcagcgcgctcgccggctccctattggccgaggcactcgccaatcctggtgaagcggccccgtgagttggccctggttggtggagccggcactgagcccccctcctgctccggccgagcccccccgccgggagggggcgtggccgcggccgtggacgggc

SEQ ID NO: 34832 - DNA, 451 bp, Homo sapiens
  misc_feature 1..451: note = chr13:27131859-27132310
  misc_feature 1..451: note = hyper
  source 1..451: mol_type = genomic DNA
cggtgtggtgcgaggcgggtgcgccgggcggccgcggcgcggcgggaccatggagctcagagcgcagccccggcgccggcggcgggaccgcggaccggtgagtgagggctgcggtcgccccggctctccgctgtaggctgctgtggccctctcggctccgggccgggcggctgtcgggggaggggcggccccacggcgaactgaagttgctgcatcgccgcgcgctccggccgggcggcggggcccactgcgggctgcggcgccgcctcgcgcctatccctgcagcccggccgcattctcccggccggctcccgcgctggcaggggcttctcgccgtcacggcgcggccaggcggcccttctctcccgcgcctccgggcctccggccctttgccgtccggtgcgcgctccctggactcgggacagccacccgccctccccgccgtaagtgg

SEQ ID NO: 34833 - DNA, 158 bp, Homo sapiens
  misc_feature 1..158: note = chr13:27132629-27132787
  misc_feature 1..158: note = hyper
  source 1..158: mol_type = genomic DNA
cggggtatcatccccgggggtctttacccgcgcgcctgggctttagcgagggcagaagcttcctctcagtttgtggtgctgacgtgcaatggcgattgcttcttgatttggcccctctgcaagggagagttccctggtggagacgagagttcttaatt

SEQ ID NO: 34834 - DNA, 419 bp, Homo sapiens; identical to SEQ ID NO: 3987
  misc_feature 1..419: note = chr13:27334304-27334723
  misc_feature 1..419: note = hyper
  source 1..419: mol_type = genomic DNA

SEQ ID NO: 34835 - DNA, 256 bp, Homo sapiens
  misc_feature 1..256: note = chr13:27334724-27334980
  misc_feature 1..256: note = hyper
  source 1..256: mol_type = genomic DNA
cccaggccgagggggctcctccggtgcttccgaagcgcgtgggctactcgtgtcgcatgtcggcgcagttgcccgctgtggcaaggggggggcggccgggctccggagcgggccgggagggcgcggggcgcgcactccgcggcaggtgagcggcgcggctgcaggtgagcagcagcctcggctcgcgcgcccagctttccccgccgcgcccgcccggcccacacgctccccgcgcgcgcgccgcccccgccccgcg

SEQ ID NO: 34836 - DNA, 30 bp, Homo sapiens; identical to SEQ ID NO: 11551
  misc_feature 1..30: note = chr13:28363673-28363703
  misc_feature 1..30: note = hyper
  source 1..30: mol_type = genomic DNA

SEQ ID NO: 34837 - DNA, 142 bp, Homo sapiens
  misc_feature 1..142: note = chr13:28363953-28364095
  misc_feature 1..142: note = hyper
  source 1..142: mol_type = genomic DNA
cccccggaaaccaggcggcgggcagaggccgcggggtggggaggccgggttggctgggtggggaggccgggttggcggggcggcccggacctcccggctgcccgcgctagcacctgcccaaggctcgggtctctcagaggca

SEQ ID NO: 34838 - DNA, 28 bp, Homo sapiens
  misc_feature 1..28: note = chr13:28364723-28364751
  misc_feature 1..28: note = hyper
  source 1..28: mol_type = genomic DNA
cgctggccactcgcgggctcccagctcc

SEQ ID NO: 34839 - DNA, 436 bp, Homo sapiens
  misc_feature 1..436: note = chr13:28365659-28366095
  misc_feature 1..436: note = hyper
  source 1..436: mol_type = genomic DNA
gcagcggtttcccagcgcactgctggaagtgtgctccagtagacagggtgtgggcaagatgcgcgggcagacagtccgcactcgccacatgtgctggggtgcgagatctagatctgcgccatctcggctttcattccccattccctgtctctgttcgtaacgctcagagactgtttttcctcttttacatccacggccctgtcatttgaaggaaagggctggttggccagcatctaccgaacaaagactgggcgtcgtaggcagcaccaaaattaagactatttgagaaacttagagaaaaccgagggacagcgatgggtctagggctggataaggaataatgagcccttctcctccctccccacagacgcctccttcacgcgggaacccggtcctccttcttccgacgcagagagagaagcgattccacaggtgg

SEQ ID NO: 34840 - DNA, 194 bp, Homo sapiens
  misc_feature 1..194: note = chr13:28366408-28366602
  misc_feature 1..194: note = hyper
  source 1..194: mol_type = genomic DNA
cgagggcgcctgttacggcgtgggtggggttgacaagaatagagtacattatgcagttcatttagttaacaagtgaaataatgaggaagcgtgcagagtgaatgccaagagaaaaggcacaaaaaccctattgagaggccccggccgctcctggcgtagtccatcacatggcaatagtcctatttaagccgcgc

SEQ ID NO: 34841 - DNA, 375 bp, Homo sapiens
  misc_feature 1..375: note = chr13:28366664-28367039
  misc_feature 1..375: note = hyper
  source 1..375: mol_type = genomic DNA
cggcagcagaggctactgtttcagcctaggtctcagccgcgcgttcagcctcctgggcagaggcagctgcgggataccgcggccagggaaagcgcgtggagagccgaaaggtgcggtgggcgcagagggcgggctggctgcggggcgaccgcgcgccggggccatgccgcgctccttcctggtggactcgctagtgctgcgcgaggcgggcgagaagaaggcgcccgagggcagcccgccgccgctcttcccctacgctgtgcccccgccgcacgcgctgcacggtctctcgcctggcgcctgccacgcgcgcaaggctgggctgctgtgcgtgtgcccgctctgcgtcaccgcctcgcagctgcatgggccccc

SEQ ID NO: 34842 - skipped

SEQ ID NO: 34843 - DNA, 345 bp, Homo sapiens
  misc_feature 1..345: note = chr13:28367601-28367946
  misc_feature 1..345: note = hyper
  source 1..345: mol_type = genomic DNA
gtaagaggtcaaagtcgtaggattctggcgaccgcctaccaagggattgggtccacagcacagaggtctgatcgcttccttctctgctctgccacctccagacagcagctctaaccagctgcccagcagcaagaggatgcgcacggctttcaccagcacgcagctgctagagctggagcgcgagttcgcttctaatatgtacctgtcccgcctacgtcgcatcgagatcgcgacctacctgaatctgtccgagaagcaggtgaagatctggtttcagaaccgccgagtgaagcacaagaaggagggcaagggcagcaaccatcgtggcggcggcggcgggggtgc

SEQ ID NO: 34844 - DNA, 150 bp, Homo sapiens
  misc_feature 1..150: note = chr13:28368153-28368303
  misc_feature 1..150: note = hyper
  source 1..150: mol_type = genomic DNA
cgctgattcccaggcacccgcagccaaaccactgcctggcatggatttggcactgctttgcagaggtcccgggcctgggcagggctgagagcttggcagagactggaccatggcgtccccgccccagggctcgctcgtgtccaaagccaa

SEQ ID NO: 34845 - DNA, 353 bp, Homo sapiens
  misc_feature 1..353: note = chr13:28368718-28369071
  misc_feature 1..353: note = hyper
  source 1..353: mol_type = genomic DNA
acagatgataaatttcgcccgtagtatccatattggggaaacagatttgctctgtttccaacacgctcttccttcctctaaacataggaccccgctctgcgccgctggcgaccccactcttccccctccagactctggcccgccccagcctagctgtgtaattgtacggcctctgcaatgccagaagatatttatttatttatttatgtacaaaattttaaataaacttttttttttcttagaaatgcccgtggctctgagcccagaggccttcgctctggagtagacaggcgccaacccggattgggcctcccttctgggaagggttggggatccagttgcagggtccgagc

SEQ ID NO: 34846 - DNA, 906 bp, Homo sapiens
  misc_feature 1..906: note = chr13:28369161-28370067
  misc_feature 1..906: note = hyper
  source 1..906: mol_type = genomic DNA
cgattgtcccgctccggcgtggcgcacaagcgtcgcggagctcagagagctaagccggaagggaaggagagcgctctccttggactgcaccatgggtcccaacccctgcagcgcctccttctcacctgggatccagccccacctccatccctcaccatttcgctgtcctggccaacagccgggagggcagaaaccactccctccataagcacaagaaatccgtccttcactgcgcttggattgataacgattcgttagggacaaatttccattctgcgggatggtgcagacttctctcagagggccctcctctctttgttttaaggcaaattcccttagccgagtccctggtcgcggaacattccgggcaaggaatccgagaatccgaagtgatcctgccccagggagtccccgagagggactctgcatagctggagccagtggctctgggacctcatgttctcaccaattctcgttaaaatcctatatccccctacgacttagaatccacaccccagctccctttgaggacatatgcgggtttttttactctctaagatggatgaggagaaggaagtgcgtgaggttctgcagaaacggagagcgcacagctgcgggaggagtatttctgcagtcagtatttctgcagtcagacctgggaagctaatatccgcgttctcgccgctcccattctgtgtccaggaaacctgatagaccttcttttcctgccagacccctacacacacacacagacacacacacacatacacaccctggggagcgctgaactccccgtgtctaggcaaagcaaatgcgtcttttccagcaggaaagacggtccacctgaggttgcttaacatttttgaagctcatttcctcccccccacaaaacggctttattgagct

SEQ ID NO: 34847 - DNA, 15 bp, Homo sapiens
  misc_feature 1..15: note = chr13:28370409-28370424
  misc_feature 1..15: note = hyper
  source 1..15: mol_type = genomic DNA
tagtcccagtctaac

SEQ ID NO: 34848 - DNA, 698 bp, Homo sapiens
  misc_feature 1..698: note = chr13:28370763-28371461
  misc_feature 1..698: note = hyper
  source 1..698: mol_type = genomic DNA
caccatcccaggaggcgacattgtgccaatctacggccaatctgaacgaagccaaggtgctttagtgcataccagtgaatagaatcacaactgttttactatcagtgatgaggctgatgcttgctgagttttgctcgtttgcatgttgctctagggccccagggtgagtgcagttgtgcactcttagctccagcaggaccggcccagcctccgtttggctgggatttgggggcgggcggcagcacgattttctggcaacgagttcgttgtgggtctgaaggaccggcttagaactagcacctctcctggattacaggagggggtggtcttgtgcacctgggaaaggccttcgccagcactcagtgtcaggcatcttgatcagaaatgcactttcgagcctgccagggaaccaagtttggaggggatggaaacggcggtgggagacatagaaaggatgaacacacacacccggctctccccgcactcgcctcttctccagctccccctcctctcccgcctaggagtccctcctgttcccagcttctccccagagtccgcagatccacagctgtgagccaggtccgcgtggggccagttttcccaggagtgcacgtttcctcctctcggcttcccagggattcatttccggaagaccaagctttcagctttctagtctgccttagcgagcagcgggagga

SEQ ID NO: 34849 - DNA, 146 bp, Homo sapiens
  misc_feature 1..146: note = chr13:28394662-28394808
  misc_feature 1..146: note = hyper
  source 1..146: mol_type = genomic DNA
agttgtgttggaacccgtggagagaaggaactgtccgtttccaaactctgcttcggcccctctcccctcccacccacggccccaggcagagagggccggaaaggcagcccattcctgcccgcgcattcgggcgcacaagcgcattg

SEQ ID NO: 34850 - DNA, 402 bp, Homo sapiens; identical to SEQ ID NO: 3996
  misc_feature 1..402: note = chr13:28395255-28395657
  misc_feature 1..402: note = hyper
  source 1..402: mol_type = genomic DNA

SEQ ID NO: 34851 - DNA, 75 bp, Homo sapiens
  misc_feature 1..75: note = chr13:28395998-28396073
  misc_feature 1..75: note = hyper
  source 1..75: mol_type = genomic DNA
cccaaagttcttgttcggtttcgcctggcactggaaatgccgtcaaaccagagcgcgaaacggtctggtggagta

SEQ ID NO: 34852 - DNA, 140 bp, Homo sapiens; identical to SEQ ID NO: 11563
  misc_feature 1..140: note = chr13:28396578-28396718
  misc_feature 1..140: note = hyper
  source 1..140: mol_type = genomic DNA

SEQ ID NO: 34853 - DNA, 292 bp, Homo sapiens
  misc_feature 1..292: note = chr13:28397177-28397469
  misc_feature 1..292: note = hyper
  source 1..292: mol_type = genomic DNA
ctcatgcccagagagcgggggaactgtcagaaacatttacgctagaatatcttgaaattgcaaatccttttatgggggaggacgctgccgatgtgggttaaatggacaatgacgctggttaagttggagggtcctttggagacggacacgtggcttctcaatgaaagctgctccgggctcgcgtggccgccttcgccctgcacacacttctcctcccaaatacttgaaaatagacagagaaaaacaagcaactcacaaactcagcccttggccctggcggggaaacagaatt

SEQ ID NO: 34854 - DNA, 632 bp, Homo sapiens
  misc_feature 1..632: note = chr13:28491793-28492425
  misc_feature 1..632: note = hyper
  source 1..632: mol_type = genomic DNA
gtcccttctataggtcgcaggcagcagaaaatgctaattgtgaaagtgagaacgcgcctccatggaatacccccggcgatcccctcctcctcccccacagccgcgggtacccgggtttttgccggcgaccgcaaccggcggatttgctttctgctgagagcctcttttctttctgcagggccgagcaaaaatattaaatggaagcaaatgaagcatcgaaatggagaccaatttacagaaatgtgcaattagttgagaagtgcaaagtaaacactccgggggtggcaggcgaggcagggagcaggggagggagagtggggcgcagactgagtccagagtgggtgtaggggtgcccagggaggaggggaagggggaggaaaaggagggggaggggaaaagtggccgatctttgtcctgagcggagcttgccgtccgctcataaccgcgtcgccaagtcaaccctcggcgactcggcagattatctccaagggtcaacacgccgcggccaggcaaccccctccagcctgccctcctgatcgatgtggtcactcgcggccagggtgatagggtagagttctccgcggccgcagacaatggactcattgacgcgggcgcacagagattaggtgccc

SEQ ID NO: 34855 - DNA, 127 bp, Homo sapiens; identical to SEQ ID NO: 3999
  misc_feature 1..127: note = chr13:28492426-28492553
  misc_feature 1..127: note = hyper
  source 1..127: mol_type = genomic DNA

SEQ ID NO: 34856 - DNA, 61 bp, Homo sapiens
  misc_feature 1..61: note = chr13:28494773-28494834
  misc_feature 1..61: note = hyper
  source 1..61: mol_type = genomic DNA
cgccttggattatcccgggtcggactaaactacatcagggagctaccgagcccatccctca

SEQ ID NO: 34857 - DNA, 30 bp, Homo sapiens
  misc_feature 1..30: note = chr13:28503435-28503465
  misc_feature 1..30: note = hyper
  source 1..30: mol_type = genomic DNA
gtatctgggagagcacgcttgtgccgaggg

SEQ ID NO: 34858 - DNA, 145 bp, Homo sapiens
  misc_feature 1..145: note = chr13:28527239-28527384
  misc_feature 1..145: note = hyper
  source 1..145: mol_type = genomic DNA
acctttgccaccctccgcgctgatggaaactggaggaggatgtggtttagacacaatgtggcccaagcgtccttgtttcctgaatataccccaaagtacaagtcccatctccagttttgaaagaattccccgaggaaaggggctt

SEQ ID NO: 34859 - DNA, 987 bp, Homo sapiens
  misc_feature 1..987: note = chr13:28527845-28528832
  misc_feature 1..987: note = hyper
  source 1..987: mol_type = genomic DNA
tgtgaagagaaggagcgggggttttaagagccacagcgccaccgagagagtggaaaggagtagattagctcgcgcctgctatgcgaggcgactccccccgagacccacccgcagcccagcgcccttggccaggaggcccggaaagccaccgaggcggccgaaaggggccgcggggcacccctcagcccctcctgcggcggctccggctgcccctgctcagcctcccgctccccgcccggagtcccagctctcagatcggccgcagagctgggaacagaggccgcggggtccaggccgttccgcccgctcagccggagcagcagcgccgcctgccgggggcctcgcgcaggcgagacaggccagacgccggaggccgcgggcggctgcagctttgacgggccgaacacaccagcgctcccgttccgccttttgaaaatcaaatcccttgggcctggtgccaccatcgctcagcccaggtcttcgacgacgggtcgaaggccagtgctccaggccttcttcaccgagtggcttcggcgcttgcggcccaggttccccgcacctccgcgccgtagttgcgcgcaccttttgaaaagcttggcgtcttcaggtataaggacaaaaacaaccgcggacatcacaccattccaaagaagaaaaagaaagtgcccggaatctcagggcgcgacttccggggcgacgggcggcggcggagaggcgctccccgggcttcctacccggcaggaggccgcggcgccgggacctcgcctgccctcaccgcgcgccacctctcgggagacgccgcgaatctctccagggaatcccgggcagcggcgcagacccagcaaggaccggcagcaggccgagaccggccgtcttgggcgagagcagcgggacacgagcccccgggcgcccgctgggagcgcggggaggctctgggctcagggaagctgcgctccgagtggccttggaggacggtcaaggagcccg

SEQ ID NO: 34860 - DNA, 38 bp, Homo sapiens
  misc_feature 1..38: note = chr13:28534516-28534554
  misc_feature 1..38: note = hyper
  source 1..38: mol_type = genomic DNA
aaactggaacctttccgggttcacgagcccaagcccca

SEQ ID NO: 34861 - DNA, 251 bp, Homo sapiens
  misc_feature 1..251: note = chr13:28535305-28535556
  misc_feature 1..251: note = hyper
  source 1..251: mol_type = genomic DNA
cgcccgcgggccgggccaccggagcccctttcccaatcctggagctgtatacgccacccggaagggccgcggaattggagaggtgctgcagagggtctatacctcttgctgtttcccggctctgctcatcttccccaactgcccttaaggcgcctccgtgggcgcgctgattaggctctcggatgttggtgggaagatcgaaacgaagggctaagcccccctcgcccgggtcctgccggaaagttcagctc

SEQ ID NO: 34862 - DNA, 105 bp, Homo sapiens
  misc_feature 1..105: note = chr13:28540706-28540811
  misc_feature 1..105: note = hyper
  source 1..105: mol_type = genomic DNA
cgcctggaagtgtctcggagcgacccttgctcgggtgctgccccttcagtgtcccggacgtgccgggcaacgcgatgaccagaccctgagcgctcttcgacccat

SEQ ID NO: 34863 - DNA, 18 bp, Homo sapiens
  misc_feature 1..18: note = chr13:28541082-28541100
  misc_feature 1..18: note = hyper
  source 1..18: mol_type = genomic DNA
catcacaagggcacccgg

SEQ ID NO: 34864 - DNA, 71 bp, Homo sapiens
  misc_feature 1..71: note = chr13:28541179-28541250
  misc_feature 1..71: note = hyper
  source 1..71: mol_type = genomic DNA
cggcttccctcccgcccccttcccggccctcaccccgcggccgctctcccgggacacgcaaaggtcttcct

SEQ ID NO: 34865 - DNA, 74 bp, Homo sapiens
  misc_feature 1..74: note = chr13:28542653-28542727
  misc_feature 1..74: note = hyper
  source 1..74: mol_type = genomic DNA
tccgccgctggccgccgggagacagctgctcggcggcagcggtggcggcgggcccaggagggccggggttgagc

SEQ ID NO: 34866 - DNA, 708 bp, Homo sapiens
  misc_feature 1..708: note = chr13:28542728-28543436
  misc_feature 1..708: note = hyper
  source 1..708: mol_type = genomic DNA
tttgcagcagcccagaagcgcaggaaggcgcggcggccgggtggtgcgggtggtgatgcgggtggtggtgcggatggtagtctgcggggctgctgtagcccatggctgcggccggggagccaccgttgaggccgtgagccacggcgttggcggcggccgcggcgcctccgggcgcgtagccattccagtcctcccggagtggggcgccatacgctgccggccaggatggccccggggactgcgcgctgtccaagttcgctgccgctgcagctgcggccgccacgtggtaaccgccgtagtccgggtactgcggggggctgacgaagttctgcggcgccaggttgaggccgccagagtggcgcacggagctagggtacatgctcacgtccttgtccaggaggtagctcacgtacatggtggcgagggtccgggagcagacctcaccatgctgcctggggaccgacgctggaggctgccggggggcacgaagggaaaggggcgaggggactcgaggagcggcgggtggctgcgccccagcccgcggtgctccgctggctcctcgcggctcttctgcctccgaggcggtccctccctctggcctgcctcctccctccctccctttcttccttctttcctcccacctccttcccactaggctgcagaggcggggaagacccgccacaggctggcgtgcggagccccaggccg

SEQ ID NO: 34867 - DNA, 387 bp, Homo sapiens
  misc_feature 1..387: note = chr13:28544198-28544585
  misc_feature 1..387: note = hyper
  source 1..387: mol_type = genomic DNA
ggcgagctaggggatcgttggtaaagcagtttcttaggctgctggttacacagaatgtcagtttgtgaaaattcattgagctacacttgtatgtttattatacttaaatataaggaaaagagaatttctgctaatgcttacctaggtatttatgtgtcttacatcatacctgtatctttaaaactctctgtcctttacaaagggaaacgttctccgaagaaatttatttctcatttccaggagatgataaggcaactcagggccattattaacgactgctaatgaaaagctctgagttgagaaaggatctctcttggtttgggaagcgctgcggccaaggggcctagggctggaagtggccgtcttggggaccgaagccgcgcagcc

SEQ ID NO: 34868 - DNA, 238 bp, Homo sapiens
  misc_feature 1..238: note = chr13:28544665-28544903
  misc_feature 1..238: note = hyper
  source 1..238: mol_type = genomic DNA
cgcgtggagtgggcctgcggccgccgttcacctcctaatacaagcctttgacagcgctgccagattcgggaatgaggatcactgcggcgaggcccggcgggctgggcagcctgactcggcggctttgagcgctctcagaacccgcgggcgctcgcggcactcctggagacctgcacttgtctgttctcattgtcaagcgtttcgctcggatatttgtcaccatcgccttcatcctgtc

SEQ ID NO: 34869 - DNA, 30 bp, Homo sapiens
  misc_feature 1..30: note = chr13:28545247-28545277
  misc_feature 1..30: note = hyper
  source 1..30: mol_type = genomic DNA
cctgagaaatacaaccggaagcaaattgca

SEQ ID NO: 34870 - DNA, 395 bp, Homo sapiens; identical to SEQ ID NO: 4002
  misc_feature 1..395: note = chr13:28549497-28549892
  misc_feature 1..395: note = hyper
  source 1..395: mol_type = genomic DNA

SEQ ID NO: 34871 - DNA, 20 bp, Homo sapiens
  misc_feature 1..20: note = chr13:28550239-28550259
  misc_feature 1..20: note = hyper
  source 1..20: mol_type = genomic DNA
cgccgcgcagccagctctct

SEQ ID NO: 34872 - DNA, 30 bp, Homo sapiens
  misc_feature 1..30: note = chr13:28550493-28550523
  misc_feature 1..30: note = hyper
  source 1..30: mol_type = genomic DNA
cataaagagcacagacgctgcatttggggc

SEQ ID NO: 34873 - DNA, 420 bp, Homo sapiens
  misc_feature 1..420: note = chr13:28551129-28551549
  misc_feature 1..420: note = hyper
  source 1..420: mol_type = genomic DNA
gccacctctggccttcgcctattaccttgtctttgttggggagaccatgggtgtttcatttctcctctgccaatagaagcctaagtagtatttgttggggctctttacaccttccctgtgttggggggggcgggggggtgtcgacgggtggtagaatgtggtgggctcctccgcaggatgctaatgtactttcccccagtggacagtctggctgctggtacaggaagctgcccagcctaataggggtctgaaactccagggctgacaagcaaagatttctatgggcacttccctccatttaatcgacactgcaatctcgcttcattctggggtccaaatacccagcgctgctcaatgttactattttaataactgatgggtttcccggggcagtcgagccacccccccaaagccgacctc

SEQ ID NO: 34874 - DNA, 727 bp, Homo sapiens
  misc_feature 1..727: note = chr13:28551658-28552385
  misc_feature 1..727: note = hyper
  source 1..727: mol_type = genomic DNA
cgcagggctcttcccggcccaccgcctccttcctgcggcttccccggctccccaggccggaccgaggccagcgtttgactttcctggctcccagtctgctcccctagtgcccaagagcgagaacaccgcttccgctcacatgtaaaggtcgggcgcagcaaatgaagtgggaaaagagaaaaacagacaaaccgctgtggcataaaagattccttttccgtccgttttgctttgcagttcgggcttagcaggagagggttggggagaactggataaacgctttggaatccacaaaggccggtggtgtcgggggccgcaaagggagtgaagaattgaagcagtgagctggataaatccggggcaaagcactaaacaatatggatattttggcaacgcgtgcgcgtgtgggtgggcggacaaaaggactcattactcgtatgattgcctcaattctccacttcctttgtgcacgtgtgtggacgctgttccaggcccgagtccgcctcccgcccaggacgcacagctccgggccgtggcccccgcgcgtccggttgtgcgtcccgggtccctggcccgcgcggcagctacagcttggcggggtctgcgcggaggaggtcggccaggcgcaggctgccgatcttcttcacctcgcccagagcagtgcgcagctcctgcgcggacgggcagagcagccggcgcgccagctcgcgcggcaccgccgtccggt

SEQ ID NO: 34875 - DNA, 514 bp, Homo sapiens
  misc_feature 1..514: note = chr13:28552659-28553173
  misc_feature 1..514: note = hyper
  source 1..514: mol_type = genomic DNA
cgcgtaggccgcgcccggcccccctgccccgccccgccccgcccggccccaaagaaggctgcgggagggtgaagtagagtacccaggcggtgatgtcctggcggaacaggggcgcccttggcgcgcccctctaacaagtcctggaccttgcgcttctcggtccccactacattcggtcgggaccaggatccaggggcggggcgggaagtgacacgtttgtcttttgagaccttgggtcaagaagagcggaggagagagagggcggccgctgaggctcggaatttacgactaggtcgggagggagcagagacgcgataaggatcctgagcttttcctatctttcaaagtcctttgctctcagggggggctttgatgtctaaaggggccggacgcaagggcctgaagacttcctgcaaaagctctggaatgggtttcgttctgctccaaaggagaacggacaggggcggggtgcatccatagggataacatccatggggctcggcaaataaatgcc

SEQ ID NO: 34876 - DNA, 171 bp, Homo sapiens; identical to SEQ ID NO: 1098
  misc_feature 1..171: note = chr13:28674056-28674227
  misc_feature 1..171: note = hyper
  source 1..171: mol_type = genomic DNA

SEQ ID NO: 34877 - DNA, 463 bp, Homo sapiens
  misc_feature 1..463: note = chr13:28674720-28675183
  misc_feature 1..463: note = hyper
  source 1..463: mol_type = genomic DNA
gctgcaggtggctctcttaaggatgcgcgtcaccgaccgcaaattccctcggactggtgcaaagtggaaggggggaggaaccctctccccagaggcagggaccgaggcgggagcggagaggttgggcagagccgagcagccggtgcctggcgcagcgctgcagccgagcccacgtgcccgccgcggtccgcagcctgtgctcggcggcccccggggctccccgactgcggcggggaagattgggcgcggtcccgccggagaagttgcactggctccgcggctctgccgccttgctgcccctgtgagtccccgaactctgtcgtttggatccggggcgtggggactgcagggagccacaaaccaccctcctagtgcgctgggatctttgaggccctgagaaaggcgctgaatccgctcggcacgctggcaactcccgccagcgcacaggcgagcattccattaa

SEQ ID NO: 34878 - DNA, 1213 bp, Homo sapiens; identical to SEQ ID NO: 1100
  misc_feature 1..1213: note = chr13:29067773-29068986
  misc_feature 1..1213: note = hyper
  source 1..1213: mol_type = genomic DNA

SEQ ID NO: 34879 - DNA, 283 bp, Homo sapiens
  misc_feature 1..283: note = chr13:29068993-29069276
  misc_feature 1..283: note = hyper
  source 1..283: mol_type = genomic DNA
cggcctgctcgcccggtgcccgcgctccccgcggccaacgacccggccgccagagtccgtcctctcgttcgccgccgccggccccgcgccctgagcgcccgtctcgcggctccagccaggagacaaccacttccccgggtaatcctcgccgccaggcgcccgctggccgctgcacccgagccccggagcccgctccgagccgccgccgctgccggggaggagccgagaggagtgtccgcctggcgcgctccgagcctcccgcggacctcgatgaagagcagcc

SEQ ID NO: 34880 - DNA, 32 bp, Homo sapiens; identical to SEQ ID NO: 11588
  misc_feature 1..32: note = chr13:29069551-29069583
  misc_feature 1..32: note = hyper
  source 1..32: mol_type = genomic DNA

SEQ ID NO: 34881 - DNA, 30 bp, Homo sapiens
  misc_feature 1..30: note = chr13:29069801-29069831
  misc_feature 1..30: note = hyper
  source 1..30: mol_type = genomic DNA
cccttcagactgtcccgagaagtctaggaa

SEQ ID NO: 34882 - DNA, 334 bp, Homo sapiens
  misc_feature 1..334: note = chr13:29105249-29105583
  misc_feature 1..334: note = hyper
  source 1..334: mol_type = genomic DNA
cccttcccaacagatcgagagctcggaggcttggcacggtcggtcccgatggccccagcgggagggtcacggttgagacagcagccccatctcattgtttaaggccggggcttcctcttttggcggagcgggagcgggagcgggagctgagcgggaaggggacggacgccgcgggagccttcgggatgtctattgctgccgctccctcccctcgccgggagcttgggtttcccggggtgtgtgcggattctcaataaaaagggaaaagcacgatccaagttaattttccagcgccgacaggaaatgctgtttcctgcatcgtacaacgctggtg

SEQ ID NO: 34883 - DNA, 114 bp, Homo sapiens; identical to SEQ ID NO: 1102
  misc_feature 1..114: note = chr13:29106308-29106422
  misc_feature 1..114: note = hyper
  source 1..114: mol_type = genomic DNA

SEQ ID NO: 34884 - DNA, 392 bp, Homo sapiens; identical to SEQ ID NO: 1103
  misc_feature 1..392: note = chr13:29106423-29106815
  misc_feature 1..392: note = hyper
  source 1..392: mol_type = genomic DNA

SEQ ID NO: 34885 - DNA, 119 bp, Homo sapiens
  misc_feature 1..119: note = chr13:29106898-29107017
  misc_feature 1..119: note = hyper
  source 1..119: mol_type = genomic DNA
cgccctgaggtcagggccggggcctgaggacacggcgctgggctccgggggacgcgggttcacgccggcgcccgagcgccacctccccgccctccgccggctcacgtagtcccggggtt

SEQ ID NO: 34886 - DNA, 208 bp, Homo sapiens
  misc_feature 1..208: note = chr13:29393656-29393864
  misc_feature 1..208: note = hyper
  source 1..208: mol_type = genomic DNA
caatgcctcctgctgcgcctaattcgaagcggctccctcttctgttctgagcggaaaacagcggaacccattcctggaggcctgccctggaacggccaactcattcttactcctttctcctggggtccgatgctagggcaccacggtgaccagccgcgcagcgggcagcggcccgcgccgcgcccaccgcctgcggaggctgggtctg

SEQ ID NO: 34887 - DNA, 14 bp, Homo sapiens
  misc_feature 1..14: note = chr13:29394329-29394343
  misc_feature 1..14: note = hyper
  source 1..14: mol_type = genomic DNA
gggagcgcctgggc

SEQ ID NO: 34888 - DNA, 268 bp, Homo sapiens
  misc_feature 1..268: note = chr13:29394643-29394911
  misc_feature 1..268: note = hyper
  source 1..268: mol_type = genomic DNA
aggaggaggaagcagcgtggcggaacccggcccgagatgagcgtctccgtgagggcagtggtggcctcttggacattacatctttcttggctctttttgacccaggtgagcgaatcctctgctgcgcggtccggtggggtcggctggctctgctgccgccctctggacccgccggagacaggtgagcggagttggggagcgcgcagccgggctcggggcagcgccgggctggttcggcttctcgtctccagagcgctgatgcttcctg

SEQ ID NO: 34889 - DNA, 160 bp, Homo sapiens
  misc_feature 1..160: note = chr13:33001068-33001228
  misc_feature 1..160: note = hyper
  source 1..160: mol_type = genomic DNA
aaaggcaaaagaaggcgggagggcaagccaggcaggaaggccagcgtcaaggagagaagcggcttggtttacaggagataaaaacagttcgaagttgctggaacatcaagcgcaaggcagggagcggtgggagttcaggctggagcggtggggcctagca

SEQ ID NO: 34890 - DNA, 176 bp, Homo sapiens
  misc_feature 1..176: note = chr13:33590482-33590658
  misc_feature 1..176: note = hyper
  source 1..176: mol_type = genomic DNA
cgggggtgggcgcgccggcggtgggcgggcgggcgcggcggggcgcgggcataaaggggcgcggcgcggggccccggagcctggctcccgcgcagcatgcccgccagcgccccgccgcgccgcccgcggccgccgccgccgtcgctgtcgctgctgctggtgctgctgggcctggg

SEQ ID NO: 34891 - DNA, 375 bp, Homo sapiens
  misc_feature 1..375: note = chr13:33591066-33591441
  misc_feature 1..375: note = hyper
  source 1..375: mol_type = genomic DNA
cgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggtgagtgcgaggggccaggcggagggccacgcaggggagacaga

SEQ ID NO: 34892 - DNA, 41 bp, Homo sapiens
  misc_feature 1..41: note = chr13:33924637-33924678
  misc_feature 1..41: note = hyper
  source 1..41: mol_type = genomic DNA
cggacgcggcactcccgccggggtcccgggacccaatgcgg

SEQ ID NO: 34893 - DNA, 41 bp, Homo sapiens
  misc_feature 1..41: note = chr13:35517132-35517173
  misc_feature 1..41: note = hyper
  source 1..41: mol_type = genomic DNA
ggatgattaacccttcggtgccgatccgcaacatccggatg

SEQ ID NO: 34894 - DNA, 646 bp, Homo sapiens
  misc_feature 1..646: note = chr13:36704800-36705446
  misc_feature 1..646: note = hyper
  source 1..646: mol_type = genomic DNA
cacacatcactggcccgggcacacggaaaagcacacacacaataagaggccgggcccggccactccttccttggttcccgctccgcagccagttctgacaatgacaagcacctctcccagctcctccgccctggctctccatctccactaacaacgcgaaaagcctgggagggcccgctcgcctgactccaggtttaaagccccatggcaccaaacaaaagaggcaggtgccagcagccccggggccgcccgcacgcaacgcccccgggtcgggccaggctggccagggcagggcggccgcctttcgaggaactgcgggcggggcggcggggccaagctgagcgcccgccctgccctcggcgccccgcggctgcgggcggagcgggctctgcggagtcccccggccgccctccccgcagctcccgtccccagggaaggcaaaccacgcaccggtccgcggagagacgccgccgggggtctttgtggccgcgctgggggccgcctcctggtgctgtcctcgccgggctgggcgcggccggggctgcggggctgcagggctggggggcggcggcggggccgggctgggcggcagcagctgctggagcgcggcgcctcggttgcggccactagtgcagggatgtgcctc

SEQ ID NO: 34895 - DNA, 119 bp, Homo sapiens
  misc_feature 1..119: note = chr13:36705447-36705566
  misc_feature 1..119: note = hyper
  source 1..119: mol_type = genomic DNA
gcccgtcctcattgaaatgcggcgcttcgcacagcctcactccagcctctctctccagaggagggcggcggcggcggcggcggcgggcgcgctcccttttcttgtctcactcgctcaca

SEQ ID NO: 34896 - DNA, 15 bp, Homo sapiens
  misc_feature 1..15: note = chr13:36705621-36705636
  misc_feature 1..15: note = hyper
  source 1..15: mol_type = genomic DNA
cgcccttcttggcag

SEQ ID NO: 34897 - DNA, 91 bp, Homo sapiens
  misc_feature 1..91: note = chr13:36729246-36729337
  misc_feature 1..91: note = hyper
  source 1..91: mol_type = genomic DNA
cggcggcgccttcccccggcgtccccaaatagaaacagcactagtgccctctctccgaccccaccagggccgctgccgggctcctccttac

SEQ ID NO: 34898 - DNA, 345 bp, Homo sapiens
  misc_feature 1..345: note = chr13:36919879-36920224
  misc_feature 1..345: note = hyper
  source 1..345: mol_type = genomic DNA
ccatcccaatataaccgcagttgttcgtgggccttcttgcagagaaaggctgcccaaccttgacggggccatgggcgctgcgggagggcaaaagaccacagagatctgcgaagccaaagtaaacaacggggttggggcggcgagaatgatcaatagcgatgctccgaaaggactccgcgataggaatcgagcgggaaggattccctccatcctaacagtccatgggttaagaggccgaagcttccctaaataccacactcccgcgagagaagggactgagaacaacttctcaaactattctctctcgaaatcgctcccttcctcgaaaattccatctctgagact

SEQ ID NO: 34899 - DNA, 66 bp, Homo sapiens
  misc_feature 1..66: note = chr13:36920266-36920332
  misc_feature 1..66: note = hyper
  source 1..66: mol_type = genomic DNA
cgcccgctcagcctcccagccgagtccgcggggcctggggcgcccaccccgcccacccaagggacc

SEQ ID NO: 34900 - DNA, 54 bp, Homo sapiens
  misc_feature 1..54: note = chr13:36920333-36920387
  misc_feature 1..54: note = hyper
  source 1..54: mol_type = genomic DNA
cgcaggggtgaactcccccgcgccccacctgcgccttccagacctcgggcgccc

SEQ ID NO: 34901 - DNA, 657 bp, Homo sapiens
  misc_feature 1..657: note = chr13:36920464-36921121
  misc_feature 1..657: note = hyper
  source 1..657: mol_type = genomic DNA
cgctcgccgggggccggtcccgaggttcccaaggcctcgcgcgcgcgcttgccgtggcaaccaagacgttccacgacgcgcgctctcgaacgcttcgcgtcacgcggccgcgcggccccgcccgtcggcctcgctcccgccacagagcccgcagcacgccgccgccgcagcctaggtcacgtgagtacccacgcgcgcgtcttgccagcggattcatcaccggcctgctcagactaggttctgcccactctgaccttctaaatggtacgtgggaggacgtccgtccccttcggacccaagagtcaccgtaacactctagaaggggagaaaaggagcgagggcggcaggcgacagagaacctcgcgagtcagcggccccgcgcagacccccccaggcacggtcccctgcggccacgtcggctgctcggcgcctgcgcaatctctttctctccagcgaaaccgaggcctccggagagcctagtagagagtgtgggcagtgagcgcttgtagccgctagagggagcgctgggcacagtgcacgagagacaataaaggctgattatcccctcaatgtctctgcagcctgagctttgtgacttctgtatccagagcacagttaatttccaaaagcccgcctgcaccacgtgttttaagtctt

SEQ ID NO: 34902 - DNA, 34 bp, Homo sapiens
  misc_feature 1..34: note = chr13:37004837-37004871
  misc_feature 1..34: note = hyper
  source 1..34: mol_type = genomic DNA
gcaggtgggggagggcgcccgggaagatatccaa

SEQ ID NO: 34903 - DNA, 108 bp, Homo sapiens; identical to SEQ ID NO: 4013
  misc_feature 1..108: note = chr13:37005473-37005581
  misc_feature 1..108: note = hyper
  source 1..108: mol_type = genomic DNA

SEQ ID NO: 34904 - DNA, 164 bp, Homo sapiens; identical to SEQ ID NO: 4014
  misc_feature 1..164: note = chr13:37005899-37006063
  misc_feature 1..164: note = hyper
  source 1..164: mol_type = genomic DNA

SEQ ID NO: 34905 - DNA, 225 bp, Homo sapiens
  misc_feature 1..225: note = chr13:37006433-37006658
  misc_feature 1..225: note = hyper
  source 1..225: mol_type = genomic DNA
cgcatcgctaagcccggccgcctcccaggctggaatccctcgacacttggtccttcccgccccgcccttccgtgccctgcccttccctgcccttccccgccctgccccgcccggcccggcccggccctgcccaaccctgccccgccctgccccgcccagccggccacctcttaaccgcgatcctccagtgcacttgccagttgttccggacacatagaaagataa

SEQ ID NO: 34906 - DNA, 138 bp, Homo sapiens
  misc_feature 1..138: note = chr13:37006733-37006871
  misc_feature 1..138: note = hyper
  source 1..138: mol_type = genomic DNA
cgcagcaccctgctcgtcacttgggatggagaccggctttcccgcaatcatgtaccctggatcttttattgggggctggggagaagagtatctcagctgggaaggaccggggctcccagatttcgtcttccaggtaac

SEQ ID NO: 34907 - DNA, 471 bp, Homo sapiens
  misc_feature 1..471: note = chr13:37248523-37248994
  misc_feature 1..471: note = hyper
  source 1..471: mol_type = genomic DNA
gtcccgagaagcaatcgcagcccggctctccgagtcttggggtgactccacgggctgcaggaggagccgcgaggggccctgagtgcaatgtccttggccccgtgttgacctgcctcggtcccagacactgggaaccgggaaggtctaccctcgctctgcaaggtggattcctccatgcaagtgtagacagttctacactttgcagagtgtgtctaggtgccttctgtttgcttttgcctttgtggtgtgtggagggtcattcttgggtttgttttgctcctgtctgattttctagggtcatttgcgtcccttctcgggaacggggactcgccatgcgcacactgacagctggctttgcacctgctaaggcgctggagagtcttttcgcccgtcttagggtggccctaaatccggggaagttttatgtggcgctgaacacttgcgtttcccaggggcgttttccctagctcc

SEQ ID NO: 34908 - DNA, 15 bp, Homo sapiens
  misc_feature 1..15: note = chr13:37249039-37249054
  misc_feature 1..15: note = hyper
  source 1..15: mol_type = genomic DNA
cgggtctgatgagac

SEQ ID NO: 34909 - DNA, 30 bp, Homo sapiens
  misc_feature 1..30: note = chr13:38443600-38443630
  misc_feature 1..30: note = hyper
  source 1..30: mol_type = genomic DNA
ccccgcagggatgtccgcctcccagaagag

SEQ ID NO: 34910 - DNA, 87 bp, Homo sapiens
  misc_feature 1..87: note = chr13:39260356-39260443
  misc_feature 1..87: note = hyper
  source 1..87: mol_type = genomic DNA
ttggtctaattactgcgaagagaacaggaacgtctctaatgacagctaccctaacagagtcggatttgggagcgcctggggccacat

SEQ ID NO: 34911 - DNA, 300 bp, Homo sapiens
  misc_feature 1..300: note = chr13:39261007-39261307
  misc_feature 1..300: note = hyper
  source 1..300: mol_type = genomic DNA
caggacaacctgttgcgcctctatctcctcccctccccgcagtttccccgccttggcctctaagagctgattggcagaaattactacccaaccctcagctccgcacctcctcccccgaccaacgattggccacctgggaggactggagtaaggggtgcgagcggagggatttccctcaaagcccagggtccggggacctggaaagtagaagtggagggattcaattctccgcgcgattgaggcgctagcggcggagctggacggcctgggaaggcttcggctcctcggctgcggctccag

SEQ ID NO: 34912 - DNA, 94 bp, Homo sapiens
  misc_feature 1..94: note = chr13:39261689-39261783
  misc_feature 1..94: note = hyper
  source 1..94: mol_type = genomic DNA
aggccatagtgctggcgaaccgcggactccgggtgcctttcggccgtgaagtctggctggatcccctgcatgacctggtgttgcaggtgcagcc

SEQ ID NO: 34913 - DNA, 102 bp, Homo sapiens
  misc_feature 1..102: note = chr13:39261928-39262030
  misc_feature 1..102: note = hyper
  source 1..102: mol_type = genomic DNA
cgcgtccggctgcagctgcgctatgacgcgcccggaggggcagtagtgctaccactggtactggaggtggaggtggtcttcacccagctggaggttgtgact

SEQ ID NO: 34914 - DNA, 112 bp, Homo sapiens; identical to SEQ ID NO: 11605
  misc_feature 1..112: note = chr13:39262129-39262241
  misc_feature 1..112: note = hyper
  source 1..112: mol_type = genomic DNA

SEQ ID NO: 34915 - DNA, 95 bp, Homo sapiens
  misc_feature 1..95: note = chr13:42031220-42031315
  misc_feature 1..95: note = hyper
  source 1..95: mol_type = genomic DNA
ccccttgggacaatgcgtaggggacctccgcgtccccgacacccgactgggacacggccgcgggctccttcgtccctcaccgccagccagggagg

SEQ ID NO: 34916 - DNA, 69 bp, Homo sapiens
  misc_feature 1..69: note = chr13:42032580-42032649
  misc_feature 1..69: note = hyper
  source 1..69: mol_type = genomic DNA
cagcagcggcttcagcgactcggagagtaagtgcggcccccgctaggatggcgccgggatctcccagct

SEQ ID NO: 34917 - DNA, 517 bp, Homo sapiens; identical to SEQ ID NO: 4016
  misc_feature 1..517: note = chr13:43566059-43566576
  misc_feature 1..517: note = hyper
  source 1..517: mol_type = genomic DNA

SEQ ID NO: 34918 - DNA, 137 bp, Homo sapiens
  misc_feature 1..137: note = chr13:44359843-44359980
  misc_feature 1..137: note = hyper
  source 1..137: mol_type = genomic DNA
ctttccccatgtgctcgccgcgggatgacaaccacaacactccagaaccaccccccttccgaaagagggcggggttacgccttcagccaatcaggacccgcgagccccgggtgtccaacctatggggtggctgtggc

SEQ ID NO: 34919 - DNA, 236 bp, Homo sapiens
  misc_feature 1..236: note = chr13:44360043-44360279
  misc_feature 1..236: note = hyper
  source 1..236: mol_type = genomic DNA
cgggtccggagaggcggggaggcggccggcgtccagcggccgaggcgcgggctctgcaccctggcagcggccgagtccggctgccccagtgcctcctttacctcgcgttgggccaggcagggcgcgctcccgccgacgaagacctgtccaaggtgtccgagctccccgcgagaggggacagtcacgaataacaacagtacccagcgcagactaggcggggaggaaagtttccggcc

SEQ ID NO: 34920 - DNA, 327 bp, Homo sapiens
  misc_feature 1..327: note = chr13:44360467-44360794
  misc_feature 1..327: note = hyper
  source 1..327: mol_type = genomic DNA
cgcggagcccggagctgacactggctggcgggcggaggggagagcggggaacagctgtctggggcgctgggcacccccgggcgcgtaaaagtgagggagcttgagacggggcacggcggggaagggcgtgggggctgcaccgaagcccccacgcgtccacgcacccctcctcaccagcctcacctctagctccactcccctcccccctcgcccactcccctctcagtctagatccaggtgccgtggcgggggtgagaccagaggaccccggctcggagcccggacgccccagggaggctgcgggccccggagctgcttacctggggc

SEQ ID NO: 34921 - DNA, 99 bp, Homo sapiens
  misc_feature 1..99: note = chr13:44360995-44361094
  misc_feature 1..99: note = hyper
  source 1..99: mol_type = genomic DNA
cggctggaagcctgtgtgagtagcggcgcccgggagagcggggatctgctgaggggcgctggagactccgcggctggaggcgcgcgggcgtgcgcacgc

SEQ ID NO: 34922 - DNA, 780 bp, Homo sapiens
  misc_feature 1..780: note = chr13:44947737-44948517
  misc_feature 1..780: note = hyper
  source 1..780: mol_type = genomic DNA
cgacgcgctcacaaacgccgtggtcgcccgaaccttcggccccgcagcattcggctacaggaccgcgacactgcagggccccggctctgcgcgctgcgctccggccgctcggcgcgggaggacgtgcggtcgcgcctgcctcggtggccgcgcggggtaggtggctgcggggaccggaaggatggcgaggaagtcggaaagggtttcctgagatgagagattacttccgtccgggctgcggcctctctctggagtcggctagccggggctcggggagcggggtgcgcagggctcggggccacgccttgccacctgcagcgcccgggtgggccgcgggggcctcggcgggacgcgctcggccctgtcgcaggagctaacgcagggggaatccttgcaggtgggagcatttcagagcgcacaagccatggtggccaaacagcggatccggatggctaacgagaagcacagcaaaaacatcacccagagggggaacgtagccaaaaccctggtaaggcggggtcggcgccggccaggcagagccctgcagcccggcggggtggggcggaaggtgggggcggggccgggcgggtagcggcgcagggtccggcctcccggctcccggcccgccccttctgcggggtcctgcagagtgggggctgagagctgggttcagggcggcgcggtctgcttggcgtcctcgtgggcggagagggccctggttggtcgtggcccctctgggagtggctacctgggctaccagggaggcgcagaggagccctc

SEQ ID NO: 34923 - DNA, 207 bp, Homo sapiens
  misc_feature 1..207: note = chr13:45885757-45885964
  misc_feature 1..207: note = hyper
  source 1..207: mol_type = genomic DNA
ctgccgagcagcatccgcgcggagcgagctgcggtcctcgggaccccgcagcaggagccacgagcccgccccggcgtccgagccctgcaggcgaggccaggcttggcgcggagggacctcagcgtccggggagcgctcgctgtctttgagttcctgctgccagagccgggcctcctctgctctccgcagcctcgcagggagggcgca

SEQ ID NO: 34924 - DNA, 146 bp, Homo sapiens
  misc_feature 1..146: note = chr13:46189788-46189934
  misc_feature 1..146: note = hyper
  source 1..146: mol_type = genomic DNA
ggagcgcattgctaacgtgcgcagcccttacccaagccaggctcccgcgcgtgcatccaccgcgatctcaggccccggcgtttgtggcagctctcggttaccatgggaaccgcactccgcagcctccctgggccccatctaatctg

SEQ ID NO: 34925 - DNA, 33 bp, Homo sapiens
  misc_feature 1..33: note = chr13:46425360-46425393
  misc_feature 1..33: note = hyper
  source 1..33: mol_type = genomic DNA
ctctcaggttgacagcgtcggggaaagacatca

SEQ ID NO: 34926 - DNA, 548 bp, Homo sapiens
  misc_feature 1..548: note = chr13:46961084-46961632
  misc_feature 1..548: note = hyper
  source 1..548: mol_type = genomic DNA
tctccaaggggtccccgacactgctctgagcgaccctaagatacctgggtgtctctgctgggcacaaacctctctggcgccacttccaccatccaacctctcccgcggccctcccttccctttctccaaccaccctctccaccccgcgccgctcccatctcgcccccggccccgccagcctcacccagccaaacccgagcggtggaacgctgcgctgggtaaacgccgcgcgtcgggtcctccctcgcgcggctccgggcagcgttccgtggccaccgcgctcccggtaacagcagaaaggggagggaggagagctaccgaggaggggacagcgacgccccgacgccgccacgccccccgcctcccacacgggggccaccgtagctctctagaagctcctcagggaagcaaagcgccgttcccgccgcaggcaccgagacgtcgcccagatggaagaaactctggagatgcgcgctcctacaccggtgccgcggcgcccgggcccagcaccacgcacctatgcgcgcctctgccggtcctcctagaaa

SEQ ID NO: 34927 - DNA, 780 bp, Homo sapiens; identical to SEQ ID NO: 1106
  misc_feature 1..780: note = chr13:49794146-49794926
  misc_feature 1..780: note = hyper
  source 1..780: mol_type = genomic DNA

SEQ ID NO: 34928 - DNA, 236 bp, Homo sapiens
  misc_feature 1..236: note = chr13:50070422-50070658
  misc_feature 1..236: note = hyper
  source 1..236: mol_type = genomic DNA
ccagaggacagggcgcggcccaggccagttccacaggtggctctgactgcccatggtttcgcgcgagtggtgggcacgcttcggtttacctcccccgcgggtgacagcccagtgcttccaccacaaccgatgtcaactctcctagcgcccctccgctcaccggtaaaccaggacagtggaggggcgccctgatgcggtgaggcagggggcggccctgagggaagagctgggtctca

SEQ ID NO: 34929 - DNA, 15 bp, Homo sapiens
  misc_feature 1..15: note = chr13:50070684-50070699
  misc_feature 1..15: note = hyper
  source 1..15: mol_type = genomic DNA
cgtctccccttctcc

SEQ ID NO: 34930 - DNA, 108 bp, Homo sapiens
  misc_feature 1..108: note = chr13:50704569-50704677
  misc_feature 1..108: note = hyper
  source 1..108: mol_type = genomic DNA
ccggggcgctgaggtcggcaagtcgtcttcggaactggcggcggcgcttctccagtcgacgtggaaaaaaaaatcgtctcaaatagcacccctcggtctgcagccctt

SEQ ID NO: 34931 - DNA, 30 bp, Homo sapiens
  misc_feature 1..30: note = chr13:50705047-50705077
  misc_feature 1..30: note = hyper
  source 1..30: mol_type = genomic DNA
caattggctgaatctcgaaataactttttt

SEQ ID NO: 34932 - DNA, 30 bp, Homo sapiens
  misc_feature 1..30: note = chr13:51086861-51086891
  misc_feature 1..30: note = hyper
  source 1..30: mol_type = genomic DNA
tcaaagagaaaccaccgcttcctccccgag

SEQ ID NO: 34933 - DNA, 68 bp, Homo sapiens
  misc_feature 1..68: note = chr13:51797123-51797191
  misc_feature 1..68: note = hyper
  source 1..68: mol_type = genomic DNA
aagtctttccgaagtcggctaggaggatggcatttctcgttatatggcttcatcgtgggactttaatc

SEQ ID NO: 34934 - DNA, 63 bp, Homo sapiens
  misc_feature 1..63: note = chr13:52979747-52979810
  misc_feature 1..63: note = hyper
  source 1..63: mol_type = genomic DNA
gaagtctacccctcgcgtcgtcagcttaaagccctccttaatgaggaccgtctttaatttaat

SEQ ID NO: 34935 - DNA, 169 bp, Homo sapiens
  misc_feature 1..169: note = chr13:52980066-52980235
  misc_feature 1..169: note = hyper
  source 1..169: mol_type = genomic DNA
tgaggtggcagagtccggaggcatttcccgaccccagaggagcctccaagagtctcgcggcacgggcgcgaacaccaggatgcggagggcgcttcttacctttcgagactgacgggcagcaaccccaggccgtccgggcgcgtggcgaggcggacgggaaggctcaggg

SEQ ID NO: 34936 - DNA, 105 bp, Homo sapiens
  misc_feature 1..105: note = chr13:53174056-53174161
  misc_feature 1..105: note = hyper
  source 1..105: mol_type = genomic DNA
ctagtccccagagcccgggctttagggcgcccggatgcaaaccagttttgccgccaaggaacccggacaggcgcgcctcctccccggcctcgcaaggaacaggtt

SEQ ID NO: 34937 - DNA, 14 bp, Homo sapiens
  misc_feature 1..14: note = chr13:53174673-53174687
  misc_feature 1..14: note = hyper
  source 1..14: mol_type = genomic DNA
gggtgctttcctac

SEQ ID NO: 34938 - DNA, 454 bp, Homo sapiens
  misc_feature 1..454: note = chr13:53312860-53313314
  misc_feature 1..454: note = hyper
  source 1..454: mol_type = genomic DNA
tgccttccccacggtcgcgccactgcttagtgggagatgagccgagaacggcctttctcggaccgtccactacattctcccctactctacgcttcaatcttctcccgtgaaaccttcacttgcttttctacaacgttgacctaaggcggaaagccgcgtgccagagtgggatgggagaggggagctcacgctgggcccgaggggcccgccggcagccgcgcgcccctcgccggcccgcgctcgggctccccctaggggcaccatgggcgacacgggggtccccgcgcgccgccctctggacttacgtgactgtcgctccccttccagaagtagaaggccccgatggccccaaagagcagcagcacagctcccgaaatgaggaccacggctcccaccttgagcagccgcgcggggctggagggcttcaccgtcagcgtagcgtacgcctgcgggc

SEQ ID NO: 34939 - DNA, 17 bp, Homo sapiens
  misc_feature 1..17: note = chr13:53313512-53313529
  misc_feature 1..17: note = hyper
  source 1..17: mol_type = genomic DNA
cgcagcacagggccttc

SEQ ID NO: 34940 - DNA, 83 bp, Homo sapiens; identical to SEQ ID NO: 1109
  misc_feature 1..83: note = chr13:53313530-53313613
  misc_feature 1..83: note = hyper
  source 1..83: mol_type = genomic DNA

SEQ ID NO: 34941 - DNA, 273 bp, Homo sapiens
  misc_feature 1..273: note = chr13:53313677-53313950
  misc_feature 1..273: note = hyper
  source 1..273: mol_type = genomic DNA
cggtggcacgcacccctgagtccgaactgtggaacctgatactcacacaacccaggccctgcgtgtggaatccctggcggtactcaccggggggctgcagaattccacgtcatcaggtcccaccagggcaatgggaactttgtcggagttctctgtcatgtttgcggcgggaggagtgaggcacttggagactccctgggcaccctgggatctgtcccgctgccccgacgtgcagggcatttcaacgccgcgcgcacacacggtgcacggtcc

SEQ ID NO: 34942 - DNA, 287 bp, Homo sapiens
  misc_feature 1..287: note = chr13:53419734-53420021
  misc_feature 1..287: note = hyper
  source 1..287: mol_type = genomic DNA
ctcctttccaaaacccggggaggcaccgtagggctgcagcagggaataggggaatgggagtggggggagggttggataagaaacaaacaaaaaacaagtgcgacaggttgtctacctgaatgcacccaccctacccctccagtctcccttcccccagcctgtccgcggagctcggaggggggcgcccagccgaaggaaggcctcacctcggcgtgcgcgccgcggagccgctgctgcccctcgaagtgacaggcgctttccccagtggcgctgccgccctctgagcc

SEQ ID NO: 34943 - DNA, 22 bp, Homo sapiens
  misc_feature 1..22: note = chr13:53421826-53421848
  misc_feature 1..22: note = hyper
  source 1..22: mol_type = genomic DNA
cgccctgcgggaaggccgggct

SEQ ID NO: 34944 - DNA, 138 bp, Homo sapiens
  misc_feature 1..138: note = chr13:53422642-53422780
  misc_feature 1..138: note = hyper
  source 1..138: mol_type = genomic DNA
aggctctcggaatcacgctctttgcgagccctgtgcgggagaagtctgcgggtagcagctccgagcctccagcgggctctgaggacgcgcggacccgccctcactctgcgcctctccgtctcttacagaagctgcgcc

SEQ ID NO: 34945 - DNA, 27 bp, Homo sapiens
  misc_feature 1..27: note = chr13:53422781-53422808
  misc_feature 1..27: note = hyper
  source 1..27: mol_type = genomic DNA
cctcgcgccgcctttgcctttatagcc

SEQ ID NO: 34946 - DNA, 76 bp, Homo sapiens
  misc_feature 1..76: note = chr13:53422809-53422885
  misc_feature 1..76: note = hyper
  source 1..76: mol_type = genomic DNA
ccgatatgctaatcacccgagccgggtagccaatggccgcctccccctcgcgtcgcccctccgcctgcctctgaca

SEQ ID NO: 34947 - DNA, 30 bp, Homo sapiens; identical to SEQ ID NO: 11621
  misc_feature 1..30: note = chr13:53423168-53423198
  misc_feature 1..30: note = hyper
  source 1..30: mol_type = genomic DNA

SEQ ID NO: 34948 - DNA, 341 bp, Homo sapiens
  misc_feature 1..341: note = chr13:53423765-53424106
  misc_feature 1..341: note = hyper
  source 1..341: mol_type = genomic DNA
ctaaacggtgatgggcgctgaattccacacaatacccggctcgtattaaagtgcatttagagaactttttcctcctgatgccttgttccgcctatttagaggattttctttctgttctaatagggccactctgggaagcaacactcgtccggttccagaagaacaaaatcacagcgtgacgttgaaacctggcaggaacgtggggggaacttaaccatctgcttaggaaagtgtggagcttcggcactgccaaaatctgggctgggcggatcctggggctggccgggcgctgcgctgccccacagatagccccctcccatccctgacggccagggagatgg

SEQ ID NO: 34949 - DNA, 105 bp, Homo sapiens
  misc_feature 1..105: note = chr13:53424765-53424870
  misc_feature 1..105: note = hyper
  source 1..105: mol_type = genomic DNA
gggggtacacgcagtcgaaggaactttctattttccttccgagccccgcaacactcccaccccaacctggggctggctggtgacctttagcgcccctaggctaac

SEQ ID NO: 34950 - DNA, 196 bp, Homo sapiens
  misc_feature 1..196: note = chr13:53425241-53425437
  misc_feature 1..196: note = hyper
  source 1..196: mol_type = genomic DNA
tactcaaagtgcttccgcgtcagcatgctcattctcaaggctgaaataaaccaaggcgtgcttgaaagtgggaaaaggaaaggggagtaggggcaggcaaaagccaggaggcgggaggaggggtgtagggtggctggtagcaggtctaaagtgttttttccgcggccaggccctcgtcgatcggaagtagccacga

SEQ ID NO: 34951 - DNA, 146 bp, Homo sapiens
  misc_feature 1..146: note = chr13:53425699-53425845
  misc_feature 1..146: note = hyper
  source 1..146: mol_type = genomic DNA
aaagggaggggagctcgcccgcccgggtgctgatcaggcctcacaaaagccgctcgaatcgccttgttatcataccaaaaggtctgggcaggcccaaaggagcccctttctctcggttttagcaacttcgccggcaactgtctcgc

SEQ ID NO: 34952 - DNA, 831 bp, Homo sapiens
  misc_feature 1..831: note = chr13:58203590-58204421
  misc_feature 1..831: note = hyper
  source 1..831: mol_type = genomic DNA
gcatgttcgtaccagcgcgggcagaaacgggctcacgagcgccctcgaattcacacacactcaccgaaatacacatctcagcccgtggaagcgcattcacacacacccacgtacactcctccgcacctcattcagatgggtccacgcggagtcagggctgcgcttcccttggcatgggcgtgtgtgcggcgagggcgtgtgtgcgtgcgtgtgtgagagtgtgtgtagagaaaccctttaggcagaccgcagctacgttattctgcaagcatactgcgattcccgattccgtgtatgtaggaccacaaaaaaattaaatcgctgttaaacttttttttgtaaattctcttttccgaaggaaggcgctggaagagctactcccggtggttaaaggcccgggagacctggtggcgaatcctggggcgcgtccgctttggcggagcgctgggctccgctagccggactggttccccatctaactgatctaatcaatgactccgaagagccggggctcctggccccgcccccgccatcctcttctccgcctcccattggacgcgggccgagaaggcagggccttgctcctcgctcggattggctgacagggaatcagtatcaatgtttaagcggcggcgtgaggtgaatagagtcagtcagcaagagacgctggggagagagcagggatcgcgagcccggcggatgcggcagcggcggaaggcggctggggagacgctactccaactgttgaattgaattttcacctttcctttcatccgctgctttgcttgcggagatggatttatttgctttgaaatccgcatatctttctca

SEQ ID NO: 34953 - DNA, 63 bp, Homo sapiens
  misc_feature 1..63: note = chr13:58204937-58205000
  misc_feature 1..63: note = hyper
  source 1..63: mol_type = genomic DNA
gggaggaccatgaggcgagagtgaatacgattcgttccgctgcttctgactcatccggcagat

SEQ ID NO: 34954 - DNA, 392 bp, Homo sapiens
  misc_feature 1..392: note = chr13:58205840-58206232
  misc_feature 1..392: note = hyper
  source 1..392: mol_type = genomic DNA
gaggaaactacaaatcgggacactagttctttacgctgcatttcctcccctccctttggctgctcggaaaggagagagaggaaaaaaaaaatacgcttggctggtagatgcagtccgccgccgccgctgcctcagccagcaatgcaagattagatctctaaatgcagcaaaacactgcctgaaaacagaccggcccgcgcagcaagcagacatttcacggtgcgctggggaagcttcaaaatatatctgtgactctgtcttcgttgctcttcatccccatcaatttcatcacgggaggcgagcagcaagtaagaatttcactttcggatctgcctagagacacacctccctgctccctcccccactcgatgtgaagagtattccggagtctc

SEQ ID NO: 34955 - DNA, 210 bp, Homo sapiens; identical to SEQ ID NO: 11626
  misc_feature 1..210: note = chr13:58206452-58206662
  misc_feature 1..210: note = hyper
  source 1..210: mol_type = genomic DNA

SEQ ID NO: 34956 - DNA, 114 bp, Homo sapiens
  misc_feature 1..114: note = chr13:58206898-58207012
  misc_feature 1..114: note = hyper
  source 1..114: mol_type = genomic DNA
cctgctggacgtggacgcagacagcgggctcctctacaccaagcagcgcatcgaccgcgagtccctgtgccgccacaatgccaagtgccagctgtccctcgaggtgttcgccaa

SEQ ID NO: 34957 - DNA, 247 bp, Homo sapiens; identical to SEQ ID NO: 11627
  misc_feature 1..247: note = chr13:58207567-58207814
  misc_feature 1..247: note = hyper
  source 1..247: mol_type = genomic DNA

SEQ ID NO: 34958 - DNA, 234 bp, Homo sapiens
  misc_feature 1..234: note = chr13:58207891-58208125
  misc_feature 1..234: note = hyper
  source 1..234: mol_type = genomic DNA
cgggcccgggggttccgtccccttcaagcttgaggagaactacgacaacttctacacggtggtgactgaccgcccgctggaccgcgagacacaagacgagtacaacgtgaccatcgtggcgcgggacgggggctctcctcccctcaactccaccaagtcgttcgcgatcaagattctagacgagaacgacaacccgcctcggttcaccaaagggctctacgtgcttcaggtgca

SEQ ID NO: 34959 - DNA, 609 bp, Homo sapiens
  misc_feature 1..609: note = chr13:58208334-58208943
  misc_feature 1..609: note = hyper
  source 1..609: mol_type = genomic DNA
tgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctatctggtgagcactgtgcgcgccctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgggacatgtcgctgccgctcatcgtgactctgagcactatctccatcatcctcctagcggccatgatcaccatcgccgtcaagtgcaagcgcgagaacaaggagatccgcacttacaactgccgcatcgccgagtacagccacccgcagctgggtgggg

SEQ ID NO: 34960 - DNA, 69 bp, Homo sapiens
  misc_feature 1..69: note = chr13:67804269-67804338
  misc_feature 1..69: note = hyper
  source 1..69: mol_type = genomic DNA
acttcttgtaggaaacgtcagagttgcggtgatgatgattctctgacagctatccgggtgacagttgcc

SEQ ID NO: 34961 - DNA, 100 bp, Homo sapiens
  misc_feature 1..100: note = chr13:67804644-67804744
  misc_feature 1..100: note = hyper
  source 1..100: mol_type = genomic DNA
cggcagcagcgaaaacccggaaatctgatcctggccccaggagagccgggttccatgaggtgcactgagcatgctctgcagggtccggcgtgggagggac

SEQ ID NO: 34962 - DNA, 23 bp, Homo sapiens
  misc_feature 1..23: note = chr13:67804745-67804768
  misc_feature 1..23: note = hyper
  source 1..23: mol_type = genomic DNA
cgctggcgctccccaggcccggg

SEQ ID NO: 34963 - DNA, 384 bp, Homo sapiens
  misc_feature 1..384: note = chr13:67804863-67805247
  misc_feature 1..384: note = hyper
  source 1..384: mol_type = genomic DNA
cgcggatccggggaaccagggccaccgctgcgggcggatgggggtcaccgaggcggctcgtctccaggcgcacacttcgcacatctctttgctaagtgaaggggccaaaatgcacagatgggggagtctacccaggaacagaggcgcgagacgtatagccacccctgggttgggagcacgagccagcagatccccggagcgcgttaaacggacaacatgcccggtgctgcaaatagaggcttttgctggcagggacattggaaagaagggcggagagggagtacagcgaaaggtggggaccgcagaatttggaatctctgcggagaccggaaagaaaattaatcggagcacttcctacatgcagagccacggaaactgccttgg

SEQ ID NO: 34964 - DNA, 199 bp, Homo sapiens
  misc_feature 1..199: note = chr13:70681579-70681778
  misc_feature 1..199: note = hyper
  source 1..199: mol_type = genomic DNA
agaggacggggaggacgatgaagaggaagaggaggaaggcttcttccagaaagtgctcacaccgcttctctcttggcttttgagcaggcgactctggctgggtccccagtgctcaaagctgccactgccgtcctgttgcaggcagcctccccccgccgggccgccggtggaaggagacgggtggctgaagagtttccag

SEQ ID NO: 34965 - DNA, 205 bp, Homo sapiens; identical to SEQ ID NO: 4025
  misc_feature 1..205: note = chr13:70681866-70682071
  misc_feature 1..205: note = hyper
  source 1..205: mol_type = genomic DNA

SEQ ID NO: 34966 - DNA, 30 bp, Homo sapiens
  misc_feature 1..30: note = chr13:72438533-72438563
  misc_feature 1..30: note = hyper
  source 1..30: mol_type = genomic DNA
ggaaaaaagagctagcgctttttcaaccca

SEQ ID NO: 34967 - DNA, 124 bp, Homo sapiens
  misc_feature 1..124: note = chr13:72438769-72438893
  misc_feature 1..124: note = hyper
  source 1..124: mol_type = genomic DNA
gaacttttgcctctgcgcttccttgcagagaaccgtggggacaaagcggcgctgtgaaagggggtggaatgatcatctctaccccgaaactgacaagttgccccactcccgccccctcttggta

SEQ ID NO: 34968 - DNA, 65 bp, Homo sapiens
  misc_feature 1..65: note = chr13:72440007-72440072
  misc_feature 1..65: note = hyper
  source 1..65: mol_type = genomic DNA
tggtgggaaggggcgcgggcggcgggggctatcccccccgactcaccttgcgttggtgcagtcat

SEQ ID NO: 34969 - DNA, 30 bp, Homo sapiens
  misc_feature 1..30: note = chr13:72440711-72440741
  misc_feature 1..30: note = hyper
  source 1..30: mol_type = genomic DNA
ccgccgccgccgaagcgatgggctccgggc

SEQ ID NO: 34970 - DNA, 91 bp, Homo sapiens
  misc_feature 1..91: note = chr13:74707261-74707352
  misc_feature 1..91: note = hyper
  source 1..91: mol_type = genomic DNA
agttacacatcattacgaccagagacaataatgaatgtagcaccaggagcactattcatgccagcagtgtcatctccgccttaaccccttc

SEQ ID NO: 34971 - DNA, 43 bp, Homo sapiens
  misc_feature 1..43: note = chr13:74707625-74707668
  misc_feature 1..43: note = hyper
  source 1..43: mol_type = genomic DNA
cttctttcttctccacgaatccgaccgacgctacttgctttgc

SEQ ID NO: 34972 - DNA, 165 bp, Homo sapiens
  misc_feature 1..165: note = chr13:75149921-75150086
  misc_feature 1..165: note = hyper
  source 1..165: mol_type = genomic DNA
cggcccggagaggctcgcggatgcctggccgcgcgcctccgcgggacgtcagcgcccgcggcacgatctgctgctgtcactatcagtatccggcaggagcccgcccgccccggcccggccccaggccgtggaggaggggggagggtgcggcgcaggaagctgaag

SEQ ID NO: 34973 - DNA, 981 bp, Homo sapiens
  misc_feature 1..981: note = chr13:78492991-78493972
  misc_feature 1..981: note = hyper
  source 1..981: mol_type = genomic DNA
taatatgcagtggggcggggcgttctggaaggggtgtgccagggagggaatgatgggggtcccaggcaaagctccgaactctttcacgtaacgggaggaatacagacacgtcttagttaagcgtgcgtgggaaccgcggaattaaggcacctagaggccaagggcttgtgtcaagctctgcattttgccccgcaggggaacctctataccccgcgattgaactcgaaagactcctcccggcggatgaaagccgctactccctggctggctgagctacagctcccgcagcgcgcccaggagtgcgccggagattcggaaacccgcagagacttctcaagtcagcaggaacttggaaaccgctgttccctccaaacggcttcaaacactcgcgctccttcctttacccaacctaattttaatttgccctctctataggcttaatttttatttttttaaaatcccaaactagtaagccaaaccgaagccccagaataaggttcaatcaatgattttaattcaacaccaagcccgaatgtttacctctcggatctgacaaaccagatgcagagcgacgaatggagaccaccttcccgggaggcggaacccagctgggttccagcctgctctgggagaggagcacgcctcccttgagctgcaggcgggtccggctctgacgaaacgctgcgagaatgccagacagtgtagcctccaccgtttgctcggggtctctgctgccatcagacaagtacttttattcattcatcccttcccatcaatcaccgccagactcctcccgcgccttccgaccccgctgcaacctttccccttgggcgatgcctggacagcatcagtagtagttgcccgagggaggggggcagtcctcgtccggggacaggtcccaaaaggctgtttatttgttagagttctacgctcttcaaatgaacccaaatcaagggcaagttatcacgcaccatgtgacac

SEQ ID NO: 34974 - DNA, 47 bp, Homo sapiens
  misc_feature 1..47: note = chr13:79160995-79161042
  misc_feature 1..47: note = hyper
  source 1..47: mol_type = genomic DNA
atgcagaagagtactcgggaccattgccgggacgagaagcccatcag

SEQ ID NO: 34975 - DNA, 265 bp, Homo sapiens
  misc_feature 1..265: note = chr13:79169849-79170114
  misc_feature 1..265: note = hyper
  source 1..265: mol_type = genomic DNA
cgccccgggtataaatccctgccggataaattcaaatctgtagcagggttttggtaatatgcatcttagcaacaaaacaaaaaccaacctcgtatgccttccagttctttttaaaacgtgtacggcagttgtgaaagttttgtggtgcttgagactgttgacttatgcaactggggagagggtttttttaaccgctttgagatattggtccatcccttttctctcagaacgtcctcaagggcacgtaagagttggaggtgacctc

SEQ ID NO: 34976 - DNA, 37 bp, Homo sapiens; identical to SEQ ID NO: 1112
  misc_feature 1..37: note = chr13:79170347-79170384
  misc_feature 1..37: note = hyper
  source 1..37: mol_type = genomic DNA

SEQ ID NO: 34977 - DNA, 729 bp, Homo sapiens
  misc_feature 1..729: note = chr13:79170467-79171196
  misc_feature 1..729: note = hyper
  source 1..729: mol_type = genomic DNA
cgccacccggagaaccgcggctggtgcccttgaaggccctgggatgcctgggttgggtgggtgagtgaacgagaaccctgagtgagtgaggggagggcgggtcccctcctggcttcaaattcaacccaatcagctctgccgatggtttgaaactgcacacgccgacccacccgccccgaagtctgaaagttatgccctggagacctgcgagctgcggagtgcagctggagagggagctgccccacgaggaggcctccagaataactcccggagtcggaacagcgctgggctgctgaagtttgcagcctccggatccgcgccccgccctgcagatccaccggatttcggggagggaatcggggggctgcccgtcctcccgtaaagctgacttgacaacaattacgaaagtttttaattagctccttgttataattcattttatttccagaactctccgaccataaattattcaaagagtaagccaacccgagcggggcggccgcgcgccttccccacgcgcgccgggctggctctggccgctcagctcacccgatgccccgtgagccagccccgcgccagaagccgcggtggcaggaaggtttgatcaaacattaaataacgtaatgtttgcgacaaggcttatctcacaagtggaaaagaggacctcgcgagaattagaattcggctgctattttaaaaaatcaattaagcttgcggtcttttttgaaa

SEQ ID NO: 34978 - DNA, 349 bp, Homo sapiens
  misc_feature 1..349: note = chr13:79175595-79175944
  misc_feature 1..349: note = hyper
  source 1..349: mol_type = genomic DNA
ttgcaaaaccacacccgcaccacgttctttttgaggtccagtttctcggcgatggcggcgatcttctcggacgagggccggggctgcacggcgaagtaggcctcgagggagcgcttctcgggcgcggcgatggaagtccgcttgcgcttcttctcgccgccgttgaagagctcaggcttgttcattttctcgcgctgggcgccctcggcctcctcgagccacgcctgcaggatgggcttgagcgcgatcatgttgttgtgcgagagcgtgagcgactcgaacctgcagatggtgctctggctgagtgagcccacgcccgggatcttgaggttggccagcgccgagccca

SEQ ID NO: 34979 - DNA, 49 bp, Homo sapiens; identical to SEQ ID NO: 1115
  misc_feature 1..49: note = chr13:79176077-79176126
  misc_feature 1..49: note = hyper
  source 1..49: mol_type = genomic DNA

SEQ ID NO: 34980 - DNA, 145 bp, Homo sapiens; identical to SEQ ID NO: 1116
  misc_feature 1..145: note = chr13:79176276-79176421
  misc_feature 1..145: note = hyper
  source 1..145: mol_type = genomic DNA

SEQ ID NO: 34981 - DNA, 577 bp, Homo sapiens
  misc_feature 1..577: note = chr13:79176608-79177185
  misc_feature 1..577: note = hyper
  source 1..577: mol_type = genomic DNA
ggcgatgtccacggccgccagcgcctcggcccgcgccagcagcgtctcgtccaggctggcgaagaggttgctctgcagctgcaggcgacacaaaccaaaccaaaaaaaccacaaaaccaaaagagcaaaacaaaacaacagaagaaacacacacacaggccggaaagcacagcatgcgaagggcaaacacaaagcaaccaaaataacaacgggtttgggggcagtggagagcgggaaagacggagagggggcacattgacgaccagggagggggcagacgagaagggatgggagcgtggagagggggacagaagtagggagaaagggggacacaagaacacattccggaaacgggcgtgggagacgaaaaagagggaaaagaagaaatggaaatgtaactcgcagctggggacccgtgtcacacacccgagcacgcacagagactgcctttctgaggcgtgaaattaacagagaaagtagagggaagtcgagagtcctggccccagcgctccctactccgatcgcaggcgcctgacgcggaggcagaggcagacaggaacacgacattaagggccgc

SEQ ID NO: 34982 - DNA, 318 bp, Homo sapiens; identical to SEQ ID NO: 1119
  misc_feature 1..318: note = chr13:79177305-79177623
  misc_feature 1..318: note = hyper
  source 1..318: mol_type = genomic DNA

SEQ ID NO: 34983 - DNA, 193 bp, Homo sapiens
  misc_feature 1..193: note = chr13:79177885-79178078
  misc_feature 1..193: note = hyper
  source 1..193: mol_type = genomic DNA
cgtgggagccgctcttatagtgaccaccagcaaggacagcgcaggtgatgcacctgtagctacccgggcatgcgcactgcccgcctcacctttcccaccgtggtctggaaagatcagaaggtccagctattgtctaagggtgggcaccttttagaataaaaaagacgagatgcgcgcacgcccctctatgtgt

SEQ ID NO: 34984 - DNA, 221 bp, Homo sapiens
  misc_feature 1..221: note = chr13:79182709-79182930
  misc_feature 1..221: note = hyper
  source 1..221: mol_type = genomic DNA
ccgcctgggccctgccgcattcaaagctggaagaaggcgctgatcagagaaggggcttccaggtcctgggttagaacaacaacaaacaaacgaaactccacaacagacacgcctgcccatgaccccacgcaaggacataggaagttctgtcgccttcctgctccgcggatagccgcctgccgtctgctgccaccagaacgcacggacgctcggggtggagg

SEQ ID NO: 34985 - DNA, 244 bp, Homo sapiens
  misc_feature 1..244: note = chr13:79183180-79183424
  misc_feature 1..244: note = hyper
  source 1..244: mol_type = genomic DNA
aatcaaagccccttgcgagggactgggaaatagttgccttgtcatgtaacacattgccctgatttattataaaattttaacgaaatcatgcatattttaacagcctttaatcactgcatgaaaatttaattcatgaactgtagcgcgtttaaataaatgaagtgttaattcattaggattaattaatttgttaaaggattgtgtgcaaggttaaggtggaaagaaaactctttgttggtttcgc

SEQ ID NO: 34986 - DNA, 196 bp, Homo sapiens
  misc_feature 1..196: note = chr13:84455560-84455756
  misc_feature 1..196: note = hyper
  source 1..196: mol_type = genomic DNA
tcttctctttgcaaacgtcccctgtaacgtttccagcggcaaaacaaagagacgtctccagcaacagaatccaaagcagcatttttaaagcgagcaattcatccccgatctcatcacaaagtaacagcgaccatcctgctcgccacagacacaattcaagttcatttagtgctccaatgtccgaagccaggaaagg

SEQ ID NO: 34987 - DNA, 274 bp, Homo sapiens
  misc_feature 1..274: note = chr13:84456111-84456385
  misc_feature 1..274: note = hyper
  source 1..274: mol_type = genomic DNA
ctgtgcatggctgtgcgtcggactgaccttgcctctctgatacaaagcagggttttccgcggcttctgttgttgaggctgctggtggagttcttgctgtggttgcgggttgcccagaagtccccccgaggtgctgtccagttcccccggtgctgaaatcacgcccgaccgaaggactcacgctgcccagccaatggcgctggaaaatttccgcaatcgctgcgttttgtggttgtccatccttttcctttcctccccttcggtcctcttaaggc

SEQ ID NO: 34988 - DNA, 451 bp, Homo sapiens
  misc_feature 1..451: note = chr13:88323380-88323831
  misc_feature 1..451: note = hyper
  source 1..451: mol_type = genomic DNA
caggaggaaggcaggcgatcagcacagggctggaatcatctgttcctgaccaccagcaagcctggcactgccggggttatttccactcctccctttcccaatccgagaattgcacagtcccacgctcgaattacacacatggtccaagacttctctctcttcctacgaatgtgacatccaagggggccccggttgcgccgccctagcccagggacgccttcgccctcggctgccatctatcggccaccgagcgcccgcttcgccccgggcccatcatgtctgctgcagcttggctcgcaccagaggcgcgacaataaacaagtgcactggactgggccctgcacccgctccggagcagctgtctcagagacccggtgttgcttaccgcgttgccacctcctcggcgcccgggaggaagacgcaactttctcggagttttttttagagccac

SEQ ID NO: 34989 - DNA, 87 bp, Homo sapiens
  misc_feature 1..87: note = chr13:88323867-88323954
  misc_feature 1..87: note = hyper
  source 1..87: mol_type = genomic DNA
cggttgctgcccgccccccccttcccccagaaaccccaaaggatgtcggtgatagagagttccaactaatgacgattgtgcgccgca

SEQ ID NO: 34990 - DNA, 278 bp, Homo sapiens
  misc_feature 1..278: note = chr13:88324241-88324519
  misc_feature 1..278: note = hyper
  source 1..278: mol_type = genomic DNA
atgcatgcacacccccgcgacccgctccctctggctcgtcccccggcgtgcgccactgaccaggggggaatgtggtgaagacggcgaggaggagagccgaggggggaggggagggccggccggcgcgaacccaggccggagggtgcgaggagccagaggaggctggagggggcggcggccacagctgggtcggagaaagttgccccctatgcagatggcaactgtgagtacccctgtgggggggagggtgcagcgaaggctgccagggaccccgcgat

SEQ ID NO: 34991 - DNA, 79 bp, Homo sapiens
  misc_feature 1..79: note = chr13:88325198-88325277
  misc_feature 1..79: note = hyper
  source 1..79: mol_type = genomic DNA
ctccccttcttcctccgttttcccttccttctctttggggcggggtgggggagggggagcctcgcgtcctggaactccg

SEQ ID NO: 34992 - DNA, 429 bp, Homo sapiens
  misc_feature 1..429: note = chr13:88325619-88326048
  misc_feature 1..429: note = hyper
  source 1..429: mol_type = genomic DNA
tgagaggaagctcttcgacccttgctaactagaactgaattaaagttgtaaacgctggagtttaatactggctggactgaatttgcaatgggctttcagatggggtgggaggtgaatgggggcggggaagcacagggagggagggggaggggacccaacctcgctgaatggatgtgcggatttgatccagcggagaactgaaatttcaaggtaaacgttttgctttcactggggtggggatgtttttgccgcttttaagccgggagacgtttaccgttgcgttgggaggtcggggatacttgcgaggtttatgcactgtggttccaattcatctcgacacgtctgggtggccacacgtgaatgattcgcaggcacactgatacatgtgcgtttgaatgcaggggcgtttaataacgcgggctggagtcg

SEQ ID NO: 34993 - DNA, 208 bp, Homo sapiens
  misc_feature 1..208: note = chr13:88326500-88326708
  misc_feature 1..208: note = hyper
  source 1..208: mol_type = genomic DNA
cttaatcagcccaggcgtcctttccctgagattaaaaaaaagagagaggggagcgttaacaattaaatgtaataagcaactccaaagatggggatgctgtcgaggtggtagttccgtgcaaaccttgctattaccgttgcaaatagacgcggagcccaaggtaagggaggctttcgtgctgatccttggtgtactgattcccggtaag

SEQ ID NO: 34994 - DNA, 188 bp, Homo sapiens
  misc_feature 1..188: note = chr13:88326936-88327124
  misc_feature 1..188: note = hyper
  source 1..188: mol_type = genomic DNA
cgtggtagtgaagtccaccatcaaagcaaatgcgctctccttttttctccttactcaaagctccgggagacaattggtgatttaagagcttcttggggctcctttgatgcattatattacagcctttttgcctctgaaaagtatcctttaggttcccaccgtggcatttctagcgatggtttaaaata

SEQ ID NO: 34995 - DNA, 30 bp, Homo sapiens
  misc_feature 1..30: note = chr13:92050679-92050709
  misc_feature 1..30: note = hyper
  source 1..30: mol_type = genomic DNA
tgggagagcgaggtccgggtttccttctat

SEQ ID NO: 34996 - DNA, 404 bp, Homo sapiens
  misc_feature 1..404: note = chr13:92050996-92051400
  misc_feature 1..404: note = hyper
  source 1..404: mol_type = genomic DNA
cttgcgggctccctgcggctccactagttttcttcgccccgcccagccgcccactcttctcggctagggaagaagaccagagggtgctcagctggaaaactctggtgtctcagcttagggcctcctccgggaagagctaactgctcccaggtgaagccggtgcccgcgggcggtccgtacaccccgcagccggctcgcaccgctcgagagcctcggccgctgtgtcttccacgtctgcagctcagccagggcgcgcagggcgagtggggtccactggcgggtaaaggggaccaggacggcgaggatggacgcacagacctggcccgtgggctttcgctgcctcctccttctggccctggttgggtccgcccgcagcgagggcgtgcagacctgcgaagaagttc

SEQ ID NO: 34997 - DNA, 113 bp, Homo sapiens; identical to SEQ ID NO: 11658
  misc_feature 1..113: note = chr13:92051401-92051514
  misc_feature 1..113: note = hyper
  source 1..113: mol_type = genomic DNA

SEQ ID NO: 34998 - DNA, 20 bp, Homo sapiens
  misc_feature 1..20: note = chr13:93879283-93879303
  misc_feature 1..20: note = hyper
  source 1..20: mol_type = genomic DNA
tcccgggggagccggcgcgc

SEQ ID NO: 34999 - DNA, 157 bp, Homo sapiens; identical to SEQ ID NO: 11660
  misc_feature 1..157: note = chr13:93879304-93879461
  misc_feature 1..157: note = hyper
  source 1..157: mol_type = genomic DNA

SEQ ID NO: 35000 - DNA, 175 bp, Homo sapiens
  misc_feature 1..175: note = chr13:93880042-93880217
  misc_feature 1..175: note = hyper
  source 1..175: mol_type = genomic DNA
gcgggggaaggtgtgcgtctccgccgcctcattgtgtgcacacgcgggagcaccctggctcccgcctcccgctgctctcgcgcccttctaccccttagttgatggctcaggcccggctggccagggagcccgggtcactccggggcggctgcaaggcgcagacggagagccgagc

SEQ ID NO: 35001 - DNA, 205 bp, Homo sapiens
  misc_feature 1..205: note = chr13:93880533-93880738
  misc_feature 1..205: note = hyper
  source 1..205: mol_type = genomic DNA
cgttagggttcctcagtgcttccccagttgctgttggccactcagggcccggggacaccctgccacccggtctggagccggcctcgtctgccagcgaacagccaactttagcgggtggctcagctggggattcgggtccgggttcgggggccccgtgtcccccgcatgcccggccactggcattgctccaccaagagcttgagag

SEQ ID NO: 35002 - DNA, 49 bp, Homo sapiens
  misc_feature 1..49: note = chr13:93880793-93880842
  misc_feature 1..49: note = hyper
  source 1..49: mol_type = genomic DNA
cgcggcagtctgggtgcttgttttccggctcttagctccaaccgaatcc

SEQ ID NO: 35003 - DNA, 183 bp, Homo sapiens
  misc_feature 1..183: note = chr13:93880843-93881026
  misc_feature 1..183: note = hyper
  source 1..183: mol_type = genomic DNA
agcttctctggggctctgtgaatgaaacgtgtcggggagagataatcctttggctgctaaagaacagaactgagagaggccgagggaggccaggagatgctgcgagggcgcgggctgctcaaaccgggcagctgaagtccttagtgacctcagatcgtcaagtcaaaacgctgaatttccacc

SEQ ID NO: 35004 - DNA, 65 bp, Homo sapiens
  misc_feature 1..65: note = chr13:95354293-95354358
  misc_feature 1..65: note = hyper
  source 1..65: mol_type = genomic DNA
gtgtgcatatgagagcggagagacagcgacctggaggccatgggtgggggcgggtggtgaagctg

SEQ ID NO: 35005 - DNA, 46 bp, Homo sapiens
  misc_feature 1..46: note = chr13:95355963-95356009
  misc_feature 1..46: note = hyper
  source 1..46: mol_type = genomic DNA
ctgtctcaggctctccgtgcgtcctttcactcgtcttcacccggcc

SEQ ID NO: 35006 - DNA, 749 bp, Homo sapiens
  misc_feature 1..749: note = chr13:95357026-95357775
  misc_feature 1..749: note = hyper
  source 1..749: mol_type = genomic DNA
tttcctccagtcaagcgtgagtgatggggcggccgcgcaagggcaacggagtccagcggacaaagcttgcagagaggggcagtggcccggaggcaagggtggcggtggggggggtggggggatgggtcacaaaagtagagcaactgagcttgctgcctagcggtgccacttccctgctctgcgctaaggctatcgtcgaaggcccagagacaccttgaccctggaaacccaatccagcacgtcctgcctccccacaaatatccctcaccccaaatcgctgtgcgttttgtctcctcaaagcgactcccaatggatttggatttattcagatagaactcttcggaagtttttcagatttttcaatttcaagaatttgcatgttttaagtgaagctgaaaccgcgaaggctcaggttacactttaaaatatgcaaggcttccgtgcggccccgacatttggtaaggctcaattgcttaagaaaaaagaaaaaaaaaagaacattgctttgagaatttggggtgccccccccccacttttgtcacaattcagagcttcattccctccggccgtccaggacgtcgagagagcggctggccagagctcagccccggcgcattcgcagggacgtgtcagctgggcaggctataatttgcattattccattaagttaggagcagcgctgataacgactggaaagttcgacggctgggtgggcccgcgacccgcaggcctggcgagcaaccatcgaa

SEQ ID NO: 35007 - DNA, 179 bp, Homo sapiens
  misc_feature 1..179: note = chr13:95359682-95359861
  misc_feature 1..179: note = hyper
  source 1..179: mol_type = genomic DNA
cgcggaccctcgaggcggacgagttgcgggaacttcgcttgcctggaggacacggcggcccaggcggccgggagcgccggcgccgagccgcgctctgattggctggcgcgaccgtccctatctgctccggggagagtggaatcttctctccatcttctgcgccccgagcctggggtgag

SEQ ID NO: 35008 - DNA, 182 bp, Homo sapiens
  misc_feature 1..182: note = chr13:95360231-95360413
  misc_feature 1..182: note = hyper
  source 1..182: mol_type = genomic DNA
aaacagggagagagacggagatagataaagagatggagatagagatcgcgagccagcagcagctctctgcccaatcacagcgctgcatttgtgggccactttcagacgcttacaccacccacccccgggcctttctctacgccctcttgccccggagccgctccccccgctccaacccctta

SEQ ID NO: 35009 - DNA, 443 bp, Homo sapiens
  misc_feature 1..443: note = chr13:95363009-95363452
  misc_feature 1..443: note = hyper
  source 1..443: mol_type = genomic DNA
gcatgcaacacggaccgggagggggttgggggttggggggctgaggggcgaggaagaagaatgagaaacaaaaacaaaaccgaccatgaaacttccaacaaaactggaaaggccaacatgtcaaaaagttactcctccacctccgtgggtcaaaacgcaacaggttccgaagtgcaaagcaaacgccaactgctgccgcacacaaccgcctgctttcgagttggctgccgaagtgcgggtctgaaatgatcctgcgaattcacaggcctgctcgcccgcgcccttgcgcgcttggccactcctgccccgcctggcctctctgcctctacctggcacctatacattctatgtacatacaaaccgggcccccggtcgcgggagggcgcacggggaggccgcagcgctcgtacctatacatatgtacacgtgtgcacaccggtcct

SEQ ID NO: 35010 - DNA, 467 bp, Homo sapiens
  misc_feature 1..467: note = chr13:95363493-95363960
  misc_feature 1..467: note = hyper
  source 1..467: mol_type = genomic DNA
cgcggggtaggggtccagctggggcttgcccatgcccggcagcaggatgtaggcgagcggcggctgcagcccggggctgggccacgcgctgcagttgcacgggatcatgtagcccgggttgcccgggctggggtgcgagtgcgtgtgccccccggcggcggcggccgccgctgcagccgccgccgccgcgccgtggaaggcgcccgcgcccgcggtcgggtagcccagcgacgacgcgtacgggaggccggacgaggacgacgagatctctgccattttggagcccaggtcgagcagcgagtaggggctgcccgcggcggcggcggcggcggcagcggcggcggcagcggccgactgcgggaagaagacgcgtgcggcggcagcggcggcggccgcggccgccttctcgggattggcgagcagcgactcaggcaccaggccgccgcccgcccccgcgtgcagcccgg

SEQ ID NO: 35011 - DNA, 132 bp, Homo sapiens; identical to SEQ ID NO: 11670
  misc_feature 1..132: note = chr13:95364064-95364196
  misc_feature 1..132: note = hyper
  source 1..132: mol_type = genomic DNA

SEQ ID NO: 35012 - DNA, 16 bp, Homo sapiens
  misc_feature 1..16: note = chr13:95364659-95364675
  misc_feature 1..16: note = hyper
  source 1..16: mol_type = genomic DNA
ctcctcctcctcggtc

SEQ ID NO: 35013 - DNA, 699 bp, Homo sapiens
  misc_feature 1..699: note = chr13:95364676-95365375
  misc_feature 1..699: note = hyper
  source 1..699: mol_type = genomic DNA
ttctctcttaaatgcaaagcgtccccaaaagttgcgtcgcggagactcctcgaagttgagccgaggagcccgccgccgcgtgctgccaagtgccaaagggggctctcagcggctggagtgtttgggttctcctcggtgactttctcatttgacagaagcagatgggggtggggaaggcggggaggtggccctggaggaggaagaggagggggaggcggaggagtgtccaggcgtgccacgagaacgcagagcgcagcaatggatataaatacaaatacagcagcaccagcctgtcttcttggctccgggcagggtgcgccgatgggaaacccccaatcggctgggtgattttttttttttggaggggggagctgtcccccgcagcacctgcctctcgagtcttcctctcccgctgctggactgacgggtggggcgaggaaggagggtggatgaggcttgagcaagcgttggtcgcccggcctcagaggaagttctcccggctcgccgaggagccgcgtccggccgtcccctgggccatgccggctctgttcgctccgagccccttcaggcgcgcctgccgacttagggctcccggagctcgccggccgcggagggcagcgcagcctccacgcggcgccgcaggcctggcaccggccgcgtccccgcctcgctcttctcggcagccgcctggcacttgca

SEQ ID NO: 35014 - DNA, 101 bp, Homo sapiens
  misc_feature 1..101: note = chr13:95365624-95365725
  misc_feature 1..101: note = hyper
  source 1..101: mol_type = genomic DNA
ggccgccctctgcaccggctcaggtgagtgtggctacctgcatgtgtgcgcgcccggagccggcactgggtgtgcatgtccagccgcggctgtgtgtgtat

SEQ ID NO: 35015 - DNA, 503 bp, Homo sapiens; identical to SEQ ID NO: 11673
  misc_feature 1..503: note = chr13:95619803-95620306
  misc_feature 1..503: note = hyper
  source 1..503: mol_type = genomic DNA

SEQ ID NO: 35016 - DNA, 475 bp, Homo sapiens; identical to SEQ ID NO: 11674
  misc_feature 1..475: note = chr13:95620307-95620782
  misc_feature 1..475: note = hyper
  source 1..475: mol_type = genomic DNA

SEQ ID NO: 35017 - DNA, 221 bp, Homo sapiens
  misc_feature 1..221: note = chr13:95620853-95621074
  misc_feature 1..221: note = hyper
  source 1..221: mol_type = genomic DNA
cgctgcggccgctgtgtgcccgaggggcggctctgtaacccggctccaggcatttcttaggtttcccatccccgccctccaagctcccgggagcgcctgctccgctgcccgcagacaggcgtcgttcaaacctcagctctgctcggtctgcattcatggaccccagatcttcaccctaggatttccatctcagcatttcacgttcccggggaaaaagggag

SEQ ID NO: 35018 - DNA, 205 bp, Homo sapiens
  misc_feature 1..205: note = chr13:95655055-95655260
  misc_feature 1..205: note = hyper
  source 1..205: mol_type = genomic DNA
tcaggactttagacccggtggctaccacgtggccatggctagctgtgtccacacggcccctccgaagcgccttggccccagctgcactctcctcgcccccttcctcccagtgggaacgagccagccagcgagccctctccccacgggtggcgcccgcacccctccttgcccccgggccccggcctgtgatcgctttccagggggc

SEQ ID NO: 35019 - DNA, 30 bp, Homo sapiens
  misc_feature 1..30: note = chr13:96056313-96056343
  misc_feature 1..30: note = hyper
  source 1..30: mol_type = genomic DNA
ctcagtaagaaagtgcgaactgaggtgcct

SEQ ID NO: 35020 - DNA, 441 bp, Homo sapiens
  misc_feature 1..441: note = chr13:96204922-96205363
  misc_feature 1..441: note = hyper
  source 1..441: mol_type = genomic DNA
cgggaggcggagccccggggttgggagtgcgggggtcgcggcgcagagtgggagccggagagcgagcgcggctgcagccggcggcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggtctgcatccccgcggcccccgccctcagccctccttccttgatggccagcccgctaggcgccctctcgcccccaatacccccagcgggacccctagactggactcctctgaggcccgacccgtctctcccaacag

SEQ ID NO: 35021 - DNA, 173 bp, Homo sapiens; identical to SEQ ID NO: 4037
  misc_feature 1..173: note = chr13:96296383-96296556
  misc_feature 1..173: note = hyper
  source 1..173: mol_type = genomic DNA

SEQ ID NO: 35022 - DNA, 110 bp, Homo sapiens; identical to SEQ ID NO: 4038
  misc_feature 1..110: note = chr13:96296840-96296950
  misc_feature 1..110: note = hyper
  source 1..110: mol_type = genomic DNA

SEQ ID NO: 35023 - DNA, 247 bp, Homo sapiens
  misc_feature 1..247: note = chr13:96296991-96297238
  misc_feature 1..247: note = hyper
  source 1..247: mol_type = genomic DNA
cgcagcgctaaaatgcgctcagccaatccggcagctggcgcagacacgtggttcgggggcgcgctccgttgctggccctggatgctaaccctaggaaggcttttcaaagagaaaccagattcgctcctacccggttgttggtctggccctcagcaagctaatttcccagaggagcttcaggtgaattatcttccaaaaagagatgcgttttaatcgcagaagtctgcagatgcgaaggaccttgaaa

SEQ ID NO: 35024 - DNA, 30 bp, Homo sapiens
  misc_feature 1..30: note = chr13:96742799-96742829
  misc_feature 1..30: note = hyper
  source 1..30: mol_type = genomic DNA
gtcgcctgagagagccgcgccggggcggga

SEQ ID NO: 35025 - DNA, 57 bp, Homo sapiens
  misc_feature 1..57: note = chr13:96743056-96743113
  misc_feature 1..57: note = hyper
  source 1..57: mol_type = genomic DNA
gcccgtccgccctgccgccgccgccgccgccgcttcgcctgccggcctgagagcggg

SEQ ID NO: 35026 - DNA, 198 bp, Homo sapiens
  misc_feature 1..198: note = chr13:96743376-96743574
  misc_feature 1..198: note = hyper
  source 1..198: mol_type = genomic DNA
gccggaggaggaggacgaggagcccggagacccccgggagggggaggaagaggaggaggaagacgagccggaccccgaggccccggaaaacggctccctgccccgattcgtgccgcgcttcaacttcagcctgaaggacctgacccgcttcgtggatttcaacatcaaagggcgcgacgtgatcgtgttcctccacat

SEQ ID NO: 35027 - DNA, 107 bp, Homo sapiens; identical to SEQ ID NO: 11682
  misc_feature 1..107: note = chr13:96743788-96743895
  misc_feature 1..107: note = hyper
  source 1..107: mol_type = genomic DNA

SEQ ID NO: 35028 - DNA, 151 bp, Homo sapiens; identical to SEQ ID NO: 11683
  misc_feature 1..151: note = chr13:96743896-96744047
  misc_feature 1..151: note = hyper
  source 1..151: mol_type = genomic DNA

SEQ ID NO: 35029 - DNA, 324 bp, Homo sapiens
  misc_feature 1..324: note = chr13:99404616-99404940
  misc_feature 1..324: note = hyper
  source 1..324: mol_type = genomic DNA
cctcggcggagtcggcgcctctgggcacctctggcttccgcgccccggccgcacggtgaccacccgggaggggatcccgggcgccccgcaacctcccggcccccgtgggccttcgggtcgccccgcttcccgccgccgcgtacccttcgcgcctcccggccctcggtgccggcccccgccccgcgtagctccgagtctttagcccggccggccccccacccgccgagcgtacccatggcggcggctcccagggctcctgcgacctgccggcgggacgtgctcctggcaggtgctactcctccgacctgacgtccaggcccggcc

SEQ ID NO: 35030 - DNA, 344 bp, Homo sapiens; identical to SEQ ID NO: 4040
  misc_feature 1..344: note = chr13:100608461-100608805
  misc_feature 1..344: note = hyper
  source 1..344: mol_type = genomic DNA

SEQ ID NO: 35031 - DNA, 116 bp, Homo sapiens
  misc_feature 1..116: note = chr13:100608838-100608954
  misc_feature 1..116: note = hyper
  source 1..116: mol_type = genomic DNA
cgagttctgggacggctgggaccaaagggctggcctccggcctgcgccctgtttgttttcctttcgccccctgaatactagattgagacgtaaagattacccgggccgaataatgc

SEQ ID NO: 35032 - DNA, 30 bp, Homo sapiens
  misc_feature 1..30: note = chr13:100609476-100609506
  misc_feature 1..30: note = hyper
  source 1..30: mol_type = genomic DNA
tcctcactccacccccgccacttcgtgcag

SEQ ID NO: 35033 - DNA, 327 bp, Homo sapiens
  misc_feature 1..327: note = chr13:100611882-100612209
  misc_feature 1..327: note = hyper
  source 1..327: mol_type = genomic DNA
tttaaatgtcacctccgcctttctaatgggcacagggctggaggcgacccttcaaagcgcctcggtgatgaacgacccttattaaatatggcccgagctgctgggaaagtcccgcgcccggccgcgcgccctagagcgcccctcgccggtgggccctggaggagccgggcctccgctgccaccgagcggagtccgggcccgcagagccccagcccggactggcgagggggtgcagagggaagaagagggaagcctggacgagggggggcgttgtaatacaacttcttatctgccgaccccaacacgcccgtgcgcccccagccccag

SEQ ID NO: 35034 - DNA, 32 bp, Homo sapiens
  misc_feature 1..32: note = chr13:100620640-100620672
  misc_feature 1..32: note = hyper
  source 1..32: mol_type = genomic DNA
aaaaacccaaatgaccgcgggtcccctcgccg

SEQ ID NO: 35035 - DNA, 30 bp, Homo sapiens
  misc_feature 1..30: note = chr13:100620880-100620910
  misc_feature 1..30: note = hyper
  source 1..30: mol_type = genomic DNA
ttgggagttccctttcggggccgggctggg

SEQ ID NO: 35036 - DNA, 263 bp, Homo sapiens
  misc_feature 1..263: note = chr13:100621752-100622015
  misc_feature 1..263: note = hyper
  source 1..263: mol_type = genomic DNA
gtgaagagtgtgtcacggtgggcgagtgcgagtggtctccggggttccgaaagcgcattcctgtcttcccggaggggtcccttcccctcccggaaggcctgcctcgggcggcccaaatccggcagcaaatcccacgcccggtcctcggagcgcggagactgcgcggggcctacgacccggtgggaagagaggcgcttgccggggcggcccggcctctctttccatcgccctcccagacttcccagggccgggcgggtggggac

SEQ ID NO: 35037 - DNA, 166 bp, Homo sapiens
  misc_feature 1..166: note = chr13:100622330-100622496
  misc_feature 1..166: note = hyper
  source 1..166: mol_type = genomic DNA
cgcaggagctggtggcggcggcggcggcgcggccggggacagacacccacctgtatgagtacgcttgtggatcttgaggttctcggagcgcgcgaagaccttgccgcagccggggaaagggcagggaaagggcttctcgccggtgtgcacgcggatgtggttgatg

SEQ ID NO: 35038 - DNA, 201 bp, Homo sapiens
  misc_feature 1..201: note = chr13:100622959-100623160
  misc_feature 1..201: note = hyper
  source 1..201: mol_type = genomic DNA
gggcggccgccgctgcggccgcaaccgccccgtagtgcgcgtccccagagcgcggcgcgaagggcggttcggcgcggccgtacagctcagccgccgcggctgccgctgccgccgccagccccaggcgcatctggccgttgagcgggtgcgggtggccgcctggggcccccggcgtgtcgtgcagcgcggggaagagcgccg

SEQ ID NO: 35039 - DNA, 231 bp, Homo sapiens
  misc_feature 1..231: note = chr13:100623899-100624130
  misc_feature 1..231: note = hyper
  source 1..231: mol_type = genomic DNA
tttattccctctgcccgccttcaaaaacatgtatgtattgggcgctctttaacttcttttgtcctggcctcttaactctgcttattcctgttcccactctatcctccagcgattggcagagtgaacaccacatttgagctgcacagtgggaccgagattttggaaatggcacgggtgggattggagggagccgcgtgattggcagtagcctcggctgctcgattggctccc

SEQ ID NO: 35040 - DNA, 102 bp, Homo sapiens
  misc_feature 1..102: note = chr13:100624131-100624233
  misc_feature 1..102: note = hyper
  source 1..102: mol_type = genomic DNA
ttcaggccctcgacccagcggggattcgcccccgtgcttgcggccgcctgcgctttcgcttcgcgccccctcctccgctggagccacacgtccccgcctccc

SEQ ID NO: 35041 - DNA, 279 bp, Homo sapiens
  misc_feature 1..279: note = chr13:100624323-100624602
  misc_feature 1..279: note = hyper
  source 1..279: mol_type = genomic DNA
cgccggcacgcgggcagagggcgcggggtggtgaggggctgaggacccccgaggggcagtcccagtttcaaaaaccttggcctcacttctctgtgtgccttctggcacccaagtactttctgcctctacctccacctctcttgtggggtggaagagccctgggctgctgtttgggagagaagggtgaatagcccgtcctacctgtagtggtgatgctagaaacttcttgtttggacacccaacctgcctagcgctcacctagggcgcatagacagtaga

SEQ ID NO: 35042 - DNA, 30 bp, Homo sapiens
  misc_feature 1..30: note = chr13:100626366-100626396
  misc_feature 1..30: note = hyper
  source 1..30: mol_type = genomic DNA
tcttgttaaacacagcgtgatatgtatctg

SEQ ID NO: 35043 - DNA, 331 bp, Homo sapiens
  misc_feature 1..331: note = chr13:100630666-100630997
  misc_feature 1..331: note = hyper
  source 1..331: mol_type = genomic DNA
acttctgagaagggacggcgacgtgactttgaacttggctcagctcttctgtgccctgcagagagaggagaactagagccgggaaagaatagccaggagcgcccaacccgtagggtctccggcgggaattaaggcgtccgccccaccgcccggccgcgcgcggcccctggaatccggcgcgagcgagcgcccagccgcgcgatccccaaacgcgggagcagcaaaggcgaaatcaaagcgaaagagagaatgggtcaaagaggagagggagggaggactggggagggggtaagacagtgggaaaggaggaaaacttcgaagtctgatggcc

SEQ ID NO: 35044 - DNA, 54 bp, Homo sapiens
  misc_feature 1..54: note = chr13:100631883-100631937
  misc_feature 1..54: note = hyper
  source 1..54: mol_type = genomic DNA
gcgcggcgccgggagcggcctcgccgctgggccaccgcccgggtggtactccct

SEQ ID NO: 35045 - DNA, 245 bp, Homo sapiens
  misc_feature 1..245: note = chr13:100635085-100635330
  misc_feature 1..245: note = hyper
  source 1..245: mol_type = genomic DNA
aatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcc

SEQ ID NO: 35046 - DNA, 53 bp, Homo sapiens
  misc_feature 1..53: note = chr13:100635398-100635451
  misc_feature 1..53: note = hyper
  source 1..53: mol_type = genomic DNA
cgcgggctgggacagggaccaggcgcggaggggagacacgcacaggctgagac

SEQ ID NO: 35047 - DNA, 30 bp, Homo sapiens; identical to SEQ ID NO: 11693
  misc_feature 1..30: note = chr13:100636167-100636197
  misc_feature 1..30: note = hyper
  source 1..30: mol_type = genomic DNA

SEQ ID NO: 35048 - DNA, 100 bp, Homo sapiens
  misc_feature 1..100: note = chr13:100636984-100637084
  misc_feature 1..100: note = hyper
  source 1..100: mol_type = genomic DNA
gaagaaagtaaaatacgaaataaatgagcaggactgtcgggcgggaaggcggttaatttgatcttagttctgccgcagaggggatcggactggtttgagg

SEQ ID NO: 35049 - DNA, 642 bp, Homo sapiens
  misc_feature 1..642: note = chr13:100637364-100638006
  misc_feature 1..642: note = hyper
  source 1..642: mol_type = genomic DNA
taccaccgcggcggccgggaggagggcgaggcaggccgaggcgccggtgcagcactggcccggaccacctcagccggcctgggagggtccccaggggccagggcggcggggggaacatttctgggggtgctctcccccaggggcccggccccacagcagctgcactcacacccagtcccctctggtcccccctcccggcttttgtcttgcaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcga

SEQ ID NO: 35050 - DNA, 30 bp, Homo sapiens
  misc_feature 1..30: note = chr13:100640440-100640470
  misc_feature 1..30: note = hyper
  source 1..30: mol_type = genomic DNA
agctgtgaggaaaatcgtttagagttttcc

SEQ ID NO: 35051 - DNA, 187 bp, Homo sapiens; identical to SEQ ID NO: 11697
  misc_feature 1..187: note = chr13:100640972-100641159
  misc_feature 1..187: note = hyper
  source 1..187: mol_type = genomic DNA

SEQ ID NO: 35052 - DNA, 51 bp, Homo sapiens; identical to SEQ ID NO: 1121
  misc_feature 1..51: note = chr13:100642150-100642201
  misc_feature 1..51: note = hyper
  source 1..51: mol_type = genomic DNA

SEQ ID NO: 35053 - DNA, 328 bp, Homo sapiens
  misc_feature 1..328: note = chr13:100643842-100644170
  misc_feature 1..328: note = hyper
  source 1..328: mol_type = genomic DNA
gttcccttttcaccccggctcttatgttgccagtctcccccctaccaccaggcaaagcccccctaaacttagggtctggaacaaggccgagccagcgagggcctgccaggagctgcgctggagcctctcgctgcatccagagctggttcttgttcttttctctctcttggcccactgggcccacagtggttaggtggccgagtgtggtttcccgaaactctttggagtcgcctgggtctgcgtgcccctggccccgtcctcacccccgggctcgtcccccagcctccgccggcccgcctgtgaatggtggatttaatgagcgtttgtg

SEQ ID NO: 35054 - DNA, 32 bp, Homo sapiens; identical to SEQ ID NO: 11700
  misc_feature 1..32: note = chr13:100647898-100647930
  misc_feature 1..32: note = hyper
  source 1..32: mol_type = genomic DNA

SEQ ID NO: 35055 - DNA, 115 bp, Homo sapiens
  misc_feature 1..115: note = chr13:100648149-100648264
  misc_feature 1..115: note = hyper
  source 1..115: mol_type = genomic DNA
accacttggctggaacgcttgctttcgatttgtttgtttcgcgcatttccctaaagagccgggctctttgcgctgttttaattctgctttaaaaatgcatcgcttctgccctgaa

SEQ ID NO: 35056 - DNA, 224 bp, Homo sapiens
  misc_feature 1..224: note = chr13:100649352-100649576
  misc_feature 1..224: note = hyper
  source 1..224: mol_type = genomic DNA
tgtgcgaggacaattattttcatcagctgcttgctagcccgcgcccgactgctcctctttgcagaaccgacgggctttcaactctggaagtgaagcaggacgaattcctccatggagactccctccttgggaacgtcgaactctctctgccttggggagtggggctcgataaagggtacctaggtcgcaccctggcaggggagcactagagggccgcgaggtcc

SEQ ID NO: 35057 - DNA, 86 bp, Homo sapiens; identical to SEQ ID NO: 1123
  misc_feature 1..86: note = chr13:100649799-100649885
  misc_feature 1..86: note = hyper
  source 1..86: mol_type = genomic DNA

SEQ ID NO: 35058 - DNA, 52 bp, Homo sapiens
  misc_feature 1..52: note = chr13:100649944-100649996
  misc_feature 1..52: note = hyper
  source 1..52: mol_type = genomic DNA
cggccgagggagcctagagccggtgggagacgggcagcggcctctcctgatc

SEQ ID NO: 35059 - DNA, 169 bp, Homo sapiens
  misc_feature 1..169: note = chr13:102068189-102068358
  misc_feature 1..169: note = hyper
  source 1..169: mol_type = genomic DNA
ggtttacccaggcagcggccctggtgccgagggggcaggtgcagcgctgtagtgatgcccagtggcctcgtcctcagccacctgccccccaacacctgctagatgcccaggcggggcaggcccgaggtgtcgccggccctgggcttcccaagccagcccaggggcatcc

SEQ ID NO: 35060 - DNA, 29 bp, Homo sapiens
  misc_feature 1..29: note = chr13:102068417-102068446
  misc_feature 1..29: note = hyper
  source 1..29: mol_type = genomic DNA
cgccccggccaggccggcaaggaccccac

SEQ ID NO: 35061 - DNA, 58 bp, Homo sapiens
  misc_feature 1..58: note = chr13:102069013-102069071
  misc_feature 1..58: note = hyper
  source 1..58: mol_type = genomic DNA
gcagttggtggggagcgccagggtcggtactggcagttccttcttgccggctgccacc

SEQ ID NO: 35062 - DNA, 163 bp, Homo sapiens
  misc_feature 1..163: note = chr13:102568410-102568573
  misc_feature 1..163: note = hyper
  source 1..163: mol_type = genomic DNA
gctcagatcagactgcgagcggtggctcgaccccgggtgtggcaggaaggggtgccccgcgttccagagccagtgccagtccctatcctcccgggaagccgagactcagggggaacaggtttcccagagcccagcctgcagggacgcggagggcaggagccgc

SEQ ID NO: 35063 - DNA, 109 bp, Homo sapiens
  misc_feature 1..109: note = chr13:102568659-102568768
  misc_feature 1..109: note = hyper
  source 1..109: mol_type = genomic DNA
cgacggcacccagagtgctcagaagggaggccggggccggggtgggccgggaaaaccgagggagggaaggagcctggagaagctccgtttaggcggggagggggcgacc

SEQ ID NO: 35064 - DNA, 642 bp, Homo sapiens
  misc_feature 1..642: note = chr13:102569312-102569954
  misc_feature 1..642: note = hyper
  source 1..642: mol_type = genomic DNA
gctcgtcgcaggaaccccggcgggggtcgccaccgccactcgcgctgccttctcgccctgcccggctcccgggcgggaggtagagccggccggcggctccccgggcgccggctggagggcgggtcccggcagggtctctgcgcgtccgtcggtccgggtcgcgctgggcaggactcagcgccgggctccagctgcccgcgggccggtgccgccgccggcgccgcccgctctcggcttctgccggtgattgtcaagtgctttggaaatcagcatctggagagaccaatcttctcccctgagatctctaatcaaacgctccgttcccaccccactacaccccctccacctatgtggtccccctcctgatgtacctcttcagaaagaaacaaaacgtataggtaataatgatttaaaaataataagaaagaaagctaagatggattgcagggatggggtgctaagaggccgagccaaagcaggtggaattgaaggaacatcggggcgctttttcttagatgcaactcgctggttcccgagccttccgcggcttggttggggcttctcggtcttaacgtggttaccggtgcactgaaactctcagcagcggttggagggcgaggtggtttccgccctccctgctaa

SEQ ID NO: 35065 - DNA, 30 bp, Homo sapiens
  misc_feature 1..30: note = chr13:102572245-102572275
  misc_feature 1..30: note = hyper
  source 1..30: mol_type = genomic DNA
ggactccggagtctccgggcatctattctg

SEQ ID NO: 35066 - DNA, 388 bp, Homo sapiens; identical to SEQ ID NO: 11707
  misc_feature 1..388: note = chr13:103046665-103047053
  misc_feature 1..388: note = hyper
  source 1..388: mol_type = genomic DNA

SEQ ID NO: 35067 - DNA, 247 bp, Homo sapiens; identical to SEQ ID NO: 11708
  misc_feature 1..247: note = chr13:103047054-103047301
  misc_feature 1..247: note = hyper
  source 1..247: mol_type = genomic DNA

SEQ ID NO: 35068 - DNA, 30 bp, Homo sapiens; identical to SEQ ID NO: 11709
  misc_feature 1..30: note = chr13:103052128-103052158
  misc_feature 1..30: note = hyper
  source 1..30: mol_type = genomic DNA

SEQ ID NO: 35069 - DNA, 23 bp, Homo sapiens
  misc_feature 1..23: note = chr13:103052445-103052468
  misc_feature 1..23: note = hyper
  source 1..23: mol_type = genomic DNA
aggcggcagacccctcggagcgc

SEQ ID NO: 35070 - DNA, 359 bp, Homo sapiens
  misc_feature 1..359: note = chr13:103052469-103052828
  misc_feature 1..359: note = hyper
  source 1..359: mol_type = genomic DNA
ccaccccagctacgttgcattggcaaggttcggaggctggagggcagcagccacttgctgccccagtcgctggggctctgggtgccagtgcggcccccggcagagcccagggcgtcagggaggccgtggagagccatgatctactgcaccgcagtgccagcgtcaggagcttccagagcccgggctgccactgcgggacggccgatctgcccgctccctccttcagacacaaccccagacaaaaacagccggccccgggtccctctccaccctgaacggagctaggggacgccacacactcccggctgccagcgtgagcggttccgggaaaggctgcgcccagcctcctcgccagcgcc

SEQ ID NO: 35071 - DNA, 403 bp, Homo sapiens
  misc_feature 1..403: note = chr13:103052829-103053232
  misc_feature 1..403: note = hyper
  source 1..403: mol_type = genomic DNA
ccgccaccaccatgcagccctccagcctgcctcccctgggttgctcgcccacagctccgcggccgcccccaatcgcctcggactgagacgcggggacgggaacccctgggatccgactccccaaatcagatgcatttgcatttcttatgtaatgtactgcaagttcccttgttggagccctttggaatcggggcgcatgatcaccagtaggcttaaaagcaggaactcacggcctggctcatccccacccctggccctgtgggaccccgacgcagggctttgacaccgctttctaaagggggggacttcaattacaaatattagaggggctgggcttgtcctctcagtctggggttccctcccggcgcaagccttgctcaagtattcccggtggcaggatgtg

SEQ ID NO: 35072 - DNA, 59 bp, Homo sapiens
  misc_feature 1..59: note = chr13:103054561-103054620
  misc_feature 1..59: note = hyper
  source 1..59: mol_type = genomic DNA
agtgctcagtgggatcggtttgaacctgcagttctcaatcaccacgaagaaaagatgca

SEQ ID NO: 35073 - DNA, 78 bp, Homo sapiens
  misc_feature 1..78: note = chr13:107186854-107186932
  misc_feature 1..78: note = hyper
  source 1..78: mol_type = genomic DNA
tgtggccatgtccttcgtcctcgaaaacaggagagggtcaggtatcgccatcggacaccttcccggacttgacacccg

SEQ ID NO: 35074 - DNA, 97 bp, Homo sapiens
  misc_feature 1..97: note = chr13:108518548-108518645
  misc_feature 1..97: note = hyper
  source 1..97: mol_type = genomic DNA
gggcagggtgggggacgaggaggcggagaggagtctgtgtgcctgggcggcgggcgaggactcccccatgctcgccaggagcgcgggccaggagggc

SEQ ID NO: 35075 - DNA, 217 bp, Homo sapiens
  misc_feature 1..217: note = chr13:108518705-108518922
  misc_feature 1..217: note = hyper
  source 1..217: mol_type = genomic DNA
tgctgctgccgctgctgctgctggtgctccttgtcccgggcccgggtcagcttggcctcggcgcagaaccacaagtgatcagagagcaggactgtgaaaaacaagagagatgccagagacagtcgccatttctgagccctctcggaatcgatgaacggtttctcgttctctcggggtgctgccaaccagatttttaagccgtcgtcatactgccgac

SEQ ID NO: 35076 - DNA, 156 bp, Homo sapiens
  misc_feature 1..156: note = chr13:108519254-108519410
  misc_feature 1..156: note = hyper
  source 1..156: mol_type = genomic DNA
agagagagagagagacggaggaggctggtgctggtggccggcggcgaggctgggtgcagggggcgatggtggaggtgacagggtggctggcgcggctccggtcacccaggcattgtcagcgcgcgggtccccatggccccgcggagcccagcccgc

SEQ ID NO: 35077 - DNA, 124 bp, Homo sapiens
  misc_feature 1..124: note = chr13:108519622-108519746
  misc_feature 1..124: note = hyper
  source 1..124: mol_type = genomic DNA
ccccaccccccaccccgcgctctaagtgctgccgccgccgccgccgccgccgccgctgccgcagggccgcccgcgggcgccgccgccggggctccgactgctgacgccgcctcccgcggagctc

SEQ ID NO: 35078 - skipped

SEQ ID NO: 35079 - DNA, 70 bp, Homo sapiens
  misc_feature 1..70: note = chr13:108520465-108520535
  misc_feature 1..70: note = hyper
  source 1..70: mol_type = genomic DNA
ctattctaaagtaaacgattagaagtggcctcatagagtcttaggaagaaacagtaagccctgtgccacc

SEQ ID NO: 35080 - DNA, 21 bp, Homo sapiens
  misc_feature 1..21: note = chr13:108520805-108520826
  misc_feature 1..21: note = hyper
  source 1..21: mol_type = genomic DNA
aatctggggtcacctcgattc

SEQ ID NO: 35081 - DNA, 150 bp, Homo sapiens
  misc_feature 1..150: note = chr13:109147713-109147863
  misc_feature 1..150: note = hyper
  source 1..150: mol_type = genomic DNA
ttcaggagtgagctgcgttcttagaattgtagcagagagagaggagggagagagcagaggatcggagggcaggagtggagagaggcgcggtctcctggaacgcgcgggggaacgtggaaaggagggcgcgggagacccggagggctgccc

SEQ ID NO: 35082 - DNA, 125 bp, Homo sapiens
  misc_feature 1..125: note = chr13:109148154-109148279
  misc_feature 1..125: note = hyper
  source 1..125: mol_type = genomic DNA
cgggcacaggggcaactgccgacccctctcacccgccgcgcggggctggtttccgagccgagtcccggccatcgccgcgtcgcctggcgcccggctccggcggacccttctccggcaggtagggg

SEQ ID NO: 35083 - DNA, 278 bp, Homo sapiens
  misc_feature 1..278: note = chr13:109148376-109148654
  misc_feature 1..278: note = hyper
  source 1..278: mol_type = genomic DNA
cgccgggctggggacgccgggagggtgccccgggtcggacttgcggcgctgggtccccacccagagttcccgcacggtgagggttggacgcgtctggggggcgtggagaggaggcttgtcggtcccttcctgggaaaggaatcgcggggacttcccaaccgctaggacgcgtaagccgaggctgggagtagaagccttctgaactctggacctaccccagaaggagggggcgaaactggccatttcgagggacgcggaagccccgttgctaggggaga

SEQ ID NO: 35084 - DNA, 140 bp, Homo sapiens
  misc_feature 1..140: note = chr13:109148885-109149025
  misc_feature 1..140: note = hyper
  source 1..140: mol_type = genomic DNA
gtctcacccggggggcgtcgagcctcagcgcatcgccccgtcttccctggctgcagaaaaccactaggccggtggaagtgctccgtttaattggtccctagtacgcccccgaaaggaaatggagacgatttccgtcaagt

SEQ ID NO: 35085 - DNA, 268 bp, Homo sapiens
  misc_feature 1..268: note = chr13:110958709-110958977
  misc_feature 1..268: note = hyper
  source 1..268: mol_type = genomic DNA
acttctgccttggagcgcgccttaggcagcagtcgtgggaaagctcagatacagctgtttccaggcaaagggcccagagcttttcagcctcagccaccagggtctccagacaaggagaaatacgcccaaagctgctcccaggggctaggagctcggagctcccagtgtgggtctctgagcagcgcggggtgggcgctcccggccctccagcccccaactccctcgcgcacccgggacgggtgaaggcgcccagctgccgagcataccc

SEQ ID NO: 35086 - DNA, 76 bp, Homo sapiens
  misc_feature 1..76: note = chr13:110958978-110959054
  misc_feature 1..76: note = hyper
  source 1..76: mol_type = genomic DNA
cgacgcgggttcaaatcccgccggctcccaggcaccctcaccccgccacagcgcgggctgtttctcctcccttccc

SEQ ID NO: 35087 - DNA, 132 bp, Homo sapiens; identical to SEQ ID NO: 4051
  misc_feature 1..132: note = chr13:110959517-110959649
  misc_feature 1..132: note = hyper
  source 1..132: mol_type = genomic DNA

SEQ ID NO: 35088 - DNA, 391 bp, Homo sapiens
  misc_feature 1..391: note = chr13:110959752-110960143
  misc_feature 1..391: note = hyper
  source 1..391: mol_type = genomic DNA
cgagcccccggggccggcgcccagagagcccagcaaggccggccgccctgccggtgtgccgccggcgggtgcttctggaagggccaatgcgttcgggcagcagcccctgaagccgagcccgaggtgagagcgacccccgagcggcgcccagaccctggcccgagagcaccgacttggagcgccttgtgcaggctagggctgcacgctctcctgcttgggagtagaaagggggagggtgggagagcgaagaccgagctcctcggccaaggagcacccacaggggcctaacgggaggctctccttctttccgggtcgtgggggggacggccctccggtcacccctgcatgcgggccgcgcaccgcgctgtccccgcgtctcgcggaccgagac

SEQ ID NO: 35089 - DNA, 259 bp, Homo sapiens
  misc_feature 1..259: note = chr13:110960344-110960603
  misc_feature 1..259: note = hyper
  source 1..259: mol_type = genomic DNA
cggtgtaactctcggggactgacaagccgggcccgcacgttcacgtctctcttcctccctttcccatgcaggtggctgctgctggggacagtgaccgtggggttcctcgcccagagcgtcttggcggtaagtcctggctcccgcgcttggacttgcgcgcccgagagtggttgggacgtttgagtggccttggagaaggcagctcgtccgtgcgctcccgagtgtgtgtgtgcgtgtggatgttcgccaggctgcccac

SEQ ID NO: 35090 - DNA, 221 bp, Homo sapiens
  misc_feature 1..221: note = chr13:110960909-110961130
  misc_feature 1..221: note = hyper
  source 1..221: mol_type = genomic DNA
ctctgggtaaaggggcggggcgaggaggcgaacgagacaaccttagtattgtttgaattgaagcattgcgagggaacaatggcagaaaaaccgcgttttctcccaagtcctgttccggccctggaagagctgctccgggcgccacactgggatcctgttcgccgagcctgcccctccacgccggccgtgcacagccctgccgataccgtgggtgcagctgg

SEQ ID NO: 35091 - DNA, 112 bp, Homo sapiens
  misc_feature 1..112: note = chr13:111766833-111766945
  misc_feature 1..112: note = hyper
  source 1..112: mol_type = genomic DNA
gctccatttcttcctcgcatgtcaatgtgtgcgtgtcatcagttgttcgaggaagctcgcgcatgacgcgacacttgccgtctgggctctccaggttcggcctgctgctttc

SEQ ID NO: 35092 - DNA, 80 bp, Homo sapiens
  misc_feature 1..80: note = chr13:111767213-111767293
  misc_feature 1..80: note = hyper
  source 1..80: mol_type = genomic DNA
tgcaaggtagcaaagcgaaacaaacgtctcgttttcagcctgtccccgccaccttgaaataaaaccggcaaaaataaaaa

SEQ ID NO: 35093 - DNA, 252 bp, Homo sapiens
  misc_feature 1..252: note = chr13:111767866-111768118
  misc_feature 1..252: note = hyper
  source 1..252: mol_type = genomic DNA
cgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtaagtcccggcccgcgcccccgcccgcgccccccggtccggcccgctgcggcccgggatgcgcgcggagcacctgaggc

SEQ ID NO: 35094 - DNA, 30 bp, Homo sapiens
  misc_feature 1..30: note = chr13:111768438-111768468
  misc_feature 1..30: note = hyper
  source 1..30: mol_type = genomic DNA
gtggacagttcttgccggtggcgttgcgtg

SEQ ID NO: 35095 - DNA, 311 bp, Homo sapiens
  misc_feature 1..311: note = chr13:112707694-112708005
  misc_feature 1..311: note = hyper
  source 1..311: mol_type = genomic DNA
acatttcaaggatgacggaagctctgagtgagtgaacagatattcttcgtgcagaataatcccccgtggcactggtttgccggcagagcagaatgtttgagacctcaccccgcagccacgcgcgggcgtaaatcgttctcagcacgagaaacacaaaggccgcaggatcccgcgagccgcagggggttggggtcatttttttgatgccgccgcccttaagagttccagtccttcaggcgaaaggggcagatcaggccttcggggaggacccttgcctgggagagggagggcagtgccccaggggccgcctc

SEQ ID NO: 35096 - DNA, 206 bp, Homo sapiens; identical to SEQ ID NO: 4054
  misc_feature 1..206: note = chr13:112708307-112708513
  misc_feature 1..206: note = hyper
  source 1..206: mol_type = genomic DNA

SEQ ID NO: 35097 - DNA, 30 bp, Homo sapiens
  misc_feature 1..30: note = chr13:112709027-112709057
  misc_feature 1..30: note = hyper
  source 1..30: mol_type = genomic DNA
tgtctccgcgtttcccgccacgaaattcct

SEQ ID NO: 35098 - DNA, 30 bp, Homo sapiens
  misc_feature 1..30: note = chr13:112709489-112709519
  misc_feature 1..30: note = hyper
  source 1..30: mol_type = genomic DNA
aaaaaaattaccctgcgtttgtccggggga

SEQ ID NO: 35099 - DNA, 236 bp, Homo sapiens
  misc_feature 1..236: note = chr13:112709815-112710051
  misc_feature 1..236: note = hyper
  source 1..236: mol_type = genomic DNA
cagagacccagaccccgagaaacaagtgtggctccagcccaggagcctcacagaacacatttcctcctccgccttcggctctgcgtgggctagccccgcgctagggagggcaggcaactaggtcctccgaggtgaggctggggctccgcctgcagagggagtgacagcgcgccgcgagggtccgcgacccaggcaggggtggccgcaccaccccggagcgccgcacagccccgcag

SEQ ID NO: 35100 - DNA, 117 bp, Homo sapiens; identical to SEQ ID NO: 11728
  misc_feature 1..117: note = chr13:112710359-112710476
  misc_feature 1..117: note = hyper
  source 1..117: mol_type = genomic DNA

SEQ ID NO: 35101 - DNA, 78 bp, Homo sapiens; identical to SEQ ID NO: 11729
  misc_feature 1..78: note = chr13:112710745-112710823
  misc_feature 1..78: note = hyper
  source 1..78: mol_type = genomic DNA

SEQ ID NO: 35102 - DNA, 470 bp, Homo sapiens
  misc_feature 1..470: note = chr13:112710824-112711294
  misc_feature 1..470: note = hyper
  source 1..470: mol_type = genomic DNA
caaaccaactgctcgattctattcactgtcgagtaggaacaaaaaagtggctatttattagaatacttgtttggtattgttccgcgccacacaaaaggcgtttcattatgtggagggatctcctttttccagagagaaacaataacttgaaattgtctttaaagtcttttctatcaataataaatttcattttcttgtctctctcgcctgcagtgtgtgtgcgcgcgcgcgaggcgaggagagaggcgcgtgtgcgagtgagtgtgctagcgggggtgcgcgtgtgagtgtgcgcgtgtgtgtgcgtgcgcgtggcaccggcgcccgcggctacggggctggcgctgccggagccgggccggaccggggtccgagatctgcgtcgcgctgggcacgctggccacccggtccggaatgagtcggggctccgggaggtgcccgtgggcagagcgttaggggcgcggccgtgc

SEQ ID NO: 35103 - DNA, 1654 bp, Homo sapiens
  misc_feature 1..1654: note = chr13:112711375-112713029
  misc_feature 1..1654: note = hyper
  source 1..1654: mol_type = genomic DNA
cgcccggggctgcggagctggccggtaaaggctctcgggagaggggcgcggtgtctccacggtgactttccgtgaaggaggatggggtgtctccgcagctttggggccccaggaaagaacaggtgggtagatgtggtggccacggctagcggactcgccgcggggcacatttgtcattttcttatctgtgcgttcactcctcccccatcctcggcttttgggattggccgccgcccaacggacccagactgtttctctctgggtcgccatttttggggaggggggagggaggtcgagtctgtggatttgggggagaggttcttgtccgccacagctccgcgccccctccccgcccctcgcggctcccccaccctcgcgttcggcagcgccaggctgcgctctccccggtgcacacccggccgcgccgagaactaaatccgcgggctgaaattacgttttaaaaattaacatgttgaagcgtgtgccatttagtgagaggtgttttgggcaaagaatcaatttaactgtgactgaccgacgggcttgactgtattaattctgctaccgaaaaaaaaaaaaaaaaaaaagcaatgagccgcaagccttggactcgcagagctgccggtgcccgtccgagagccccaccagcgcggctcacgcctcagtctcgccgccccaaggtgggatccgacgcccaaaggagggcgccccaaggtgggatccgagcgggccgccctaggaggagtgaaccccgcccgggcgcacagctccgtgcgcctgtcctccctcctccagcgaaatcacacccgctttgcctcctcttgcagcaccgcgcgtgcctaggttctcggtctgcgcagctgggagtctcccccaccagcgccgcggagccgcccgcttccgctccctctttccgcgggtttgagcctcccgtggagaggaaaggtcacgaagtttcaaaggtgaaatggattttcggcggtggctggtgcgggagtcaatgggcagggcggggcaagcctggcagtcatcgacccgagcagggacccggctggccgcctccccttgcaggaaacaggtgtttgaacgcgatagcggccgccagtcaactaaggcattaaaagctcgctttataacatcgatttcctggagtgcggtggggcctgcgttctggaagctcgtttgtgaaaggcggggttgggggaattgccctgatggtaccccagttggcgcagaagatccccaaaagtccctgtcaccgcagcggcggacagcggggctgcccaggcggctgggagggcagcttttccctcccgctggggtggaaagaggagtcctgctccgttccccacccaggacaatggtcttgttaccccggcctcctcccctgcacctagggcctggcatgcagagagcgcccgcagcagagggggaagtctccaacaactggcaggtgtcccccgaggagctccgcttgatttggaagggtggttaaaccgggatccaggaggaaagcaattccgttgccacccacatcccctgggccctaccaggcttcttcccctgctagcacatctcccggatgcgacgcaggccaggtggcagggctgaagcaggcaggcacacaggagatggcatgcgtacctgtaaggat

SEQ ID NO: 35104 - DNA, 365 bp, Homo sapiens
  misc_feature 1..365: note = chr13:112715354-112715719
  misc_feature 1..365: note = hyper
  source 1..365: mol_type = genomic DNA
gggaacgctcccagccggcagccgctctgggcgtgcacccgccacgcgaagccagaggttggacgacgcagccggccaggcgcggctcccgggggaccccgaaaccgcctgtggctcaggccctacttggcaagaagagactggggagtgagaggaggggtcactcttgctctctcgcacaatagacttcccgcaggcgagtgcgaacggccttttgcttcctccttcttttccaggacccttagcgacaggagaggaagagaagcggcccggcggtttaattgccaatttcctgatgcagccacagggcccagcagcggctcagcctaggccaccgggtccaggcctctaggcaataggcccgg

SEQ ID NO: 35105 - DNA, 550 bp, Homo sapiens
  misc_feature 1..550: note = chr13:112715803-112716353
  misc_feature 1..550: note = hyper
  source 1..550: mol_type = genomic DNA
cgccgggcgctcggcgcatccgccgtgcccacagcgctgaggaccaactagggctgccctcggccaggggcactgtgcccgtttgagtggcactcggacctggcgaggggtggaagcccaggtagagctcgcgtctttaagagccacccgacagaactgcgcgctacatctgcgccagctgggctgggtgggaacagcgcagaaatactcccgtgccggggcgtacagggcaggtaggcccagcagagagtcttctcggaaagtttcccacaaaagaagggccgggcaggccgagcggcaggaaaagccggtgctcagcggcgaggcccgagaggtctggcatccggcggcctcccagctttgctcgggtctcccgccgcctctctccagagccgcccgtagctccgtggggcggagggcgcaatgccccgctctggttccagcctttttcctccccttgtctcctctttcattcataaacctggtggctacagacgcagcttgaatattgacgtctctcccccaactgctctgccgttaacccaattac

SEQ ID NO: 35106 - DNA, 99 bp, Homo sapiens
  misc_feature 1..99: note = chr13:112716622-112716721
  misc_feature 1..99: note = hyper
  source 1..99: mol_type = genomic DNA
cggaggcacacagcacgcgcgcgtgcgcgcgcgcgcacacacacatacacacacacagttgtttgttcttcgattgtgaatgtgcggctctccacacga

SEQ ID NO: 35107 - DNA, 44 bp, Homo sapiens
  misc_feature 1..44: note = chr13:112717110-112717154
  misc_feature 1..44: note = hyper
  source 1..44: mol_type = genomic DNA
cccctggccatcacccgagcgccctggagcgccatcacccgaac

SEQ ID NO: 35108 - DNA, 495 bp, Homo sapiens
  misc_feature 1..495: note = chr13:112717474-112717969
  misc_feature 1..495: note = hyper
  source 1..495: mol_type = genomic DNA
ctccctcctcgccctcgctccgcgcctcctgttggcagagatggcctcgaaggcctcttccaatttgaatggctctttcttcttctctctcccgcgctttcttttccgccttctcctcctctccttctgactactcttgtctctttcaaaagctccgcctggaaactagcggcttcctcttcatctgcctcctttaactgtggcctcggccctctggggcgacaccagagcgcggaagcctgagcccctcggagatccggggaggcacctacacatggcctcaatcctccaaccggccccagaagccgtaggagctgaacccaggagggcaaccggttgtggtgcggccacatgtccctggagagtgtcagcaagacgggtcgacttcaccaggaccacgaaagacagggcagagtttctgtcttctttcactgtcccgtagaactcctagcttgtccatcgtgctccttgcttgggactcgggactgacactgg

SEQ ID NO: 35109 - DNA, 975 bp, Homo sapiens
  misc_feature 1..975: note = chr13:112720052-112721027
  misc_feature 1..975: note = hyper
  source 1..975: mol_type = genomic DNA
tgaaaatctctttcacgttcccaaatcaaagccactttgaggtttaagaatgataaccacaggtgaatgccttactctttccacgagccaggcctttcctttgcatgacgcagaccggcggctgagacccgtcctgaggccccgcctttcattcggtttatgtggccccgcgcagttcacgcagttttctccgttcttaggcaaccagctcgtgggaaattcactccagaaaagcgtgcgccatatcattattttgcgattcaacaaactttttcaactgttgttcaggaactagattccagatagatcttgttgtgttcggccttcctagaaattccttttccagaggaagaagatccgggttgggaagagtgcgtgactatggccccgggctcattgaaagactcctccccacaaaagtttagggctgatactaaacgaagctatggagccatgcccacacaaatactccccctttacccgaattgtggggcctggactgtgaaggccttcgctgcaagagcgggcactggcgaacttcagtgcacgccgcggccgagaacggatgcagggcgggggatggctgagccgcctgatccttgcagagaacctgcaggggccctcggagggtatcccctgcgtccaagggagcgcccctccttttcagcactcgggggaactgagggcgacgtgccagccccgcactcaactttccccttccctgcaggcacagagttggccggcgggggcagaggaggagctgggtctccactgcgcccgtttaaacctggccaggggctgcgtttcctccccccaccccacgacgatcctttcttagtcttcgcttttcaacccaatcgttaatcattcggaacgcgcgggcggggagcggcgaggagggcgagctcggggttcgccgccgccgccgccgccgcgcgcgcgcgctcaggaagcggtgtggctgtcaccccctcc

SEQ ID NO: 35110 - DNA, 93 bp, Homo sapiens; identical to SEQ ID NO: 4060
  misc_feature 1..93: note = chr13:112722128-112722221
  misc_feature 1..93: note = hyper
  source 1..93: mol_type = genomic DNA

SEQ ID NO: 35111 - DNA, 129 bp, Homo sapiens
  misc_feature 1..129: note = chr13:112722274-112722403
  misc_feature 1..129: note = hyper
  source 1..129: mol_type = genomic DNA
cgacgaggccaagcggctgcgcgcgctgcacatgaaggagcacccggattacaagtaccggccgcgccgcaagaccaagacgctgctcaagaaggacaagtactcgctggccggcgggctcctggcggc

SEQ ID NO: 35112 - DNA, 111 bp, Homo sapiens
  misc_feature 1..111: note = chr13:112722871-112722982
  misc_feature 1..111: note = hyper
  source 1..111: mol_type = genomic DNA
ggcggcggcggcggccgcgtcgtcgggcgccctgggcgcgctgggctctctggtgaagtcggagcccagcggcagcccgcccgccccagcgcactcgcgggcgccgtgccc

SEQ ID NO: 35113 - DNA, 236 bp, Homo sapiens
  misc_feature 1..236: note = chr13:112723488-112723724
  misc_feature 1..236: note = hyper
  source 1..236: mol_type = genomic DNA
cccacttttgtataccggccggcgcgctcactttcctccgcgttgcttccggacggcgccgaccgccggagcccaagtgacgcggagctcgtcgcatttgttataaatgtagtaaggcaggtccaagcacttacaagttttttgtagttgttaccgctcttttgggttggtttgttaatttatacaaagagattaccaccaccaccccctccttcagacggcggagttatattctg

SEQ ID NO: 35114 - DNA, 363 bp, Homo sapiens
  misc_feature 1..363: note = chr13:112724172-112724535
  misc_feature 1..363: note = hyper
  source 1..363: mol_type = genomic DNA
aagtatcttctgctccggctgtttcactgcggacggctggggctgctgcgcgttaccttgctgcaagcggggcgccttccacctggctgggggtctgcgccacagtttggtccagaggagggaggaggaagggaagaccccagtggtgggaccctggaccaggccatggatgaaggacaaagaccagggcaggtcacgggtttcccaattccccagcaattaagatttcgagcagaatttatctaaatgtgtttcaaggaaacacaatcgctgaaccaaaacgtactgcagccgagccccctccgtccatcctctgcccctccccctggcttctttctcttgggaaaacgggcaaaataattg

SEQ ID NO: 35115 - DNA, 30 bp, Homo sapiens
  misc_feature 1..30: note = chr13:112725438-112725468
  misc_feature 1..30: note = hyper
  source 1..30: mol_type = genomic DNA
aggttctttgactgacgtccactctcagtc

SEQ ID NO: 35116 - DNA, 45 bp, Homo sapiens
  misc_feature 1..45: note = chr13:112725825-112725870
  misc_feature 1..45: note = hyper
  source 1..45: mol_type = genomic DNA
ctatccccccttccccgcccccagcagtgtcgctccaattcaaat

SEQ ID NO: 35117 - DNA, 294 bp, Homo sapiens
  misc_feature 1..294: note = chr13:112726435-112726729
  misc_feature 1..294: note = hyper
  source 1..294: mol_type = genomic DNA
cgtttcattcccccggcaaagactgggcgccgcagatttctgtctccggaaaattccagttaattcaagaaacccatccccggacgtgtgcccgcccccccccgaaggctcgcttcaggccagcccggactccagcgccccctcgaccccgtcgggctccggccgactcccgccccctccccacccacgctcggcctgggcccgggggcagcggctccagaggcgtcggcggcagaatttaacccccggtctgagtccttggaaacttcaagtgaaaagcagacttggccttgg

SEQ ID NO: 35118 - DNA, 378 bp, Homo sapiens
  misc_feature 1..378: note = chr13:112726796-112727174
  misc_feature 1..378: note = hyper
  source 1..378: mol_type = genomic DNA
cggggtgcgggcccccagtatccggcggggtggggcggcgtcaggacggagcgagggccggcgggggggctcgcgtggaggcccaggccgggaggtggggacgcagggacccctcacccagtcctctgctcccgcccgagccaggcctcgggatcacctccccttgcctgagggcgagctctcctcctccctcttcctccccgcctcccccgttcttccctccctctctccctcctccctccccggcccttcctctccagctgcgcgcccgccgggaccacgctcctcccgcccccgggagccgagcggcgtctgcggctggtccggacgtgtcccctccgggcgggggtggccgggcctcctcggggcctcgggcct

SEQ ID NO: 35119 - DNA, 42 bp, Homo sapiens
  misc_feature 1..42: note = chr13:112727837-112727879
  misc_feature 1..42: note = hyper
  source 1..42: mol_type = genomic DNA
cgaagggagggggaggggaggccgggtaccggccgggtccgg

SEQ ID NO: 35120 - skipped

SEQ ID NO: 35121 - DNA, 370 bp, Homo sapiens
  misc_feature 1..370: note = chr13:112758003-112758373
  misc_feature 1..370: note = hyper
  source 1..370: mol_type = genomic DNA
ctcagcacctgcaggcggggggaccgcgcgcttggctcgaagaccccgccctgggcaggggacagaaaatatgaaatcagatggggagttatgaataactgtcctcccctcccctctgccgtgtttcctgaatccgtacgctatgcaggaggggggcgggggcgggggcgcggggaggaggagggggccgtttgccattaatctgggaacaagcggctaacctcggtgactggtattttcgcttttcttttctcacttttctcagtgtggggaaagcagtcaagcccgcgcggagcgattgtgaggggctctgctggaatttggcagcgcggaggcttggagagaagccccatgctggctcccattcagc

SEQ ID NO: 35122 - DNA, 196 bp, Homo sapiens; identical to SEQ ID NO: 1129
  misc_feature 1..196: note = chr13:112758495-112758691
  misc_feature 1..196: note = hyper
  source 1..196: mol_type = genomic DNA

SEQ ID NO: 35123 - DNA, 670 bp, Homo sapiens
  misc_feature 1..670: note = chr13:112759111-112759781
  misc_feature 1..670: note = hyper
  source 1..670: mol_type = genomic DNA
cgagtttggggtcgaggggcagttccctcccggagtcattaacttcgtctcctcgtgctcagggaccagcaacttggtgctgcgggcgccagaaagaaaagggtagcgcctcgcggagcgcgcgggggaagagggactgcggcagcgggacgcgagggcgggaggggcgcagcagcggggagccggagcgcagcggaggggagcgctggggggcggggagcgctcgggcagccaccctgtccccgtctggagccccgcgctgcgtctaggagggcgcaacacgcagtccccgcgggggccagagctcggagccccctagtgcatgccccctctcctcgcgccctgccgaggcctcggccctgcctgccgtgccctgggcctggttgtgcccgggggtccccgcgggcagggcgcggggcaggcagggcgcgcgcgccgacgctcttttgtctgataactaatttgagttaatgcgatctttatgtaaagctaacagcggataattgtctattttctcgccaacagtctccatcacaatcacttatctggaaacctgcggttggattaatcgttatattcccgagatgagcgtcgctgcaatccgcagcgaacgcgggtagggacctggagacgcctcccgggcgctggcggggccggtgtgggccagctc

SEQ ID NO: 35124 - DNA, 416 bp, Homo sapiens
  misc_feature 1..416: note = chr13:112760006-112760422
  misc_feature 1..416: note = hyper
  source 1..416: mol_type = genomic DNA
cggggcctgggggggcccaggcgccggaggagccgtcggtgccggaatgcagcgtgtttcacttgggagaaacgttgccctcggtcccttgcctccctcctgttgtctcggtttttctggcttcgtccttcgtcccacccacccgttcccacctcaggtccctcccccaggatcccctccttaaggatccaggtctctgaaaattattggcaacagttacacgccccacgattgaaatccacaagagaagagtcccagttctgcaggccgctccagggctaggggtagagatggtggcaggtggtgcgtcaactctctagggaagaggaacttgcattacaaagacttgtctttctgagctgaagtcaaaacgggggcgtcaagcgcgctccgtttggcggcggtggaggggccgc

SEQ ID NO: 35125 - DNA, 492 bp, Homo sapiens
  misc_feature 1..492: note = chr13:112760850-112761342
  misc_feature 1..492: note = hyper
  source 1..492: mol_type = genomic DNA
ggccaaggctctccccgcgttttcttctcgtgacctggggaatgtcccgccccatcgctcacctggctcttgtcatctcgctcatcttgaagtgacccgtggacaatgctgctccctgccgcagctccgccggtcactcaggcagaacggggtatgcaaatggcctggagaggccgaggccgaacactgcgcccattgtcccgggcgctcaaagcgccgagcagctgcgcagactttctgggctcggaccctcggccgccacgctaatgtcatcattgcaaaacatcagattttgagaactatgcagtctgaattcattagcagccttctcggcgaaggttcttttccccgtgacaagtttcaaagtccagaccccctccaacgttggtaggggtaggaagaggaggaggggcccagggaggggggtctttcgcaagtggggcctcgggggatccctgctctccttctggtgcattccgcaactttaaaagc

SEQ ID NO: 35126 - DNA, 69 bp, Homo sapiens
  misc_feature 1..69: note = chr13:113547082-113547151
  misc_feature 1..69: note = hyper
  source 1..69: mol_type = genomic DNA
tgcagggtttctgcacgctggggagggcaggttccccagtggagccactccctgcgggtctgagtgggg

SEQ ID NO: 35127 - DNA, 132 bp, Homo sapiens
  misc_feature 1..132: note = chr13:114462866-114462998
  misc_feature 1..132: note = hyper
  source 1..132: mol_type = genomic DNA
cgctgcagcctcggagccaggcaaaggctgggaaaacaggaaacctgttgcgtgttcaccagttcgcaagccgggctcgggggctctgccgggaagtggccaggactggaaggatgccgggtgtcttcctga

SEQ ID NO: 35128 - DNA, 32 bp, Homo sapiens
  misc_feature 1..32: note = chr14:21093506-21093538
  misc_feature 1..32: note = hyper
  source 1..32: mol_type = genomic DNA
tgcaaactcctataacgtgtgtggtagtgtgg

SEQ ID NO: 35129 - DNA, 152 bp, Homo sapiens
  misc_feature 1..152: note = chr14:21093598-21093750
  misc_feature 1..152: note = hyper
  source 1..152: mol_type = genomic DNA
ccaccactgccagtggtacgttttagcacaacaaggatcctgaagtactaacactttctaactagtaaaataattaaatcttcctttcccaggattctcccggattacacagcatcagttcctctgaattctgcattcgtaattaaaatcct

SEQ ID NO: 35130 - DNA, 30 bp, Homo sapiens
  misc_feature 1..30: note = chr14:21098864-21098894
  misc_feature 1..30: note = hyper
  source 1..30: mol_type = genomic DNA
cagagcagaagccaccggcttggggtgaat

SEQ ID NO: 35131 - DNA, 378 bp, Homo sapiens
  misc_feature 1..378: note = chr14:21100629-21101007
  misc_feature 1..378: note = hyper
  source 1..378: mol_type = genomic DNA
gcaacttttccccgacggcacctcctgggcgcccttgaaagacgccttaaatctaaacctataatacataggtaatcaactaaagctgaaagggaatggccaaagcacccacgtggagtgctgggtgctgtaggcgagaggtctgaggtagtggcttttagagctcaacatcttggtaatgttggttcgaccttttcccctgccagtcccgcggtgacctttatctttcggtgagtgaaatcggtcgttcgtgtttttcgtgggtcttccaaccacaggccgcctgagatggttctagtccctttgagtatacagacccttcctgtgcattgaccgacacagctcggcccggatcccgaaatgaacgtttctaccttc

SEQ ID NO: 35132 - skipped

SEQ ID NO: 35133 - DNA, 19 bp, Homo sapiens
  misc_feature 1..19: note = chr14:21101037-21101056
  misc_feature 1..19: note = hyper
  source 1..19: mol_type = genomic DNA
cgcacgttgactttcctgg

SEQ ID NO: 35134 - DNA, 30 bp, Homo sapiens; identical to SEQ ID NO: 11759
  misc_feature 1..30: note = chr14:21121400-21121430
  misc_feature 1..30: note = hyper
  source 1..30: mol_type = genomic DNA

SEQ ID NO: 35135 - DNA, 15 bp, Homo sapiens
  misc_feature 1..15: note = chr14:21121902-21121917
  misc_feature 1..15: note = hyper
  source 1..15: mol_type = genomic DNA
ctcatcccccacccc

SEQ ID NO: 35136 - DNA, 292 bp, Homo sapiens
  misc_feature 1..292: note = chr14:21769054-21769346
  misc_feature 1..292: note = hyper
  source 1..292: mol_type = genomic DNA
atgtcccaaataacccgtagaaataataactgtcatgaaaggagaagccacgtgctctatttgtccacaggctgaggaccaccttgctgcggttgaccgctgctggccgggacctgcgggtcgcggaggaggcggcgccgctctcggagaccgcaaggcgcgggcagaaggcgggatggcggcagcgcctctccatgcaccagcgcccccagatgcaccgactgcaagggcatttccactgcgtcggccctgccagcccccgccgcgcccagcctcgcgtccaagtgggaca

SEQ ID NO: 35137 - DNA, 139 bp, Homo sapiens
  misc_feature 1..139: note = chr14:21994200-21994339
  misc_feature 1..139: note = hyper
  source 1..139: mol_type = genomic DNA
gctctgccggctccccgcagggcaccccgagacgagagctcctctcggattcgtgcgccatggttgtgggggaagtggagggccaggtggggtgggagacaatggatattgggattgagggaggcgatggccgctgggt

SEQ ID NO: 35138 - DNA, 88 bp, Homo sapiens
  misc_feature 1..88: note = chr14:23291857-23291945
  misc_feature 1..88: note = hyper
  source 1..88: mol_type = genomic DNA
ccctgcataagctggcggccagacaggagtctgggcgagcgccccaacccctgaccacaactgcctccggccccgagatgcttggctg

SEQ ID NO: 35139 - DNA, 30 bp, Homo sapiens
  misc_feature 1..30: note = chr14:23652871-23652901
  misc_feature 1..30: note = hyper
  source 1..30: mol_type = genomic DNA
cgtgcttctctttagcgaggggttttattc

SEQ ID NO: 35140 - DNA, 177 bp, Homo sapiens
  misc_feature 1..177: note = chr14:23821399-23821576
  misc_feature 1..177: note = hyper
  source 1..177: mol_type = genomic DNA
cgtgaagatggggtccgaggccatgcccagagccacgaagagcaccggcaggcagcagaggccgagctgcagctgctggccgccgcccagcgcccccacctgggcgagcagcgcctcaaagctgagggggcctgggggcacggccagcgacaggctgctgcccagtccgtcgccgcc

SEQ ID NO: 35141 - DNA, 592 bp, Homo sapiens
  misc_feature 1..592: note = chr14:23821601-23822193
  misc_feature 1..592: note = hyper
  source 1..592: mol_type = genomic DNA
cgctcccgctcaccctgcagctgctccgtgggcaccgcatctccgagggtcccgacctgctgttggggggcagggggtggcaggagaagggtgaagcggaggaaaccgcagagcaagggcagggggcaggtgggagggagggctaggaaggcagtcaggggcgagggatgcgcaggaggaaaatgccagacgctccgcgggggcgggggtgctgggagaggatggcgtcgccacctggggctcgggcacttactccgttggaggtgggggtgatctctacagtgttgtcgattttgccgccgcccccgccattgggctcgggggtcccggtggccacccggggagccagcttgccgaccgcaggggccctgccggcccgcgccgaaaggatgcgctgtcctctggctcagttgcgcgccggctgcccggacacagacagctcgaagagatcccgctctgcagctctgcagccgcgggcgcctccttggtctctgcgatctctgcgctgctttcccctccccttcctctagactctcctccccttcccacgtcagcagaaccttcggtccagactcttcgtcagagagaggaa

SEQ ID NO: 35142 - DNA, 444 bp, Homo sapiens
  misc_feature 1..444: note = chr14:24803473-24803917
  misc_feature 1..444: note = hyper
  source 1..444: mol_type = genomic DNA
gaacccggacagaaacgagaagcatccaggactcagctttctccctgagcagacccagaagggtagagtgacttgcccagggtcactgcagttcctagccaggctcaatggtcctttctttctctgctcccagcaacgaaaacacatcgaaaagaagaccccacaaaccccaaccccgaaaatgctccccaggtagagaccctcccgcagcagaggctcggctcaccctgccgctggcccaggccactgcgagcagcgccgcgagcgcacagagcacgatccccagcagcagcagcagcagcgggtactgctggctcaggctgtagtaggtctcgtagaagaggtcttcgctggggggcggccgggggctgaagaggcgggccatgatctccccagccccgagccccggggctggctagggccgggcgccgggttacctccttc

SEQ ID NO: 35143 - DNA, 205 bp, Homo sapiens; identical to SEQ ID NO: 1132
  misc_feature 1..205: note = chr14:24803918-24804123
  misc_feature 1..205: note = hyper
  source 1..205: mol_type = genomic DNA

SEQ ID NO: 35144 - DNA, 70 bp, Homo sapiens
  misc_feature 1..70: note = chr14:24804424-24804494
  misc_feature 1..70: note = hyper
  source 1..70: mol_type = genomic DNA
cgcctccccgcttcagccccttcagggaagggcaatgtggaccctgggagagatgcgaaggggtgggctg

SEQ ID NO: 35145 - DNA, 36 bp, Homo sapiens
  misc_feature 1..36: note = chr14:24808711-24808747
  misc_feature 1..36: note = hyper
  source 1..36: mol_type = genomic DNA
cccggaacactgtgccgaacccgcctttgccgacga

SEQ ID NO: 35146 - DNA, 30 bp, Homo sapiens
  misc_feature 1..30: note = chr14:24837774-24837804
  misc_feature 1..30: note = hyper
  source 1..30: mol_type = genomic DNA
ggactcgttggcctgcggaagtgaggctgg

SEQ ID NO: 35147 - DNA, 234 bp, Homo sapiens
  misc_feature 1..234: note = chr14:25518435-25518669
  misc_feature 1..234: note = hyper
  source 1..234: mol_type = genomic DNA
ggtgttggtgaggctcgatgccggcgtgcacggcaagcgcgaattcggaacctggcgcccttgaccaagcctgagatcggaaagggggcatcgcccagggccagcgccctgggggcagggtgccgtgcccgccagaaaagctcgcctcagttttggcagtaatgattttcctagaagatgccagagttcgcgaagatcggagtgattcgcggatttctgcgctcaagctagagg

SEQ ID NO: 35148 - DNA, 432 bp, Homo sapiens
  misc_feature 1..432: note = chr14:25519184-25519616
  misc_feature 1..432: note = hyper
  source 1..432: mol_type = genomic DNA
cggacaaggcttagccggcccgggtgctggctcgccgccgctcgcggctcccgcgccggctcctgctgccgcgcgcgaaaagggaggggttggggggaaactcccggcaactccaactccgggcgctggagctccagctgcagccgcgcgcccgcccgccgccgagtgcgagcgcctgcgaagcaaacctgcccgcgcggccgcctctgagcatgctcagtgccgccgtgggcgagcccgagcgccctggcccggggcaaagagcagcggctaggggctgggggctgggggccgggacccgcgacccgccccaggcctcggagcgcggaggtggcagaggaagggaaaggccaatgtaggggcgggggccctgagccaaagacccgggagaaaccgatctgggtgcaagagccggtgcgactttcacggctt

SEQ ID NO: 35149 - DNA, 258 bp, Homo sapiens
  misc_feature 1..258: note = chr14:26674319-26674577
  misc_feature 1..258: note = hyper
  source 1..258: mol_type = genomic DNA
agcccgactctggggcgtttgggaggtgggcctgaggtttgcctaggactcgagttcctttcaaaggaaggcgagagggagatggggagaaggagactcggagacttctctattaaagccgcgctgaactctagccttctggcaagccgcggcaagccgccaatttgaagtgtgtgagctttaatctgctcctagcctgatgggctcccgtgtccacagggagctgggaggcatccattacgccggaccaaggagatg

SEQ ID NO: 35150 - DNA, 110 bp, Homo sapiens
  misc_feature 1..110: note = chr14:27066218-27066328
  misc_feature 1..110: note = hyper
  source 1..110: mol_type = genomic DNA
ggtcaacctctggaccgattaaatggaaagataggtctattccgaaaaactggtcgccattttgatgaatgataaacacagaaatggaaatgtgtcggggacacctaggc

SEQ ID NO: 35151 - DNA, 63 bp, Homo sapiens
  misc_feature 1..63: note = chr14:27066618-27066681
  misc_feature 1..63: note = hyper
  source 1..63: mol_type = genomic DNA
ctggatgggagctgccgccatcatgtttgcagttcctgccgctgctaccgggagaaggttctc

SEQ ID NO: 35152 - DNA, 60 bp, Homo sapiens; identical to SEQ ID NO: 11772
  misc_feature 1..60: note = chr14:27067097-27067157
  misc_feature 1..60: note = hyper
  source 1..60: mol_type = genomic DNA

SEQ ID NO: 35153 - DNA, 65 bp, Homo sapiens
  misc_feature 1..65: note = chr14:27067614-27067679
  misc_feature 1..65: note = hyper
  source 1..65: mol_type = genomic DNA
aaggtcgctggtccccggcaacacggctcaggcaaacgtaagcggcttgtcgcagaaaccaaggg

SEQ ID NO: 35154 - DNA, 37 bp, Homo sapiens
  misc_feature 1..37: note = chr14:27068238-27068275
  misc_feature 1..37: note = hyper
  source 1..37: mol_type = genomic DNA
gaactaaatattgaacgaaatacgagtgtcggaataa

SEQ ID NO: 35155 - DNA, 46 bp, Homo sapiens
  misc_feature 1..46: note = chr14:29224761-29224807
  misc_feature 1..46: note = hyper
  source 1..46: mol_type = genomic DNA
ggggaaggctaacatcgccgttaatataatgcgggagaggaatgat

SEQ ID NO: 35156 - DNA, 237 bp, Homo sapiens
  misc_feature 1..237: note = chr14:29225531-29225768
  misc_feature 1..237: note = hyper
  source 1..237: mol_type = genomic DNA
tttggaggagtggggcggggagacattcctggagggccagagcggggatcgcagcagaatctgcagcactggtgttaaggagaatttgagcgctcgaatgctgttgttaaatttcttcccagagccccatgctccctcgtttagcatctcccttccccaataattacttgagaggatgagctcgagattgaagagtgaggttggcttttctgtgtgaggagccgataggatccacca

SEQ ID NO: 35157 - DNA, 121 bp, Homo sapiens
  misc_feature 1..121: note = chr14:29226033-29226154
  misc_feature 1..121: note = hyper
  source 1..121: mol_type = genomic DNA
gagatctcagatcttcgcgtttggggtggggagtgggggcgctggggaaaagtcgggaatagccccgcggtacctggggatcccagttgttttttctaagaaagcccggggttaaaaaatg

SEQ ID NO: 35158 - DNA, 207 bp, Homo sapiens
  misc_feature 1..207: note = chr14:29226360-29226567
  misc_feature 1..207: note = hyper
  source 1..207: mol_type = genomic DNA
aagaaaatattgtgacgatgttgtagggcgaaaggggacgtgaggaggaaagggagggggagttagtttggagagcaatttgcaaaggaatattaactttgattcccgaggtcaccgcgggaaaaggggttctgggctgcagagctcttcctctaggtggcggactttggcaccaaacaaccgctagatgagcgctgacttcaaaca

SEQ ID NO: 35159 - DNA, 48 bp, Homo sapiens
  misc_feature 1..48: note = chr14:29227895-29227943
  misc_feature 1..48: note = hyper
  source 1..48: mol_type = genomic DNA
cttctgcagccctggcgtggatatgcacgtgagcgaagtaaaagtcgc

SEQ ID NO: 35160 - DNA, 981 bp, Homo sapiens
  misc_feature 1..981: note = chr14:29228268-29229249
  misc_feature 1..981: note = hyper
  source 1..981: mol_type = genomic DNA
ccctgttttgtgtttcgagcgggagagcagacactcagctcaaatagaggcctttctctcgtctttcggggtgtttattctatggccaaaaggtaagatggccaaggcagcgatctgagcgtgatgtctggccccgcggggggcccaggaggcccaagttgggacagctccggagctaccccggtgcccctcagctgggggagggcgcgcggcagccgcctgccagccccacaggctgctctccaaaggagctgggctttttcagcgtttctgtttccttgtagcctcatctatcttatctaacaagttcacgctccgggagaaaagaagagggtgagaaaaaaaaaaaagaaagaaaaaagaaaacctcttcaccgcggtgattcatagttcataggctccggagccaaacttgccgacccagcttttttctcgaacattactttctctcctacgtgccttaggacaaacccagaaggaagacactaaaattgccgaacaagaatctaggattgttttaaaaataaaagtgaccccccacagacacctttgatgttgttgattctgacacagaggagtcgagttgttttgtttacacatgctaacggtaacttgctcctgatgccgctctacgcgcagcttagtctgtcttctcctctcctccccgcaggcgactccttccaaagagcgagagagaaatacgggtattactgttatcccccactgggttcaataccccttacatgtaattgaatattcgaattaacgtcacctgcatgcaccccagtcttttaactctgaaatgtgctttatagcaatacagacttgaaacctttaactgttttctatatccccgcgtttaccgtggcagatgacctcttagcccaaaattgatttggtgtgtatccggtcttatgtgccaaaaaaagagatacctaggctgaaaaggcaactttaaggggggacatctagagagatgac

SEQ ID NO: 35161 - DNA, 468 bp, Homo sapiens
  misc_feature 1..468: note = chr14:29229250-29229718
  misc_feature 1..468: note = hyper
  source 1..468: mol_type = genomic DNA
cctagaatcaaggcctctggctcgattgcgttcggcaagcgtctgcaacaaaggagcgtcgggcaagctcgcgggtatgcgcagggagcagcggcgcgcagacctgggagccccagctccgcgaagctcctcgaagggaaccctcgcagttacagcctcaagaggcaaggcaggggagggagaaaagctggacctcttgagaaacgctcctccaacagattttccatggcctcgtgttggagaaggggcgcgggggaggagcgagggttggggtaggaagacctactggaaccgactccggagagtgagggccaggtgggtgtaagatgagcacaaagtaaaaacttgcccattggtttgtccacgcaggtttcttgaaagaagcagatagatctgattagtagatactactttccccacgcaaagggagactttggggtgaagggttctctgcgtgcttcctggctt

SEQ ID NO: 35162 - DNA, 315 bp, Homo sapiens
  misc_feature 1..315: note = chr14:29230871-29231186
  misc_feature 1..315: note = hyper
  source 1..315: mol_type = genomic DNA
cttttcttttggctgcgtacgtacttggcttcagagagcctggaacacctggcagcgtcacagagacttgcctggagagtcccaggggtctctgtcaaggccttctcctcatccttgtcctcttcctcctcctgctcctcttcttcgccttggactttctcccttttaaagtggctccctagcttacacaagctaaacatttccactctcatagacgaggctctcccatagatttttttactcgaggttctcaagcaaaattgccggtgccacaatgttatgatggaaggatgctgaaatgacaggcctagtaga

SEQ ID NO: 35163 - DNA, 213 bp, Homo sapiens
  misc_feature 1..213: note = chr14:29231283-29231496
  misc_feature 1..213: note = hyper
  source 1..213: mol_type = genomic DNA
cgcccccggggacgttgagggtgcgcgtgcgcgcgctgagagcagccactgacaacctgcagctccctaatgagtgacgaggcagggctgctgcagaaaagtaacacttccctggtgtgaagacctcttactgagaagtttagttcactactgttctcgcaaacctaatcgtataacctgtaaccaaaacccacagaacgaggatacaacacg

SEQ ID NO: 35164 - DNA, 30 bp, Homo sapiens
  misc_feature 1..30: note = chr14:29231696-29231726
  misc_feature 1..30: note = hyper
  source 1..30: mol_type = genomic DNA
ttagctagagcttggcgctgggtgccactc

SEQ ID NO: 35165 - DNA, 35 bp, Homo sapiens
  misc_feature 1..35: note = chr14:29234555-29234590
  misc_feature 1..35: note = hyper
  source 1..35: mol_type = genomic DNA
tccttttaaagcccccgattcgcaatttccccatt

SEQ ID NO: 35166 - DNA, 456 bp, Homo sapiens
  misc_feature 1..456: note = chr14:29234853-29235309
  misc_feature 1..456: note = hyper
  source 1..456: mol_type = genomic DNA
tgtcaacaagcaaaacgaaaatatttccagggtgatcgctcgcagctacccgcttccaattcggattagaagctgaggctggagcggcgaggagaaaacgacatcgagtcaccccgcgcgtgagcgacgctctggagcaggagagaaggaaaaggaagagacacacgtatatagcatgtgttacctgatttatttcgagattgtttggtactgttttctctctgggcacctctcatttcggaaggccatcagaggcgcccactactgagcggccccggccgccgcagcagcacccggagccccagtcccggtttccccgcggtgccggagcccggagctcgccgccgcccaggcctcaggaatcgagtaagtaacccctgtttggccccgcgctcctctgcccacttcctcctcctcatctcatcgctcccaaagctctcccacaccctcctcccc

SEQ ID NO: 35167 - DNA, 15 bp, Homo sapiens
  misc_feature 1..15: note = chr14:29235341-29235356
  misc_feature 1..15: note = hyper
  source 1..15: mol_type = genomic DNA
cggtgggccttatct

SEQ ID NO: 35168 - DNA, 203 bp, Homo sapiens
  misc_feature 1..203: note = chr14:29236018-29236221
  misc_feature 1..203: note = hyper
  source 1..203: mol_type = genomic DNA
ctgtctccccagcctcgccgcggccgctccgggacgcgcccgcccgccgcccggctctccccccctttgggctgctgctgctgctgctgtgactgctgctgcgagaggaggaggaggaggaggaagcagcgggggggggagcggggggtggggggggagaccaagaagtacagttgggagcgagggagcttcacccccggggc

SEQ ID NO: 35169 - DNA, 54 bp, Homo sapiens
  misc_feature 1..54: note = chr14:29236281-29236335
  misc_feature 1..54: note = hyper
  source 1..54: mol_type = genomic DNA
tcctgaggggtggttgctgcttttgctacatgacttgccagcgcccgagcctgc

SEQ ID NO: 35170 - DNA, 371 bp, Homo sapiens
  misc_feature 1..371: note = chr14:29236413-29236784
  misc_feature 1..371: note = hyper
  source 1..371: mol_type = genomic DNA
ggtcgccgccgcccgccgcgccgctgtcccgctcccgcgccgccgccgccgtttccccccgacgactgggtgatgctggacatgggagataggaaagaggtgaaaatgatccccaagtcctcgttcagcatcaacagcctggtgcccgaggcggtccagaacgacaaccaccacgcgagccacggccaccacaacagccaccacccccagcaccaccaccaccaccaccaccatcaccaccacccgccgccgcccgccccgcaaccgccgccgccgccgcagcagcagcagccgccgccgccgccgcccccggcaccgcagcccccccagacgcggggcgccccggccgccgacgacgacaagggccccca

SEQ ID NO: 35171 - DNA, 37 bp, Homo sapiens
  misc_feature 1..37: note = chr14:29237030-29237067
  misc_feature 1..37: note = hyper
  source 1..37: mol_type = genomic DNA
gccgttcagctacaacgcgctcatcatgatggccatc

SEQ ID NO: 35172 - DNA, 77 bp, Homo sapiens
  misc_feature 1..77: note = chr14:29237139-29237216
  misc_feature 1..77: note = hyper
  source 1..77: mol_type = genomic DNA
cgcgagaacaagcagggctggcagaactccatccgccacaatctgtccctcaacaagtgcttcgtgaaggtgccgcg

SEQ ID NO: 35173 - DNA, 317 bp, Homo sapiens
  misc_feature 1..317: note = chr14:29237573-29237890
  misc_feature 1..317: note = hyper
  source 1..317: mol_type = genomic DNA
cgtggaccggctggtcaacggggagatcccgtacgccacgcaccacctcacggccgccgcgctagccgcctcggtgccctgcggcctgtcggtgccctgctctgggacctactccctcaacccctgctccgtcaacctgctcgcgggccagaccagttactttttcccccacgtcccgcacccgtcaatgacttcgcagagcagcacgtccatgagcgccagggccgcgtcctcctccacgtcgccgcaggccccctcgaccctgccctgtgagtctttaagaccctctttgccaagttttacgacgggactgtctg

SEQ ID NO: 35174 - DNA, 30 bp, Homo sapiens
  misc_feature 1..30: note = chr14:29242568-29242598
  misc_feature 1..30: note = hyper
  source 1..30: mol_type = genomic DNA
ctgcctgaggttgtccgaaggatgccgagg

SEQ ID NO: 35175 - DNA, 63 bp, Homo sapiens; identical to SEQ ID NO: 11788
  misc_feature 1..63: note = chr14:29243208-29243271
  misc_feature 1..63: note = hyper
  source 1..63: mol_type = genomic DNA

SEQ ID NO: 35176 - DNA, 157 bp, Homo sapiens
  misc_feature 1..157: note = chr14:29243513-29243670
  misc_feature 1..157: note = hyper
  source 1..157: mol_type = genomic DNA
ttaattagcttttcccggcgcctcagggactccggggtgaagatggagaggtggcataatggcgggacttgaagtcgttgtggcagggacctggcagcgttgttttctcgggttttgaaccggtgtggagaagtaacttcagctgctgagttggggc

SEQ ID NO: 35177 - DNA, 524 bp, Homo sapiens
  misc_feature 1..524: note = chr14:29243730-29244254
  misc_feature 1..524: note = hyper
  source 1..524: mol_type = genomic DNA
cgatccccgcagagggtgaagccgggcgctgcgcagggagcagcaacatgagggcgctcttgcccaggacaagcagagctgtacgtttgggtagctcatattggctgatgccaagaaaagtgacttcagaaccttggctggcgcgcttccctaccttttccctttcttcttaatcttctgtgtgccaccacctccccccaaccttttttcccctcccaaagttgtttccttttgtttacccggtgcggtttcagatctcagcacttctcagctagtagataaaattatttgctctgtaatggacatctcttctcctctccacttgttaccccactcgcccttcgctttctaccccattttgcttctctctgcccaagcctgtggtccaaggtgcagggatctcacaggaaaacaggtagcctcggggtgggaattcccagagcactgaaggcgccggttgttggccagagggaggccgggactccggtgggcagagtaccccgcgagtgcggagattttcaggc

SEQ ID NO: 35178 - DNA, 622 bp, Homo sapiens
  misc_feature 1..622: note = chr14:29247097-29247719
  misc_feature 1..622: note = hyper
  source 1..622: mol_type = genomic DNA
atcttctcaccctggcgagttttcctgaaactacttatccttagcgtcagcgctgtaagaggtggagccgctcagtcccgcgggtggctgcagacagaaggtgggcgagtcctgggacttaaaaagttttgcagaaggttgaaaagaggagcagagggagagttttgagtttatttattttattttcctttttttttttttgtcttgtgccaagcccttgaagttaacgtagcgacgacgtggtccttgtaggaccaagcattcttggcattctgtcgagattgagattccagagcatcggatgaacgggacttatagctaaggcgtactcacccacccctcccttcgtctttttacgcacgcagcaactcgtcctcacgtgcataggggtagtggacagtgttgacttgaattgctgtccctcgttccaagcctttcctgtgaatgaacccgaaaacactcgacaggtcgtgaataatcgttttaatgagtgtgcaaagcgtgcgacggggtgcaccgagctgtcgggttaaacaaacaacttgtaccctgaccaaatccgattgttaaagtgcaaagtgatgtcagtaccatttccattgcctttcggaaatccacagat

SEQ ID NO: 35179 - DNA, 15 bp, Homo sapiens
  misc_feature 1..15: note = chr14:29254425-29254440
  misc_feature 1..15: note = hyper
  source 1..15: mol_type = genomic DNA
ggcgcccgcagaagc

SEQ ID NO: 35180 - DNA, 522 bp, Homo sapiens
  misc_feature 1..522: note = chr14:29254611-29255133
  misc_feature 1..522: note = hyper
  source 1..522: mol_type = genomic DNA
cgcgtccgccgggaccccgtccctctttccccttcagtcttcagggagggggaggcgctccgcattagcggggcagttcagcaaccccgaccccacccgcgtggctccaggcccaggggtccgttcacttccccgtccggtttgggggacgccaattcgcctaagaaaaccctggcagaagagcgcggacccttcactacaaacctcacgtcagggttacagccacatttaggaacctcttcggaaaagctgagaaatcactgttttgcaaaaagccttctgtactgtgatggggctttgtggtgagaggaacctctgagaagcctcgtgcggcttgagtttagagtcacgccctgcccagcgacattctcccgcgcacgggagaacctgcacttccggtctccaaccctcgcgggccgtgactcttcccctcccccgcgccgggccctgcatttccggcccccttgctctcctgcacttccgcccagtcacatggatgatggatagcgttgggagctgttt

SEQ ID NO: 35181 - DNA, 30 bp, Homo sapiens
  misc_feature 1..30: note = chr14:30396081-30396111
  misc_feature 1..30: note = hyper
  source 1..30: mol_type = genomic DNA
cgctggtccagggtccgtaggggagagagg

SEQ ID NO: 35182 - DNA, 51 bp, Homo sapiens
  misc_feature 1..51: note = chr14:30396380-30396431
  misc_feature 1..51: note = hyper
  source 1..51: mol_type = genomic DNA
gcggagagggccagccgggcagcgccccctgcgccgcggggaggcgccggg

SEQ ID NO: 35183 - DNA, 245 bp, Homo sapiens
  misc_feature 1..245: note = chr14:30396925-30397170
  misc_feature 1..245: note = hyper
  source 1..245: mol_type = genomic DNA
ggaaaatggccgaggcgggaggactctgaggcccggaacgcggcagccggctcggggccgccggcactggggaggcgccgccgccgccaagaatctgccgcctggcgcgctcggaaggacggggcgacgggtcggcgcggcccgagcgccgggcgggggccggggcgggaagggggcgtgaggggcggggaaggggagctgggggcgggcactggggagccaccacccggcgggcgcgggagtcg

SEQ ID NO: 35184 - DNA, 39 bp, Homo sapiens
  misc_feature 1..39: note = chr14:30739946-30739985
  misc_feature 1..39: note = hyper
  source 1..39: mol_type = genomic DNA
gttcacatcagcagtcgtcagcggcgatgtcaggcgccg

SEQ ID NO: 35185 - DNA, 623 bp, Homo sapiens
  misc_feature 1..623: note = chr14:31343352-31343975
  misc_feature 1..623: note = hyper
  source 1..623: mol_type = genomic DNA
gttcggttctcaggccgcgtggacctgacagctctcagaagctccaggcctcgctgggtggggcgggtagcggccgccgctgcctcagcagccctggtcccggcagagcagggctggcgaggccgctgctgccgccgtcggggccgccggccctccacactcgttgagacgccggcacggggaccttcgtgcccctctagggactggcgccgcgtccaggtggccgagcctgcgctgctggaggaggcgcctccgcgccggcctcaccccggggccggcagggggcgaaggcggagctggaagtcgccgccgggccccgggggaccggctcccgcgcttcctcccgcgccccccgcacagtgctcatgcgcacggcccagcctttatagcggccgcgggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagaccta

SEQ ID NO: 35186 - DNA, 362 bp, Homo sapiens
  misc_feature 1..362: note = chr14:31344187-31344549
  misc_feature 1..362: note = hyper
  source 1..362: mol_type = genomic DNA
cgcccctcacgaccccggccccttgctccgctgggtggaggctggagccagccctcacgcttctctcttcgcaggtgtgtgtctgctgctgctgccggggcccgcgggcagcgagggagccggtgagtgggggagctggggtgcgtccaggcggtcgcaggggctgagcaccagcgggtacaagcgggactcagatccagccccttgggcttcagccctaccgcctgaggaggaaggcgcgaaggttgagccgccgcgtggcgcgcccgcgttaacccctgcagccgatctgctcctgctcacctgtttctcccatggtagggggcccctggggtccagtggggggacgttctccaagagca

SEQ ID NO: 35187 - DNA, 40 bp, Homo sapiens
  misc_feature 1..40: note = chr14:32671453-32671493
  misc_feature 1..40: note = hyper
  source 1..40: mol_type = genomic DNA
cccagtagacacctacgatgctgtccgggcctcccaccag

SEQ ID NO: 35188 - DNA, 232 bp, Homo sapiens
  misc_feature 1..232: note = chr14:33401993-33402225
  misc_feature 1..232: note = hyper
  source 1..232: mol_type = genomic DNA
ttacgattctttttacgtgcaacacgtgggggacgaagcagtttcatatctcctggtattatctgccgtccaaagcattttctttgaaaggaaaatggaaacgcagctgcgccgtgggcccggccagcgagagctggggctccctccctctgtttcccagcggctgccgggtgcaggaggcgcctccggaaactgacttgggttaggggagttcagaggttgccccagcagg

SEQ ID NO: 35189 - DNA, 145 bp, Homo sapiens
  misc_feature 1..145: note = chr14:33402367-33402512
  misc_feature 1..145: note = hyper
  source 1..145: mol_type = genomic DNA
cggcctgtgtcactcttggccttggcaacttctggccaatccgccctgcccctctgggtcccggcgggccggctgcgccctaggctcaaagggttaagcaggtgcctctccgggcgaggcgctattggccgagggctggggcggc

SEQ ID NO: 35190 - DNA, 404 bp, Homo sapiens
  misc_feature 1..404: note = chr14:33402513-33402917
  misc_feature 1..404: note = hyper
  source 1..404: mol_type = genomic DNA
cggccgcggtcaccacgcttcgccgatcccaacttgggttcctgcggaaggcaaggcggccactcgtcccctggctgcggctgcggggcccaggccttggcgcgcagggagtgggaaggagaaaaggacgagaaggggcaagcaccagccgcaccagcaaagggggcgagggtggcgcgcgcaagatgaggggagctgaagccctgcatcccgaaggaggctgcgcccaccgcccgcaactccactccaggctcgccagccggaagaaagaggaggaagtgggacaacgggggtcctgggcaggggtaggggaaacgatcaactcccactgcccccacccactagtcgagttggaatgcaagtcgtcacttaaaaaggctcacccaaaccgcaggcatacctcc

SEQ ID NO: 35191 - DNA, 631 bp, Homo sapiens
  misc_feature 1..631: note = chr14:33403270-33403901
  misc_feature 1..631: note = hyper
  source 1..631: mol_type = genomic DNA
taagtatcaagttctcgaggagcccaacttgcgcttggcagccctcgcgctgcctgatgtgcataagacgggcagagaggggttccggccaggaagggaggctctacgtccccattcctgcacacgcgggctggcttccaggttgctggaagccgcgggaggcgcgagcttgcctggatggtggttatttctctagagaaaggaggagagagagagcgcgcctgagtcttgcactttgggtcggaagtgcgcggcgtgtgtgtgtgtgtgtgtgtgtgtgtgtgtagaggggggcgggaaagaaacgcaccctccgctgccggtcattcccttgcaccggccaagtcctcgccaagcctcccggtgcatccttcctccgccaccccctccccttcttccctcagctgggctcgcgcggcgcagccggagcagccagtgagagcaacatcctggaaagaggggggagcaccgccgccccccaaaagggaaaaaaggccccaccctgacacgttttgctgtttgcaagtccctcgcacgccccccgcacctcctcctcgcgcttgcggccccccccacccccagcccgctgcgcgcacatcaaagctcctctccgccgcgcacagtggccgcg

SEQ ID NO: 35192 - DNA, 269 bp, Homo sapiens
  misc_feature 1..269: note = chr14:33404149-33404418
  misc_feature 1..269: note = hyper
  source 1..269: mol_type = genomic DNA
cggcgccgcggccaacggcaccccgcagaacgtccagggcatcacctcctaccagcagcggtgagtagtcccgcctgggctgggatagtgcccccgccccggggtgctggggtgggactcactttgcctcctgttttgtgtcttacaacacacatgcacattgccagggctcactttgcctgcccctcgttctacagatgaggaagaaaaacacacttcactttggtggattgaaaagcactccagtgcgctggcgaagtgaaatcatc

SEQ ID NO: 35193 - DNA, 30 bp, Homo sapiens
  misc_feature 1..30: note = chr14:33407749-33407779
  misc_feature 1..30: note = hyper
  source 1..30: mol_type = genomic DNA
ctgcgtacgagagagcgctctggagcaaag

SEQ ID NO: 35194 - DNA, 60 bp, Homo sapiens
  misc_feature 1..60: note = chr14:33408303-33408363
  misc_feature 1..60: note = hyper
  source 1..60: mol_type = genomic DNA
cccacctcagcagcacggccgccgccgccgccgccgccgccgccacggccacggccacgg

SEQ ID NO: 35195 - DNA, 55 bp, Homo sapiens
  misc_feature 1..55: note = chr14:33408623-33408678
  misc_feature 1..55: note = hyper
  source 1..55: mol_type = genomic DNA
cgccgcctccgccgccgagggcccctctccgcagcccgcccgcctcctgggccgc

SEQ ID NO: 35196 - DNA, 177 bp, Homo sapiens
  misc_feature 1..177: note = chr14:34419561-34419738
  misc_feature 1..177: note = hyper
  source 1..177: mol_type = genomic DNA
ccgcgggagcagctgcggcagggcgccgagcgcgtcctaccttagacctctccttgacgtagtatttgcccagccggctcccgcagtagaggaccagcctgtcgatgagggacaggaggaagctgatggcctcgcagccctcctcgttgcccccgatccacgtgatctggtcgcccc

SEQ ID NO: 35197 - DNA, 182 bp, Homo sapiens
  misc_feature 1..182: note = chr14:34529691-34529873
  misc_feature 1..182: note = hyper
  source 1..182: mol_type = genomic DNA
ctcgccttccctgggcggagtccccatcggtgcctgcccgcccggaagtaggggcgcgagggtgacgggcaagaccgagcccggcccgtgattcttcctcagccggagctcgaccttctccttgtcccttgcgtttcctttctttgaaccacacactcgctcgctcacgtttgtcccgacta

SEQ ID NO: 35198 - DNA, 151 bp, Homo sapiens
  misc_feature 1..151: note = chr14:36003806-36003957
  misc_feature 1..151: note = hyper
  source 1..151: mol_type = genomic DNA
ggcgcagagctgcgtcgggcgttcctggagcgctgcctcagctcgcccgtctccgccgagtctttccccgggggcgccgccgccgtggccgctttctcctgctccgtggcgccagcagccgcaccgaccccgggggagcagtttctgctgc

SEQ ID NO: 35199 - DNA, 655 bp, Homo sapiens; identical to SEQ ID NO: 4075
  misc_feature 1..655: note = chr14:36004080-36004735
  misc_feature 1..655: note = hyper
  source 1..655: mol_type = genomic DNA

SEQ ID NO: 35200 - DNA, 101 bp, Homo sapiens; identical to SEQ ID NO: 4076
  misc_feature 1..101: note = chr14:36004821-36004922
  misc_feature 1..101: note = hyper
  source 1..101: mol_type = genomic DNA

SEQ ID NO: 35201 - DNA, 206 bp, Homo sapiens
  misc_feature 1..206: note = chr14:36972706-36972912
  misc_feature 1..206: note = hyper
  source 1..206: mol_type = genomic DNA
ctgactttattcttacggaattaaacacaataatttttttaaaatatcttctttgaggcaagtgaccacgagagcacctgttatttaaaagtttattgggtagtttaaaaagcggtgtctccctcttcccccttcaaaaataaatggcattgaagtcctccgtttctcttgtttagatcctgcggttggctcgctcatgaatatta

SEQ ID NO: 35202 - DNA, 12 bp, Homo sapiens
  misc_feature 1..12: note = chr14:36973210-36973222
  misc_feature 1..12: note = hyper
  source 1..12: mol_type = genomic DNA
ccctgcgcagcc

SEQ ID NO: 35203 - DNA, 412 bp, Homo sapiens
  misc_feature 1..412: note = chr14:36973454-36973866
  misc_feature 1..412: note = hyper
  source 1..412: mol_type = genomic DNA
ggaacgcaggctgaggtcaggctgaccacgccgcctcctcagtcgccgtatcgcggggctggcggccagcgccttagaagagcctgctccgccgcaggaagaaagacgcccgacaggcgcccactgcccgaacccacgcgggggccagtcagccagcgggccgtgttgggaaagctccgcgcggcggcgggacataggatccccatcggggacctgggcgacggcctgagcttgggcgcccctccagctgggcgtcatctccacacagttcttcccttgcgccgcgaattcagcccctgtgaagacgctttgggcattggcgagcaacaggggaaaaaacgagtcacttaaatgggagaaggaaggggatggtcatgaggacttggaggaaaccacacggaaaagaaatcct

SEQ ID NO: 35204 - DNA, 267 bp, Homo sapiens
  misc_feature 1..267: note = chr14:36974533-36974800
  misc_feature 1..267: note = hyper
  source 1..267: mol_type = genomic DNA
tagaaatctttgcctcggaaattatcggagaatattaacggagagggaggggagcgcgcgggtcgccgaggaaggacgcgggtacggccccttgctttggggtggcagagccgggctcaggagccagccaagctgacttcgcgaggtggcgcctgggcctttcgggggaaagccccgacggcggagccgcggctgggcggggactcaaatgctggcggcctctgggctggggccgagcagggggtgccgaccgcgggaagtctgggc

SEQ ID NO: 35205 - DNA, 127 bp, Homo sapiens
  misc_feature 1..127: note = chr14:36974801-36974928
  misc_feature 1..127: note = hyper
  source 1..127: mol_type = genomic DNA
gccgccctcccacccagacgagccgatgctgggccgcggtccctctcagctacctcgcttgcccgcctcggggcccctggagaggggtctgtgcctcccaggcagggaagcgtcttgatgtgcaccc

SEQ ID NO: 35206 - DNA, 262 bp, Homo sapiens
  misc_feature 1..262: note = chr14:36974967-36975229
  misc_feature 1..262: note = hyper
  source 1..262: mol_type = genomic DNA
cgatgtcatgctgggtattaaaagggttgtgctgcagctaaaatatctcacagtgtgtgtgaacctcataaaagggaggacccggattccaagcccctcgaagtccccaagcagcctggagggtgggggactcccctctccttctctccacactgagcccccgggcaagcccaggcctcctcctgcgccggggtccccgggctccgaaactgcgagagccctgcggagcccggccagaggggcagagggtgggggctggggg

SEQ ID NO: 35207 - DNA, 177 bp, Homo sapiens
  misc_feature 1..177: note = chr14:36975280-36975457
  misc_feature 1..177: note = hyper
  source 1..177: mol_type = genomic DNA
cggggagccgggatccgccttccatcctgggaaacgactcgggttagggaagcgggatgggctccgctcggagttcccaggcagctggggcgccctccaagtgacgcctttgtccaggctgcgctcgcggagaataaagggggcgctgtccaacctcaggttcggggaaaaccaagg

SEQ ID NO: 35208 - DNA, 427 bp, Homo sapiens; identical to SEQ ID NO: 4079
  misc_feature 1..427: note = chr14:36977503-36977930
  misc_feature 1..427: note = hyper
  source 1..427: mol_type = genomic DNA

SEQ ID NO: 35209 - DNA, 26 bp, Homo sapiens
  misc_feature 1..26: note = chr14:36977974-36978000
  misc_feature 1..26: note = hyper
  source 1..26: mol_type = genomic DNA
cgcagactccccgccagtcccggcca

SEQ ID NO: 35210 - DNA, 30 bp, Homo sapiens
  misc_feature 1..30: note = chr14:36978658-36978688
  misc_feature 1..30: note = hyper
  source 1..30: mol_type = genomic DNA
acaccaccacccagccgtctcccaggccct

SEQ ID NO: 35211 - DNA, 67 bp, Homo sapiens
  misc_feature 1..67: note = chr14:36979742-36979809
  misc_feature 1..67: note = hyper
  source 1..67: mol_type = genomic DNA
gggtctcctgggttgcggcagagcgtgcagtcagctcagaggaactagctctcggtcctcttagtgt

SEQ ID NO: 35212 - DNA, 244 bp, Homo sapiens
  misc_feature 1..244: note = chr14:36981839-36982083
  misc_feature 1..244: note = hyper
  source 1..244: mol_type = genomic DNA
gaacatggtgtccagcgtctcctaaccaggatctagccgagcagagaaaacattcagcctcctccctcccaatacccgtgtctgtcactttctttccattcaaaaagaaagtcctagttgaactaaacaagccagtaacccatgcctaagaatcatatcatctcagattctcatctcccaatgggctttctagttctccacaaataaaatcgtctactctgcttcctcgcgctaataattgggg

SEQ ID NO: 35213 - DNA, 294 bp, Homo sapiens
  misc_feature 1..294: note = chr14:36982402-36982696
  misc_feature 1..294: note = hyper
  source 1..294: mol_type = genomic DNA
tgtgcactcgcgcctcgagatagcccctcactgacgcctggacgcggtgagcgcgctgaaggctgtgcggcctctaaagtctcagaattcctccctgcggcctcaaaattggagagttggattccagaccaagacactgtcactagagctccctagccctggcccaggaagatttaaaatcccttaaaatcccttagacttgctcccgagcaagtctttccctatgaaaggccaaactctaagcttcgtgaagaagcctcctacaaggacactggtctggagcgcccgggcctc

SEQ ID NO: 35214 - DNA, 288 bp, Homo sapiens
  misc_feature 1..288: note = chr14:36983130-36983418
  misc_feature 1..288: note = hyper
  source 1..288: mol_type = genomic DNA
gctctccaaggctctcgagaaagtcctagtgtttacatggcgaagtgggggtggggagaggaggaaggggggtgcagtgtgcaaaatctcccccactcctctcagccgttggggcctagggatgggtagggtactttggcggaggcaaagcttcgcggtgatctcggggtgaaccgtacttgctcccaaacctcggaagcttccaagcacctcagcgccaggggcatcctcagaatgctgatttctccgagaggggaggccagaaattgggcacgagttgatgcagga

SEQ ID NO: 35215 - DNA, 585 bp, Homo sapiens
  misc_feature 1..585: note = chr14:36983678-36984263
  misc_feature 1..585: note = hyper
  source 1..585: mol_type = genomic DNA
gagttcacctttccccgggacaagtaaacagacttcaaactatgccgactgtagacggcgaggagaagaatgtatttgatggaaactccatccaatgcaaagatgataaggccgagggtgccacagcctactaaaattgtgactcccaaaggcttcctcccagctagaatggggtgcggggcagccgccagaaccacagccgggcaccgccagccaggtccccgcccgggcttgggctaggctggggcaggttaagcgaagctccaattccgtgggatccggacctagagccaaacagcagctgcagtatccatgtcccctgcccggccggcctgagctgggtgccttagccacctacactcccggtcccggaaccacagctgaccattccaacgcaagtggtcaaatttgtttgttttccaaaacgtgagacctgttaaaatctcccttccccgccttccaacaagcactctcactagacccaaccatcctcttgggaatcttcgagtccctctggctgttggaaactgtgtctcagcagtgaggcccaggtttctgagggagaaagcccggcctagcccacag

SEQ ID NO: 35216 - DNA, 30 bp, Homo sapiens; identical to SEQ ID NO: 11812
  misc_feature 1..30: note = chr14:36985841-36985871
  misc_feature 1..30: note = hyper
  source 1..30: mol_type = genomic DNA

SEQ ID NO: 35217 - DNA, 244 bp, Homo sapiens
  misc_feature 1..244: note = chr14:36986228-36986472
  misc_feature 1..244: note = hyper
  source 1..244: mol_type = genomic DNA
ccttgagattggatgcgcttggttgtttttcattttctttttttaaaaaaaaaaacccacaaattttagggggggaaaaaaagaaagacgtccagcagtttggcctttgtggtttttttgttccttggtctaaacgcggccaggttgttaagaaaagtcgaagcgcgtggagcagcggtggatggtggtctgtgtggcgggcaggagggaagcggtgaggcagagcgctgggctagggccggcc

SEQ ID NO: 35218 - DNA, 384 bp, Homo sapiens
  misc_feature 1..384: note = chr14:36987301-36987685
  misc_feature 1..384: note = hyper
  source 1..384: mol_type = genomic DNA
gcccggcccgccccaaccgacggcgccctcctgacccaggcagcctagcgctggggcccaagaggcccatccgcggggaactgccagcgcctgccccaggccgtaccgtcgagggggctgtactggagcgctcacagccccaaccctggctgccctccctcagtctcagttccctctttcgaaccaaaagacgcagtgggggaaaggccgcttctgctcctttcgtgcccagcccgggtcagagcattaggattagctggccacaggcggcgaactgggctcaggccgggagctggggtcctacggtagaccccagtttggagaggttaggagagggggtgttgacttccaaaagctggagcccccagacgctttgcctcttgg

SEQ ID NO: 35219 - DNA, 214 bp, Homo sapiens
  misc_feature 1..214: note = chr14:36987939-36988153
  misc_feature 1..214: note = hyper
  source 1..214: mol_type = genomic DNA
accgcgcctaggagacgccgagtacccgcatctgaccgcaggaccccagcgctaccaagtgcctgttcttggacccccagccgagcagggggaagcatccccagctcccgcacccaagtccctggcgccgctgccgggccgccctccctgatgcccagcgcgcagcctgccggcgccgcgccttctggacggctctcgccgcacctcctgagct

SEQ ID NO: 35220 - DNA, 38 bp, Homo sapiens
  misc_feature 1..38: note = chr14:36988606-36988644
  misc_feature 1..38: note = hyper
  source 1..38: mol_type = genomic DNA
gggagagggggaaggcgaagcctcgctgcttttttttt

SEQ ID NO: 35221 - DNA, 36 bp, Homo sapiens
  misc_feature 1..36: note = chr14:36989186-36989222
  misc_feature 1..36: note = hyper
  source 1..36: mol_type = genomic DNA
tcggtcggggttccccgggcacggacaggtctttag

SEQ ID NO: 35222 - DNA, 829 bp, Homo sapiens
  misc_feature 1..829: note = chr14:36989705-36990534
  misc_feature 1..829: note = hyper
  source 1..829: mol_type = genomic DNA
tgggaaggggtctcacgggagggtccgtcactgaagttgccccacctcgaacaaacctggtgtccctgaccctcgcccatctcccagacacgcggggatctggggctggagctgactttccgaggacatcacagccccagcacccgagcccagagccacgctgttttcccctctgatgcttcagggagcgcgcgagcagggagcggcgtgagtgcccgtctgtctgttgccgggcggaactgagcctgaaccccggcggctggagcgctggccaggagggggcgaatgccgaggtgcgggcagctcagcgggcgggaggctgggccgaggctcgcctccgcccgcagctcagccatgcaaaagtgctcttgcttcccgggaataaccaaatatctttgtttaaagtggtggcgtaaatggccagtcgctttgtggccacgctggatattagtagatgaggatcattctgcttcaattgggcgcctctcatccgacgagcaagaaactgcttaggaggaagagggtttcctgtctgcgcgttcccaggcttcaagtgtgggccccgcgccttgagggtccttgggcgcctggcgagggggagctgtgggctgcgctccccagcggaatcgggggtgtcccccgcgttgctccggccaggccggggcctgcagccgagtcgactaccgagtggagcactgaacggcgcggattttgagaccgactccggtttttgtccttggattttaaacgtttttatcattgtttttgttttgctttctccttagctgttttagtctcctctgcgcgccaggggctgggagggcggagc

SEQ ID NO: 35223 - DNA, 498 bp, Homo sapiens
  misc_feature 1..498: note = chr14:36990535-36991033
  misc_feature 1..498: note = hyper
  source 1..498: mol_type = genomic DNA
ctccccggccggccccggcaggtgcctccaagacacccgcgctggtcaaggagcttcttgaatttagtttttgttttcacattttctttcccctccttgtagagaaggagctcctgatcatgacgaacaggcagttttgagctacttaattcatccgggctccctttttttattaatagcaattacagtagagaaagttttatttatttttaaagatttcagccctctccttgaagagagctcttactccctcaatacaaagccaacttctataataacattcgcttttctcaccgcctaccttctttaccagggtaaagaaagctcaggacaccctccgccctcccacctgcgcccgcgtttttgtgcggtccccacggcagagctggggaggccaccctacgtttgcgcagggagacgcgctcgccgctggtgttgcgaaagaccagagcgaagcccggctccttgcccttccttcccaggggcttctctgggggg

SEQ ID NO: 35224 - DNA, 105 bp, Homo sapiens
  misc_feature 1..105: note = chr14:36991094-36991199
  misc_feature 1..105: note = hyper
  source 1..105: mol_type = genomic DNA
cgacgccgggcttaagcgaaccacagaggagaactggcaacgctgaatacagaccttgtctgcaggcgcgacctggccgggcctgagtcccgaatggggtctaat

SEQ ID NO: 35225 - DNA, 199 bp, Homo sapiens
  misc_feature 1..199: note = chr14:36991579-36991778
  misc_feature 1..199: note = hyper
  source 1..199: mol_type = genomic DNA
tcagcaggccacaggcgcacgtggctggcagctccccggcctccggctctgacagtccgggggcaaccaggcctgcagttctcgaggaaacccccagccccccacgtctcgttctggaccaggaaccccctccccaacaaccgcgcagcaagtggcgactctgggagctgaactggagtggagctcgaagtggctgggg

SEQ ID NO: 35226 - DNA, 176 bp, Homo sapiens
  misc_feature 1..176: note = chr14:36991988-36992164
  misc_feature 1..176: note = hyper
  source 1..176: mol_type = genomic DNA
cgaaaataagcccggagactaacgcaccttgtagggaagagaaggacatctgtatctccaagcttatccaagcaaaggcctccagagtccctcccatggcccgaaacacctccctctgaccgaagagcgtcctttctttccgccgcctcctggactcatcctaaatagggcagacc

SEQ ID NO: 35227 - DNA, 280 bp, Homo sapiens
  misc_feature 1..280: note = chr14:36992221-36992501
  misc_feature 1..280: note = hyper
  source 1..280: mol_type = genomic DNA
cgaagtctgcgcgtattcctttatcccgcaactagcttgctcccgggtggagtgggcacagtggggagcggtcagggcagggcagggcccaacgctggcccctcgcggagctttccctggcgcgacctcacacggtcgctgcctctattccgaccacgctctgcttcgctggctgcggctccgccaggaatccgagggggcgcaggcccaggctcggccctagatgcgcggaatcgccatcagcctttgcttacaccagcgtggccgcagggaaactcct

SEQ ID NO: 35228 - DNA, 50 bp, Homo sapiens; identical to SEQ ID NO: 11824
  misc_feature 1..50: note = chr14:36993438-36993488
  misc_feature 1..50: note = hyper
  source 1..50: mol_type = genomic DNA

SEQ ID NO: 35229 - DNA, 263 bp, Homo sapiens
  misc_feature 1..263: note = chr14:36993693-36993956
  misc_feature 1..263: note = hyper
  source 1..263: mol_type = genomic DNA
cgcgggagcccggggcgtgcagacaggcggctttcacagacgcagcgggaggaaggatccctctactgctccctttcccgatttgaccgtctagggcctttgagaggactttccttttgggaaagcttttctcaattcgtggcctgtgggcaggctggggggtggggcgccaagtcatccgagcgcggcttctgcttctccctttccctcacaggcatgctctacggagggtatgggaggcgagggcgcgtctatgagggcca

SEQ ID NO: 35230 - DNA, 706 bp, Homo sapiens
  misc_feature 1..706: note = chr14:36994303-36995009
  misc_feature 1..706: note = hyper
  source 1..706: mol_type = genomic DNA
cgaccctgtgaggcccgcgctgccgtgctacgccgcgaatccgccagacgcccccgtcggaaggggcagggacaccctcgggggcgctctagggttcgtgctgcgctaaggtaagtttcgcagctgctcctgataattaaaggacagattcccgaagcatccttgtggcggcgcggctgttttcgccccaggacctgtgcagcctcattcagctttaggtagtcgaaacctatagctctttctgccctctgttccccaacaaatctcagtcccaacagtgggagcccgtgggccttgggtgttcgagtttcccgcgggcttgccagcagcgctggggttccctcctccgctcctttcctcctctccaacctcccaccacagcccgtctcccccacatccccaacacttgtcccaggcagtttccggtggccgcagtatcgaccccaggccattggggtgggtgtgagggaagggtggagggggaatctccgaggcccaatgttttctgggacttgagggaggctgaattctccctcgctgcctaggacttggggtctgaaggttgcagaccgaggcgatccgcagcgccctcttccggcggccgtctggagaactgcagctttagagcggtctcggggaagctttgctactagtttccggctagggaaaactggtggtggtcggagactggtagtacatcatccac

SEQ ID NO: 35231 - DNA, 63 bp, Homo sapiens
  misc_feature 1..63: note = chr14:36995010-36995073
  misc_feature 1..63: note = hyper
  source 1..63: mol_type = genomic DNA
cattcgctcattctaactgtccgcccgaccatacgtcaggctgtctatcggtccacccaaagc

SEQ ID NO: 35232 - DNA, 84 bp, Homo sapiens
  misc_feature 1..84: note = chr14:37051112-37051196
  misc_feature 1..84: note = hyper
  source 1..84: mol_type = genomic DNA
ggcatggagagggggcggggggtggggtgggggcggcaggtggcggcgcgttttaaatttcaattattccgacctctagaaatc

SEQ ID NO: 35233 - DNA, 30 bp, Homo sapiens
  misc_feature 1..30: note = chr14:37051599-37051629
  misc_feature 1..30: note = hyper
  source 1..30: mol_type = genomic DNA
aggaggggaaggaggcgggggcagggcagg

SEQ ID NO: 35234 - DNA, 30 bp, Homo sapiens
  misc_feature 1..30: note = chr14:37051933-37051963
  misc_feature 1..30: note = hyper
  source 1..30: mol_type = genomic DNA
agcatttggcattagcgattctgtctgatt

SEQ ID NO: 35235 - DNA, 190 bp, Homo sapiens; identical to SEQ ID NO: 4091
  misc_feature 1..190: note = chr14:37116105-37116295
  misc_feature 1..190: note = hyper
  source 1..190: mol_type = genomic DNA

SEQ ID NO: 35236 - DNA, 387 bp, Homo sapiens; identical to SEQ ID NO: 11829
  misc_feature 1..387: note = chr14:37116983-37117370
  misc_feature 1..387: note = hyper
  source 1..387: mol_type = genomic DNA

SEQ ID NO: 35237 - DNA, 511 bp, Homo sapiens
  misc_feature 1..511: note = chr14:37123566-37124077
  misc_feature 1..511: note = hyper
  source 1..511: mol_type = genomic DNA
ggcgtaggatccctgcgcaggaggttgcaggaatgcccccgctagccgcaaggttcctgctggcctgtagagctttcgtgatccccgccaagatgcgaacagtaaggtcctcgtatggatcgcagtttttgtccgaaacctgaaaacactaacttgggatttcgcagttctggccctcgggcccgcctcggaggcgcacccccaatccccacggaacgaattccgcggctaaaatgcattttcccaaggcagtaaaagtgacccctgcacctaacaacctttgggctttctcttctcctgactaccacctctcgcagggtgcgctgaaatctctttatcgttatcgttttttataaatgaaatgatttatttattcgctgtttgcagggaatgaaaggagttgatcctgactccaagatgcattccaaagaaagaaaacgcaactgtagcccggactccgcggaggaaggccaactgactccactacgtgcacttccgagccacttgggcc

SEQ ID NO: 35238 - DNA, 91 bp, Homo sapiens; identical to SEQ ID NO: 1143
  misc_feature 1..91: note = chr14:37124481-37124572
  misc_feature 1..91: note = hyper
  source 1..91: mol_type = genomic DNA

SEQ ID NO: 35239 - DNA, 664 bp, Homo sapiens
  misc_feature 1..664: note = chr14:37124988-37125652
  misc_feature 1..664: note = hyper
  source 1..664: mol_type = genomic DNA
ggccgcaagagaatccgcccggtagggcatagaagatgggttttcggtgaatcgtgaaaagacatgatcgggtttcccttggagcatggtggagaatgatgcggagccttggggtcaatggagagttgagggtgcagagggatctgaaagggggaaccaaaaatatcgggctttgaaattctgtggattttcaaaggcggttcccaaccttgtcaaaaactacagtgggtgcgcgatctaatctggctcctataggtggcgctgtgacaaggtgcggtggccgggagaggcggctgggggactcgaagactgcgggaaattttctgcgactccgacgctaacccgctgctcccagcctccgcttcctgttttcgagggattagctaggactgtgcaacaccagtctccgctctcggagtcggcacgggggctggtgggtggcgggatgaactcggggaaggcgacaggctggaaacgcagctcctcgactttgcagcgcaccaaccccctatcgccccgtccgctgctcaggtgcgaggattcgccagacgccacaggactgggggcgactcgcaagggcatcatgccacctagaggaaacgcgcagtgagtgagccctgggtcactgaaaatgggagaacgttcgagtcggtcaagatgactc

SEQ ID NO: 35240 - DNA, 165 bp, Homo sapiens
  misc_feature 1..165: note = chr14:37125763-37125928
  misc_feature 1..165: note = hyper
  source 1..165: mol_type = genomic DNA
cgtccggctctgatcagagtacagcgggctgggcctggcagcctgcaggcaacctggaccttgcaataaagctgcattcaacataactcagaccacagtgggagcccccgaagggcttcatgtgagtcccgaaaccagagtttagaggcgcggcctggttctcgt

SEQ ID NO: 35241 - DNA, 558 bp, Homo sapiens
  misc_feature 1..558: note = chr14:37126156-37126714
  misc_feature 1..558: note = hyper
  source 1..558: mol_type = genomic DNA
gcaaccctggcaagacgaaatccccctccctctggctagatcagcccagcctcccctcagggaccttcctgcccctccctacccctccctacccctaggccgctccccccttcctctgttgggatccgatccttgttcgctcttgcaatcccgcagcccggagttttgccccgtgcattaaaacatgttctctttcatttgcagatttaataaacaaacgtaaccatatcacatggagctccacactgtccttctgaaagcaattccgctgttgaaaactgaaaaatgggtgtaatttgctttcagaaagtaatgttagggtcacggcaatttctcgggccgttatttatttttactttaaagtctttaggaaagatttgcttatatgctcggaaaacttccaaatgcgcgaataccagcaatcccgctcgccttcaacgcgtggggtaagggggggtggggaacaattactgagtgacgctaatatggggaaactgaaaagaaatgtcgattgtttttattgtaatagaaggagtgagcaaacagaaaaaccaaccc

SEQ ID NO: 35242 - DNA, 816 bp, Homo sapiens
  misc_feature 1..816: note = chr14:37126964-37127780
  misc_feature 1..816: note = hyper
  source 1..816: mol_type = genomic DNA
cgtgaggctccttgatgagaaggtggagaggctgccgggctattctccgagcatcttccggccgagctctgctcctctccgtgcgcttgcggcttctccttgggctagcgcgtccgcagtccctccaagtccaggccgcaggtcagtgtgcgggcgcctcctgtcctcctctcccaccagaggacccctgagggctgtctccatccccaatccccgcgactgctccttttagccgccatcccctcccgcagcgcagatcctgcaggggccagcggtccagggcggaccctccctcgccctgggcgcggggcgagcttctggctgtcacttgccgctgcagtttcagggaaactcagctggccgcttaccctgcaagacggggacatagcagagggccgagttctggagaagctgggcttgtttttctctctgcaccgcgcgcaatgccccaactgaccctgaagggtcttgcctttactgcatttgcccccagacggctagaagtcaatgcactatgaaaatcccagtcccggacctcggactctggctgtcttacaatccctgcaactcctccgagtggacaagaggcgggcaccgtcgcctgggcctcgcttggggggggggggtcctgtccccagcagggggcaagttggaggaatcagctccttaatattttctgctagctctgcttgtcataactgcaactcggaatagaacaacctctctcccgtgcatacgcacccccaactctcgccctatcctcccatccacagtcatcactgacctgtagacccggaggagcaggcttccgggggt

SEQ ID NO: 35243 - DNA, 506 bp, Homo sapiens
  misc_feature 1..506: note = chr14:37130077-37130583
  misc_feature 1..506: note = hyper
  source 1..506: mol_type = genomic DNA
cagaagtaggcagaacgacagggcctctggagcttaatggaagacgagggaattacatccatgtgcagcgtcggtgtccactgtcttgggactaagtctctttcatatttaaacaaaactctttcgagagggctcgctggtttggagaaccctcacaaacgctgccaccgagggccaggggcccaggacagtggctgaatgtggcagagccttgggctccgtagtgagtgccccacgcactggcaattggtcgacttggggctgtgcgctagcgttagccgcctgtggttcagttccccgcacacggcgtggcccgtgcctcgagcctgtgtggctagtggttggccggtccacctggactggggggtcgccgcaggaagctggcggtaggaggaacctccctggccttaacagtggcccccacctgtggctcgggctccccgcaacctcctggtttctttggccggcctatcttctcacacctgcgctctcgccacctggcatgg

SEQ ID NO: 35244 - DNA, 30 bp, Homo sapiens
  misc_feature 1..30: note = chr14:37131143-37131173
  misc_feature 1..30: note = hyper
  source 1..30: mol_type = genomic DNA
ttccttttgccctctcgcctcctcctcctg

SEQ ID NO: 35245 - DNA, 264 bp, Homo sapiens; identical to SEQ ID NO: 1144
  misc_feature 1..264: note = chr14:37132290-37132554
  misc_feature 1..264: note = hyper
  source 1..264: mol_type = genomic DNA

SEQ ID NO: 35246 - DNA, 697 bp, Homo sapiens
  misc_feature 1..697: note = chr14:37132602-37133299
  misc_feature 1..697: note = hyper
  source 1..697: mol_type = genomic DNA
cggccgccaaggtgcccacgccacccggggtgcctgccatccccggttcggtggccatgccgcgcacctggccctcctcgcactccgtcaccgacatcctgggcatccgctccatcaccgaccaaggtaggggctcagaggctgggcgtgtggatgtgcagcgtctgcccccgcactctcgcggaggtcccagtatctgcagcctcagggacactgtctttcccaccacctgaggctttttcctttggaaacgtaaggagtcttcctagggggtgttctgatctcattaacttgaaactcatgcccctggtttccttgccacacacagtcttctgcctcatctcaaactaccagacccataacatccccccatccccaacacatggttcgcattttccaccctcccccgcctctcgcgccgaggcagcctcagcccggcttgctcacttggagagtgcggccggggctggacttggggcgcagcccgggaggcccgagcctgcttggggctgccggctgcagactccgctgtgggcagagcagcttgcttggggatcactacggccgggagaagtctggccgggaggagtccagcacgccttggaaattgaagtattctccgattctggtaatcaggccaaatttgctcaggcaggaagttcaaatgtcacctaattggtttcgttcttatgcttca

SEQ ID NO: 35247 - DNA, 86 bp, Homo sapiens
  misc_feature 1..86: note = chr14:37133668-37133754
  misc_feature 1..86: note = hyper
  source 1..86: mol_type = genomic DNA
ttgcctagtcctaagcgtcctttctgccttgtcagaaggattccccgagccctcctgcccagtccggcttccgcaggagacctgag

SEQ ID NO: 35248 - DNA, 12 bp, Homo sapiens
  misc_feature 1..12: note = chr14:37135739-37135751
  misc_feature 1..12: note = hyper
  source 1..12: mol_type = genomic DNA
cgccgccccgca

SEQ ID NO: 35249 - DNA, 324 bp, Homo sapiens
  misc_feature 1..324: note = chr14:37136294-37136618
  misc_feature 1..324: note = hyper
  source 1..324: mol_type = genomic DNA
gttcggactttctctccggtggctctcggacaaacacgcttggccaatcctgcggagaggggcacccagataaacgtaacaaagctaccattttctcgactaaaggtcacattgtaatctcccaaggaagttagtgagaaaacctcaaattatacggactggctgtggaccgtttaatttttctttccctccgtccctccctcatgtctccaaaggaaaatttaaaacactcgtgtttttattttccccccgagaaaagctaaacaaccaccacaacaaaagccccagatttaagtctaaattcatcaccgtcctggagtcaag

SEQ ID NO: 35250 - DNA, 170 bp, Homo sapiens
  misc_feature 1..170: note = chr14:37666822-37666992
  misc_feature 1..170: note = hyper
  source 1..170: mol_type = genomic DNA
gaggccacaagacaccgtttttagttccgcgttctccctcttctaatcctattaggttttgtccagacaacgttttgctctttcagaagagaaagagcgttctgcgctcgtcgtcttggattcgacaaccataagcatcccgttagggcaaccaccgcagcagactaagt

SEQ ID NO: 35251 - DNA, 112 bp, Homo sapiens
  misc_feature 1..112: note = chr14:38052852-38052964
  misc_feature 1..112: note = hyper
  source 1..112: mol_type = genomic DNA
ttccttgccaggttgcgggtacagccagctccgcgccggggttgggcggcgcggccgggatgctgagagccctgcgtgctcagccaggggcgcagggcggcccttctgccca

SEQ ID NO: 35252 - DNA, 95 bp, Homo sapiens
  misc_feature 1..95: note = chr14:38057238-38057333
  misc_feature 1..95: note = hyper
  source 1..95: mol_type = genomic DNA
gtggaaacacccagacgaaaaggggatggggtgggggtcgcaggaaggcggcgccctcaggcagggtctccgcactccctcggaaccacagatgt

SEQ ID NO: 35253 - DNA, 273 bp, Homo sapiens
  misc_feature 1..273: note = chr14:38060644-38060917
  misc_feature 1..273: note = hyper
  source 1..273: mol_type = genomic DNA
gctcctggtggtcaccgaggcgctgcctagaggcaggctggcgggcaacgtagagccgtaaggcgagtattgcagtgcctgttcgtatgccttgaagtccagcttatgctgctgctccgaggaggacatgaggttgttgatggagaacgggtggttgaaggagtagtgggggtcccctttcaggtgcagctgggactcgtggggtgccaagccgtgtgccgggtgagaggcgggcacagaggccagcgccccgggcccggagcttatgggggg

SEQ ID NO: 35254 - DNA, 45 bp, Homo sapiens
  misc_feature 1..45: note = chr14:38062015-38062060
  misc_feature 1..45: note = hyper
  source 1..45: mol_type = genomic DNA
gcactttgcagaacacgggacgcccccacccggggcaaatggcta

SEQ ID NO: 35255 - DNA, 128 bp, Homo sapiens
  misc_feature 1..128: note = chr14:38072551-38072679
  misc_feature 1..128: note = hyper
  source 1..128: mol_type = genomic DNA
gagagtcagccctgacgacctcacccagggaaatgaggaacccgtgtgaacctaagaaggaaaccgctatggtggttgtggtggtgggtggctcagctccagaagtggtgaagcgactttcccgaaag

SEQ ID NO: 35256 - DNA, 42 bp, Homo sapiens
  misc_feature 1..42: note = chr14:38677446-38677488
  misc_feature 1..42: note = hyper
  source 1..42: mol_type = genomic DNA
ccagctgcgcgtcctcgtttctgcagtcgatattcctgtggg

SEQ ID NO: 35257 - DNA, 30 bp, Homo sapiens
  misc_feature 1..30: note = chr14:38678172-38678202
  misc_feature 1..30: note = hyper
  source 1..30: mol_type = genomic DNA
gaaaaaaatggggggcgggggggacaagcc

SEQ ID NO: 35258 - DNA, 52 bp, Homo sapiens
  misc_feature 1..52: note = chr14:38678631-38678683
  misc_feature 1..52: note = hyper
  source 1..52: mol_type = genomic DNA
ctcctagccccagcccgggcagctgcggcgaaggcggcggcagcaggggccc

SEQ ID NO: 35259 - DNA, 142 bp, Homo sapiens
  misc_feature 1..142: note = chr14:38679118-38679260
  misc_feature 1..142: note = hyper
  source 1..142: mol_type = genomic DNA
ggtagtaaacctgggcgtgtgggtgctatcgctgctcgtcatcctgcccatcgtggtcttctctcgcaccgcggccaacagcgacggcacggtggcttgcaacatgctcatgccagagcccgctcaacgctggctggtgggc

SEQ ID NO: 35260 - DNA, 136 bp, Homo sapiens
  misc_feature 1..136: note = chr14:38679744-38679880
  misc_feature 1..136: note = hyper
  source 1..136: mol_type = genomic DNA
gcacgtcccggatcacgacgctctgagcccgggccacgcaggggctctgagcccgggccacgcaggggccctgagccaaaagagggggagaatgagaagggaaggccgggtgcgaaagggacggtatccagggcgc

SEQ ID NO: 35261 - DNA, 232 bp, Homo sapiens
  misc_feature 1..232: note = chr14:38724294-38724526
  misc_feature 1..232: note = hyper
  source 1..232: mol_type = genomic DNA
ggttgcagtggccggcgggcgcctggtgggcaccccggtccccccaagggtcggctgtccttccccactggtcacacaagagcggccgtccttccccagctcgaagcccgtagcacattcgcaggcaaagcctcccaagtcgtctaggcagttagggagctctgcgcatttgccagcacggaggtacctcccggggcagggacacaacacatcgcccgagagtttgtcccag

SEQ ID NO: 35262 - DNA, 382 bp, Homo sapiens; identical to SEQ ID NO: 1146
  misc_feature 1..382: note = chr14:38724978-38725360
  misc_feature 1..382: note = hyper
  source 1..382: mol_type = genomic DNA

SEQ ID NO: 35263 - DNA, 30 bp, Homo sapiens
  misc_feature 1..30: note = chr14:42074229-42074259
  misc_feature 1..30: note = hyper
  source 1..30: mol_type = genomic DNA
gtgaagtcccagaagcgatcaagtttaaag

SEQ ID NO: 35264 - DNA, 113 bp, Homo sapiens
  misc_feature 1..113: note = chr14:42074474-42074587
  misc_feature 1..113: note = hyper
  source 1..113: mol_type = genomic DNA
tctgtggtcttcctgcgcagtccctcagcggctcggagtttggccttccagctctccaactcagatcctgagcctcctaagctcccgcggagaccctgaagtcccggatctgg

SEQ ID NO: 35265 - DNA, 15 bp, Homo sapiens
  misc_feature 1..15: note = chr14:42074668-42074683
  misc_feature 1..15: note = hyper
  source 1..15: mol_type = genomic DNA
cgtggcttgagtgga

SEQ ID NO: 35266 - DNA, 183 bp, Homo sapiens; identical to SEQ ID NO: 11850
  misc_feature 1..183: note = chr14:42075097-42075280
  misc_feature 1..183: note = hyper
  source 1..183: mol_type = genomic DNA

SEQ ID NO: 35267 - DNA, 330 bp, Homo sapiens
  misc_feature 1..330: note = chr14:42075480-42075810
  misc_feature 1..330: note = hyper
  source 1..330: mol_type = genomic DNA
accaactgcagtattcgtaatgtctgatgctgagctgagttgattcccaaatataaatgttcttttcagaatccgctcccatctgattagtaagcaaatcaccacccacaactaaggggacagcggaagccagcctcagatgactgaaacccccaagtcagtagctctcctcaaaatttccggcgggttattatagataatgacttttcccaccgccctaagcagccgaagcttgactcagtgatgattctctctatcccgtaactgcgaggaagtgggcgatcagcaaattgcccttttgcaggaggctggggacgcccctggaagttc

SEQ ID NO: 35268 - DNA, 70 bp, Homo sapiens
  misc_feature 1..70: note = chr14:42075811-42075881
  misc_feature 1..70: note = hyper
  source 1..70: mol_type = genomic DNA
ctttcattctccaggttttctgccttttcccttcccccttcctgcaacgcccccgcgcctcctcagcctg

SEQ ID NO: 35269 - DNA, 565 bp, Homo sapiens
  misc_feature 1..565: note = chr14:42076803-42077368
  misc_feature 1..565: note = hyper
  source 1..565: mol_type = genomic DNA
gcaaatgtgttaactcggcgatgccccttcatgcccgggttcttgcagagctctgaggacgcccagacccattttcctggctggatttggagcggctgctgggctgtggacccaggtgtgtggatcgctttacccagaagcttggaaagcgccaatattaacctgcttccaggtacatcacaaggtcaagagagtgtcttgcagccctcttgtttccgtgtatctacaccttcttctcttggccagaaggatatttacgttttggttcacagcatttgaagccaaaagttcagcccttcgaactggtttgctatacaaaacaaaacaaaacaaataaggtaatgaggattgcttattaaactgcttaacaaaatccccgactcttcctcagccctttctcggctccctcctccccaccaaaatgtcaccagctcttgaattacgtggattcgggttggaggagaacttgaaggaaacgtgattaaagggctatgcgagaacgctctctttgctgcccgcggtccggtgggcttcgaagccaatcgtgagaaggaccggttccctc

SEQ ID NO: 35270 - DNA, 200 bp, Homo sapiens
  misc_feature 1..200: note = chr14:42077488-42077688
  misc_feature 1..200: note = hyper
  source 1..200: mol_type = genomic DNA
cgccctgcctctgcccgctccccgggcgcggagccgcgggtttcatggggcgattgcagcgattcccccacccagagcgacctgcgggcagcggcggcagtggcaggagccgcctttccgattccctacgatgcgggtgctgagctatggcaaagggcagcgaagtgacgagcgagacccgcgtacgactgtgaaagcca

SEQ ID NO: 35271 - DNA, 690 bp, Homo sapiens
  misc_feature 1..690: note = chr14:42078799-42079489
  misc_feature 1..690: note = hyper
  source 1..690: mol_type = genomic DNA
cgaagacattagaattaacaagataaagcacttccaaagtagtctcatcaatgttttattccatagtgaagacggtctgaataatttaactaaggagtgttcgtttgtctcccgcctttgggagctgcttgctggctacattcagcggaggatttggcccagccaagctcagggtgccctgcttcaggaggcagtgactggggctgctggggggcggggggttctctttgctaacgccgtttaggaagtgtaggggcgctgcctgattttcccccactcgctgcatttctatagatatccatatgatggcatttgcagacttctagctggccgatagctgctctgcttgtccctgcgcactgacgtccccaactcctcttcgagtctgggctcggctgctgctgcagccctcgcaggctggtggtgctacaaggccatgtatgcagcgggctttgggggctgggctctgccactgcagctggcaggacggctttgacactttctccgggcagggcggaagagctcagcggaccccctggcagacagcaagcgcatcgtggccgaggcggccgcctggatgcgagaggagggagatgcccagagccacagaggagcgtggagggcggtggtgtcctgtctttgcctgcaaaacctttctctctctctccctccccgcgacaatgaatattg

SEQ ID NO: 35272 - DNA, 486 bp, Homo sapiens
  misc_feature 1..486: note = chr14:48143051-48143537
  misc_feature 1..486: note = hyper
  source 1..486: mol_type = genomic DNA
gccctggaacccagacgcgcggacttagcagtccgttcattcatgcacttgctcatccattcacacaaacatgtcccttaattgtgtctggcaccgagaatcttgcctgctattttcccctcccgaagtcagtgctcatggcaaccgctggtgcagaacgcaactcaactgtcaccccacttcctgagccggaaaatcaaggcatgtaggcattcacagaaaaaggaaaaggtggagaggaggaggcggcgggggcggagaggggtggggagactcacggggtcacactggaagcttccctggggggtggggggaaaccgtgacaccgacaccgtggcatgcaaggagccaaaccattattaaatcaaagactgctggagctcggattccccgcggggataaatcaagtgcaaagccgctcgttcgcacgagtgcgttgctgccggctaaacccaactccgagccagagcccaggcgccggggaag

SEQ ID NO: 35273 - DNA, 102 bp, Homo sapiens; identical to SEQ ID NO: 11855
  misc_feature 1..102: note = chr14:48143617-48143719
  misc_feature 1..102: note = hyper
  source 1..102: mol_type = genomic DNA

SEQ ID NO: 35274 - DNA, 161 bp, Homo sapiens
  misc_feature 1..161: note = chr14:48143797-48143958
  misc_feature 1..161: note = hyper
  source 1..161: mol_type = genomic DNA
cgtgaacatgaacatatccagcccagggggtacgcaacgggaccttcaggaggccggcggccagccaggcgcgctccactcgcgcccgggccaagccgaggtgcccgggaaccgctcgccgaaggaggaagcgccgtccgtctgtccttccccggcggcgg

SEQ ID NO: 35275 - DNA, 13 bp, Homo sapiens
  misc_feature 1..13: note = chr14:48144358-48144371
  misc_feature 1..13: note = hyper
  source 1..13: mol_type = genomic DNA
cgaaggtccccgg

SEQ ID NO: 35276 - DNA, 141 bp, Homo sapiens
  misc_feature 1..141: note = chr14:48144623-48144764
  misc_feature 1..141: note = hyper
  source 1..141: mol_type = genomic DNA
gggtccaacagggagcggagtgtgcgtctggagctcgcttgggcacaccagcccagccgccaccgccaccgctctccaaaatagcctttagcgcccggccagcgtagaggtgctctggccggccgcaccaattcccggagc

SEQ ID NO: 35277 - DNA, 126 bp, Homo sapiens; identical to SEQ ID NO: 4104
  misc_feature 1..126: note = chr14:48145236-48145362
  misc_feature 1..126: note = hyper
  source 1..126: mol_type = genomic DNA

SEQ ID NO: 35278 - DNA, 197 bp, Homo sapiens; identical to SEQ ID NO: 4105
  misc_feature 1..197: note = chr14:48145469-48145666
  misc_feature 1..197: note = hyper
  source 1..197: mol_type = genomic DNA

SEQ ID NO: 35279 - DNA, 171 bp, Homo sapiens
  misc_feature 1..171: note = chr14:50155136-50155307
  misc_feature 1..171: note = hyper
  source 1..171: mol_type = genomic DNA
aactgagggccagagcgtcttccctggtgtcgggctgcgttgagccagccacagcgctctcaccgctgccctagacattgcaggactgcggccgagcttcccggacacaggatcccccttctttcgaggccatgagagctgttgggttccctacttcgcacaagctctgga

SEQ ID NO: 35280 - DNA, 154 bp, Homo sapiens
  misc_feature 1..154: note = chr14:51026705-51026859
  misc_feature 1..154: note = hyper
  source 1..154: mol_type = genomic DNA
ctatcactgtcttcacggtctgggggtggactgaggtagggagggtgtgacgctggtatctgtgtgaactcgggcttgtgatgctgagcttggttcatctgctttctcctcccttttcctccccactccttcccaccagcgccacagcaacatc

SEQ ID NO: 35281 - DNA, 19 bp, Homo sapiens
  misc_feature 1..19: note = chr14:51338713-51338732
  misc_feature 1..19: note = hyper
  source 1..19: mol_type = genomic DNA
gcgaacagcctgacccggg

SEQ ID NO: 35282 - DNA, 49 bp, Homo sapiens
  misc_feature 1..49: note = chr14:51410296-51410345
  misc_feature 1..49: note = hyper
  source 1..49: mol_type = genomic DNA
aggagaatgggtgggcggcgctctacgcttggagcgggaccctgcccct

SEQ ID NO: 35283 - DNA, 94 bp, Homo sapiens
  misc_feature 1..94: note = chr14:51410569-51410663
  misc_feature 1..94: note = hyper
  source 1..94: mol_type = genomic DNA
tgtgaagtggacaggcgagaggggcctgggcttttgcccacctggcggtttccaggggcggacggcacagtggtttgggcgggacactggcggg

SEQ ID NO: 35284 - DNA, 410 bp, Homo sapiens
  misc_feature 1..410: note = chr14:51560304-51560714
  misc_feature 1..410: note = hyper
  source 1..410: mol_type = genomic DNA
ggctcatcagtattccgcctgcggcgtctccccgaccctccgccgtgcctcaccaggtccgcctatccagcagcgacagactcccgccgtccgcgcgaccccaccgcccccatcccagtccctccccgagggttcgcagcccgccctgccctcgagcgtgcctagcggccctgggcactggcgcggctctacccagctatgcagtgctttcccacacactggccgcggccactggctgcagacccgccgcggaaagggggcgccctgagtcccgctcgcaggcagcgcgccccgagagacccgctctaaggcatccccgcaacaactctgtgggggcattcaactcccccgtgcgccggttaagattcccccatgcctcctgcaatgcaccagaccagggaggtaaacat

SEQ ID NO: 35285 - DNA, 523 bp, Homo sapiens; identical to SEQ ID NO: 1148
  misc_feature 1..523: note = chr14:51560770-51561293
  misc_feature 1..523: note = hyper
  source 1..523: mol_type = genomic DNA

SEQ ID NO: 35286 - DNA, 344 bp, Homo sapiens
  misc_feature 1..344: note = chr14:51561294-51561638
  misc_feature 1..344: note = hyper
  source 1..344: mol_type = genomic DNA
gggcaccggggccagggccggtgacaagtgggtggccggtggcggcatagccgggggaaacacgcggacgccgttgggggacttctggcacggggtagtgggggcgctggcgaaccccccgtaggagccatagccgctgtccgcctcgctgtataggctcatcttgtccaggtccagatagtcatagtcggagaccccggagcccgcggcccgatggctctggggggattcagactctggggtctgcaccaggatgttgcgggcgcacgcctgacacaaattgtgagagcagggcaggatgatgggctcccgatagaaggagccgcacacggggcatttcaact

SEQ ID NO: 35287 - DNA, 35 bp, Homo sapiens
  misc_feature 1..35: note = chr14:51561875-51561910
  misc_feature 1..35: note = hyper
  source 1..35: mol_type = genomic DNA
ctgccctcctagtcccgccccggcccatgagcagc

SEQ ID NO: 35288 - DNA, 425 bp, Homo sapiens
  misc_feature 1..425: note = chr14:51562235-51562660
  misc_feature 1..425: note = hyper
  source 1..425: mol_type = genomic DNA
cccagctctgagctccgcgcccacctaccgcgggcgagtgctgcgcagcacggaggacgccccttctcttccgctgctggcagccttcgcaggcgtctcacccgggcctaggcttctgcacggcagtggggcttttctccttctccgtgaatccgctgacgccgtgccctggagctcccccatcccgggagtctgacggcgctggcgcaagccctggcgacactcttggcttctttcatcctgcgtccctcgtttcctaaagagcatgtataaagtcgatttcctagtgtcgacatgagattcaactgggtaaccgatggaaatggtcagcattagtcagaatctatgaccccttcgtttcatgctttaaattatagctcggcccagaggcctcagtgccgtggtgtgaacgtgcttccttccac

SEQ ID NO: 35289 - DNA, 396 bp, Homo sapiens
  misc_feature 1..396: note = chr14:52534631-52535027
  misc_feature 1..396: note = hyper
  source 1..396: mol_type = genomic DNA
aggtggccaggaaggcgtgggtgggggtaaagcgcgcagagcgcgggaagccagcgcgcacatagcgggcggccaggcccagcactgcgggggaggtgtcctctcggtacaggactcggcctctgccgtggctcgtgtcgatgtccgccagaaaaggggcgatggccgggaagtcggtggggaaatcatagtccacatactgcgtttccctggggaagtcctgagtggagatgatgccgttggtgcccacctgggagaggagagggacaaaaaggtgacagtcgctcaagcccaaggacgctaccctttcgcgcagggagggaagggaactgacttaggcaaaaagcctctctctccttccccactggccagggagtctggattcagggaaacaag

SEQ ID NO: 35290 - DNA, 209 bp, Homo sapiens; identical to SEQ ID NO: 1151
  misc_feature 1..209: note = chr14:52535055-52535264
  misc_feature 1..209: note = hyper
  source 1..209: mol_type = genomic DNA

SEQ ID NO: 35291 - DNA, 91 bp, Homo sapiens; identical to SEQ ID NO: 1152
  misc_feature 1..91: note = chr14:52535334-52535425
  misc_feature 1..91: note = hyper
  source 1..91: mol_type = genomic DNA

SEQ ID NO: 35292 - DNA, 332 bp, Homo sapiens; identical to SEQ ID NO: 1153
  misc_feature 1..332: note = chr14:52535426-52535758
  misc_feature 1..332: note = hyper
  source 1..332: mol_type = genomic DNA

SEQ ID NO: 35293 - DNA, 214 bp, Homo sapiens; identical to SEQ ID NO: 1154
  misc_feature 1..214: note = chr14:52535759-52535973
  misc_feature 1..214: note = hyper
  source 1..214: mol_type = genomic DNA

SEQ ID NO: 35294 - DNA, 92 bp, Homo sapiens; identical to SEQ ID NO: 1155
  misc_feature 1..92: note = chr14:52535974-52536066
  misc_feature 1..92: note = hyper
  source 1..92: mol_type = genomic DNA

SEQ ID NO: 35295 - DNA, 38 bp, Homo sapiens; identical to SEQ ID NO: 1156
  misc_feature 1..38: note = chr14:52536067-52536105
  misc_feature 1..38: note = hyper
  source 1..38: mol_type = genomic DNA

SEQ ID NO: 35296 - DNA, 62 bp, Homo sapiens
  misc_feature 1..62: note = chr14:52536342-52536404
  misc_feature 1..62: note = hyper
  source 1..62: mol_type = genomic DNA
cgcttcgctccacccagagacgccctgaggagaagcgagcctttgtacgaaggcagagggct

SEQ ID NO: 35297 - DNA, 16 bp, Homo sapiens
  misc_feature 1..16: note = chr14:52734509-52734525
  misc_feature 1..16: note = hyper
  source 1..16: mol_type = genomic DNA
ccagccctctgctccc

SEQ ID NO: 35298 - DNA, 476 bp, Homo sapiens
  misc_feature 1..476: note = chr14:52734526-52735002
  misc_feature 1..476: note = hyper
  source 1..476: mol_type = genomic DNA
cacgccatgaagtcgccgttctaccgctgccagaacaccacctctgtggaaaaaggcaactcggcggtgatgggcggggtgctcttcagcaccggcctcctgggcaacctgctggccctggggctgctggcgcgctcggggctggggtggtgctcgcggcgtccactgcgcccgctgccctcggtcttctacatgctggtgtgtggcctgacggtcaccgacttgctgggcaagtgcctcctaagcccggtggtgctggctgcctacgctcagaaccggagtctgcgggtgcttgcgcccgcattggacaactcgttgtgccaagccttcgccttcttcatgtccttctttgggctctcctcgacactgcaactcctggccatggcactggagtgctggctctccctagggcaccctttcttctaccgacggcacatcaccctgcgcctgggcgcactggtggccccggtggtgag

SEQ ID NO: 35299 - DNA, 380 bp, Homo sapiens
  misc_feature 1..380: note = chr14:52735044-52735424
  misc_feature 1..380: note = hyper
  source 1..380: mol_type = genomic DNA
cgggaagttcgtgcagtactgccccggcacctggtgctttatccagatggtccacgaggagggctcgctgtcggtgctggggtactctgtgctctactccagcctcatggcgctgctggtcctcgccaccgtgctgtgcaacctcggcgccatgcgcaacctctatgcgatgcaccggcggctgcagcggcacccgcgctcctgcaccagggactgtgccgagccgcgcgcggacgggagggaagcgtcccctcagcccctggaggagctggatcacctcctgctgctggcgctgatgaccgtgctcttcactatgtgttctctgcccgtaattgtgagtccccgggccccgaggcagcagggcactgagactgtccggc

SEQ ID NO: 35300 - DNA, 20 bp, Homo sapiens
  misc_feature 1..20: note = chr14:52735451-52735471
  misc_feature 1..20: note = hyper
  source 1..20: mol_type = genomic DNA
cggatcgggatggacgcggc

SEQ ID NO: 35301 - DNA, 549 bp, Homo sapiens
  misc_feature 1..549: note = chr14:52781428-52781977
  misc_feature 1..549: note = hyper
  source 1..549: mol_type = genomic DNA
gggtgcagcgccggccgcaggagctccctctccttgttccacgtgctggtgaccgagctggtgttcaccgacctgctcgggacctgcctcatcagcccagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcgcgctccgggggcctggccgtgctgcctgtcatctatgcagtctccctgctcttctgctcgctgccgctgctggactatgggcagtacgtccagtactgccccgggacctggtgcttcatccggcacgggcggaccgcttacctgcagctgtacgccaccctgctgctgcttctcattgtctcggtgctcgcctgcaacttcagtgtcattctcaacctcatccgcatgcaccgccgaagccggagaagccgctgcggaccttcc

SEQ ID NO: 35302 - DNA, 233 bp, Homo sapiens
  misc_feature 1..233: note = chr14:53417159-53417392
  misc_feature 1..233: note = hyper
  source 1..233: mol_type = genomic DNA
ctccaatgtgcacctcgccggtcactctcagggtgacatcgcggttcaggtccgtcacatggacactcagttcccacgtcccgtccgcgtagcagccatctggcatccttatcccgtccagagccatggctccttcctgcgagcgcggaggaaatggctctcgtaagcgtcactcccccaaagaaaggcgaatcccaccgaattcgcagcgccggccacgggctgggaggtgg

SEQ ID NO: 35303 - DNA, 494 bp, Homo sapiens; identical to SEQ ID NO: 11873
  misc_feature 1..494: note = chr14:54422431-54422925
  misc_feature 1..494: note = hyper
  source 1..494: mol_type = genomic DNA

SEQ ID NO: 35304 - DNA, 34 bp, Homo sapiens; identical to SEQ ID NO: 11874
  misc_feature 1..34: note = chr14:54422926-54422960
  misc_feature 1..34: note = hyper
  source 1..34: mol_type = genomic DNA

SEQ ID NO: 35305 - DNA, 57 bp, Homo sapiens
  misc_feature 1..57: note = chr14:54423406-54423463
  misc_feature 1..57: note = hyper
  source 1..57: mol_type = genomic DNA
agctagatactcagccggagcagcagcggcgtctcaggctcgcgtccctcagctcgg

SEQ ID NO: 35306 - DNA, 387 bp, Homo sapiens
  misc_feature 1..387: note = chr14:54430156-54430543
  misc_feature 1..387: note = hyper
  source 1..387: mol_type = genomic DNA
atgtccgctaactaacgtaaagaaacgtccgcgtgctccgctgataccccagggccaccggaggagagcagtggggtgtgagaactaggctgtgtccagtggctggtggtggggggagcggctactgcgccttccccttgggcactcctctcgggtccctgaggcgacgccctagtaagcctccacgcacgtcagcgaagggtgggtggagggtcaccctgaccgcgccccacagctggctcccgcgctctgcccaccgccacgccaccttcaccgcgcgatctcggcactcccgcctttctcttgccctcgttatttttagttcggctgctgcacctccctgcctgcaacagctcgccccactctcagactcgttttgcaggattt

SEQ ID NO: 35307 - DNA, 35 bp, Homo sapiens
  misc_feature 1..35: note = chr14:54687254-54687289
  misc_feature 1..35: note = hyper
  source 1..35: mol_type = genomic DNA
tggggagaggggttccgtttcgggtcacggtcctg

SEQ ID NO: 35308 - DNA, 232 bp, Homo sapiens
  misc_feature 1..232: note = chr14:57260863-57261095
  misc_feature 1..232: note = hyper
  source 1..232: mol_type = genomic DNA
cattttaggccaattcgttaaaccagccgtctaaacgggccctggcactgggtatccgaccgctccacgcgccagctggtgaggcctggagttggaaccggaagccgtctccagccggcctcctaggccctaggtgcccgggtgggcacacttccgcgagggcccggggacagcgccggccaagtcttgcgggcaactgcacactcggttccgggaggcaggtactccaggt

SEQ ID NO: 35309 - DNA, 234 bp, Homo sapiens; identical to SEQ ID NO: 1159
  misc_feature 1..234: note = chr14:57261174-57261408
  misc_feature 1..234: note = hyper
  source 1..234: mol_type = genomic DNA

SEQ ID NO: 35310 - DNA, 415 bp, Homo sapiens
  misc_feature 1..415: note = chr14:57261465-57261880
  misc_feature 1..415: note = hyper
  source 1..415: mol_type = genomic DNA
cggaggcctgggttggggggtcgtgagccggatgttccccgcagctggccagaaagctgcctctgagcctcttgagcaactccctgcctcctccggtagtctctctggactctccaagtgacttgctgggggcaccgggcgcggggagggcaggcccccggggtgacgcaggtgtgtactttacagccagagaaggcctagctttcagggacattggcttagtttgttgggtgagacgtgggggtggagaatgggagcactgtctctttgccaaattttccagagaaaccccgggactagctctgtccctggtgccccggctactgccagcgggtccttagcgctgtcgattgcgcgcaccggagcccgaagtcttccccaccgctggcaggagagccccgcgagctctcccgga

SEQ ID NO: 35311 - DNA, 214 bp, Homo sapiens
  misc_feature 1..214: note = chr14:57261965-57262179
  misc_feature 1..214: note = hyper
  source 1..214: mol_type = genomic DNA
cgcgaaggaggcctcaaccttaggacaacccgggcgtcccgggcgaaggtctcgatctgccggagccactgcctttcaggcatcgctccattaaagccagggaggagagggtcattggccagcgacccgccctccttacgtccggaggtcaccccacgcctacaggcaggtttttctgtctcctttgcagaacactatgcgtttgttacaacga

SEQ ID NO: 35312 - DNA, 815 bp, Homo sapiens
  misc_feature 1..815: note = chr14:57263831-57264646
  misc_feature 1..815: note = hyper
  source 1..815: mol_type = genomic DNA
tatcagagcaccctgcgctgacaggctcgggcggtttagaagagaaaatcagaggtgctcagggcacctggtcacaaacctgggcatgcagatgcctgatgggggcttggaccctttcgtggcacgaaaaggagagagactgctgttcatcttaaaagtctcgaaggaggcaaaaacccaggcggaagtcatggctgactctgatcctgcatcttctcattctggttgttttccaccgcgtctgctcccatttgcgtgggatgcgctggtctcctgcccgactcttttgtgttcctcttttgcatgattaaaaacacgtttctatatgcactaaaccatcacctagcactggcacgcctggttttgggttacagctttgtccgtataataacagcgaagttctccctgggtgtgagatgcgggttcgaacatgtggtgtgcgcgccagggctggccgcttccggttaagtggacgcggggacttgactgcgtcccctgccttgcaggtaactggaatgggttgcctggcaagttggccctgcccgggacgccgaagggaccgcttccccattccagagcctgcctctggccttcagggccgctgacaggtccgaaaagaaagagaaggcactcagttttaaaaaaaagagatctagaggactggggaaaaggggatgagccaaggcaaactgggaattgctcgggcttcccccgaaagcctcagctcagtgccgggggagaccccaacggagggccagactcccccaaatccagtggccgaagacctggatttcctgggaggatccccgggggcc

SEQ ID NO: 35313 - DNA, 43 bp, Homo sapiens; identical to SEQ ID NO: 1162
  misc_feature 1..43: note = chr14:57264764-57264807
  misc_feature 1..43: note = hyper
  source 1..43: mol_type = genomic DNA

SEQ ID NO: 35314 - DNA, 135 bp, Homo sapiens
  misc_feature 1..135: note = chr14:57265147-57265282
  misc_feature 1..135: note = hyper
  source 1..135: mol_type = genomic DNA
gccctgggaccggcgcccccgaggcctgagaactacgcccggggggcgcgggctgaggctcaagagaggtcctaggtgcgggccagggatggagccagcccagagagaaaggggaaaacccggcaaggcaagagc

SEQ ID NO: 35315 - DNA, 160 bp, Homo sapiens
  misc_feature 1..160: note = chr14:57265517-57265677
  misc_feature 1..160: note = hyper
  source 1..160: mol_type = genomic DNA
gccccagcctcccagcgtcttgcgcctgtggcggcggcagtacgggcctggggggtcacccacaggaaaggtgagattagcagcaccatgtgggagaggggttgaggaaacccaccattatctaaaacttggaggtttccaaagccggaacttaattgag

SEQ ID NO: 35316 - DNA, 15 bp, Homo sapiens
  misc_feature 1..15: note = chr14:57270957-57270972
  misc_feature 1..15: note = hyper
  source 1..15: mol_type = genomic DNA
aagatgtctgggtac

SEQ ID NO: 35317 - DNA, 96 bp, Homo sapiens
  misc_feature 1..96: note = chr14:57271153-57271249
  misc_feature 1..96: note = hyper
  source 1..96: mol_type = genomic DNA
cgcagcagtcccccgttcctcacagcccttcagccgggagcctaccaatgctctccccaccgtctccccagccttgctccccggggacccaggaca

SEQ ID NO: 35318 - DNA, 30 bp, Homo sapiens
  misc_feature 1..30: note = chr14:57271654-57271684
  misc_feature 1..30: note = hyper
  source 1..30: mol_type = genomic DNA
aacaactgcgaagcccgagagtgctaagga

SEQ ID NO: 35319 - DNA, 95 bp, Homo sapiens
  misc_feature 1..95: note = chr14:57272009-57272104
  misc_feature 1..95: note = hyper
  source 1..95: mol_type = genomic DNA
agggtgttgcatccccggagggtgggcatggggaagaggggtgcgggagtgcagcagggctcacttacccgggtagcccacggaggggtgcagca

SEQ ID NO: 35320 - DNA, 77 bp, Homo sapiens
  misc_feature 1..77: note = chr14:57272324-57272401
  misc_feature 1..77: note = hyper
  source 1..77: mol_type = genomic DNA
gctggtttactgcttcggaggcagcagctcttccacgttccagcactaacttaaaaagagcacggactaggcgaggc

SEQ ID NO: 35321 - DNA, 30 bp, Homo sapiens; identical to SEQ ID NO: 11888
  misc_feature 1..30: note = chr14:57273051-57273081
  misc_feature 1..30: note = hyper
  source 1..30: mol_type = genomic DNA

SEQ ID NO: 35322 - DNA, 322 bp, Homo sapiens; identical to SEQ ID NO: 1166
  misc_feature 1..322: note = chr14:57274417-57274739
  misc_feature 1..322: note = hyper
  source 1..322: mol_type = genomic DNA

SEQ ID NO: 35323 - DNA, 310 bp, Homo sapiens; identical to SEQ ID NO: 1167
  misc_feature 1..310: note = chr14:57274740-57275050
  misc_feature 1..310: note = hyper
  source 1..310: mol_type = genomic DNA

SEQ ID NO: 35324 - DNA, 476 bp, Homo sapiens
  misc_feature 1..476: note = chr14:57275210-57275686
  misc_feature 1..476: note = hyper
  source 1..476: mol_type = genomic DNA
cgcgagggagggaggaagaaacgtgccaaaagggttggccttgactattaattatcgttgggagaaagccccggtgttagcgctgaggtctgggtgtctaccttactctggggggaggagttccctctcctactcccctctgttgctaataacttttggtgcctgtaaaaagtcccgagctgagcaggagaaatcctgaccccgaagctctaggatggaggggagaatttctaggagcgacttccccgtcccctccccaagcaatccaccaccgcagggtcggcgccgctcggccttcgctccccgcgcaccagttctatctgtgaaggaagcaaaagccaactcggtggaatcctgacaggggacttgggtttccaaaaatatgtcccgaaatcgggcatcgatttcaagagtcacttgaacgcaacaacgcgaagacttcttgggagtttgcagagcgacccgtcgcccgcgcc

SEQ ID NO: 35325 - DNA, 807 bp, Homo sapiens
  misc_feature 1..807: note = chr14:57276073-57276880
  misc_feature 1..807: note = hyper
  source 1..807: mol_type = genomic DNA
gggggttgggaggctgcgtaattacaacccagggtggtttggattttggggggtggtggatatttaaaaacaaaaaggagatctggaagcttttgggagaaacagacaaccgagctgtgctaggctgagggagaggaggccaaagagagcgagcagtgagcgccggggcggacgagaagccagcgctcccagcctcctcggttatccgctccggtttccgctcacgttcaacaggggccgacaggggctcgagcggcggcccccggcccaggccgacccgcaagcgaaccgagcttccggcgcgcgggcccaaggaggcgcctggctttttattattgttgtttcaatccatccatctagttacatctgcatctttttgtctcggactctaaaaaggtccctgggatccatccaaacgaccccaaccaaatctgggggccaaaacgcaaagatcgcgggagaagcccagaacggcgttgacataaaaacaaaaccacaaacaaaaccttccaaaacaccccagattacattcgcagcgtttcgacgacgttttgcagaagcgacgacccccaggagcacgctctctgcctctctcccactaccgctctcatctctagatcacatttttctttttgcaacgatcgttattacacctcaaaatttgtaagagaaaaaatacatccgcctacagaactccacgttcgcagaggggcatcggtcggtctattggaggtactggggtgatggccgacagacacggggacacgtagatatggatatagacaagacagacggacacttacctta

SEQ ID NO: 35326 - DNA, 829 bp, Homo sapiens
  misc_feature 1..829: note = chr14:57277934-57278763
  misc_feature 1..829: note = hyper
  source 1..829: mol_type = genomic DNA
ccgagtgagagaccccggcttctggtaggttcctggggttttttggaattgagaagcccacgacagactgcagggaacacgaaccccggaatctaatctcagggcccatttaggagaagtagctgggaccacatcgggcctcgaggatgcgagtgtgaggtcgacaagatatcgtggaagagagcgaacgagggaggcccccgttggaaacagtttctgtgttagaacaaacgccaccaaacgaccgacactgcgaggcctggagctacctgggctggcgccgcccgagccccgggctgcgagcccagaggctgggaagtgatgggacctgggggcccgagccggagagtgcgacccccagcccaacttttttgcctggcatagaaagcagggaccggacaggtttcaaacggatccgagtccctagaaaagcaaaaacagactgggcggagtgtggggtggggggtggctagtggaactggtgagtgtgtgtgaataagctgggtgggggtgggagcagaagacagctcttgcttcacaacacccagtgcaggaaaagaaaaataaaatctcttcctaaataccccaccccccgccacccacccaccaccaactaccatcaccaccacggccagtgggcccaaagaaacagctcgctgcctttaatttggggacctatgttaatgaagttggtaattaattcgtcgctttgttgtcggttcttatactgtatgtgtactcaaatgtggccgtccttgggatttacagcaattaacgaattacgggagtgcgcacgaggcagcaagctctcggcagccgggctccggct

SEQ ID NO: 35327 - DNA, 728 bp, Homo sapiens; identical to SEQ ID NO: 1171
  misc_feature 1..728: note = chr14:57278837-57279565
  misc_feature 1..728: note = hyper
  source 1..728: mol_type = genomic DNA

SEQ ID NO: 35328 - DNA, 126 bp, Homo sapiens
  misc_feature 1..126: note = chr14:57281138-57281264
  misc_feature 1..126: note = hyper
  source 1..126: mol_type = genomic DNA
tcactccctgcattgcggttgcctcaaaaaagagggtaagggagaaagaaacaacttcaaagataggattgggctgtctcgataaaagagtagggaggcaaactccaaatgcgaaaaagaggaaaa

SEQ ID NO: 35329 - DNA, 110 bp, Homo sapiens; identical to SEQ ID NO: 1172
  misc_feature 1..110: note = chr14:57283299-57283409
  misc_feature 1..110: note = hyper
  source 1..110: mol_type = genomic DNA

SEQ ID NO: 35330 - DNA, 592 bp, Homo sapiens; identical to SEQ ID NO: 1173
  misc_feature 1..592: note = chr14:57283445-57284037
  misc_feature 1..592: note = hyper
  source 1..592: mol_type = genomic DNA

SEQ ID NO: 35331 - DNA, 541 bp, Homo sapiens; identical to SEQ ID NO: 1174
  misc_feature 1..541: note = chr14:57284070-57284611
  misc_feature 1..541: note = hyper
  source 1..541: mol_type = genomic DNA

SEQ ID NO: 35332 - DNA, 188 bp, Homo sapiens
  misc_feature 1..188: note = chr14:58332215-58332403
  misc_feature 1..188: note = hyper
  source 1..188: mol_type = genomic DNA
ctgggcgcacccagccgggccccttgccctctcacggttcagcaccgaggacagcggacatacttttctccccggggggtccccgccgccaggaaggcggtgttgacagcgtccgcagggctgcaggtgtccgtaccgcgcgcccgcccgtccgcatccccgcggcacccctgcgcgcccacctccct

SEQ ID NO: 35333 - DNA, 68 bp, Homo sapiens; identical to SEQ ID NO: 11902
  misc_feature 1..68: note = chr14:58332640-58332708
  misc_feature 1..68: note = hyper
  source 1..68: mol_type = genomic DNA

SEQ ID NO: 35334 - DNA, 100 bp, Homo sapiens
  misc_feature 1..100: note = chr14:58618341-58618441
  misc_feature 1..100: note = hyper
  source 1..100: mol_type = genomic DNA
gcattggggacactgcgatcgacggtttgaaaggagtaaaccgttgttttcgggaacttctctctcactgctgtgggattgcgagcggagggagaaagag

SEQ ID NO: 35335 - DNA, 158 bp, Homo sapiens
  misc_feature 1..158: note = chr14:59931281-59931439
  misc_feature 1..158: note = hyper
  source 1..158: mol_type = genomic DNA
gatcttctcccgcggcggccgcacgatagcgcagtaacggtccaacgagatgagcgccacgctgagcgtggacacgatgccgaagcacgagctgaagaagcggctggcggcgcagaagccgcgccagggccccgcggcggcggcaggcgccgaacccc

SEQ ID NO: 35336 - DNA, 334 bp, Homo sapiens
  misc_feature 1..334: note = chr14:60043273-60043607
  misc_feature 1..334: note = hyper
  source 1..334: mol_type = genomic DNA
tgagtgcctcctaagcgccacctctgaggagacgtcccttccagcgcccgaggggcgtcttacccacaacaaacagctgctccagcgcctcgaccgcgaccgaggagcccagggtggagggtaaggtgcataactccagggaggggccagtggagacggcagccgcctgcaccagcttctcgccagcgcccagccctggggtccaggggctcagggccattttgccgctctacttgagcgcctcctaagccagagccaaggattgccggttgccacgggcaacgaggacaccgaggtcgtggggcgccccctcgtggcccgcacctctagtagg

SEQ ID NO: 35337 - DNA, 54 bp, Homo sapiens; identical to SEQ ID NO: 11904
  misc_feature 1..54: note = chr14:60097193-60097247
  misc_feature 1..54: note = hyper
  source 1..54: mol_type = genomic DNA

SEQ ID NO: 35338 - DNA, 204 bp, Homo sapiens; identical to SEQ ID NO: 11905
  misc_feature 1..204: note = chr14:60097406-60097610
  misc_feature 1..204: note = hyper
  source 1..204: mol_type = genomic DNA

SEQ ID NO: 35339 - DNA, 77 bp, Homo sapiens
  misc_feature 1..77: note = chr14:60336952-60337029
  misc_feature 1..77: note = hyper
  source 1..77: mol_type = genomic DNA
gcgaatattcccagtcgcccgtggcgacgcgggggtggggtcggcgctcaaggcagaaagcgcgaggcaggtgccca

SEQ ID NO: 35340 - DNA, 16 bp, Homo sapiens
  misc_feature 1..16: note = chr14:60386034-60386050
  misc_feature 1..16: note = hyper
  source 1..16: mol_type = genomic DNA
atccagagaacgacac

SEQ ID NO: 35341 - DNA, 668 bp, Homo sapiens
  misc_feature 1..668: note = chr14:60386051-60386719
  misc_feature 1..668: note = hyper
  source 1..668: mol_type = genomic DNA
agacctgcggttgctttggtttgccttttactaagttcatttctcagcctctctgcccactctgaaaagtctcccctttccccccttttaattctactctattttgtaaattactgttgtctcctgaaaattttggaatgcttaaaaggcactcaaaagcctgtccgagatcgactagaagaccctcggaaggtccctctcttctctggacctcactgggcgttcgtttgcccgcgccgtccttccattcggcttgccgggcgcgcagcggcttgcggctgtggtcagccaccttcccgggaggcggtggtcgctggccgcgggaaggatgccgcgctgggggtcggggttcgtcccggctgtcacgccaccttgtgacatcacagggccatgccctcggggctcaaggccagagaggctccgcgcttccaggacccgagagctaaagataatgaatgggagagagcgagactggaggaggtaacgaataagtccccaccaccttgcccataacgcgttgctttcagtcacgttccgcgaactggcgaaggtaagtgaaaagataagcgcaggtacagaaaaacctgccagcgagaagctcccgccgtttcccaggagccccaggtggggtcttccggttggacccctgcttccgctgattggttgga

SEQ ID NO: 35342 - DNA, 358 bp, Homo sapiens
  misc_feature 1..358: note = chr14:60794473-60794831
  misc_feature 1..358: note = hyper
  source 1..358: mol_type = genomic DNA
ttaaaaaaatatcctcgtggcttaatgaccaaggcgggtttattctcaaggaagggggagcggcgtggtggtgttactaaacataacagatggcagctgtctgcggctatatagggcgcgctgacaaatccctctggatggccacgcggcgctgggctgcggggcctgggtgcacttcgcgcctggctcggagggcgccgcctgcgggaggacctccgggagccgagctgcctccccgcaaacccggcccgggcccacgcgggctcagggcgccaggcggggtgcgccgaggtgcagctccccggccctaggcttcgctggggtgggggtcgaggcctctccgcgggtggctccctcc

SEQ ID NO: 35343 - DNA, 225 bp, Homo sapiens; identical to SEQ ID NO: 1175
  misc_feature 1..225: note = chr14:60952195-60952420
  misc_feature 1..225: note = hyper
  source 1..225: mol_type = genomic DNA

SEQ ID NO: 35344 - DNA, 117 bp, Homo sapiens; identical to SEQ ID NO: 1176
  misc_feature 1..117: note = chr14:60952516-60952633
  misc_feature 1..117: note = hyper
  source 1..117: mol_type = genomic DNA

SEQ ID NO: 35345 - DNA, 230 bp, Homo sapiens
  misc_feature 1..230: note = chr14:60952729-60952959
  misc_feature 1..230: note = hyper
  source 1..230: mol_type = genomic DNA
cgccacagcggatcctaactacaaacggtccccggagccctgggctggactcgctcagccccgcccccacgcccctggtaccagccctgagagaccccgcggagcacgccgcgggagccgcagatcgcgctgaagagcagcgagatcgcgctctggacgagacctgcgcggctgcaaccgctccttcttcgcgggtggaagcgcggaataagccccgtaaaaccacagaa

SEQ ID NO: 35346 - DNA, 769 bp, Homo sapiens
  misc_feature 1..769: note = chr14:60973239-60974008
  misc_feature 1..769: note = hyper
  source 1..769: mol_type = genomic DNA
atacttcttcctgttcgtcccttccccttgtgaagctggtgaacaaataagtgattccaaggtgccctggcgcagtctatttcctttgggttaataaaattaaatcaagtcccttgcgatggcgaagatggatctcctgatagtagtccccaacctccaggcacttctcagtcccttcctgccaagccaccagacagtgctcctactctgccacacgcagcccgcacccttctggcggctcccgcgaggccaactcagactctcagttccagttgcccgcgagcctcagacacgcagaagctaaagcgccctcatctaattatttgcagaactattatccaagaaatgggccatgggataaatattcccatttcctggatggggcccctagactgtccacttgctcacaaagattaagggtaagaaaccagctctccccgaatgtgccgcttccaaactgtccagtaaaagggcgagagggagacgtgtggtctcctggggcatggacaacctctcccacctcagcagctaggcgctgggatcggggtcggctctcggctcggctcgcgggctgtaaggtctccgcggaccccaccgcctcttctgcgcgctaagggtgagcgccaagcaatttcgcgagcaatagccggcaaagtaaccaccccgagagggaaaataaacctctgcaaactggagcaagggggtgctttcctcccctggccagaagctccgggatcgcagccctcccgggtccggcttcatccctgcc

SEQ ID NO: 35347 - DNA, 15 bp, Homo sapiens
  misc_feature 1..15: note = chr14:60974077-60974092
  misc_feature 1..15: note = hyper
  source 1..15: mol_type = genomic DNA
cgatgtttctttcta

SEQ ID NO: 35348 - DNA, 47 bp, Homo sapiens
  misc_feature 1..47: note = chr14:60974368-60974415
  misc_feature 1..47: note = hyper
  source 1..47: mol_type = genomic DNA
tgccctgcactcaggcgtggcgtgatctgacccgacacctccaacca

SEQ ID NO: 35349 - DNA, 441 bp, Homo sapiens; identical to SEQ ID NO: 1179
  misc_feature 1..441: note = chr14:60975448-60975889
  misc_feature 1..441: note = hyper
  source 1..441: mol_type = genomic DNA

SEQ ID NO: 35350 - DNA, 536 bp, Homo sapiens
  misc_feature 1..536: note = chr14:60976074-60976610
  misc_feature 1..536: note = hyper
  source 1..536: mol_type = genomic DNA
cgctccgggctcagtgccctcgccgccgccggcactgcctcgatgttccagctgcccatcttgaatttcagcccccagcaagtggccggggtatgtgagaccctggaagagagcggcgatgtggagcgcctgggtcgcttcctctggtcgctgcccgtggcccctgcggcctgcgaggccctcaacaagaatgagtcggtgctacgcgcacgagccatcgtggcctttcacggtggcaactaccgcgagctctatcatatcctggaaaaccacaagttcaccaaggagtcgcacgccaagctgcaggcgctgtggcttgaagcacactaccaggaggctgagaagctgcgtggaagacccctgggacctgtggacaagtaccgagtaaggaagaagttcccgctgccgcgcaccatttgggacggcgaacagaagacacactgcttcaaggagcgcacgcggcacctgctacgcgagtggtacctgcaggatccataccctaaccccagcaaaaaacgtgagctcgcccaggcaac

SEQ ID NO: 35351 - DNA, 376 bp, Homo sapiens
  misc_feature 1..376: note = chr14:60977337-60977713
  misc_feature 1..376: note = hyper
  source 1..376: mol_type = genomic DNA
tttttgcctttaggtcgggccgacccgatccaacgcgatcgcgggagcacttgctcaggcgtaagccccaggcagacgcaccgttagaaatggtatcccatgtccctgggaccgatctgtccttgtcacccacacttcgtttatttcctgacagtcctgtaaatctcccaaaagtgcacaacaaacagggaggacactgcaagcccagtatataaaagacctgggagctgcggcgctgagaaagggcgcgaatcatggtggggcacaacagtagggacccgcggaggggcggccgcggactcctgcccgacctctgtcgccttgccgagtaatcctcgccttaactgctggggtcttcggaagaacctctagccgc

SEQ ID NO: 35352 - DNA, 410 bp, Homo sapiens
  misc_feature 1..410: note = chr14:60977879-60978289
  misc_feature 1..410: note = hyper
  source 1..410: mol_type = genomic DNA
cgtcgccaccagcccggccgccagtctatccagcaaggcggccacttcagccatctccatcacgtccagcgacagcgagtgcgacatctgagttgcccatccaggatgctcagaagcagattccagtgtaaaaacgagaaaaacaaaatgaaagaggggaagaagatgagagacctgcaaatccagcgccacagaagccaggtgaccagggacccgcgggctcgggttgccgtttcccgccccaccccgcggccggcctggcttcactggcgccctttggccgcgaccacgggaaccagcggtgaggcctgacccagcaccacgttcttcttgctttgctttttcctaaggattttgctgcaaagtctccttcggaacccgaactgcaagctgagcgcctgcccagattc

SEQ ID NO: 35353 - DNA, 611 bp, Homo sapiens
  misc_feature 1..611: note = chr14:60981202-60981813
  misc_feature 1..611: note = hyper
  source 1..611: mol_type = genomic DNA
tttcaccaaaaaaaacgacggcccctgctccccaaatgccgcagttcctctcgcctccactttaatgacccactccacttccacccgtcactccctcctttcccttcgccagtttgtttataaaaaatctgggagggaggggagaagacgatgggggtggggagggcttgctctttgtttacattaaacaaatgacaggcaaagagctcaagcaaagtcttccttgacctcgttccctctccctaattttaacaaaaaggaaaaaaatattgtatccaaagagaatgtgaatggggcgggaggagaggagaagcagcttttcgctctattcaacggggacgcgagagcgcggacgatttccgctccttttgtgaggcggagcccgggggcggccgtgaatggggggtctgtggagcggccggcggggctgtcaggcggctctgcgtaatcagggctaatgacggcggccgggcgctcggcgggacaatgcgcggggccgcggggttttgtcggcctgaatggctaataggtttgcctgtgagctgcgagggggcggtgtcggggaggaggcggcggcgaggggagaaggggtcattgtccgcgcgctggcc

SEQ ID NO: 35354 - DNA, 396 bp, Homo sapiens
  misc_feature 1..396: note = chr14:60981972-60982368
  misc_feature 1..396: note = hyper
  source 1..396: mol_type = genomic DNA
cggtccgctcccaaagagaagcccagactgggcccacagtacccgggaaggtgagtccttactcgggggcccagatctccccacggaggccacagatctgggtccccgaggaaggagagccccccttttcgcgcacccaccttttccatccagcgccccgcgaactcgcggacgtgtaggcctcgagccactcctactgttgggctgcgtgactcagcggctcgaggagagaaacctctcaaaaccgggggaccgagacggggttcaatttaaacctaggtgggagaatgagcccacaagcgcgcgcccctgcagctgcggaggcgcgcgcccgcccaccctcgggcgcctgaagtcgcagcggttgcagagcctcgagcccgtggatgcggcgcg

SEQ ID NO: 35355 - DNA, 426 bp, Homo sapiens
  misc_feature 1..426: note = chr14:60982573-60982999
  misc_feature 1..426: note = hyper
  source 1..426: mol_type = genomic DNA
cgccggggttagccttcgaggcggggagagggagcggggtccttcaaggaccgcatgttcgcgatagcacatttgagccctggcaggccacctgggccgccttctttcggaaaccttgcggggtttccaagcaaggtttacaatgggaaactttatttcccattgtaagctcttacaaatctcctctggctagatccttccttgcagctctctttgctaggatttatattcccaaacttcttcagacgtgccctaccgcgagggaacgaactggttttcttcccgttttcacctccttgtctggagacaaaggggtgtgagggcgatcccagagctgaacaagcagtttcacgcctccctgcccgctcatgctgtttccgcttgccctgtggtttgctctgcctggaacgccgccccctacctcaa

SEQ ID NO: 35356 - DNA, 15 bp, Homo sapiens
  misc_feature 1..15: note = chr14:61104140-61104155
  misc_feature 1..15: note = hyper
  source 1..15: mol_type = genomic DNA
cctaccccccagtgc

SEQ ID NO: 35357 - DNA, 316 bp, Homo sapiens; identical to SEQ ID NO: 1182
  misc_feature 1..316: note = chr14:61104241-61104557
  misc_feature 1..316: note = hyper
  source 1..316: mol_type = genomic DNA

SEQ ID NO: 35358 - DNA, 241 bp, Homo sapiens; identical to SEQ ID NO: 1183
  misc_feature 1..241: note = chr14:61104623-61104864
  misc_feature 1..241: note = hyper
  source 1..241: mol_type = genomic DNA

SEQ ID NO: 35359 - DNA, 1003 bp, Homo sapiens
  misc_feature 1..1003: note = chr14:61109265-61110268
  misc_feature 1..1003: note = hyper
  source 1..1003: mol_type = genomic DNA
cccttgtctggccttcgaatccatactggcagcctctcctctcaggcactccgcgggccgggccactaggccccctgctcctggagctgcgctatgatccgggtcttgagatgcgcgcgattctctctgaaccggtggagaggaggctctgccccgcgcggagcgaggacagcggcgcccgagcttcccgcgcctctccagggcccaatggcaagaacagcctccgaagtgcgcggatgacaggaaaagatcttcagttcttctgccgctagagaagtgcgggatacaagcctctattggatccacaacctggagtcctgccttcggactttgccaaagacttgcaggcggtggggaggcagtaggaaatgaagccccctccagcctcagccgccgccgcgttcggtgcagcagcagcagtgccactgccacagagcagaggaaggcccgctccgcgcgagttctgtgccaggtgtcccgttggccctcagcggacaagggagagccgctaataagggtcgctgctcagcaaactcagagctcatccataagtgccaacgccactgcttctttctggaagcttccactccggcccggggtccggccccagccacgctgtcctagcccagagaacaggttcaagaacggtggtgcccagccccagcggtgcccttctccgtccctgtagctcgctgggctcttgagcccctacccactaagccaaaaattcgggaaccgggagccaaaccccttggcctctgagaatttaggaagcttcgttttcagccaagaggtcaaggcgagcagagagtggggactcgaacaatcgcgtgtttaggtttaaaacgttaaaaaataaacatcactcgagtgttttttttttttttcatttcacttggcacaatgctgtatggtttcgtcctacaaactatttataagccgttgttcattacttttggctaccgttatgacatctgtagaggagaaacgaaaagtggcttta

SEQ ID NO: 35360 - DNA, 329 bp, Homo sapiens
  misc_feature 1..329: note = chr14:61114393-61114722
  misc_feature 1..329: note = hyper
  source 1..329: mol_type = genomic DNA
cctaaccggcccctgcgctcaggttttcccccaaactctttggcttcgcggagcgctctccccgccacagccacctccccaccgtccttctgaatctctgtccgaaacgctatagagaacagaaggagcctgcccaggtggccgaaggtgttgccccgaggtgggggaaagtagagaccaatttttaaaatattgccttgtgagctccagtgcgagagagggctgcgactggagaccctttcctcgtctgggcatgcggcgcggtcagccagaccgacgggctgcagtgccgggccacgcgcgagcgagcacggcgaggatcaaccctt

SEQ ID NO: 35361 - DNA, 1052 bp, Homo sapiens
  misc_feature 1..1052: note = chr14:61114997-61116049
  misc_feature 1..1052: note = hyper
  source 1..1052: mol_type = genomic DNA
caacatttcactgcccgttgatttagaaactcactctccacccaccactcatagccgcggccagccagggaggcataaagaccaaatctagcgccaatatttcccgacactcacatcccagagaaacccacgcgcgggtgctcaaagcaaatgaggccccatccttagcaaggaacctcagagttcatgaactttcgctgcagcgccgcggagggcctgcgcgccgccccgtggacgggctccggccggcggggaggacttggtggctggtgcctgcgggggcgggagggggcggaggagaaaggacggcttcctagggtcgcccgagtcgcgggaagcacgccgcgtacctttccttggcctccgcggcccggtctctttgcctccggttcttaaaccagttgctgacctgggtggtggtgaggccggtggcctcggccagctcccgcttctcacgcggcgatgggtagggattgtgcgcgtaccactcccgcaggacacccctcgacttctccttgaagcagtagctggtctcctcgccgtcccagatggtgcgcggcagtggaaattttcggcgcacccgatatttgcccacggcgcccaggggtcggccgcgcagcttctcggcctccacgtaatgcgccttcagccacagttgctgcagtttggggtggttgtgaggcgagaactggtggctctccaggatcttgtagagctcacggaagttgccgcggtggaaggcgaccaccgccttggccttgagtacgctctcgttcttgtgcaggtggtcgcaggcgggcagtgaccacaggaacctgcccaggcgctccaggtttccgccttgctgcagaacctcgcacacgcacgccacttgctcctgcgtaaagccaaacgacggcagcatcgacatggctggggcctgccggggcgcacggcccaggcgcacgcggcagggagcagagccgagaggcagggggcggcggccgcagggaggggggcgcggctgttcctaacctcctccttaggctttgcaaaggcgaaaaccggagtcg

SEQ ID NO: 35362 - DNA, 122 bp, Homo sapiens
  misc_feature 1..122: note = chr14:61116488-61116610
  misc_feature 1..122: note = hyper
  source 1..122: mol_type = genomic DNA
gtcaggaccctgcaacgcgggacccgtcgccagtatcacctaaggggagtcgcgcacaactccgcacaaatcaatgactccaaaccttaattcctcccctctccctccgtactcttgtcctc

SEQ ID NO: 35363 - DNA, 153 bp, Homo sapiens
  misc_feature 1..153: note = chr14:61116875-61117028
  misc_feature 1..153: note = hyper
  source 1..153: mol_type = genomic DNA
ctcccagtcggacagcgtttccctcgttcacaaaagacctccatgatttgagaccaggcagagagctgtttagagcatacttgctgagcacctagagactccgagcgttcatttgtgatttggtatcttaatgttctgcgattgaaaccagca

SEQ ID NO: 35364 - DNA, 358 bp, Homo sapiens
  misc_feature 1..358: note = chr14:61118778-61119136
  misc_feature 1..358: note = hyper
  source 1..358: mol_type = genomic DNA
aggccgtgactgggccggccaacatttttcctcccgcttaatccaatagatcgcgtaactggaaagggaaagtgctatgcgctttataccaaggagtctacctgctatttcgatccctcggttaggggaaccaattgttataaatgttaattattggctcggatatataaggtttcccaaaatggaacctttcactgaaaaccgctgaaagaggtaaaatgacatgaatttacaaaccacctaaactaaatgatccattttaaatcgcacacagaaaggtttgagttgttctcgtaacataaaacctttgctgtcaatgcaaatcgcacgaaaagcagagatgcgttggagatttaaa

SEQ ID NO: 35365 - DNA, 70 bp, Homo sapiens
  misc_feature 1..70: note = chr14:61124556-61124626
  misc_feature 1..70: note = hyper
  source 1..70: mol_type = genomic DNA
ccccagccagtcattcgcgttgaagcgccgcagcaagtggcaatgcttttggccgcgcattgcccaggaa

SEQ ID NO: 35366 - DNA, 155 bp, Homo sapiens
  misc_feature 1..155: note = chr14:61188472-61188627
  misc_feature 1..155: note = hyper
  source 1..155: mol_type = genomic DNA
tctgccccggccctgcggattccgttggtttccgagcgcgggatccgcggcctctagtgggcgcagggcaggtggctcggcgtaaccaaagcgccttctctggacctctccgcatatctgcggaaggcgcacgcacatcccggtgcaccttttgt

SEQ ID NO: 35367 - DNA, 50 bp, Homo sapiens
  misc_feature 1..50: note = chr14:61655782-61655832
  misc_feature 1..50: note = hyper
  source 1..50: mol_type = genomic DNA
ggacagcactgggatcgaaagacgatctgctccttcggaagaaaacacag

SEQ ID NO: 35368 - DNA, 39 bp, Homo sapiens
  misc_feature 1..39: note = chr14:61748115-61748154
  misc_feature 1..39: note = hyper
  source 1..39: mol_type = genomic DNA
gagccgcacctcgcccgccccttccgaggtgagcaggtg

SEQ ID NO: 35369 - DNA, 42 bp, Homo sapiens
  misc_feature 1..42: note = chr14:61788181-61788223
  misc_feature 1..42: note = hyper
  source 1..42: mol_type = genomic DNA
cgggcactggcctcccgggggcttgcgcggggatccacccac

SEQ ID NO: 35370 - DNA, 483 bp, Homo sapiens
  misc_feature 1..483: note = chr14:61788722-61789205
  misc_feature 1..483: note = hyper
  source 1..483: mol_type = genomic DNA
ctcctgcacctgtcccgagggctggcctgagacgggactcccggttctcccgctgcgaagcagcgcggccccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacgcccctgggctacgaccacttcgtggccaactgcaccctgcagttccaggagctgctgcgcacgaccggcgcctcggacaccttcgagggttgggtgagtagcggtgaccccttccc

SEQ ID NO: 35371 - DNA, 154 bp, Homo sapiens; identical to SEQ ID NO: 4151
  misc_feature 1..154: note = chr14:62279322-62279476
  misc_feature 1..154: note = hyper
  source 1..154: mol_type = genomic DNA

SEQ ID NO: 35372 - DNA, 104 bp, Homo sapiens; identical to SEQ ID NO: 4152
  misc_feature 1..104: note = chr14:62279519-62279623
  misc_feature 1..104: note = hyper
  source 1..104: mol_type = genomic DNA

SEQ ID NO: 35373 - DNA, 229 bp, Homo sapiens; identical to SEQ ID NO: 4153
  misc_feature 1..229: note = chr14:62279624-62279853
  misc_feature 1..229: note = hyper
  source 1..229: mol_type = genomic DNA

SEQ ID NO: 35374 - DNA, 82 bp, Homo sapiens
  misc_feature 1..82: note = chr14:62279898-62279980
  misc_feature 1..82: note = hyper
  source 1..82: mol_type = genomic DNA
cgagttctgggtcgggtttgtgcgtctgccttttggggatcagggtggcttgcatggctcggctgcccggtggcccacgggc

SEQ ID NO: 35375 - DNA, 156 bp, Homo sapiens
  misc_feature 1..156: note = chr14:62583714-62583870
  misc_feature 1..156: note = hyper
  source 1..156: mol_type = genomic DNA
ccctctccccaaacccgacctccgtaggggacaccgagccaaggcctgcagcgagtgacctgcccggggaggcgcgggaccgaggctcacctacccgggcccgcgagtctcgcccagccccagcctcccaacccactctgccggccccaacttagg

SEQ ID NO: 35376 - DNA, 360 bp, Homo sapiens
  misc_feature 1..360: note = chr14:62583918-62584278
  misc_feature 1..360: note = hyper
  source 1..360: mol_type = genomic DNA
cggcgttccagctctcaaccttgctcccagcagcccccgccggcgcactcgacctacaggaaagttgctcccgagctgtggaggggcgtcatcgcctcctagcaacgctcctagcaaccgggtaacatctgctccctgtggtccaatgcgagctgagaacagctgcgcgcccgcctagcgctgcgaacccggagtgagaggcgcttcagagactggagggacggacctgcaggagccagggctgcccgccgagctgcagttgccgctactgccgctgtcagcgcccgactgaagagtgacagccgcaaaagcaggagtgagcaccgaaccccgcgcttctacctaacaggtgcatgcgcc

SEQ ID NO: 35377 - DNA, 13 bp, Homo sapiens
  misc_feature 1..13: note = chr14:62584279-62584292
  misc_feature 1..13: note = hyper
  source 1..13: mol_type = genomic DNA
atctggtgagtgg

SEQ ID NO: 35378 - DNA, 151 bp, Homo sapiens
  misc_feature 1..151: note = chr14:63511856-63512007
  misc_feature 1..151: note = hyper
  source 1..151: mol_type = genomic DNA
caaaaatgtgttctgcggtgccaccagccctctcttgccccccggcatcctgggtctggagagcagcggccaggatccgcggcgggggagggggggatgcaggcaaagaaggtggaggaagaggaggaaaaggtggaagagaagattgagc

SEQ ID NO: 35379 - DNA, 646 bp, Homo sapiens; identical to SEQ ID NO: 4156
  misc_feature 1..646: note = chr14:63512063-63512709
  misc_feature 1..646: note = hyper
  source 1..646: mol_type = genomic DNA

SEQ ID NO: 35380 - DNA, 414 bp, Homo sapiens
  misc_feature 1..414: note = chr14:63512740-63513154
  misc_feature 1..414: note = hyper
  source 1..414: mol_type = genomic DNA
cgctgctaccgcccccctccgggctccggcgcctgaaaccttcctgaacactggcgctttccgcaccgcccttaccccaccccggagcgggagcgcgagccctgaagtccgagcgcacagccggcgcccggaatggcccctgcgacccgggccgggcttggcgtctgggggagcgtgcggccgcccaggggagtttcccccaggaccgctgagcgcaggaggcgatccgcgagcccgccaccgctgcaaagttgcgggaaaggttgcacttgatgtgaagagtaggggaagagggtgaataattcacacccgagagagggggagtgaggagggcagtgttagcgatggaaaaacggtaaaggctgtgggggcgaagatgcgccagggtggagcagggcacgaatcacctctaac

SEQ ID NO: 35381 - DNA, 30 bp, Homo sapiens
  misc_feature 1..30: note = chr14:63670862-63670892
  misc_feature 1..30: note = hyper
  source 1..30: mol_type = genomic DNA
gcaggcagtaatccccgctttccatcctct

SEQ ID NO: 35382 - DNA, 30 bp, Homo sapiens
  misc_feature 1..30: note = chr14:64760774-64760804
  misc_feature 1..30: note = hyper
  source 1..30: mol_type = genomic DNA
gccttctctaaaatgcggacacgtgctttt

SEQ ID NO: 35383 - DNA, 66 bp, Homo sapiens; identical to SEQ ID NO: 11941
  misc_feature 1..66: note = chr14:64761073-64761139
  misc_feature 1..66: note = hyper
  source 1..66: mol_type = genomic DNA

SEQ ID NO: 35384 - DNA, 226 bp, Homo sapiens
  misc_feature 1..226: note = chr14:65007311-65007537
  misc_feature 1..226: note = hyper
  source 1..226: mol_type = genomic DNA
aaatctgttgggtcacgggccagtcactccgacctaggcaagcctgtggtggagctggaagagtttgtgagggcggtcccgggagcggattgggtctgggagttcccagaggcggctataagaaccgggaactgggcgcggggagctgagttgctggtagtgcccgtggtgcttggttcgaggtggccgttagttgactccgcggagttcatctccctggttttcc

SEQ ID NO: 35385 - DNA, 39 bp, Homo sapiens
  misc_feature 1..39: note = chr14:65007552-65007591
  misc_feature 1..39: note = hyper
  source 1..39: mol_type = genomic DNA
cgcctttcagtcaggatgtctgcccgtggcccggctatc

SEQ ID NO: 35386 - DNA, 258 bp, Homo sapiens
  misc_feature 1..258: note = chr14:65008997-65009255
  misc_feature 1..258: note = hyper
  source 1..258: mol_type = genomic DNA
cgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgagggg

SEQ ID NO: 35387 - DNA, 315 bp, Homo sapiens
  misc_feature 1..315: note = chr14:65016501-65016816
  misc_feature 1..315: note = hyper
  source 1..315: mol_type = genomic DNA
atggataggccaatacgtcgccacggcttttaagactgggaaacggggcaccaggctgggctttagaaatcgctggagaagcctgggtgcggccgcagcccgcgcggcctaggacggaagcgacgccccgccccgctccgcgccccgggcagccgtgtgcaggcgcctgcgggcggtatcctcggcgacgccgtatggcttccagggcgaggccatgtaccgggtgcccgagttttatgcgaggaggaagcggttaggtgggcagaccccttacttgatggatgtaagtgcagccttggtcgcccccatacccgg

SEQ ID NO: 35388 - DNA, 30 bp, Homo sapiens
  misc_feature 1..30: note = chr14:65170683-65170713
  misc_feature 1..30: note = hyper
  source 1..30: mol_type = genomic DNA
aaaagcggacacggccggctctggtaggat

SEQ ID NO: 35389 - DNA, 52 bp, Homo sapiens
  misc_feature 1..52: note = chr14:65170984-65171036
  misc_feature 1..52: note = hyper
  source 1..52: mol_type = genomic DNA
accccggctctggctcgccgcgccgcgaaggttgccccggcccccgcagagc

SEQ ID NO: 35390 - DNA, 38 bp, Homo sapiens
  misc_feature 1..38: note = chr14:65345951-65345989
  misc_feature 1..38: note = hyper
  source 1..38: mol_type = genomic DNA
gtggctcccagcacccggaggcccggccccctctgctg

SEQ ID NO: 35391 - DNA, 30 bp, Homo sapiens
  misc_feature 1..30: note = chr14:67878885-67878915
  misc_feature 1..30: note = hyper
  source 1..30: mol_type = genomic DNA
tccgacgcggcagggcgacgcctccctggc

SEQ ID NO: 35392 - DNA, 308 bp, Homo sapiens
  misc_feature 1..308: note = chr14:69726355-69726663
  misc_feature 1..308: note = hyper
  source 1..308: mol_type = genomic DNA
ctcaggactctcccccgcccagccgcccctacacaaggactcgccgaacacaccttgaatcccgcgccagagcgcagcccggaactgcagctcgcggcgcgggcccaggtcgggggtcgcgcgtctccagtcggtgactcaaggccgctcggtccgggggtgggtgtgggtcggcaggaccgaccagggccgcgcgggggcagctgccgggcgttcggtcacctagcggtgggagccgaggctggctttggccagtcgccattccgccgcgggcgtctgtctcgccgggttcccgggcgcgggaggaa

SEQ ID NO: 35393 - DNA, 521 bp, Homo sapiens
  misc_feature 1..521: note = chr14:69727096-69727617
  misc_feature 1..521: note = hyper
  source 1..521: mol_type = genomic DNA
ccacgcagcatcctccggcggccggggcgcgcagagggcaggcaggaggtcggagcagctccgcgaggaccgcaccatcccgctcattgtgagtacgccccgagcgtcggccggccggctagggagccgcggcgcgcgtccagaccctgcgcggcggccgagggcgcggggcccggccagggctgagtgcccgctgcgccgggccggctttgtatatgttggagcattcctgcccgttgttatggcaacctctgccgggcggcggggctggggcgcaccgactaagggagggtgacagagggtgggggctgggagaaagtgctgcaagtttggtgggcccggcgtgcgcgcgcggctgggaacgtggcggctctcccggctctgcgctgccggggccgggagtctgggggctgcgggagcctcgtgtgccccggaaggctgccgggcccagcgcgcggcgagcgggcggtgggaaccactcgcagccgagcgcgtaggtggcagtgcgcagcccctctcca

SEQ ID NO: 35394 - DNA, 81 bp, Homo sapiens
  misc_feature 1..81: note = chr14:69727831-69727912
  misc_feature 1..81: note = hyper
  source 1..81: mol_type = genomic DNA
ggtgggcagtgtcagcgcccgaacttggcgatacccttgcatgaagtcagcctcgcgacatctaagcgggcagggaaacaa

SEQ ID NO: 35395 - DNA, 58 bp, Homo sapiens
  misc_feature 1..58: note = chr14:69950779-69950837
  misc_feature 1..58: note = hyper
  source 1..58: mol_type = genomic DNA
ccaggaagagaaatccgatccgatgcgcgctaggcggcggcggcggagcacagtgaaa

SEQ ID NO: 35396 - DNA, 30 bp, Homo sapiens
  misc_feature 1..30: note = chr14:69951121-69951151
  misc_feature 1..30: note = hyper
  source 1..30: mol_type = genomic DNA
agcggacgtggccctcgtctcgatgtcggc

SEQ ID NO: 35397 - DNA, 324 bp, Homo sapiens
  misc_feature 1..324: note = chr14:70014623-70014947
  misc_feature 1..324: note = hyper
  source 1..324: mol_type = genomic DNA
agggtgggcgagacacggccgccttccttcacatccaacgccggtgaggctcagcactcattgtctcactggcagcacagacaaagccttgcgggctccacgggataatcaacagcgagaacgcccccagggacctccggaaagagacaccattggttgcaggcctccaggttctcgtctgcctggtgagtgaggtggcacgcagcgtcagtcgtctgcaggaatttgtgctggggtaaatgcgcgcttcgtgcagaccgcagagctggaggcggagggctggggtccctgggccgcgggcgggttccgcgtgcccctccctcg

SEQ ID NO: 35398 - DNA, 510 bp, Homo sapiens; identical to SEQ ID NO: 11948
  misc_feature 1..510: note = chr14:70346020-70346530
  misc_feature 1..510: note = hyper
  source 1..510: mol_type = genomic DNA

SEQ ID NO: 35399 - DNA, 40 bp, Homo sapiens
  misc_feature 1..40: note = chr14:70346833-70346873
  misc_feature 1..40: note = hyper
  source 1..40: mol_type = genomic DNA
ttccctgtggtctcacgctggcgcccggtccagcgcgctg

SEQ ID NO: 35400 - DNA, 147 bp, Homo sapiens
  misc_feature 1..147: note = chr14:70653698-70653845
  misc_feature 1..147: note = hyper
  source 1..147: mol_type = genomic DNA
gccgctgcaagtcaccgggtcgccaggggccgaggaggcttcccttttggtgccccaccggaaggccggatgtgttcctatcacgtacccacattccacccccgctcaactccctcctccccccacccccttcgggtgtttcttgac

SEQ ID NO: 35401 - DNA, 227 bp, Homo sapiens
  misc_feature 1..227: note = chr14:70654063-70654290
  misc_feature 1..227: note = hyper
  source 1..227: mol_type = genomic DNA
gagagaaggaagctgcgatgagcgggtaaatttatggtactgcattaaaggcatttcttctatttaaccccaccccgccaccaccaccactaccacaccgttaaaaataaaatacaatgaattaagacgaagaactgcttttttccccggagcaaattgctttcatcatctttcccagtggctcgggtcctctgggcaggtcagccagggcctgtaggagcagcagc

SEQ ID NO: 35402 - DNA, 42 bp, Homo sapiens
  misc_feature 1..42: note = chr14:70654291-70654333
  misc_feature 1..42: note = hyper
  source 1..42: mol_type = genomic DNA
ctagcctctgaatcagggctttgactgtgtgtgtgtgtgtgt

SEQ ID NO: 35403 - DNA, 204 bp, Homo sapiens
  misc_feature 1..204: note = chr14:70654393-70654597
  misc_feature 1..204: note = hyper
  source 1..204: mol_type = genomic DNA
ttagttatatatttcgattctctccaccgagtcccggatcacgcagaccaccaggggctggagagtgcagcactggagaaaccctccttctccctcgcccccttggccccagcggtgggtgctctggggctgcagctcccgacccgcggcggtggagtcccgagattggggtgagcgcgtgcgtgcgtatgtgcacgcgggcgc

SEQ ID NO: 35404 - DNA, 41 bp, Homo sapiens; identical to SEQ ID NO: 1186
  misc_feature 1..41: note = chr14:70654598-70654639
  misc_feature 1..41: note = hyper
  source 1..41: mol_type = genomic DNA

SEQ ID NO: 35405 - DNA, 147 bp, Homo sapiens; identical to SEQ ID NO: 1187
  misc_feature 1..147: note = chr14:70654640-70654787
  misc_feature 1..147: note = hyper
  source 1..147: mol_type = genomic DNA

SEQ ID NO: 35406 - DNA, 858 bp, Homo sapiens; identical to SEQ ID NO: 4164
  misc_feature 1..858: note = chr14:70655032-70655890
  misc_feature 1..858: note = hyper
  source 1..858: mol_type = genomic DNA

SEQ ID NO: 35407 - DNA, 211 bp, Homo sapiens
  misc_feature 1..211: note = chr14:70655919-70656130
  misc_feature 1..211: note = hyper
  source 1..211: mol_type = genomic DNA
cgaattcagatccaacccctgccccgcggccacccaccctagtcgttggagcctggcgcccgcgcctcccggccggcagcacgtcaaaacggcggcgcgtcctgacctggattccgccgagttgggagctccaggcagcaggcgggcgcgcggcaccggctttccccttgtcctcaggagacgctgcctgcaattccgaaattaagtctcc

SEQ ID NO: 35408 - DNA, 602 bp, Homo sapiens
  misc_feature 1..602: note = chr14:72398631-72399233
  misc_feature 1..602: note = hyper
  source 1..602: mol_type = genomic DNA
aatacataaaaatgacgaggttaggaacaatatcgctgacggtcgcggtgtcccgttttaatttagagggcgccagcaacacgtcagtgagggagattcagaagccgccgggcacctcaccccgggccgggaatccctaagagaaccttgacgccgctgaagtttccggaccgggccagtttggaattgacgaaagcagcctccgcccggtcgagccagtctctcggttttctcggcggcttcttgaggatgaggcatttctaggttttctcctcctcgagcaaatcacggtctgcgccttccgcggctctgggaacaggtgagccgtgcggcggcgcccgcgggacgcgctcaggtgccggtccccgcccgccggcccctccctgcagcacgcggtccgggcccaggtgccggggcccaggtgccggcgcccaggtgcgcggggcacggggctgcagctccgctcggcatccgacagcgggcgccgctgcagcagctcgcgggccgcggagctgaacggcttcgcgagttggggcagctcctcgcgctcggccctgctcggcggcgagagctccgcctgggcgccgcgttcctacagccgc

SEQ ID NO: 35409 - skipped

SEQ ID NO: 35410 - DNA, 459 bp, Homo sapiens
  misc_feature 1..459: note = chr14:72399780-72400239
  misc_feature 1..459: note = hyper
  source 1..459: mol_type = genomic DNA
tgtccatttcagatgcgtgacaggtgcccgtgtgtgtgtgtctgcagtttgggactgtggaagcacgagcttacataagtggttaggcaagctggcgtgtggacttgtgtgggatgggtgcaggtctgcatataaatcatgttcctgggtttctgggtgtgaagcgcacaccgacggggacgagagcgcagaggatggcgcttttagatacttccagtcttccgatgttgtgatcgcaggtagggcagctttgcctctaatcaggcgttcattaactttttccctgaacaagctcgcccatttgtggtttggaagaaaagaaagcgagtctccgcggtgaggtgtggagggcaggggcgggtggggaggtttgttgtttgggaactgcgctagcaaaggaagcggtggctattcgcttggagaggatgacaaatgaactggttgcgtgaggagtgaaga

SEQ ID NO: 35411 - DNA, 76 bp, Homo sapiens
  misc_feature 1..76: note = chr14:73358964-73359040
  misc_feature 1..76: note = hyper
  source 1..76: mol_type = genomic DNA
tagaaacagcatcagcggtgttgcagcgaaagcaaccggcagcgaggatgcggcgaagttacgcccatttattctg

SEQ ID NO: 35412 - DNA, 88 bp, Homo sapiens
  misc_feature 1..88: note = chr14:74208209-74208297
  misc_feature 1..88: note = hyper
  source 1..88: mol_type = genomic DNA
gttagcaaccccagccgctcccaggaaaccagccagcagcagcggagggcagggctgggcgggcacagggtcccgactatacccagtt

SEQ ID NO: 35413 - DNA, 176 bp, Homo sapiens
  misc_feature 1..176: note = chr14:74254402-74254578
  misc_feature 1..176: note = hyper
  source 1..176: mol_type = genomic DNA
gggtccctgtccccacgttctctctaaaagtctgcatgatgtccctcgtcatttctacgggttataagtgagcaagacgtttaccacgtatcacacttctgggggctatttcaacgcccaagctggggctgcagaatggtttctgttctaatcctcccccgcgatttccacctctt

SEQ ID NO: 35414 - DNA, 351 bp, Homo sapiens; identical to SEQ ID NO: 1188
  misc_feature 1..351: note = chr14:74706046-74706397
  misc_feature 1..351: note = hyper
  source 1..351: mol_type = genomic DNA

SEQ ID NO: 35415 - DNA, 605 bp, Homo sapiens; identical to SEQ ID NO: 1189
  misc_feature 1..605: note = chr14:74706940-74707545
  misc_feature 1..605: note = hyper
  source 1..605: mol_type = genomic DNA

SEQ ID NO: 35416 - DNA, 176 bp, Homo sapiens; identical to SEQ ID NO: 1190
  misc_feature 1..176: note = chr14:74707572-74707748
  misc_feature 1..176: note = hyper
  source 1..176: mol_type = genomic DNA

SEQ ID NO: 35417 - DNA, 120 bp, Homo sapiens; identical to SEQ ID NO: 1191
  misc_feature 1..120: note = chr14:74707791-74707911
  misc_feature 1..120: note = hyper
  source 1..120: mol_type = genomic DNA

SEQ ID NO: 35418 - DNA, 464 bp, Homo sapiens
  misc_feature 1..464: note = chr14:74707912-74708376
  misc_feature 1..464: note = hyper
  source 1..464: mol_type = genomic DNA
aaaaatgtccaaatctgctttaaaccagaccaagaaacggaagaagcggcgacacaggtgaggcccccgctttctgttacctctcctgcccgcgcaccccgctgccgtcccccgttccgggatcgggtctctcggaccctattttcgccgacaacggatctgaggtccgaggccgtgccagggcgcagaccacgggttgtttggcggaatctgcccgggggccttggcgtcggcaccggttgagcaggatgagtggccgccgggaaagcggcccggttcgggctttctcctccttgttcaggagaaaggaaaggctccaacacaggccaaactgagccacagagtgggggcggtccccagatccccgcaccagtacattctgagagccacacagacccggcggcgggcagattagctcccacctcctgccagagccggttctttgccctcggcctcaaccgccg

SEQ ID NO: 35419 - DNA, 318 bp, Homo sapiens
  misc_feature 1..318: note = chr14:74708774-74709092
  misc_feature 1..318: note = hyper
  source 1..318: mol_type = genomic DNA
cccttccgcaccagccgcactgctaccagttccttgggtacatttgtaaggtggttttcaaggaaataaaggagaaagaaccaaaaatctgcctgcctttctgcgggtgctgctcgcaggtgctgccccggcgctcacctcggagctatttccccgcaccccactccgtccccatcaggtggggccgccacagactctgcgccctttcaagacatttctccactagggcgttctctggcacccccgccgccacatcgttttctcccaccctaatttgttttcagcctctttgcaccctctctgcgcttttctatgctt

SEQ ID NO: 35420 - DNA, 30 bp, Homo sapiens
  misc_feature 1..30: note = chr14:74725251-74725281
  misc_feature 1..30: note = hyper
  source 1..30: mol_type = genomic DNA
aaggactgtgaggggcgagaagggaaccgc

SEQ ID NO: 35421 - DNA, 182 bp, Homo sapiens
  misc_feature 1..182: note = chr14:74892589-74892771
  misc_feature 1..182: note = hyper
  source 1..182: mol_type = genomic DNA
gcggcgcccccagaccgccccttacctgtcccgccgcggacggtcccgcctcctccgcggggctcgggggctcggcatgggccggtgagcgacggcgcccccgcctcgcggtcgcggtggaactcccaggagggctcccctgctctcgtccccgcgtccctgagcagccgccgcttcagcac

SEQ ID NO: 35422 - DNA, 18 bp, Homo sapiens
  misc_feature 1..18: note = chr14:74892798-74892816
  misc_feature 1..18: note = hyper
  source 1..18: mol_type = genomic DNA
cgccgccgcccgccccgc

SEQ ID NO: 35423 - DNA, 56 bp, Homo sapiens
  misc_feature 1..56: note = chr14:74893057-74893113
  misc_feature 1..56: note = hyper
  source 1..56: mol_type = genomic DNA
gaagtcgggggagcccggaggaggcggcgaagcgaggggcgcgcagctggaacccg

SEQ ID NO: 35424 - DNA, 348 bp, Homo sapiens
  misc_feature 1..348: note = chr14:75077895-75078243
  misc_feature 1..348: note = hyper
  source 1..348: mol_type = genomic DNA
tgcgaaaggatttaacgtcggggctccgggagagttggtaagaaaggatgaggatgatgatctatctgccttcaactcttcgaaagcggatcaaatcttccaatcccgattttggaacctcggggctgtttcccgaagtactaaagacagagggacgagggtatgagagcggcgccctctcctctcgcctgcacgcccctccacaaatgagccctggctcccctctgtaccctccaaacttccctctcccatgctcaccccgtgagccgccctcgcggcggggttgggggcgcagccccagaccgctgtggggtccccaggcgtgggagagccggcgcggcccgggtc

SEQ ID NO: 35425 - DNA, 247 bp, Homo sapiens
  misc_feature 1..247: note = chr14:75078651-75078898
  misc_feature 1..247: note = hyper
  source 1..247: mol_type = genomic DNA
cggggcggctggagagtggtgcgcgcgggcaccgcgaagagctttgtggtcggcacgctggacgcccgcgggctgttctcccggccccgcccggcggccagcttctctgagtctagggggccctgaagcggccgactgggggcccggctctcggcggaacgagggctgcgcgccccgagcctcgagtccgcgctcctactccagctgggctcgcacggctgctgcaccttcgcgcctcctccctgtg

SEQ ID NO: 35426 - DNA, 230 bp, Homo sapiens
  misc_feature 1..230: note = chr14:76604575-76604805
  misc_feature 1..230: note = hyper
  source 1..230: mol_type = genomic DNA
tagagagattcagcccggacaatcagggttggcttcacggaggagggggtatctgagctgagctttgatgaatacgtcagatttgggggaaaggttgctgctggatagcggggcaggaagaacgagcgtatctagttgtaatgccaacaggtcagggggggaaagttggggaatggggtgggaggaggaagaattagactggccccttccatcatcgccatccttctgtg

SEQ ID NO: 35427 - DNA, 425 bp, Homo sapiens
  misc_feature 1..425: note = chr14:76605040-76605465
  misc_feature 1..425: note = hyper
  source 1..425: mol_type = genomic DNA
caagaaaaaagggagcgcagcgccgttcccacttgttagattgaaggcgcctctccagaggggggaaggctccaaattgctaattagcgcctgtgaaaaggcctagctctgatatgcgcgccgctgaaaggccgacgttaatgaagccgcggcgcgcccgcttccctttgactggccttcatccctcctccgcgccccgggccggcccgaacaatgcggcggggagcgcaggctcccccaggcctcgccgggacggcccgggcagcgcgcgcggggggcggcgcggcgccggcgaaatgtggagggggagataaggccgagcgcagggaagaggctcactcccaggggcccagggaaaatttgcagttattatgaaggagatgagacagattaaaagcccttgtgttcgccgctttgccccttta

SEQ ID NO: 35428 - DNA, 109 bp, Homo sapiens
  misc_feature 1..109: note = chr14:76795936-76796045
  misc_feature 1..109: note = hyper
  source 1..109: mol_type = genomic DNA
gctgtattaaatcaccgaggtgcccatgtagcgcgggctctcttttctcctctcaactccccccaccacccttgtgggcacacacagacccgggcgcacactcacatgc

SEQ ID NO: 35429 - DNA, 92 bp, Homo sapiens; identical to SEQ ID NO: 11971
  misc_feature 1..92: note = chr14:76819300-76819392
  misc_feature 1..92: note = hyper
  source 1..92: mol_type = genomic DNA

SEQ ID NO: 35430 - DNA, 84 bp, Homo sapiens
  misc_feature 1..84: note = chr14:76842636-76842720
  misc_feature 1..84: note = hyper
  source 1..84: mol_type = genomic DNA
tcactgtgccctgcccgggctcgcaccttgcccgtgcccttcactcgctcttccgcgtgatttccccgccgtctttctctacca

SEQ ID NO: 35431 - DNA, 202 bp, Homo sapiens
  misc_feature 1..202: note = chr14:76843184-76843386
  misc_feature 1..202: note = hyper
  source 1..202: mol_type = genomic DNA
agagaaagcctttcccgcgggcgctttgttttattatttccatcctggggaccaaaaatgatcccggcaagagagagaaaatcgaacgtgccgcggcggtttggaaactgcaggcggccagtgccgctctcgcctcgcggtctccgtggggcgccccgagggtgcgcacgtggcgcggcggatccagggcgcccgggggatg

SEQ ID NO: 35432 - DNA, 262 bp, Homo sapiens; identical to SEQ ID NO: 11972
  misc_feature 1..262: note = chr14:76843732-76843994
  misc_feature 1..262: note = hyper
  source 1..262: mol_type = genomic DNA

SEQ ID NO: 35433 - DNA, 187 bp, Homo sapiens
  misc_feature 1..187: note = chr14:77227599-77227786
  misc_feature 1..187: note = hyper
  source 1..187: mol_type = genomic DNA
tctccatggagtttgcgctccctctggcacgttgaaaacgtcctccgcagcttcgcaccggcttcgcggcgccctgacagctgggtgaggagggagcgaatgcccaccggcgtccttggggtaacttgggacagaggcaccgccgcggggggcggaggactgggcgcgaaggcgctggccctttaag

SEQ ID NO: 35434 - DNA, 239 bp, Homo sapiens
  misc_feature 1..239: note = chr14:77228556-77228795
  misc_feature 1..239: note = hyper
  source 1..239: mol_type = genomic DNA
ctcccggacttgtctcgtcgcgtcggagaaatcgccccccagcgccgctctcccgcccgggggtcttggttccgagctcgcgcggccgggagtcgcctcggtcttccttggggcgcgcgcagatgtgagcgtgcgagagttgtgtaggggattttgttccctccgaaactgagacccagggcgcccagtgggcacccgtgccttgactctgtcctttctgcagccgctggtccgagctg

SEQ ID NO: 35435 - DNA, 308 bp, Homo sapiens
  misc_feature 1..308: note = chr14:77591237-77591545
  misc_feature 1..308: note = hyper
  source 1..308: mol_type = genomic DNA
gcccactcatcaggccgattctcctcaccttacgcttagatgagtttcgagtaagaccactgctggcatcaagagtctgggcccatgatctcgccctttcgggctaggcgaggcagacccaggttggctgcggcccgcggtccccgcgcagccaacactggcagccaagcgcggggcgcgcgcgccgggagagtggagcgcggaggcccgacggcgccccctcccggcgggcccgagccacggccgcgggctctggcgggtgccggggaggccacgcgcgacggcgtcgcagccggagcccagacaga

SEQ ID NO: 35436 - DNA, 104 bp, Homo sapiens
  misc_feature 1..104: note = chr14:77600264-77600368
  misc_feature 1..104: note = hyper
  source 1..104: mol_type = genomic DNA
cgaacatttcagaacccaggacagctcctgcagggcacggggaggggaaacaccagagccgctttacacccaggccaccggcataactgcgatctaggcaggct

SEQ ID NO: 35437 - DNA, 87 bp, Homo sapiens
  misc_feature 1..87: note = chr14:77606262-77606349
  misc_feature 1..87: note = hyper
  source 1..87: mol_type = genomic DNA
ccagagacccgagcccgcagcggcctcgggtctaggccccacctgggggtgagtgttgcctggggttttgagcgagctcggcgcctt

SEQ ID NO: 35438 - DNA, 99 bp, Homo sapiens
  misc_feature 1..99: note = chr14:77606757-77606856
  misc_feature 1..99: note = hyper
  source 1..99: mol_type = genomic DNA
gtatgtatatatctgcgtgtacagacacgcagcctctgctatctagctttaaaaaaatcaattgaaacaatcgatacactcacactcgctctcgggcac

SEQ ID NO: 35439 - DNA, 1396 bp, Homo sapiens
  misc_feature 1..1396: note = chr14:77606921-77608317
  misc_feature 1..1396: note = hyper
  source 1..1396: mol_type = genomic DNA
cgctggctgcccgggctatttctttgcgaagagcgttttcatttgaggcgaaattaaaatccccccttcgcgcccgcctcccgccctcctgctgagagaaacccaaacaaccctcatggcgccgaaatcctttccatgccgacaagcccgccctgggcgcacgagtggatgcttggccagcctttcctgggatcgaccccgccgccgtgctcagccctcaccacgtccccatcccaccccacgcctcacagccggggttcctggccagcttcggaagccaccgagaaataggattccgtgcgcccgagagaacttttccaggggctaaggaatcggccagccggaggcgcgagaaaagttctgggaaggcggttgcacctaggatgggtggatgccacggggcctccgtccaggctgtcccgtccgcacgggtcgactggtcaccttggaatcccctttgcaggtcccagcgccccccgggaacccgcagcctccgcggagagcgtgggcctctccctaccgctggggcgcagcgcagtgcacgcctgagggtggtcgccgggggctgggcacgcccccagtcctgcgccgccgggggctgcggcggtgctgcccaccccagagagccctcggcctggggctccggcgaagcaagtgccttcccggcgccggtcgccaggggggcgcgggagcagccagatgcgccgcagcgctgggaaggcggcgaaggacaggggctaggggagtgaggggcgctcggcaggcagcctcagccctggccctgcgcgggagaagggacagcagagaccgcccgtggggccccggggtgtagggagctgtccgttcagccctggcgcccgcctcgcccgcggcagagggcggcacagccggagccttggaaagaccggcagcgccggcagccgcgggcttctcggccactgcctcccggacgcacgggaagccgccccccgcgccgccgccgccgcactgccgccgtcgcagaggggtgaggaaatcaactcaccgagctctggtcgccgacaagaggagccccggacgccggctctcgccctgcccgaggctgcaaagttgtggactcggcccggctggctcgcagcctgcgcttcgcttcgggaactgggcaagtagcggggatgtggggaggagggagcgggcagctgctggcttcccacttgggcgccagcgagtaagggccaggaagcggcggggatggcagctgggcaccccccagccccgccacccctccctccgctcctgggggcggtgctctggccgccagtctcagcatcgtggacttgccccctcctcccctctcgattccccttgagcgggctggggcgccctgcctggtttcagcgcccgttccagctgggag

SEQ ID NO: 35440 - DNA, 127 bp, Homo sapiens
  misc_feature 1..127: note = chr14:77737019-77737146
  misc_feature 1..127: note = hyper
  source 1..127: mol_type = genomic DNA
aggggctgtgccacccgtcgccgcgccccgctcctctggcgcacatctggcaggcgccccagcgccccggcagcggccagttttccctccttcggggccggtcctgccgcgtgacccctttcccgcc

SEQ ID NO: 35441 - DNA, 439 bp, Homo sapiens
  misc_feature 1..439: note = chr14:77737147-77737586
  misc_feature 1..439: note = hyper
  source 1..439: mol_type = genomic DNA
aggcagcctccacccgcatccccgggcgctcgtgtagccctcacctggcaaacaggacggtgccgtgctccagcgggctgcggctcactgcccgccagctctgccggatcagctcgggctccgggcgctccatgctgtcccggggacgcggagcgcggggctgggaccctcagggctcgggtgccgtcaccgcacgtgccgcgccatctcctccgcgacgcggtcccctccgcccctcgtacgccccccgtgcctccgcccggcgggggccgcagccgctccttccctggcgcgggagagaaaaggcgcgcggccagtcgtaggtggagacaccccagctgtgcttccggggaccccgcttggccgctgcgccctgcgccccgcagccgccagagccgccccaccccgcgacgcctgggctgggcgctttaaagccgcc

SEQ ID NO: 35442 - DNA, 549 bp, Homo sapiens
  misc_feature 1..549: note = chr14:77964498-77965047
  misc_feature 1..549: note = hyper
  source 1..549: mol_type = genomic DNA
gctggccacccctgccggcggctggagagccccactgtgcctccgcttgtctcatggaaggggctcacctgaccgtttgaacctcagcggccctggcccgccactccgcaaagcgccagattcctcgcaccggcgggactcctctccgagctagcgcgcacctggaaagggggctgcaggcgaggtccgctcagggcgaggaagcccggccaccgtggagtgtcggccacctcactccgcacagaagtcaaacttgtcacccggctggtccgcggcagcccggctcgcggtcacgcgcgaggagtggaagccccgaagtccggcgcacctgggcaacgcccggtgtccgggagcttccggccggccccggcccctctctccatcggggggtcgctgcctgtgtgtgtcccggtcccgctccccgcacggctggagccggcgggctggggaggtgggaccgacagcgcgctccgcagcccggtgccgccgccactcacctctgcgagcctcgtgaggctcccaggccgtggtccgcggagccgcggcttc

SEQ ID NO: 35443 - DNA, 190 bp, Homo sapiens
  misc_feature 1..190: note = chr14:77965493-77965683
  misc_feature 1..190: note = hyper
  source 1..190: mol_type = genomic DNA
cgggaagctgcggcccggcgcgctccggccctgcgctgcgactcctgcggggccctgagggtccgacgccacctctgccctccccgaccgcgctccaactgcgacctggaccggcggtgccgcgcgggcgagggaggcgcagcccgacgggagagtggcgcgagtcttcggatgccgggcagatgtttgg

SEQ ID NO: 35444 - DNA, 30 bp, Homo sapiens; identical to SEQ ID NO: 11983
  misc_feature 1..30: note = chr14:78624601-78624631
  misc_feature 1..30: note = hyper
  source 1..30: mol_type = genomic DNA

SEQ ID NO: 35445 - DNA, 30 bp, Homo sapiens
  misc_feature 1..30: note = chr14:79745212-79745242
  misc_feature 1..30: note = hyper
  source 1..30: mol_type = genomic DNA
ggtcgcccaagccaccgccaggcagggagg

SEQ ID NO: 35446 - DNA, 117 bp, Homo sapiens
  misc_feature 1..117: note = chr14:85996479-85996596
  misc_feature 1..117: note = hyper
  source 1..117: mol_type = genomic DNA
ttgtagttagttgtacgttcgaaacctgtcgccgtcacttgcgcgtttggcattatccattgtcaccgcggaggaacgagcgctcgagatatcatcagtgcccgcaaatctccgcgc

SEQ ID NO: 35447 - DNA, 36 bp, Homo sapiens
  misc_feature 1..36: note = chr14:85997566-85997602
  misc_feature 1..36: note = hyper
  source 1..36: mol_type = genomic DNA
gtgagttccttgagccgcttgcgtgggacgcaggga

SEQ ID NO: 35448 - DNA, 105 bp, Homo sapiens
  misc_feature 1..105: note = chr14:85997821-85997926
  misc_feature 1..105: note = hyper
  source 1..105: mol_type = genomic DNA
gttgcaagctgaggtcggggtactgacaacgggaatgaagccataggggaagaggataactgggacgggctggacccatacttgatacccgggaaactcctagag

SEQ ID NO: 35449 - DNA, 15 bp, Homo sapiens
  misc_feature 1..15: note = chr14:85998560-85998575
  misc_feature 1..15: note = hyper
  source 1..15: mol_type = genomic DNA
tagttttaaactctc

SEQ ID NO: 35450 - DNA, 54 bp, Homo sapiens
  misc_feature 1..54: note = chr14:85998629-85998683
  misc_feature 1..54: note = hyper
  source 1..54: mol_type = genomic DNA
cgggctcgttctccctcttctgttcagattcagcctcaccggacttgttacaac

SEQ ID NO: 35451 - DNA, 10 bp, Homo sapiens
  misc_feature 1..10: note = chr14:85999522-85999532
  misc_feature 1..10: note = hyper
  source 1..10: mol_type = genomic DNA
gctccaggag

SEQ ID NO: 35452 - DNA, 134 bp, Homo sapiens
  misc_feature 1..134: note = chr14:85999596-85999730
  misc_feature 1..134: note = hyper
  source 1..134: mol_type = genomic DNA
cgcgaattcattactgtaaacatatccgggggtgtcaggaggggtaggggtgggggccgcggcgcctacattagcccggccgcgtcggattgaggcagtagtgtggtctgagcagcctccagacccacgccggg

SEQ ID NO: 35453 - DNA, 59 bp, Homo sapiens
  misc_feature 1..59: note = chr14:85999838-85999897
  misc_feature 1..59: note = hyper
  source 1..59: mol_type = genomic DNA
cgccgagtcccgggatcctccaaatccgaggagctccggcgccgcggggcagctttctg

SEQ ID NO: 35454 - DNA, 35 bp, Homo sapiens
  misc_feature 1..35: note = chr14:86000128-86000163
  misc_feature 1..35: note = hyper
  source 1..35: mol_type = genomic DNA
cgctgcggggaggcgcgcgccgctctgaggctccg

SEQ ID NO: 35455 - DNA, 91 bp, Homo sapiens
  misc_feature 1..91: note = chr14:86000400-86000491
  misc_feature 1..91: note = hyper
  source 1..91: mol_type = genomic DNA
gcccttcctggccctcgcgggtctggcagaaagtaagagggaggcgaagttcaagatcccggggatgagcaccgagcgctggcagatcact

SEQ ID NO: 35456 - DNA, 262 bp, Homo sapiens
  misc_feature 1..262: note = chr14:88789384-88789646
  misc_feature 1..262: note = hyper
  source 1..262: mol_type = genomic DNA
aagaaaaagtaagatcggcgaggggtggatgaaaggatggagaggaaggcttggggagatggaagagccaagctgcttcccaaaagcggtgccggcaggttaggggctgcgcagcctgaaggctggggctacggagaagcccactgcagtgtcactccagcccccgaaggcgtgtgcgcacacactcccgcacacacacacccgcacacacactcccgggcgcgcgcttgggcgggcacgtcagcctcgctcggccgcgctg

SEQ ID NO: 35457 - DNA, 171 bp, Homo sapiens
  misc_feature 1..171: note = chr14:88790076-88790247
  misc_feature 1..171: note = hyper
  source 1..171: mol_type = genomic DNA
aggcgctgcaggaggcggaggaagggccgctgcggctccgccgcagacctcggcctccgggtcacctcttctcaccgctctcaccctgagctctccctccttctcttttctcacttcattttttttcctcccgcgtctggctctctcgcctgagtcccgaacccacgtccc

SEQ ID NO: 35458 - DNA, 236 bp, Homo sapiens
  misc_feature 1..236: note = chr14:88790298-88790534
  misc_feature 1..236: note = hyper
  source 1..236: mol_type = genomic DNA
cgctccgcatctgctgcgctctccccgcccggggaagctcgctcccaaggcacagcttggtcccttccccagctacctgcagccggactggggccgctggtcgttggctggaaaggaggcttgagagaggcacgggggcccccggaggaaagcggagttgccaagacccggcagctcccggaagcggcggccccgggatcctgggaccagcagggcagatgcgaagggacccagac

SEQ ID NO: 35459 - DNA, 447 bp, Homo sapiens
  misc_feature 1..447: note = chr14:88792916-88793363
  misc_feature 1..447: note = hyper
  source 1..447: mol_type = genomic DNA
aggaaaacaaaacatcgtggcgcaaagtctccctgcactcgccggcccccagcaggagacccgggctggcggccactgcgtcctgggtgcactcggtggcaaagcgctgctaccgggcacgggtctctgcagctcaaaacctgcccggctggagcgcaccaatagttgccccaccactttaatgaatgccgtgtggcccggcatgggaaggctgggaaagcccgaaaaccccagtcatctctggcaacgaagtttccccgagttggctggctcccttaccccctccccacgctccagcccggggtagctgtgagaccggaggagacgatgcctgccgcgtggggagtctcagggtggctggcaatgaacagctcagccagagaagagtcgaacacggattccggggcgagtcaggagaatttcctgggacagcgaatggcagggagt

SEQ ID NO: 35460 - DNA, 30 bp, Homo sapiens
  misc_feature 1..30: note = chr14:89493162-89493192
  misc_feature 1..30: note = hyper
  source 1..30: mol_type = genomic DNA
ggagaggcgcgtcctcgaggtaacagggat

SEQ ID NO: 35461 - DNA, 30 bp, Homo sapiens
  misc_feature 1..30: note = chr14:89493428-89493458
  misc_feature 1..30: note = hyper
  source 1..30: mol_type = genomic DNA
tctgggcaccctcctcgggtgctgcccatt

SEQ ID NO: 35462 - DNA, 145 bp, Homo sapiens
  misc_feature 1..145: note = chr14:89817889-89818034
  misc_feature 1..145: note = hyper
  source 1..145: mol_type = genomic DNA
ccacttcctgtgaagcgtttggtctatggacagcctatttttaaaaatgtaagtccttcctttgaggccccccggaactggcagcaggccgacgggcaatcgttcctctggccgcacactttcaagtgaccgaatgtacccaaac

SEQ ID NO: 35463 - DNA, 548 bp, Homo sapiens
  misc_feature 1..548: note = chr14:90084100-90084648
  misc_feature 1..548: note = hyper
  source 1..548: mol_type = genomic DNA
aacataaaggtatctcgagcaaactgcacccaaatgaaaaaccgaccctgcagaaatctgtgcacaagagggctatctgaaactacagcacgattttaaaagaaggttttgggtgactgttttcataagtctcaatctaactgaccaatcagtgtgagagttaaagtgggctccagtcattcgtgcagccttcagagctctgcaccctccgagctgctctcctctccaaggcagagtcggcgatcaatgaaaaacagggaacaaaaggaatataacaggatgtcttccttagctaaggaaaacgattccctttttcctcaatgagccagtcgcaccctgcctacgacagctccacacgggagcttccagcagaccagtcctttcgggtgaggcacattttacatttgcaatcatgtgtcccaactgctagcaaatgtgtcaccttaagcacagcctgtgacggagggctccccgagcccaaccaattgaaactaataaattaaataaattaataatcccacaattaaaacctccggagaaagattgca

SEQ ID NO: 35464 - DNA, 110 bp, Homo sapiens
  misc_feature 1..110: note = chr14:90085840-90085950
  misc_feature 1..110: note = hyper
  source 1..110: mol_type = genomic DNA
cagacagaggtttgccgggtgcactggtgacattggccgttcacagacggtgagacgcggtacgggatcgataaagatagatttcaaaaatataacgctaaaaagaaaaa

SEQ ID NO: 35465 - DNA, 625 bp, Homo sapiens
  misc_feature 1..625: note = chr14:90526555-90527180
  misc_feature 1..625: note = hyper
  source 1..625: mol_type = genomic DNA
agtgagtaacagagccgagaggactgctaacagcaccagggtttctgatgaaaatgcactcgccagagctgtgtttctttattcgaaatcacacggttttactcaacagggctcctagcccttctgtctctgctcctggtgcgtaagggcggtgtgtggggctctgcgcctgaaaccgctctctcggaaggtgggaagatgcccacgtatccattcctctccgcgtacagattcgctcccacacgcccgggcgggtgattccggagggccgcgcggggctgtgtgcgcgggcgggggcgggatgtgtctggagggggcagagcgccctctcccggccccggagggcccacgcggaccggctgagcgtcccaccagccggttctgcatccactacccagatctgcgcgccctggtgggagcaccgcagccccgggtcggcccttcgaacgccgagcgtctacccgcggagaccagcgcaggaggcgggcccgcgcgcaaggaggcgggcgacagggtggagtcgccgcagctggcagccgcacggctctacctgttgcagcgtcggagcgcgcccgcctgagaaggcagagcgcggtgcggacctgtgctccgcgcgccggctggc

SEQ ID NO: 35466 - DNA, 380 bp, Homo sapiens
  misc_feature 1..380: note = chr14:90527551-90527931
  misc_feature 1..380: note = hyper
  source 1..380: mol_type = genomic DNA
gagcctactagtaggcgcagaggacgcccccgcgcaggatccagagaccaagggcgctctggcatggtcaaggcgagggaggctgcccgggggagaagcccctaacttcctttgctccctgttccaacctccctttctggtctcctctctccagcccgtccgcccaacggatgcgcagcgttggggcccggccggaggtcggagccctcggacgccgcagccctcggacgccgctcagcacagcccctctctccgtgcgcccgccctggaccccctccatccctaagccccggcagccgattcggagactcgggaggccacaggctcagcgcgacaccacgaccacaactaggaggcaccatcgtcgatctacctgggga

SEQ ID NO: 35467 - DNA, 519 bp, Homo sapiens
  misc_feature 1..519: note = chr14:90528183-90528702
  misc_feature 1..519: note = hyper
  source 1..519: mol_type = genomic DNA
ccggggtggaaactgcgcccgcatcccagcgccaagcagacgtgaactctgcgcccgttccccgggaccttcagcgttaaggagaactccgaggagagcagggggagtggaggggaacggcggcgacaaagcggatttgaaactaggagtcaaggaggacgtggggagctggcgccacaggagctaccgaggcggcggccgggggagcctcgcggcctgcgggagagcccggcggtcatgggcgagccggcggtggggcgcccgggagctggctgagcgccggggcccttatttcccgggggtgtgggcgagactccgccgacgcccggtgccgtgggcctgggggctgcccccgggggcccggccatggctggccggggtttcagctggggcccgggccacctgaacgaggacaacgcgcgctttctgctgctggccgcgctcatcgtgctctacctgctgggcggcgccgccgtcttctccgcgctggagctggcgcacgagcgccaggccaagcag

SEQ ID NO: 35468 - DNA, 213 bp, Homo sapiens
  misc_feature 1..213: note = chr14:90528934-90529147
  misc_feature 1..213: note = hyper
  source 1..213: mol_type = genomic DNA
tccggggggcaggaccgaccctctcatcctttcattcatccatctgggcgcccagccagactccactgacatgagctgtcgcctgatcaacaggtggtattgcctccccgctgctctaatgtggtccaggcaccggcagcttcagcgtcacctggcagcttgttagaaatgcagtctcagtcccctctgcagacctgccgagtcagaatctgc

SEQ ID NO: 35469 - DNA, 295 bp, Homo sapiens
  misc_feature 1..295: note = chr14:90850099-90850394
  misc_feature 1..295: note = hyper
  source 1..295: mol_type = genomic DNA
cactcgaactgccaccgagccgacccttcctgttttggaactcagggcccggccacccgagaagcaccctcatgggcactttgtttctacaagggcccgtttccatttccttcctaaggtttccttatcccctgcggcaggaggggcccgctgggctcgggttttcagctgcgttggagctgcagaggctgcggagtgaacgcggccaggagcccgcctgggagcgcgcagcgctctaggagccgagagccgctgcttggccctcgctggccgggtaaaccgaggggaagctcct

SEQ ID NO: 35470 - DNA, 53 bp, Homo sapiens; identical to SEQ ID NO: 12000
  misc_feature 1..53: note = chr14:91580352-91580405
  misc_feature 1..53: note = hyper
  source 1..53: mol_type = genomic DNA

SEQ ID NO: 35471 - DNA, 30 bp, Homo sapiens
  misc_feature 1..30: note = chr14:91581588-91581618
  misc_feature 1..30: note = hyper
  source 1..30: mol_type = genomic DNA
aaggaaaggagaggccgagagtaggaagaa

SEQ ID NO: 35472 - DNA, 30 bp, Homo sapiens
  misc_feature 1..30: note = chr14:91720177-91720207
  misc_feature 1..30: note = hyper
  source 1..30: mol_type = genomic DNA
ggccaagttgtgctccgattccacgccccc

SEQ ID NO: 35473 - DNA, 416 bp, Homo sapiens
  misc_feature 1..416: note = chr14:92040467-92040883
  misc_feature 1..416: note = hyper
  source 1..416: mol_type = genomic DNA
taagggggcgggccccgttgggtgctcatgacgcaaaggtccctaggatttgctcctcacagcgggagcgccctcgagaggaaccgcgtctgcgcctcccgagacggaccactcgggcgcctccgccccgcgccctgcctcgggggccgccccgcgcagtgagctcagcgtggaggcggcagcgccctcgcccttccgcgccctcccagcgcggtctctcctcgtccgcgcgccccgctccccaggcgtttctgggatgctggttggccgggcacttacgtgtttcaaagcgggtgacagccgccgctcgggtgtactgttcgctctctcccgccaggatccgagttcttgttccccgacaactcgtgggagtgcccgctccagcgtggtttctccttctccgggaacggccccag

SEQ ID NO: 35474 - DNA, 542 bp, Homo sapiens
  misc_feature 1..542: note = chr14:92789280-92789822
  misc_feature 1..542: note = hyper
  source 1..542: mol_type = genomic DNA
ggtaaaggaagggctcgttgcagctccatatggaagaaaggagagaaaaagggagaaggaaggggattatattggtcagtagaggtccaactactgaagagaagagtgcacgggggagtgcgccctacgggacgagtacacgtgctgggaagggcggggggtgagaggcgggcaggaggggaggagtagggaggcgagagcagcgggcgggaggcgccacggcctctcagacgctggcgcccgcagccgagaagccagagagaaagttcccggggagagctcgcccctgggagggccgacgtcgagcctgctcgccgcgagggtctcaggtaccgcgcgtccagccagccttcccgcggcgcgcactcggccgcccgggctcggctcgtcgggaagcaggggaacatcgccggctggcagccggggcggccgccgccaaacttggaggaggaggatgctgcgagtgggcgcggcggcgcggggcgcgggggcgcactgagtgctccctacggcgctgctgccagggctgtggccgggcgagc

SEQ ID NO: 35475 - DNA, 140 bp, Homo sapiens; identical to SEQ ID NO: 12004
  misc_feature 1..140: note = chr14:92789959-92790099
  misc_feature 1..140: note = hyper
  source 1..140: mol_type = genomic DNA

SEQ ID NO: 35476 - DNA, 358 bp, Homo sapiens
  misc_feature 1..358: note = chr14:92790436-92790794
  misc_feature 1..358: note = hyper
  source 1..358: mol_type = genomic DNA
gccgggcaggtagagcgcgcccagaagagctgatggacgctctgggctgtggcgccggttcccctgagctacgagcggcccctgggggggctcaggacgcggctgcaggtgtgtgttactaagacgaaagcaagaaccgcttccgtcccgggagtgcgcccggaatgggcagcgcaactgcggggtgcaggcaggattctcttggtctggggtgggcgaaactgagtggcccgctttcctattctgcagagccgcaggaaccgccactgcgtctcgcccctgccctggttcaaaggggtcccctgggtgccctgaggtgtttgttcttcccaaaccctaaaggcgttggggcagtctg

SEQ ID NO: 35477 - DNA, 1159 bp, Homo sapiens
  misc_feature 1..1159: note = chr14:92979611-92980770
  misc_feature 1..1159: note = hyper
  source 1..1159: mol_type = genomic DNA
gcatccaagaggaggcggcgtgcacatctgtcaggaatgtggaggaggcgccctggctctggtctgaggttgcccttgaacgatttcgaggctccctcgggcaaggctgtggctccgagtgggacgaactccccgccagctctgggcctccccacctgccggcccgcggtcggcgccggcacaggcggagggcgtcttccttcccctgcggccccaagccaagtggaagacttttctctaagtttccctctccgaagccccgcgggcctcccgcgccccagccccagccacagcctgtggaggcggcaccccgaggttgggcgcccgtgcggcgccttggccccagcaccccccgccccgaggcccggccccgggggcgcggccgcccgggcctccgtgtgccccagggggctccgggccgcgagccgctgccgaatggcttttgacaaaaaaacccttgaccaccaaggccagcctcttcctgaaagccccgctcgctccgatacaggaagtagaagggagcgagagccccagagcgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacggggtaagtccgggcggccgccccctcctccctcgcgatccccacggcccgcgtcctggccgccccactccacttcttgtcccagagagtccttcgggcgcgtgacctcggggttgtcgggctgatacgggacccccaccgtggccgaggccagaacctggttctgcggggcagggggcggccctggtgactccgctggacccgatgttggctaaactttcaaggccaggcatttcactgggaacccagtgcacactttaggctgctggtggacggattacgagggagtgcgtcgctacctgtcagcgccggggctgcccgcgtggacgcggccccctccctggcgtctgccccgcctgaactttgcaaacaaaactcgcggtcccagccccgccagcctgctgcacccgctgctctgcgagtcgcagcgcgcgccctcgggtactagagccc

SEQ ID NO: 35478 - DNA, 62 bp, Homo sapiens
  misc_feature 1..62: note = chr14:93389271-93389333
  misc_feature 1..62: note = hyper
  source 1..62: mol_type = genomic DNA
gccccccgcctcccacgccacctcttggaaaccagatacccgcctcgcggccaagacccacc

SEQ ID NO: 35479 - DNA, 92 bp, Homo sapiens
  misc_feature 1..92: note = chr14:93389602-93389694
  misc_feature 1..92: note = hyper
  source 1..92: mol_type = genomic DNA
ggtgccaccgcagcccgaccccggccgccagtccagccgcccctcgcccggtgcctaggtgcccggccccacaccgccagctgctcggcgcc

SEQ ID NO: 35480 - DNA, 224 bp, Homo sapiens
  misc_feature 1..224: note = chr14:93389712-93389936
  misc_feature 1..224: note = hyper
  source 1..224: mol_type = genomic DNA
cgccgctgtcctggctcttctgctctgcgccgggcaaggtgagcgagcgcggggagctcgcgggagagggttccgggcgcccctgcccaccttgaggtccgggcaccgcgcggcgccccgcacccctccacacttcccttcgggcgcggcgagttttcagcaccgcggacagcgcctccgcctcccgcctgaccctgcagtgtggcctccgcctgggacccaca

SEQ ID NO: 35481 - DNA, 269 bp, Homo sapiens
  misc_feature 1..269: note = chr14:93897179-93897448
  misc_feature 1..269: note = hyper
  source 1..269: mol_type = genomic DNA
ctaaccttccgggaccgaattctgcaatttgatgtgcgttttgtccgaatggtagcgacacgggcctaagggagggggaaagcgagggggtggggggtggggggtatgcactcttttcctcgcaacatcgctggcggagcgagggagctcacacgacacagattttggggcaaagcctttccaactggacagcaccatgtccaccaaagcggagcagtgtaagtagcagccggcccggcattccggcccggcctcggctgggagctatt

SEQ ID NO: 35482 - DNA, 30 bp, Homo sapiens
  misc_feature 1..30: note = chr14:94226381-94226411
  misc_feature 1..30: note = hyper
  source 1..30: mol_type = genomic DNA
aacagctgccgtccccgagggctgcctgac

SEQ ID NO: 35483 - DNA, 165 bp, Homo sapiens
  misc_feature 1..165: note = chr14:94254294-94254459
  misc_feature 1..165: note = hyper
  source 1..165: mol_type = genomic DNA
acatccccagagccccgcgtgtacactttagctccgcgcacagctccagaatactgcgtgcataccttggccccatggacacctccagaaacagccaagcacacttactgcgccccattaacccccatacaactcactctcactgtgagcacacttcaaacccgg

SEQ ID NO: 35484 - DNA, 481 bp, Homo sapiens
  misc_feature 1..481: note = chr14:94254498-94254979
  misc_feature 1..481: note = hyper
  source 1..481: mol_type = genomic DNA
cgtgcacacacactgatccccgtgcacacccaccgactcctgcctgcaccctcgctgaccctgcatgcacggccccaagaaatctcacgctgcctgcacccacactgcccagccggcctcattgcgcacactgcaacataggcacctccgtgcgctgcccctttgcacgcctccgcccagccccgatctcccgctcccgggcgtgggttcccccacgcctccatctccgcccgcacccttccaacgcctcacgctaccttgcctggcggcggccccagccgaccctgggctcggggaaaagaggtccgcgttccccccgcggcagctctgtttcccagcagccggacagcccccatttaaagccagccgcctccccagtcccccgccctctaggcggggcctccgtcctcaccttggcggctgcgcgggcgcccgggggcttcacatgccggggaggagcgcccggcgctggagcaaaagt

SEQ ID NO: 35485 - skipped

SEQ ID NO: 35486 - DNA, 59 bp, Homo sapiens
  misc_feature 1..59: note = chr14:94255304-94255363
  misc_feature 1..59: note = hyper
  source 1..59: mol_type = genomic DNA
cggcgggaggcgccggcagggagctcccgctggggcagcaaagccgtgggtggaggcga

SEQ ID NO: 35487 - DNA, 23 bp, Homo sapiens
  misc_feature 1..23: note = chr14:94255584-94255607
  misc_feature 1..23: note = hyper
  source 1..23: mol_type = genomic DNA
cccccaagcctctcccgaggctg

SEQ ID NO: 35488 - DNA, 46 bp, Homo sapiens; identical to SEQ ID NO: 12016
  misc_feature 1..46: note = chr14:94255669-94255715
  misc_feature 1..46: note = hyper
  source 1..46: mol_type = genomic DNA

SEQ ID NO: 35489 - DNA, 368 bp, Homo sapiens
  misc_feature 1..368: note = chr14:94405660-94406028
  misc_feature 1..368: note = hyper
  source 1..368: mol_type = genomic DNA
ataggcgtcgatgttcgcgccgtggtccagcagcagctgcattgtgcgcaggcagccgtggcggatggccacgagcaaggggctgatgacgtcgcggttggggtcggcgccgtgttgcagcagcagctcggtggcgtacacgttgttgttgaccaccgcgaagtacagcgcggagctgcgccggtcttcgtagaggcgcgcgcgctcgggggccagcggcgtgttcacgtcgaagcgcgcgctcagcagcgcctccagcacctcgtcgtggttgcgctcggccgccaggtgcagcggactgacgccgctacggcgtatgcgcgtgcggctggtcaccggcagcagcatctgcacgatcctgccgggtc

SEQ ID NO: 35490 - DNA, 85 bp, Homo sapiens
  misc_feature 1..85: note = chr14:94641576-94641661
  misc_feature 1..85: note = hyper
  source 1..85: mol_type = genomic DNA
actctttctcagtgtcgtcctggtccctgtctacaagccctcgcgaccctttgccgccatcctgagtcaccgctcatcctttcct

SEQ ID NO: 35491 - DNA, 66 bp, Homo sapiens
  misc_feature 1..66: note = chr14:95233491-95233557
  misc_feature 1..66: note = hyper
  source 1..66: mol_type = genomic DNA
cttgcaccaaatacccgaggtagcccaagagaaagaacaaatccctgcagccggccgttgccggaa

SEQ ID NO: 35492 - DNA, 30 bp, Homo sapiens
  misc_feature 1..30: note = chr14:95234025-95234055
  misc_feature 1..30: note = hyper
  source 1..30: mol_type = genomic DNA
ggggaagaggcaactcgcatgtggagctgg

SEQ ID NO: 35493 - DNA, 162 bp, Homo sapiens
  misc_feature 1..162: note = chr14:95234549-95234711
  misc_feature 1..162: note = hyper
  source 1..162: mol_type = genomic DNA
gtggcccgtctacatcgccatcactttattgtactgtcacccttaatttaactataaatactacggtgggggctagtcgcgggcggcctcgggctgctgggctgtgcgcgccctgaccccagacgccgaccctcccggctctgtacactatttacagctcct

SEQ ID NO: 35494 - DNA, 358 bp, Homo sapiens; identical to SEQ ID NO: 4177
  misc_feature 1..358: note = chr14:95235025-95235383
  misc_feature 1..358: note = hyper
  source 1..358: mol_type = genomic DNA

SEQ ID NO: 35495 - DNA, 182 bp, Homo sapiens
  misc_feature 1..182: note = chr14:95235513-95235695
  misc_feature 1..182: note = hyper
  source 1..182: mol_type = genomic DNA
cggtaccggggacaccagcaccgaaccggggccctcgtagcctgcgacagagtggggcgcacggtcagccgcccgccctcgccaccgcacgcatgcacgcccgccagcccccgaccctcttccacttagaagtcgtctgcaaggggatgctgagaattgggggtgcacgggaatcaggggtg

SEQ ID NO: 35496 - DNA, 425 bp, Homo sapiens
  misc_feature 1..425: note = chr14:95236081-95236506
  misc_feature 1..425: note = hyper
  source 1..425: mol_type = genomic DNA
gcacgtgcagctgcccgtagaagtagttgttgtagccgaggcgggagccgctgaccgcggccgggaggcccgcgccgccgggggccacggggcgcgggtagaaggcgccatagtccgaggaggcgccgccgctggcgccgtagagcgagtccccgtgcagggccgggaagacgacgggagccgccgcgctgtgcgccaccggcaacaccgagtccttgcagcgcggccgggcggctaggatgttgtcgatgctgaacatgctggcgggcatccccgagccccgcgtcgggaccggggggcggcgggaacgcgccgaggacagagccttaaagtgggggggtccactctcctccagccgccgaccaaaccgaaagagagcgccggcgagcgcgcagccctgcgcccctccccgccccctgcgtccg

SEQ ID NO: 35497 - DNA, 125 bp, Homo sapiens
  misc_feature 1..125: note = chr14:95237011-95237136
  misc_feature 1..125: note = hyper
  source 1..125: mol_type = genomic DNA
cttttttccccctttcggaattggttttgttttagaaaatgtgaggggctgcatcccctctcaagcaggattgaaaattccaccactcctccgcgcccccacgtactcaccgcctgatttacctc

SEQ ID NO: 35498 - DNA, 55 bp, Homo sapiens
  misc_feature 1..55: note = chr14:95237867-95237922
  misc_feature 1..55: note = hyper
  source 1..55: mol_type = genomic DNA
ggaaggggcagtacccgacccaggcgatacccccgagagccggagagggagatgg

SEQ ID NO: 35499 - DNA, 271 bp, Homo sapiens
  misc_feature 1..271: note = chr14:95239421-95239692
  misc_feature 1..271: note = hyper
  source 1..271: mol_type = genomic DNA
cgcggaggcaggccccgggaaaggcagtcggcgctcggtgctcgcactgcgcctcggcgggcggaaactcacaagtgtcctcaacgtgctaaacaaaccatcagggccccgcatcgcctggcgcaattggaataacaaatgcgacgcacgcaaattgtccacctcgtgttgctaagcgattgtttgtcggccccgcacgcacagctcagcatgggaggaccgcgagcgtccagaggcagccggcgagcgcttaggtcggaaatgcagtaaa

SEQ ID NO: 35500 - DNA, 30 bp, Homo sapiens; identical to SEQ ID NO: 12023
  misc_feature 1..30: note = chr14:95240484-95240514
  misc_feature 1..30: note = hyper
  source 1..30: mol_type = genomic DNA

SEQ ID NO: 35501 - DNA, 29 bp, Homo sapiens
  misc_feature 1..29: note = chr14:96342281-96342310
  misc_feature 1..29: note = hyper
  source 1..29: mol_type = genomic DNA
gcccaaagccacattcgccacgctcccgc

SEQ ID NO: 35502 - DNA, 26 bp, Homo sapiens
  misc_feature 1..26: note = chr14:96342605-96342631
  misc_feature 1..26: note = hyper
  source 1..26: mol_type = genomic DNA
cgcagcgcgcgtcagcgggggctccc

SEQ ID NO: 35503 - DNA, 364 bp, Homo sapiens
  misc_feature 1..364: note = chr14:96342879-96343243
  misc_feature 1..364: note = hyper
  source 1..364: mol_type = genomic DNA
cgcactgctgtgcttgcggccgggtgggcgccccgccgctgcggtcgcggtcgccgctggtaagctgcgctctggggcttggggcaggaagcagtggggggcgctcgaagagcagggcagctacggccaccgtggccgccggaccggccatgtgctaaagtttctggggctcggcgccccgctgggcgcgcagcgcggggagcagacgcgccgtgggtggggcagcgcggtgctgctggcgcccggcccccgcggggtgcagctctgcgcgttctcatgctgtctctctctctttccctccgcgctgcctctccgaggtcctcccgccgagccccggcgcggggcatgaggagcccccgggtgc

SEQ ID NO: 35504 - DNA, 116 bp, Homo sapiens
  misc_feature 1..116: note = chr14:96343319-96343435
  misc_feature 1..116: note = hyper
  source 1..116: mol_type = genomic DNA
cgcccggcggccagccctatccggcggcggccagcgggtcaacgctgcccgggagaatgaggcaggagccggcggcagcctcctttttttccttctcctcgccttcctgcggctcc

SEQ ID NO: 35505 - DNA, 118 bp, Homo sapiens; identical to SEQ ID NO: 12028
  misc_feature 1..118: note = chr14:96343667-96343785
  misc_feature 1..118: note = hyper
  source 1..118: mol_type = genomic DNA

SEQ ID NO: 35506 - DNA, 173 bp, Homo sapiens
  misc_feature 1..173: note = chr14:96505338-96505511
  misc_feature 1..173: note = hyper
  source 1..173: mol_type = genomic DNA
aaagccaggtcactccgatcttggtcctcaggctcgggataacgtgtcagccccaagagagcgctgcccacagccccgggtgggttgggttcaactgcacggggcggggcgccaacagctcaggacttgggttgcaggctggttcttgcaccaaccagcggggcggcctcggg

SEQ ID NO: 35507 - DNA, 153 bp, Homo sapiens
  misc_feature 1..153: note = chr14:96505900-96506053
  misc_feature 1..153: note = hyper
  source 1..153: mol_type = genomic DNA
aagtttggggaggttcggggccacggtctcgccctccacgctggggctgggcagtggcgcccgcccgcgatccgcgtcccggtcctttgtcccgagccggacacccccacttggtgcacgcgtcgggggcggcgatcgcggctctcccggggt

SEQ ID NO: 35508 - DNA, 30 bp, Homo sapiens
  misc_feature 1..30: note = chr14:96506466-96506496
  misc_feature 1..30: note = hyper
  source 1..30: mol_type = genomic DNA
ccccacccccctccccgacacaaacaggct

SEQ ID NO: 35509 - DNA, 157 bp, Homo sapiens
  misc_feature 1..157: note = chr14:97058943-97059100
  misc_feature 1..157: note = hyper
  source 1..157: mol_type = genomic DNA
cgcccgggcccgcggattgccgggtcggttctcagtcaccgcacaggtgccctggagagtgcgaccaccccctgccctccgccccgcgccggccctcggctcagtgccccgcccttcctggagcacggcctgcgcatgcgcgcgccccagggcccag

SEQ ID NO: 35510 - DNA, 221 bp, Homo sapiens
  misc_feature 1..221: note = chr14:97499277-97499498
  misc_feature 1..221: note = hyper
  source 1..221: mol_type = genomic DNA
atgggtctgggagtccgaaggctcgcggaggagagtgtgatgtggggtctgctcccagagcgcgcgcgctgtggctcttggaaggtggggctctgaggaccggggtcctgcgtgcatagacctggagcccaccttaaagacgctgcttcagggacgcttcaacaagccccaacccacccaactgcgtggcgctccccgcctttgggcgccctgttagggtt

SEQ ID NO: 35511 - skipped

SEQ ID NO: 35512 - DNA, 336 bp, Homo sapiens
  misc_feature 1..336: note = chr14:97684961-97685297
  misc_feature 1..336: note = hyper
  source 1..336: mol_type = genomic DNA
gaagggccccagtgacgactggattcggaattttcctctcacttcgtggtagtgaagaatttaactacaacagtaacaacactaataattctaaaagccgtgggaggtcagagcgggcgctgcccggcgtcacccctgcagcgtccggatcgctccgcataggcaggggtggtgccccctccccggggcacagaaacgccacatcccgggggcgccgcccagaggctgtctctgtttctgtgtcccttcatgaggctctgtcccacaaaggcagcctgagccaggaccctaaagaggcctggtcatcgggaccggagggagttccgcttcccaggc

SEQ ID NO: 35513 - DNA, 564 bp, Homo sapiens
  misc_feature 1..564: note = chr14:97685395-97685959
  misc_feature 1..564: note = hyper
  source 1..564: mol_type = genomic DNA
cgctccggccagctgcccgggaagcgcccaagcacacgtcccgagtcccagattggattaagttgcccaactacctactttttctctctttaaggagaagcctaattggagaagattcggttttcttcgccatggcaggtccctttctcctgacccgcagttgcaggggctgagggtaggcgcaggtccgccctggggtcgaagccaccatcgggcctcgaggttgcccccctaacatccggcctgcacgcctggcgggggcgcaacagtgtctcacggctcgggagctcgtttttggcttctgagcaaggtatttttttcatctgccgtgtgtttagctgaattcagtatatttttctcgcacttctcgcttttttttttttctttctgaatctgctcttctgctttgcgggcccctaatctctcccgaatctcgggcgcccggcccggcccaggcgagcgctcgcggttggggacgcgggtggggacgcggcggtctgggcgctgcaggatgcgcctggccgcggaggagacgaccagggagcgggtcgccagatcaagatc

SEQ ID NO: 35514 - DNA, 170 bp, Homo sapiens
  misc_feature 1..170: note = chr14:99584575-99584745
  misc_feature 1..170: note = hyper
  source 1..170: mol_type = genomic DNA
gcggcaccatgtgtgcgacgctatcatttacactgaggagccgggtatttagaaaacagggctggtaccaagcgcgccatctgtggccaagcgttcccggcccaccgcaccatattgtgcaaggcgcgggctgaaggaaacagcgtcccgtgtcgcgcagtgtttgtttg

SEQ ID NO: 35515 - DNA, 30 bp, Homo sapiens
  misc_feature 1..30: note = chr14:99713234-99713264
  misc_feature 1..30: note = hyper
  source 1..30: mol_type = genomic DNA
ggaaaattgcagtagcggggaggcaggtgg

SEQ ID NO: 35516 - DNA, 38 bp, Homo sapiens; identical to SEQ ID NO: 12034
  misc_feature 1..38: note = chr14:99736151-99736189
  misc_feature 1..38: note = hyper
  source 1..38: mol_type = genomic DNA

SEQ ID NO: 35517 - DNA, 30 bp, Homo sapiens
  misc_feature 1..30: note = chr14:99736401-99736431
  misc_feature 1..30: note = hyper
  source 1..30: mol_type = genomic DNA
acaccgtacctggcccgctcgcgctcgctt

SEQ ID NO: 35518 - DNA, 30 bp, Homo sapiens
  misc_feature 1..30: note = chr14:99736980-99737010
  misc_feature 1..30: note = hyper
  source 1..30: mol_type = genomic DNA
ccgcccctggccctacggctcccccagccg

SEQ ID NO: 35519 - DNA, 58 bp, Homo sapiens
  misc_feature 1..58: note = chr14:99738350-99738408
  misc_feature 1..58: note = hyper
  source 1..58: mol_type = genomic DNA
gctgccgagtccccgcgagcgctccccagcgctcccctggcgccgcgggcccgggggg

SEQ ID NO: 35520 - DNA, 70 bp, Homo sapiens
  misc_feature 1..70: note = chr14:99739091-99739161
  misc_feature 1..70: note = hyper
  source 1..70: mol_type = genomic DNA
tttccctggaaaagtcgcttggtagtttttacttttgttttatggtcgcgggcggcgaggggaggggagt

SEQ ID NO: 35521 - DNA, 169 bp, Homo sapiens
  misc_feature 1..169: note = chr14:99739709-99739878
  misc_feature 1..169: note = hyper
  source 1..169: mol_type = genomic DNA
gacaaggccagaccacggcccccgtggacaccccccattccccaggctgtggccaactttgtcaatttgatgacctggcctccagggctgggcgcgccacgcggctggcctcctctcccttctcagggtttctctggaggcggccagggcgggtcggggcctggctccg

SEQ ID NO: 35522 - DNA, 175 bp, Homo sapiens
  misc_feature 1..175: note = chr14:99740538-99740713
  misc_feature 1..175: note = hyper
  source 1..175: mol_type = genomic DNA
ccctaggacacacagcgcgtcagggacaggtctggacccaaaacaccgcggcgtgcctgcagcccagcgccgccggcggtccgggactcgaaatcccgacccacgaccctcaccttcctggggttgattacaaggaaggcagaccccgccagtggcaaggcgggacggggaggac

SEQ ID NO: 35523 - DNA, 49 bp, Homo sapiens
  misc_feature 1..49: note = chr14:100111198-100111247
  misc_feature 1..49: note = hyper
  source 1..49: mol_type = genomic DNA
aggcctctggccctgcgcctccctggctaaagagcgccctgtggggagg

SEQ ID NO: 35524 - DNA, 54 bp, Homo sapiens
  misc_feature 1..54: note = chr14:100111503-100111557
  misc_feature 1..54: note = hyper
  source 1..54: mol_type = genomic DNA
gggctgccgtccctccgcctcttcccccgcggggcgtagcgatggcccgggcca

SEQ ID NO: 35525 - DNA, 155 bp, Homo sapiens
  misc_feature 1..155: note = chr14:100111764-100111919
  misc_feature 1..155: note = hyper
  source 1..155: mol_type = genomic DNA
cgtgcgccggctacgcgagggacctgctgtgccaggtgagcgggcgcgcggccaccgggcggggcggggcgcgggaggccgagtcctggagcagagatcggaaccccgcgggggcgagggccaagagtgggcggcggactcgggaactctaagcc

SEQ ID NO: 35526 - DNA, 363 bp, Homo sapiens
  misc_feature 1..363: note = chr14:100125656-100126019
  misc_feature 1..363: note = hyper
  source 1..363: mol_type = genomic DNA
ctgcacctggctcagcggtcagccggcgccccagcacctgccccgcggagcccgtgagccctggctcagggcgaccccgagccgcgccctctcccaccccgcccgcaggtcggcgctgctgggcaaggtgctgcgcatcgacgtggaccgtaaggagcgcggcctgccctacggcatcccgcccgacaacccgttcgtgggcgaccccgcggcgcagcccgaggtctacgccctgggcgtgcgcaacatgtggcgctgctccttcgaccgtggcgacccctcctcgggcactggccgcgggcgcctcttctgcggcgacgtgggccagaacaagttcgaggaggtggacgtggtggagcgcgg

SEQ ID NO: 35527 - DNA, 236 bp, Homo sapiens
  misc_feature 1..236: note = chr14:100260026-100260262
  misc_feature 1..236: note = hyper
  source 1..236: mol_type = genomic DNA
cgttcccgccgccggcgcattgtgttggagccgcggggccgcgcctcgctccgggccgccccgggctccccgccgccaccccggctcccggcactggcgcgcggaccccgccggctccagcacccgcggagcgcgcccgggcggaggcgcgtggggcacagggcggcggggaggcccgggcagcctccgcgttccggggaacgtgttgcttttttgcttcccgacccacatctgtt

SEQ ID NO: 35528 - DNA, 485 bp, Homo sapiens
  misc_feature 1..485: note = chr14:100437465-100437950
  misc_feature 1..485: note = hyper
  source 1..485: mol_type = genomic DNA
gacctcgacggccctcggatcagggatgccccgagtccgagcgggcagggtgctcagcagggccaggtgatgggaatcatggggccatcgagcacggaccctggctcccccggtggcctctgtgagctctggggtcaggcggggactggaggagcgtccgcgccgggagggagcgcaccgcgccacgtgcccgcccggcgccccgcccccaccccggccacgcccctcgcgcttccctcaaagccccgcccctcagccccgccactctcgtccgccccgcccctcgcagcctcaagctcagcgctcccggaggcgcggacggtggggccccgcgccttttgtgtcgggctttgaccgccgcgcgcgctcattcacctcagcggccgcgggcggaggggcgcacgcgcgcgcagtcccctcggagggcggtggggcgaacagcaacgcgcgtaccctagctcttggctgctgtgctgagactagcc

SEQ ID NO: 35529 - DNA, 204 bp, Homo sapiens
  misc_feature 1..204: note = chr14:100438017-100438221
  misc_feature 1..204: note = hyper
  source 1..204: mol_type = genomic DNA
cgagtctcaggcggacgcgcacgcgttcccgccgcccggaccccagccggctcgccccccgcccccccatcccccggcggcggcccccaggcacgcgcccgcgcacacgccggcccgggcacgcgcccgccaagatggcaggggccggggcccagctgtcagtcgccgccgccgcggcccttccccgcagctagcggccccgac

SEQ ID NO: 35530 - DNA, 749 bp, Homo sapiens
  misc_feature 1..749: note = chr14:100438222-100438971
  misc_feature 1..749: note = hyper
  source 1..749: mol_type = genomic DNA
cccacccggagaagatgagcccccgctgccccccgcagcccagtcagacgcggagccgccgcgcccggggccggctcccccgctagcgcccgcgtcccgcgccccgccgccgccgccgccgccgccgggtcgcccctggcccggcgcgcccgtccccggcagcgacaatgaggtgagtcggggccggcgcctcgtgggaggtggcagcggccagcgtcggaggggctgggctgggggcccgcggtgcccccgagggcgggaggggggctccacgggcgcgggggcttccagagaaccgcgggggctctgcagagattcgggggcattcagagcgcgggaatggcttcgcgagagccgtgggggcgtctggagagccgggagggtctgcagggcttgtggggggcagtgttctgcaaggggcaggcggcgctggctttggctgcttgtggggtcctcttaggctccggggggcctgcggcggcctgggaggcagacccccgcgggcaggtgtggccgtgtcccgaccgcgcgaggaccgaagttggcggaagcccctgtgcggtgccttccagcccggaggaggctggcctgaagcccccaggcgttgccgaagcctccccctgccagcgcccagagccgcgtttgggcttttacaggtgtagtttcccctcgacttggagcccgtcaaccccttcgtctcctaattctcaaccccccttttttttcttcttgcacgccagtaaagtgca

SEQ ID NO: 35531 - DNA, 270 bp, Homo sapiens
  misc_feature 1..270: note = chr14:101033483-101033753
  misc_feature 1..270: note = hyper
  source 1..270: mol_type = genomic DNA
cgcctcggctcaggctccggaaggaaaacacgggaggggtgttcccaaagtaggggtcagggtgccaggggaagtcgtggaggaagtggcaaatattcaaactggctgatcccaggcctgccgcgcaggtggtcccgtgaagtctaccaaggcttaaagtttggcaccgggagggaggccgcgggggacactccccagaagctgtcgcgggattcccccaaaatggctccaagacgcggctgcctggtccagccgcgaggactccatccc

SEQ ID NO: 35532 - DNA, 175 bp, Homo sapiens
  misc_feature 1..175: note = chr14:101033978-101034153
  misc_feature 1..175: note = hyper
  source 1..175: mol_type = genomic DNA
gggtagggggcagcccggccctcagtggcgctagccccagcccccgccgcagcggcccgggccggcggaggagccccgcgcgaggctccccagcgcctcgcggcgcgcacacacgcaccacacacacgcacctggcccgcagccccgccgaggccgcccgcgggccctgggggat

SEQ ID NO: 35533 - DNA, 601 bp, Homo sapiens
  misc_feature 1..601: note = chr14:101034879-101035480
  misc_feature 1..601: note = hyper
  source 1..601: mol_type = genomic DNA
ccccagggattaacccgtgagcgcccggctcgccggcggggctccctgccttgcttgcgcagacccgcccgcgcgcggcttggagaccctccctgcccagccccgctcagccgggcagcccctccgcgcgccgggcagggggacccacccgccgccgttaaccttgtgggcgcgggcgagcgacggggaccgcgagcggcccgggcgggatcgcacttcctgcgtggagctgggggcgccgggcgggctctctatcacccgggagaggccgctccccggggctttgcccgtctttctgtgccgtgactggcactcaagggggacaggggtccgagctcagggaccacgcgacagacctgggaagactgatgactgcccatcccggcccctcgcgccgggcgccgccgccgcgtccgccgggagcgcgctccgctcgggtccgggccccacgccgcctcccccaccgccccgccgggcgagggcgcagcccggccgcagcgccaagctagaaggcccggccccggggcctcggccaggctcggccaccaacttcccgggtgctcgggccggccttccggcgctctcccggcctcagtttcct

SEQ ID NO: 35534 - DNA, 177 bp, Homo sapiens
  misc_feature 1..177: note = chr14:101193397-101193574
  misc_feature 1..177: note = hyper
  source 1..177: mol_type = genomic DNA
gcccagagatgaccgcgaccgaagccctcctgcgcgtcctcttgctcctgctggctttcggccacagcacctatggtgagttccccggcggcccggctcgcgccccctctggggaagcctgcgactccccgccggccgcccggtgccccgcacgccccgtctcgtgagccccaactc

SEQ ID NO: 35535 - DNA, 269 bp, Homo sapiens
  misc_feature 1..269: note = chr14:101543828-101544097
  misc_feature 1..269: note = hyper
  source 1..269: mol_type = genomic DNA
gggatgcaatttccccggtgtttttcaggcccagagctattgaataaatgaagtgcgcgccggcggagtcagtaactcactgcgcggctcccggcaggcgggggcggagtgggggccgcagaaccggacgtgcctggcgaggttcagaggcgctagcggtgtggtgggtgggcagcgccgggatggctggagggaggggctacggggggaggcgctgccgatcccacactgatctggcggggaggagggaggggcggatggggtttgct

SEQ ID NO: 35536 - DNA, 171 bp, Homo sapiens
  misc_feature 1..171: note = chr14:101923096-101923267
  misc_feature 1..171: note = hyper
  source 1..171: mol_type = genomic DNA
gttactatattaaagcgcttcaagttttcatagcgctcgtcaaacagagacctcggaacgctctgcagacattaattaatgttcgctccggccctggaagccatttcaccaatggaaattccgatgagaaaggaagaaacgaggggttcaaggccgcgccgttgtgagtcc

SEQ ID NO: 35537 - DNA, 166 bp, Homo sapiens
  misc_feature 1..166: note = chr14:101923521-101923687
  misc_feature 1..166: note = hyper
  source 1..166: mol_type = genomic DNA
aagaggagagaaaggcgaggcacagtgggtgcgcaaagaaaaagaggttctcagcggagcgtgtgtgaggcggggggttacgggggaggggagacggggcgggtgtgaagtctgtgccgggaaaagaaaaatatgagtgttctcttttgtgtgcgcacaaacagcc

SEQ ID NO: 35538 - DNA, 52 bp, Homo sapiens
  misc_feature 1..52: note = chr14:101924030-101924082
  misc_feature 1..52: note = hyper
  source 1..52: mol_type = genomic DNA
gacgccctggcccggtgtccccgacgcgcctggagcccgggagggaggcgcg

SEQ ID NO: 35539 - DNA, 15 bp, Homo sapiens
  misc_feature 1..15: note = chr14:101924423-101924438
  misc_feature 1..15: note = hyper
  source 1..15: mol_type = genomic DNA
gaggccatcaaaggc

SEQ ID NO: 35540 - DNA, 33 bp, Homo sapiens
  misc_feature 1..33: note = chr14:101924457-101924490
  misc_feature 1..33: note = hyper
  source 1..33: mol_type = genomic DNA
cgttgcccatgaccaggccgagggcatgaaagg

SEQ ID NO: 35541 - DNA, 214 bp, Homo sapiens; identical to SEQ ID NO: 12051
  misc_feature 1..214: note = chr14:101924858-101925072
  misc_feature 1..214: note = hyper
  source 1..214: mol_type = genomic DNA

SEQ ID NO: 35542 - skipped

SEQ ID NO: 35543 - DNA, 286 bp, Homo sapiens
  misc_feature 1..286: note = chr14:101925706-101925992
  misc_feature 1..286: note = hyper
  source 1..286: mol_type = genomic DNA
gcccgacccgcgctagggccgcccaccccctcggaccccggccgggtctctccacagcctccgtgcgcgtcccagaaggaaaatgctagcaaaccggaaggccgcacggggccgagccggcctcagcccggccaggagaggccgtcggtgccccgaggaggaaggggacccggcccgggacggccgccccgcggtacccaggaaggacgcccgccgttcccagcaccccagcgtctgaaaaatgaatgtgaactccgcaagcgtgctcccgcggacattttacatg

SEQ ID NO: 35544 - DNA, 290 bp, Homo sapiens
  misc_feature 1..290: note = chr14:102026194-102026484
  misc_feature 1..290: note = hyper
  source 1..290: mol_type = genomic DNA
ggggcggcaggcgcacgggacgctggcggcggcggcggcttccgacttgggctcagaccccgccgctccagacaagtccccgcgactgcgacagtgtctcgggcagttcagctccccagacgggagacagaccctcgcgacctggttcaggccttgccctgggggacactgcagtccaaggcgaaaggagacttgctcccggcctctgggtccctaggtcaaggcacctccccgccccgccgcccctgagcccaagtcgccaaccccgcgccgcgcgcagcgagggatca

SEQ ID NO: 35545 - DNA, 125 bp, Homo sapiens
  misc_feature 1..125: note = chr14:102026883-102027008
  misc_feature 1..125: note = hyper
  source 1..125: mol_type = genomic DNA
ctgggggcgcagggccggcgccgctttccccagctctccggtctccggcgcccggcggtaacccgcccgcgggctctgccctccgcacctctcagcccggccccggcggccgctgacccaggaac

SEQ ID NO: 35546 - DNA, 391 bp, Homo sapiens
  misc_feature 1..391: note = chr14:102029904-102030295
  misc_feature 1..391: note = hyper
  source 1..391: mol_type = genomic DNA
ctaggctggcaggggcgctggaggaggatggaggaggaagagggtctgcggcggtgcccggggcgctcctacaaccgcacgcacccacctggacggggaacttagctgcgggagaagagcgaggtagcggagcgccgcgggatcctggaaagcggcgggagaggcaagggggccctctcttgctcccgcgcgcgcacacacagaccgaacagatgcagctgcccctgcagccgccgatccaacttaactgagtatccggcggtgtgtggagggggttgggtgaggtggagggcgagaggggctttggacccggtacagcctggctcccgaccgctgcaggcaccactgcgcacctgactcctccctggcccccttccggcacctgcaacct

SEQ ID NO: 35547 - DNA, 256 bp, Homo sapiens
  misc_feature 1..256: note = chr14:102030653-102030909
  misc_feature 1..256: note = hyper
  source 1..256: mol_type = genomic DNA
ctcgcctgttgcgcccggagtgagggcgacccgggggacgcgggattagcttagcccgcagcccctgtgccagcgaaaccttgaacattaagtgaaaggtgggggacacagtgaaagccgctgaggcgggagtgtacggatccaggtgaggggactgggcacggcaacttccctggcgcgccaggacaatgcctgggaacccaggattgtcagggtcgccgggggtgggggtgagtagtgtcggtttgcgcgcttg

SEQ ID NO: 35548 - DNA, 50 bp, Homo sapiens
  misc_feature 1..50: note = chr14:102031530-102031580
  misc_feature 1..50: note = hyper
  source 1..50: mol_type = genomic DNA
cagccactccccgcacgggccgcactcgctctggtcgcagctccagggaa

SEQ ID NO: 35549 - DNA, 305 bp, Homo sapiens
  misc_feature 1..305: note = chr14:102247792-102248097
  misc_feature 1..305: note = hyper
  source 1..305: mol_type = genomic DNA
acccgcgtgggctcccgccgggccctcctgccgccccccagcctccccgcccctgcccttgccagcctgcgccttcctgggcgcctgacgcacccctctgccccaaccacgttttctcaagagtgttgtctgtcccggccttccaaggagacccttagctcccgccggccgcctccggagcctccggcatgggccccaggccggggtcccgcctttgccccggcctccgctgcctcgccccggagcccggaggaggggagccggccacccggggaagaagcggaggacgccgatctggcctcctg

SEQ ID NO: 35550 - DNA, 777 bp, Homo sapiens
  misc_feature 1..777: note = chr14:103021342-103022119
  misc_feature 1..777: note = hyper
  source 1..777: mol_type = genomic DNA
cgctttgggtcttgtcgcgcccaggccagcgccagcccaggcttgccatggactggctcctgggcgttagatgaatgaatcgactcaacccgggccgccacgttgtgttcagaacaccgacagtcgctcccaggcaaccagcacctgctgcgccccgtttccagcgacctccccaaccgcgtggactcgcatccacgtgcccggcggggccgcagcagaaaggctcggaccccccaggacgatcggccggtgggggccggtggggccgcagactcggggggcggggggcgccaggcttccgggtcctgcccccgccccgtggggaacagcaggacggcgccgaggccgtttcgctttcctccgcgcccatttgccgggaggggaccccgtgctccgacctgaaggtgacggcagagcctgcgggaggcctaggccggtcccgccctacgggtcccgggggcgaccctcgcgctgacattggcgtccaggccgcggcccctgcctccgcgcccacccacgccgggcctggccctcgctcccccgggaaaagccccgccggcggccgcgagagcgcggaagcgcagccgtagtgaccgcgagacaaagacccggcggcgggggaggcggcggagagaccccgccagcgcggagaccccagggaagcttctctggaagacctggtgctggtccgctctcccgggacctcattttccttatgtggacaacgggggcggggtcacagcagcccctcgggcttatagccgggttgttctttcc

SEQ ID NO: 35551 - DNA, 81 bp, Homo sapiens
  misc_feature 1..81: note = chr14:103389208-103389289
  misc_feature 1..81: note = hyper
  source 1..81: mol_type = genomic DNA
cggccctgcctccctcgtctggcgagtgcgcagcccggaagtgcgcggccagtgcatcgggcggtgcgggagaggagagga

SEQ ID NO: 35552 - DNA, 225 bp, Homo sapiens
  misc_feature 1..225: note = chr14:103389663-103389888
  misc_feature 1..225: note = hyper
  source 1..225: mol_type = genomic DNA
tcctgattccaaggccgagaagaggtctgtgctgccccatcctcctccatgccccagttgtcactgtccttaacaacgctgtcctctgctccagcgccaggcaaactgggggcagtgccgggaggctatctaggcaggcgtcctgcagggcgcgtttgagcgggctctgcaggtatcagtagaagtccgttggagagcgcccgggcagggcgcccacagtctggc

SEQ ID NO: 35553 - DNA, 30 bp, Homo sapiens
  misc_feature 1..30: note = chr14:103390143-103390173
  misc_feature 1..30: note = hyper
  source 1..30: mol_type = genomic DNA
ccgttgagttcccggcggacaaggtgcctg

SEQ ID NO: 35554 - DNA, 699 bp, Homo sapiens
  misc_feature 1..699: note = chr14:103394683-103395382
  misc_feature 1..699: note = hyper
  source 1..699: mol_type = genomic DNA
ccaggggactgggggcggggtgggcgcggagcaggcccggacccccgcgtggcgccgcctcagcccgtgtctcttgcagctcctgccgctggatggggaactcgtcctggcttcaggagccggattcggcgtctcagacgtgggctcgcacctggactgtggcgcgggtgaggcggtcgggcaggggcggggctctggaaaggcatgttcaggggcggggactggagggaaggcgcgtcgaggggggcgaggaccggagggagggcgcctccgggggcgtggtttagggagtggcggaagtgtcccgaagcggggcttgggaggtcgtgctcagacgcgtggcgtggcgtggcgtggcgtggtgtggcgcggcgcttgttccgtggagctcagggatgtgctccggctcaggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccgggtgagcactgaggggagggaggctcgggtcccctctccccacctcggcccgaccccgcccctcctggtct

SEQ ID NO: 35555 - DNA, 92 bp, Homo sapiens; identical to SEQ ID NO: 12062
  misc_feature 1..92: note = chr14:103550468-103550560
  misc_feature 1..92: note = hyper
  source 1..92: mol_type = genomic DNA

SEQ ID NO: 35556 - DNA, 328 bp, Homo sapiens
  misc_feature 1..328: note = chr14:103655240-103655568
  misc_feature 1..328: note = hyper
  source 1..328: mol_type = genomic DNA
ccgatttaaaactcgcgccaacgcggctgcgcgccttgtcctccgcccaggaaccctggaggccacggcctcgcccggctcctgcgctggcactggacgtcccgccggctgtacctggcgccccgtggcctcgctcccgaccgctgccccgcagaggcctcccgaccgccgaggccctcgccacgcccgggtgcccccagggggcgccggcttccacccacagagctccccaggcctgggcgggcgcagggagggcgcgaccggggcgcacccgcgcgggaacttggcagagactcgcgggacgtggcgggggcgcctcaggaaacgc

SEQ ID NO: 35557 - DNA, 77 bp, Homo sapiens; identical to SEQ ID NO: 12064
  misc_feature 1..77: note = chr14:103655569-103655646
  misc_feature 1..77: note = hyper
  source 1..77: mol_type = genomic DNA

SEQ ID NO: 35558 - DNA, 32 bp, Homo sapiens
  misc_feature 1..32: note = chr14:103673859-103673891
  misc_feature 1..32: note = hyper
  source 1..32: mol_type = genomic DNA
gctggacacgcagttcgcgtgcggccgctccc

SEQ ID NO: 35559 - DNA, 30 bp, Homo sapiens
  misc_feature 1..30: note = chr14:103686765-103686795
  misc_feature 1..30: note = hyper
  source 1..30: mol_type = genomic DNA
gaccgtccttcctaacggcacttcaccccg

SEQ ID NO: 35560 - DNA, 307 bp, Homo sapiens
  misc_feature 1..307: note = chr14:103687082-103687389
  misc_feature 1..307: note = hyper
  source 1..307: mol_type = genomic DNA
gtcgcgctatccaggcgcccgcccaggcttggggagctctgcgcgcgggagccggcgactcctcggggcaccagggcgtggcgagggcgtcggcctcggcggggaggccttggctgggccgtcggggtggcgccgtgccctggaggtcgtggctggaagcgaggccgcgggggtccaggagcgctcatcggggcgccagatgcagcctgcgggacgtccagtgcccgcgcaggggccgggcgaggccgtggcctccaggcaacgcgcagccgcgttggcgcgagttttaaatcggtgccttcccagc

SEQ ID NO: 35561 - DNA, 514 bp, Homo sapiens
  misc_feature 1..514: note = chr14:103739923-103740437
  misc_feature 1..514: note = hyper
  source 1..514: mol_type = genomic DNA
ctgggttgagcggggcggatctgggactccgaggcttcctacgtggggcgggttcccagcggacgcctctgccgcacccctggcggggacccagctgcgccccttcccgcggccctcctagggcctgggtgcttggaggctcgaggccccaagatccatgtcgcccggaatcccggtgcctaggccttgtcgcgggccctgggaccaactcgcgggggtcaggagctgggggttgagagaaagatgatcaggtgggttggagaaaggagacgcttcccgctgggcgagtgagcccaggacgcggcagaagagggcagaccctaggggaccgccgcgtccccaggcgcgcacgcgacccctccccgcgccgaaaatcctctccccgcctcagtctccccgcctccgcctccccacccatagtgtcactccgaccctagccctgggtccaaacgggcaggagaggtcgctggtgcctccgcggtccccgccgcgcgcagaactcggccgagtgcac

SEQ ID NO: 35562 - DNA, 72 bp, Homo sapiens
  misc_feature 1..72: note = chr14:103740539-103740611
  misc_feature 1..72: note = hyper
  source 1..72: mol_type = genomic DNA
cgcagcagccccggcaggcaccctccagcggccgtgggcgcctggtagctatggaggcggtagaggtggaaa

SEQ ID NO: 35563 - DNA, 35 bp, Homo sapiens
  misc_feature 1..35: note = chr14:103745329-103745364
  misc_feature 1..35: note = hyper
  source 1..35: mol_type = genomic DNA
cgcgaccgcctcctccgccccggctccgtgggatg

SEQ ID NO: 35564 - DNA, 212 bp, Homo sapiens
  misc_feature 1..212: note = chr14:103745577-103745789
  misc_feature 1..212: note = hyper
  source 1..212: mol_type = genomic DNA
gagtgggcaggaccacgctggacacgcagttcgcgtgcggccgctccccgagcagtgcgcggcgtgggcggaggagcggctccgcgaggagatcgaggcgaacgcggcgcccgcgttgctggaggtcgtggacgcggcgggcgccgagcacctggtcacgctccaggacctggacatccgccacggcgacggctccgcggtgctcccgggcg

SEQ ID NO: 35565 - DNA, 300 bp, Homo sapiens
  misc_feature 1..300: note = chr14:103989154-103989454
  misc_feature 1..300: note = hyper
  source 1..300: mol_type = genomic DNA
gacgcaggcgaacagcggccgctccgcgctcccgcggctcttaaggggcacaacgcgggccgcccattggcggctatttatagcccattcattccattggcccgcgccgcggggtggtgccgccgctttgtccgccgcccgcagcccccaacaccctggccgcccacccgagctgtcccctcgctgggaccccgcgcagcctgcccagtcccccgcccaagacctcgaggccgaaacctcaggtccttggatatctggatcccctcgcacgcccttgcctctgggcgggaaactgaggcg

SEQ ID NO: 35566 - DNA, 136 bp, Homo sapiens
  misc_feature 1..136: note = chr14:104601737-104601873
  misc_feature 1..136: note = hyper
  source 1..136: mol_type = genomic DNA
gccaggccataggtgcgcgctggcgccgctgaaaacgttctccttccctcgcctgtccaccttccaggtcctgctcaaggcgcctaatatcccctgggcagggtccctgacacttccttaactcccaaagaccttc

SEQ ID NO: 35567 - DNA, 140 bp, Homo sapiens
  misc_feature 1..140: note = chr14:104601963-104602103
  misc_feature 1..140: note = hyper
  source 1..140: mol_type = genomic DNA
cgaggctggggcagcccacaggaggagcgcgggacccgggcttgagtttgcacccaggcagagcgcccacccccgcccctagcttcggaccctgaaagtaaagtcgtcgtgcccggcagccagcccgaatcttccagccc

SEQ ID NO: 35568 - DNA, 466 bp, Homo sapiens
  misc_feature 1..466: note = chr14:104602310-104602776
  misc_feature 1..466: note = hyper
  source 1..466: mol_type = genomic DNA
gggccaggaccccaacgcgccgtgtcctcaggacagattggagggggaaggggctgcgattatgccccagtcggaagggttttacagcagccgcgctgccctctccctgccggatacccggcagtagacaccgacgtctgggggctagcgaggcaggtgggcgcggaccgcgacccgattctggcttccaacctccgcccagtggcgcgcggggccgtcgccccacacctccagtccgcgtggctggtgtctggctcgccgccggggcggaaggggcgctgtcggcgcaggcgggcggggccggagcgcgggggcgcgcggcgcggagcgagcgcagggctcgggggcgcggggcgcggaggaccgggggcttgacgggcggccctgcgcggtgcggggcgcggcggcggcgggcgcgcggccagtgaacgcgcgggcggggcggcggtggcgggaggcactaggg

SEQ ID NO: 35569 - DNA, 267 bp, Homo sapiens
  misc_feature 1..267: note = chr14:104603085-104603352
  misc_feature 1..267: note = hyper
  source 1..267: mol_type = genomic DNA
actttcccccattagcgttgtccaagtctccctctgccttcaaggctgtgtcccaaccggacccacccggaggctgtggctagggcggagagcgcagcgcagggattctcgggctcaccttgcgccttgctaggatgggcgaagtagggggtcggggcccctgactgatcgtgagcccccgaggtgactccagccttgtgcaccccgtgttctgcggatatgggatgtgagcttgtgcttcccgaagcgccgcggcggtagaagcgc

SEQ ID NO: 35570 - DNA, 488 bp, Homo sapiens
  misc_feature 1..488: note = chr14:104604185-104604673
  misc_feature 1..488: note = hyper
  source 1..488: mol_type = genomic DNA
acaagcaattaattccggagctgagttcccatctgccaggcctgctgacaacaggtccggcgcacgcccgcaggacctcccgcttcccgggcggcacggcgcgcacacccacttgcgggcacacgcgcggctgtaaagacacgtgccgttcgcagacgcgccgaggcacagatacgccggcgcggtcgctgcccggctcgaggcgcacaccgcggcgacactaacccacgcgcgacagttagacctaaagtggcccgcgacacgcagagtacgctgggcttgctggaaaggcgcctgggagtctcggggccggggtcccgccccttcctcggcccacctcgccgtgggccttgggcaagagcgtcccctccgcagcctcagttttcccgcctgtagagggaggggcgtcggcgcctcctgggagacgcgcagccctggtgtcccgggagaggggcgggaggcgcatgcgcgcgcgcaactagatcctc

SEQ ID NO: 35571 - DNA, 386 bp, Homo sapiens
  misc_feature 1..386: note = chr14:104604884-104605270
  misc_feature 1..386: note = hyper
  source 1..386: mol_type = genomic DNA
cccgagcgcgcccaccggagccaccgcgctcctcgcgacactcgcaggctctgcgaacttccgagcggctgggccgggccatgggggcgcctcggggccggatcacgtagccgcggcgcccccggagagccagcgtggccgggagcgcctgccgggctcttcccgcgccccggccatggtcggccgcggcgtccctctgtgcgctgcgcagcccgcggtacgcgcggcccggcctggagagggaggcgggcggcgggggcccgggacggcgaagatactcgcggtgtgcgctggatccctgggggccgggcctcctgctgagggtagcggacccgcaggcgggacctccggggatggagggagtgggtgagcgccagggtcgtgcc

SEQ ID NO: 35572 - DNA, 244 bp, Homo sapiens
  misc_feature 1..244: note = chr14:105070950-105071194
  misc_feature 1..244: note = hyper
  source 1..244: mol_type = genomic DNA
gtgaagagcaggcagcggccgcggaagtcgtggccgttctcggacagcgggaccaccaccacgaagctgaacaggaaggccaagaagtagcaggcgcactgagcgaaaaggaaattgttgagcgccatggccggcccgggcgagagcggcggcgggaaggccgcgggaggctgcgccgggcggggaggccgcgggaggctgcgcagtggcggcgccggcaggtcccgcgcgcccctcccgggac

SEQ ID NO: 35573 - DNA, 30 bp, Homo sapiens
  misc_feature 1..30: note = chr14:105292388-105292418
  misc_feature 1..30: note = hyper
  source 1..30: mol_type = genomic DNA
gaccgcaacccctggcgctggttggagggc

SEQ ID NO: 35574 - DNA, 437 bp, Homo sapiens
  misc_feature 1..437: note = chr14:105310006-105310443
  misc_feature 1..437: note = hyper
  source 1..437: mol_type = genomic DNA
cgctgctctgttacccggagccaggacgcgcatatattcccagaatccgcgctcagtgcgttcggtcccccgggacacctgttctctgcacaggcgcgtctgggcgcagcgggggcagacacgcgttcccgggcagcgactccggaaggcccgagggagtaaatctggccctcccggttcagcacaaagctcccctggccgcctttcaaaaccgaccgcctcccaactctccgcggacacgagtggcggctgcctcccctcccctcccctagggccgcgcacgcctcccgcagggtctcagtgcctcctgggcgggggataattcctgtccccaccggtgtcctgtactcgcggggtcccgggtgtaagttctgggtcccgggctggctccctggtgagcaaagccgcatcgctcgaattccagaaacccttctcgc

SEQ ID NO: 35575 - DNA, 349 bp, Homo sapiens
  misc_feature 1..349: note = chr14:105310485-105310834
  misc_feature 1..349: note = hyper
  source 1..349: mol_type = genomic DNA
cggaggtggatttcggaactcaggagagaagaatgagacgctccctagtacccctagtcccccaggggtgggaggggactgtatctcaaaataagattctgcaactcgacttttataggggaaaccaggcacgcatttcaaaatcttctcatccgtccccacctccttgcgccgcttttccgcgcctcctgtgccacggaagctgccctctgctcctgctgtttccagcccggcagcccccagacaggatctagcttggcccagccgggccctgcttcctctgcctggggtcctcaggccatgcaagtgaggaaacccaggctcagaggggccacgtaactcttcccaa

SEQ ID NO: 35576 - DNA, 220 bp, Homo sapiens
  misc_feature 1..220: note = chr14:105433940-105434160
  misc_feature 1..220: note = hyper
  source 1..220: mol_type = genomic DNA
ccaccgcactgggagcggctgttcctacactgcctgtagtggggatggagtgcagaggctcagcgagcggcagacctgcctctggccacagagctgcgcagtggggacccctccagtcactgggctggcaggagcctggcccaggaacacaaacaggaagggggaaatcctgcccgcctcgggataaggctgcgcagccaggctaccggcctcggacccg

SEQ ID NO: 35577 - DNA, 19 bp, Homo sapiens
  misc_feature 1..19: note = chr14:105434286-105434305
  misc_feature 1..19: note = hyper
  source 1..19: mol_type = genomic DNA
cgcccggcctccggttctc

SEQ ID NO: 35578 - DNA, 151 bp, Homo sapiens
  misc_feature 1..151: note = chr14:105512040-105512191
  misc_feature 1..151: note = hyper
  source 1..151: mol_type = genomic DNA
atgtgcaaaatgttccgcctgcgaaggttccgcggtggcggggacactgctccggctccgctcccgcccgcccgagcgctcggatggggccgcctctgcactgcgtggccacaggcgcggcccggctgcccacgggcgccctttgcagctg

SEQ ID NO: 35579 - DNA, 186 bp, Homo sapiens
  misc_feature 1..186: note = chr14:105714232-105714418
  misc_feature 1..186: note = hyper
  source 1..186: mol_type = genomic DNA
ggattagccccaggccgggaggctagaggccccacaaggagcgagcctgcgactgcgatccacaggcagagccacagaggcagggcgcgccctggggcccaagctccagggctgcaggcccagggccagatcctgacttgcccacccgccggctgtgtgaccttcagcgcgcgactaacctctctg

SEQ ID NO: 35580 - DNA, 197 bp, Homo sapiens
  misc_feature 1..197: note = chr15:23158330-23158527
  misc_feature 1..197: note = hyper
  source 1..197: mol_type = genomic DNA
cgccgggcgggtcaccgcaccccgagatgtgcccccaaggctctttcgaccgccgtgaagtggcgggcccccttgaagtggccggcggctgcccggctccctcgaggcgcctccctggcgctcgcaggggcctcgcagagccggcggggatcccaccgcggctcagtgtctagggccggtcccggcagccctctctc

SEQ ID NO: 35581 - DNA, 32 bp, Homo sapiens
  misc_feature 1..32: note = chr15:25915272-25915304
  misc_feature 1..32: note = hyper
  source 1..32: mol_type = genomic DNA
cccacgtggccagcccgcgtgagaaatccagg

SEQ ID NO: 35582 - DNA, 135 bp, Homo sapiens
  misc_feature 1..135: note = chr15:26107609-26107744
  misc_feature 1..135: note = hyper
  source 1..135: mol_type = genomic DNA
acagagaggccttggcggcgctgtggcttcggtcggcaccgggtcccgcgcagccgggccctccaccctgagtggagctgccttctaagcacccagcccctgccaatcactgtgcccaacaccaagttcccgggg

SEQ ID NO: 35583 - DNA, 482 bp, Homo sapiens; identical to SEQ ID NO: 4188
  misc_feature 1..482: note = chr15:26107845-26108327
  misc_feature 1..482: note = hyper
  source 1..482: mol_type = genomic DNA

SEQ ID NO: 35584 - DNA, 283 bp, Homo sapiens
  misc_feature 1..283: note = chr15:26108548-26108831
  misc_feature 1..283: note = hyper
  source 1..283: mol_type = genomic DNA
cggccccgccctcgttccgcgcccggactgggccacgccggatagcgggaaacaaaaaaagcccgagctggaaacttcagagaggtttagtttcgtttcccagaagcatcagttcggtcccaaaacgctgcaaacgcgcgctgcctgcagtaggagagaggaaaccgcgaagcgcgagaaaaggcgcccccgtccccaagcagcccgcgcgcccttccaggggccagacctgctccatcctggacggcgaaacgacctcgggagaccccggttaggaccttac

SEQ ID NO: 35585 - DNA, 23 bp, Homo sapiens
  misc_feature 1..23: note = chr15:26327541-26327564
  misc_feature 1..23: note = hyper
  source 1..23: mol_type = genomic DNA
ccctgtctgcgcctgcgcctgcg

SEQ ID NO: 35586 - DNA, 299 bp, Homo sapiens
  misc_feature 1..299: note = chr15:26327610-26327909
  misc_feature 1..299: note = hyper
  source 1..299: mol_type = genomic DNA
cgaaaggcggaggcagggctgggcgctgtggctgctggcactacccagttcttcagcagcgctgtgcctggaggcccccagcccctcgccccccggctcgcgggaggcggcaccagacctcctcaggccctggtccctaggaaactgcagcccggcctcagtttccagaaagctcctccgtgcgatttgggaagagcacggtttgaatggttgaaaatagaggggctgaagaaccgagccgcgcgggcctggctccggggctgagttccctagcgggcgccgagcggagcctgccatta

SEQ ID NO: 35587 - DNA, 30 bp, Homo sapiens; identical to SEQ ID NO: 12083
  misc_feature 1..30: note = chr15:27016662-27016692
  misc_feature 1..30: note = hyper
  source 1..30: mol_type = genomic DNA

SEQ ID NO: 35588 - DNA, 161 bp, Homo sapiens
  misc_feature 1..161: note = chr15:27017654-27017815
  misc_feature 1..161: note = hyper
  source 1..161: mol_type = genomic DNA
ggcgcggggcgcgggcggctctgaggactgggggctatcccaggaggggcgcgggcgaagggcccccactcccacccgccgctgctccgcggatgcggcccccgcctccctccgcccaggccgccgccgccgtgggtcgcgcttcccgcaacggccgcgcg

SEQ ID NO: 35589 - DNA, 45 bp, Homo sapiens
  misc_feature 1..45: note = chr15:27018284-27018329
  misc_feature 1..45: note = hyper
  source 1..45: mol_type = genomic DNA
gcggggagggaggagcgcgcgcgggcgcggggcgggggaggaggc

SEQ ID NO: 35590 - DNA, 63 bp, Homo sapiens
  misc_feature 1..63: note = chr15:27018746-27018809
  misc_feature 1..63: note = hyper
  source 1..63: mol_type = genomic DNA
gcctcccgacggtgcctgcagaacgccgggaagcccccgcctcacctgcggggctcagagcct

SEQ ID NO: 35591 - DNA, 146 bp, Homo sapiens
  misc_feature 1..146: note = chr15:27111977-27112123
  misc_feature 1..146: note = hyper
  source 1..146: mol_type = genomic DNA
caggcctctatcacccgactgctgacactgccctcccatccctgctctacaagcgggcggtggtgactacacgaggcgccgaagatgctgttgagggccctggagaaacttcagcagaacagggcctctccccttgcaggccgagc

SEQ ID NO: 35592 - DNA, 17 bp, Homo sapiens
  misc_feature 1..17: note = chr15:27113012-27113029
  misc_feature 1..17: note = hyper
  source 1..17: mol_type = genomic DNA
cgcgctcccagcccagg

SEQ ID NO: 35593 - DNA, 140 bp, Homo sapiens
  misc_feature 1..140: note = chr15:27113477-27113617
  misc_feature 1..140: note = hyper
  source 1..140: mol_type = genomic DNA
cgaggtggaagtacctgttgtgtctcccaattccggagtttgcgggggatgggggttgggggggcttcttgggaaaatgcttcttttcgaagcatactgttcggatgcctgtgagcacctatttgcgttatgcgcatact

SEQ ID NO: 35594 - DNA, 301 bp, Homo sapiens
  misc_feature 1..301: note = chr15:27212887-27213188
  misc_feature 1..301: note = hyper
  source 1..301: mol_type = genomic DNA
aacctggggcaaccacggagcagcggatgcgcgctgaagggcgcgtgggcagcggggtggttccgcggcctgcggggcgcagcgcgccaccgcgggatctgaaaggcgcttcctggcaacgctgctagggtcccgccgcccccgccgaggtgaagtccaacccgcagctgcgcgggcagcccaggtcttccccagaacctccggagccgaggacccagcgccaagccaggagcaaagcagcgcgccaggctggagctgttccgtcattaccgccacgtctgcgcttcggttgtgagaaccg

SEQ ID NO: 35595 - DNA, 177 bp, Homo sapiens
  misc_feature 1..177: note = chr15:27216067-27216244
  misc_feature 1..177: note = hyper
  source 1..177: mol_type = genomic DNA
atggctggaggaaggcggaccgcgggctcgctctcatggtgccaaccccggggacctttcttcaggctccctgcgggatccccagcctcccctccccctcggagctccgcccccttcctggcctcaaactccgagtccattcaaacctcgccttcctcgccctgcgcgttgtcaggc

SEQ ID NO: 35596 - DNA, 39 bp, Homo sapiens
  misc_feature 1..39: note = chr15:27216830-27216869
  misc_feature 1..39: note = hyper
  source 1..39: mol_type = genomic DNA
cggctgggctgcggcacggcgggccgggaggggactggg

SEQ ID NO: 35597 - DNA, 30 bp, Homo sapiens
  misc_feature 1..30: note = chr15:27603952-27603982
  misc_feature 1..30: note = hyper
  source 1..30: mol_type = genomic DNA
ctgcctttctccctacgtaggagggcctgg

SEQ ID NO: 35598 - DNA, 42 bp, Homo sapiens
  misc_feature 1..42: note = chr15:28339778-28339820
  misc_feature 1..42: note = hyper
  source 1..42: mol_type = genomic DNA
cgtgtgggctactgccggccctctctccggctctgcgctctt

SEQ ID NO: 35599 - DNA, 279 bp, Homo sapiens
  misc_feature 1..279: note = chr15:28340309-28340588
  misc_feature 1..279: note = hyper
  source 1..279: mol_type = genomic DNA
cacggctgagtgctccgggcatggtgggtctgcgggactcggagcagagctcgagctggcggatccccggttggcgcccggcgggagggcaggagtggcccagccaggccgccctgcgcactccccgcccgggtgcgcccgggggaccgcggccctcccaccccgcccctgtgaaacgacagccggcagcaggcgccgcacgccgacttcacagtggcggcgatcaacagcgtgtggaaaacagcttcttcgtaaatcttaagaacattgtggccgggc

SEQ ID NO: 35600 - DNA, 336 bp, Homo sapiens
  misc_feature 1..336: note = chr15:28341644-28341980
  misc_feature 1..336: note = hyper
  source 1..336: mol_type = genomic DNA
aggcctgaagaagcccgtccaggggtcagcctcctcctcagccggtcctgggctgagacaggggtgtcccgctgagggcagtgtagggtgcggtgcccccaccccacttcgggcctggaccgagaccgcgagtgtgaccgtatatcccttcaggtggatttttcaacatgtgaacttggttaaaagcttctagaacgttaagccaaacatcgtggctttccatccgttttctgttcttgtttgaaagagtacgcctccttccagcctgggaggaggggcggggcccgggagagggcctcgggaggccgcgggtgggctctgccgagggccgcgttc

SEQ ID NO: 35601 - DNA, 39 bp, Homo sapiens; identical to SEQ ID NO: 1196
  misc_feature 1..39: note = chr15:28341981-28342020
  misc_feature 1..39: note = hyper
  source 1..39: mol_type = genomic DNA

SEQ ID NO: 35602 - DNA, 40 bp, Homo sapiens
  misc_feature 1..40: note = chr15:28342521-28342561
  misc_feature 1..40: note = hyper
  source 1..40: mol_type = genomic DNA
cggccccaaggagctgagggagctccggcttgtggagtct

SEQ ID NO: 35603 - DNA, 54 bp, Homo sapiens
  misc_feature 1..54: note = chr15:28344134-28344188
  misc_feature 1..54: note = hyper
  source 1..54: mol_type = genomic DNA
cgcctggcagagagccggagggggtgctcagggggcagctgctgcaggcccagg

SEQ ID NO: 35604 - DNA, 73 bp, Homo sapiens
  misc_feature 1..73: note = chr15:28344223-28344296
  misc_feature 1..73: note = hyper
  source 1..73: mol_type = genomic DNA
cgtctgtgcacactaacctttaggggaacttgccttgcttcctaagccgcgactcagccggggctgtgtaaac

SEQ ID NO: 35605 - DNA, 78 bp, Homo sapiens
  misc_feature 1..78: note = chr15:28344614-28344692
  misc_feature 1..78: note = hyper
  source 1..78: mol_type = genomic DNA
gccccgcccacagctcgcccgctccgcacccccggcccctcagctccccagcccccggcggcgcgggctgagagcagc

SEQ ID NO: 35606 - DNA, 340 bp, Homo sapiens
  misc_feature 1..340: note = chr15:28351758-28352098
  misc_feature 1..340: note = hyper
  source 1..340: mol_type = genomic DNA
gcagggtgggggcaccgggcgcacgcggggaatttccccacgaccacggccacgccaaatgcctgaacctccacggctgccggcaacagcgagcgcagggagggggctgtgcgcgcgggggccctggtggcggagcaggcatcaccccgagagcgccgaggtttgtggtcgcaaccccgggagcaccgctgcgggaggagcggcgtggccgggcagaggcgacttcctcgcaggcagtaccgggccccgcggccgcctccgggcctgtcctggtgccccgggcttccacccggcgggctggcgtgcgggggctggtcttcgccgagatcctgctgggagc

SEQ ID NO: 35607 - DNA, 22 bp, Homo sapiens
  misc_feature 1..22: note = chr15:28352099-28352121
  misc_feature 1..22: note = hyper
  source 1..22: mol_type = genomic DNA
ggctctggccccacggtgagcc

SEQ ID NO: 35608 - DNA, 270 bp, Homo sapiens; identical to SEQ ID NO: 4194
  misc_feature 1..270: note = chr15:28352152-28352422
  misc_feature 1..270: note = hyper
  source 1..270: mol_type = genomic DNA

SEQ ID NO: 35609 - DNA, 43 bp, Homo sapiens
  misc_feature 1..43: note = chr15:28352957-28353000
  misc_feature 1..43: note = hyper
  source 1..43: mol_type = genomic DNA
cgacaggcggggagaaggcatggcccaccggctcaggagaaag

SEQ ID NO: 35610 - DNA, 158 bp, Homo sapiens
  misc_feature 1..158: note = chr15:29077236-29077394
  misc_feature 1..158: note = hyper
  source 1..158: mol_type = genomic DNA
tgagaaactgacttccgtaggagtgcgggtgtgcgtgcgtgccgcggaaatcccgccttctggcgcctgcggttgccccctggcctcagccggtaggctcccaagtaggaagataaaccgcattgcacgaagcgggagagtccagaggagcggcgaag

SEQ ID NO: 35611 - DNA, 196 bp, Homo sapiens
  misc_feature 1..196: note = chr15:29077428-29077624
  misc_feature 1..196: note = hyper
  source 1..196: mol_type = genomic DNA
cgccttgcgattggccctaagcgcgggtggctggggttgcgagaggcatcaggatccctggcggcgcctgagccagcggctgctaggaggctgtgtccgcaagccagcggggcgaggcgcctgggccctgcgcgtcaggtcccggcctggggcaccggggctgccagcgtcggaggaggtgcgggcgcggggttgg

SEQ ID NO: 35612 - DNA, 51 bp, Homo sapiens
  misc_feature 1..51: note = chr15:29077646-29077697
  misc_feature 1..51: note = hyper
  source 1..51: mol_type = genomic DNA
cgcggaccgcccgcggctcagcctccggtctctctccgtctctaagtggtg

SEQ ID NO: 35613 - DNA, 320 bp, Homo sapiens
  misc_feature 1..320: note = chr15:29130728-29131048
  misc_feature 1..320: note = hyper
  source 1..320: mol_type = genomic DNA
gccgagcaagcagggcgcggcggccggggcaaggtgcggagcctcgcgttcaccggctctacctgcggagcctcgcgttcactggctctacctgcgggaccagacccctgcagctccccagccagcacggccggggcacgcccgggaatctgtgtgctccccagggcccggggcgttcggggcgccgcgccttccagcgcctgggtcccagccccgatcccggagaccggcccggggggacccggggtcccgagtgcaccctcctgccctgcagactgtcccagcgccggggccagggggcgcaggacctcgcgcacgcc

SEQ ID NO: 35614 - DNA, 99 bp, Homo sapiens; identical to SEQ ID NO: 4198
  misc_feature 1..99: note = chr15:29131532-29131631
  misc_feature 1..99: note = hyper
  source 1..99: mol_type = genomic DNA

SEQ ID NO: 35615 - DNA, 152 bp, Homo sapiens; identical to SEQ ID NO: 4199
  misc_feature 1..152: note = chr15:29131755-29131907
  misc_feature 1..152: note = hyper
  source 1..152: mol_type = genomic DNA

SEQ ID NO: 35616 - DNA, 174 bp, Homo sapiens
  misc_feature 1..174: note = chr15:29407300-29407474
  misc_feature 1..174: note = hyper
  source 1..174: mol_type = genomic DNA
gagagctgaggagcccggcctacagaggggcccgctggggaccgggcagggaatttgggtctggggacagcagcagcaggccgggccgtctgtggtgctccccctggtggctctgtgaggctgagtgcgtggcgaccatccttgcagcctgtgggtgggcgggtgggtggaggg

SEQ ID NO: 35617 - DNA, 43 bp, Homo sapiens
  misc_feature 1..43: note = chr15:29407771-29407814
  misc_feature 1..43: note = hyper
  source 1..43: mol_type = genomic DNA
gaggcaggaggcggccggggcgttggaatcctttcagccctgc

SEQ ID NO: 35618 - DNA, 15 bp, Homo sapiens
  misc_feature 1..15: note = chr15:29407866-29407881
  misc_feature 1..15: note = hyper
  source 1..15: mol_type = genomic DNA
cgctgataaacaagg

SEQ ID NO: 35619 - DNA, 30 bp, Homo sapiens
  misc_feature 1..30: note = chr15:29561245-29561275
  misc_feature 1..30: note = hyper
  source 1..30: mol_type = genomic DNA
gtttctttggatctccgaaaattaaatgct

SEQ ID NO: 35620 - DNA, 524 bp, Homo sapiens
  misc_feature 1..524: note = chr15:29861915-29862439
  misc_feature 1..524: note = hyper
  source 1..524: mol_type = genomic DNA
gacagtcactttaatcgagacgtctttcttctatggagatttgttcaccactggcttctctgatttggtggttaagagtctgaaaatcggtcatccttaaggtctggagctcagaaagcacgccgcccccccttgcctgccccctgccccaggacgccggatgcgggtcgcctgcccagtcccgtcgcccacaaaccacgccgttctgggcggacgcgggaaaccagaagtccccgaagccaagtcagcgagcgaccacaggggccgcccggccgatccccgatatccgggctgacccaaaacccgacgggaggcgcccctcccccgcccccccaccccaccccccacccccaccgcccccggtcagggccgccgcgagggtgagaggcgcgcccacatgctgctccgctccgggttcggctcccacctcctcgcctcggccgcggccgctcggatggcgaggtcgtgtccccggcgcgcgcggtccccggcgctccctccggccgctgcgggctcggaggacg

SEQ ID NO: 35621 - DNA, 43 bp, Homo sapiens
  misc_feature 1..43: note = chr15:29863048-29863091
  misc_feature 1..43: note = hyper
  source 1..43: mol_type = genomic DNA
cagggctgcggcggccgcgcgccgggagcgggccgggccgggc

SEQ ID NO: 35622 - DNA, 70 bp, Homo sapiens
  misc_feature 1..70: note = chr15:29863540-29863610
  misc_feature 1..70: note = hyper
  source 1..70: mol_type = genomic DNA
ttcagagcctggggacggctcgggatgggcgcgcggggcgctgaggacggggagacgggctgggagcaga

SEQ ID NO: 35623 - DNA, 90 bp, Homo sapiens; identical to SEQ ID NO: 12105
  misc_feature 1..90: note = chr15:30260547-30260637
  misc_feature 1..90: note = hyper
  source 1..90: mol_type = genomic DNA

SEQ ID NO: 35624 - DNA, 331 bp, Homo sapiens
  misc_feature 1..331: note = chr15:30260871-30261202
  misc_feature 1..331: note = hyper
  source 1..331: mol_type = genomic DNA
cagcttcctcttgagcggcaggaggctgccgcggttggagggggtgacgccgatggccatctgcagcaccgtcaggtatttctggtacttcatcttgtccccgctccgctcgcgggcagggccccgccgcctccgccgccgccgcagacacagcccctccaggcgccgcatagatcagctctgggccatccgccgccaccacagctcccaccgctcccgcgcccgccgcacccgcagctgcggccgtgcgtggcccgggctcccgctcccgccgccgccgtcgccgtgcgtgcccggccgctcccgccgccgccgccgtgcgtggcccgca

SEQ ID NO: 35625 - DNA, 181 bp, Homo sapiens
  misc_feature 1..181: note = chr15:31775293-31775474
  misc_feature 1..181: note = hyper
  source 1..181: mol_type = genomic DNA
gacttgtttcctatccgtctactacctgagtggcgtcagtgtaggttcaggcaccattaggaacgtttgaccaaacacgtacacggcactgacagaggaggcgccggccttccggtggaccagggcatgtaaaaaagacaccgacacaatggaaaagaaatcctcgaaggtagaacctcgc

SEQ ID NO: 35626 - DNA, 155 bp, Homo sapiens; identical to SEQ ID NO: 4201
  misc_feature 1..155: note = chr15:31775483-31775638
  misc_feature 1..155: note = hyper
  source 1..155: mol_type = genomic DNA

SEQ ID NO: 35627 - DNA, 105 bp, Homo sapiens; identical to SEQ ID NO: 4202
  misc_feature 1..105: note = chr15:31775678-31775783
  misc_feature 1..105: note = hyper
  source 1..105: mol_type = genomic DNA

SEQ ID NO: 35628 - skipped

SEQ ID NO: 35629 - DNA, 67 bp, Homo sapiens
  misc_feature 1..67: note = chr15:32162215-32162282
  misc_feature 1..67: note = hyper
  source 1..67: mol_type = genomic DNA
acgcagtcacagctccggtgcccggcgagcggcctcgcgcgcggctcggggccgggccctgcccggc

SEQ ID NO: 35630 - DNA, 130 bp, Homo sapiens
  misc_feature 1..130: note = chr15:32322366-32322496
  misc_feature 1..130: note = hyper
  source 1..130: mol_type = genomic DNA
gcttctggctgagagcgggagcgggctgagtggggacaaagaacgcaagggagaggtagagcctggccttgggcagcccctggcctggccagaggcgcgaggccgagagcccgctcggtggagactgggg

SEQ ID NO: 35631 - DNA, 129 bp, Homo sapiens
  misc_feature 1..129: note = chr15:33009633-33009762
  misc_feature 1..129: note = hyper
  source 1..129: mol_type = genomic DNA
gggcgccggggtcagcgccctcgaagttgggggcctcgggcggggccgccggggagccacgacggccgctcgaccagagcatcccgcagtcccgttccctccagaggggaagaatggccgaatctggca

SEQ ID NO: 35632 - DNA, 578 bp, Homo sapiens
  misc_feature 1..578: note = chr15:33009821-33010399
  misc_feature 1..578: note = hyper
  source 1..578: mol_type = genomic DNA
cgcaggcgatgccgggcggccgacagggaaagcccagacctggggcagagaaggaatgaggggccgccagccggggggatttcctcccgctcttccctctccaacgggagcggaaaatgtgatttgctgtgcattccaggcgcggttccctggggtgacctctcccagccggcccgggcggggggagcagacaaagaggcgaggcgggcggagaggggaccccgcggggaagcaggaggggtgcggggggcgggggcagtaccgggaaagggggcggatagcgggtctggcggcggcggcggcgcctggccaatggagaggcgcggccccgggcgccgcgctctgccgccggcatttaaacgggagacggcgcgatgcctggcactcggtgcgccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacaggtgagcgcggacgcacccggcagggatgtgagtgggc

SEQ ID NO: 35633 - DNA, 276 bp, Homo sapiens
  misc_feature 1..276: note = chr15:33010400-33010676
  misc_feature 1..276: note = hyper
  source 1..276: mol_type = genomic DNA
gagggaagagggccgcaaaccaacccaggacccgctcagttccacgcgcggcagccctccgtgcgcgcaggctcgggtgcgttgttcgcgggggtgaattgtgaagaaccatcgcggggtccttcctgctgaggccgcggacaccgtgacctcgctgctctgggtctgcagggaaacgtaggaaaaaaagttgtcaggagcgggcaggatgacccccacatcccgtttccacctcccggaggcccccgaacacgctcctggtgctggtggcagcag

SEQ ID NO: 35634 - DNA, 446 bp, Homo sapiens
  misc_feature 1..446: note = chr15:33010720-33011166
  misc_feature 1..446: note = hyper
  source 1..446: mol_type = genomic DNA
cgccagagcgcaggagcatccggacctgctagtcggccgctgactgcgcggcgagttgccttgagagggtcccatgtgcttggggcgccgcgctgggtctgggggcgtcttggggcgcccattggagtccgcgggttggagcatccggagaatccatgatgtgtgcatttgccgatccccgaggtgagatggagactggcaagggcagagccgctgtgttcagccacagcggaaaaccgaacggtgggtaatccgacagctgcggtgcggggcgcggccctggccgcggggtccagcgaacccgcagtgctcacaaggcagacaccacacgcgctcgcggaccggccacgcactcgcgggcgctcgcttctctactccagcctcttccccgccccgcgcacgcccgggctgaatggtagacgttctggcgccgggcagcggccacc

SEQ ID NO: 35635 - DNA, 202 bp, Homo sapiens
  misc_feature 1..202: note = chr15:33011167-33011369
  misc_feature 1..202: note = hyper
  source 1..202: mol_type = genomic DNA
gctggttcccacttccgcgcgcaccccttaaactgtgttctagaggccccagcctcgccttgcagcgcctcactagctcctgaggactagggactggcggctgaggcgggttggcggctgcaacgagctgggcgtctttcgttctctctcgctgcctggctggctccgctggcccctccacagcttgcggagcaaggccata

SEQ ID NO: 35636 - DNA, 41 bp, Homo sapiens
  misc_feature 1..41: note = chr15:33011630-33011671
  misc_feature 1..41: note = hyper
  source 1..41: mol_type = genomic DNA
tccctaatgcattcccgggtcgaatccgtctactgccttcc

SEQ ID NO: 35637 - DNA, 30 bp, Homo sapiens
  misc_feature 1..30: note = chr15:33486950-33486980
  misc_feature 1..30: note = hyper
  source 1..30: mol_type = genomic DNA
acaggccacaggccccgccttcctagcacg

SEQ ID NO: 35638 - DNA, 808 bp, Homo sapiens
  misc_feature 1..808: note = chr15:33602801-33603609
  misc_feature 1..808: note = hyper
  source 1..808: mol_type = genomic DNA
ttaggggacatcctccggtcgccgcggggcgcgcgcctccgctgagtgtgcggtgcggtacccagcggtgcgggggaggctccaccgcgccagcccagggcccccgcaccgcccccgccagctcgacgcgcccagcgttgcgctctccacggagcgggcggccgcagcgcacttggctggggcgagaggcgagaggggtgggcggactgcttggttggcgttggcgctctgcagtgcagtggagtgttagcccagctccctatatggtcggggattagcttggcgctgctgaggctgaggctgagccaggagctggaggaggaggtggaggacgaggacgaaaaggaggaggagaaagagcgcagcagcagtcagcgcacgccgagcggctgccgggggaagcagaggcgccggaggctggggcaccgccgacgcctcgggagccatggccgaagggggagaaggaggcgaggacgagatccagtttctgaggactgtgagtctccgcggcgggggcgaggccgtgggcaggtggggaggagcgcggagcgcggcgaggaggggctggctgcgctgcgccgcggtgccgggtgcccggtgccgggcgctttctccgcacccgcgggctgcagaggcggaccggccacctacccgcggggccgcgaggggctgcgtgggaaggggcaccatctcctgcctctcccttgttcccctaccgccacccctgccccaggccctccacctaggaccgctcgctctccaggcaacttgctacttggtctgaaacccttgatgcccaaacttcagc

SEQ ID NO: 35639 - DNA, 128 bp, Homo sapiens
  misc_feature 1..128: note = chr15:33603647-33603775
  misc_feature 1..128: note = hyper
  source 1..128: mol_type = genomic DNA
cgttggaagccctcgccccggggtcggccctctgacacctccatactccaccccagccccattcctcttccagggcgcccccacgcacaggggaacctccgggaaggagccagcggggcaggggggag

SEQ ID NO: 35640 - DNA, 772 bp, Homo sapiens
  misc_feature 1..772: note = chr15:34728851-34729623
  misc_feature 1..772: note = hyper
  source 1..772: mol_type = genomic DNA
gggcttaccaaggcccgccgcccgacccatggagccctgcttggggaccgggggcctcgatgttctccttcaccatctgcggccagatctccctccagcagccttgccaggcagtgcctggcgtggagaaggggccctgcagaggcgcaggtccgcaccgtgcccccaacccggcgcctgcagcccaggggcaacaaggtgtggggtttttgagtttttccctctgggccttattatacagggaaagggaaggggcgaagatccgggctcgagttctcccagggaagtgaacccagaggcgatcccaaactcagtagttgccgcccggcacggggacttgatgccggcgccaagccgggcagcggaacgcaccagcggcccgaccagcccggcgagacgcgagcgggcggccccgccagacagcgccacttgccggcgccgagagtggcccctcgccgcggtgagcccctcccgggatgcgaaagccatcgcctagtccccgccgcacccgcccgcccatcgtgggaggaggatgggccggtccgagaggcgtaaggccgccgggctgcacccctagatcccagcggcggcctccccgcagccccgccgagtccggggggcagcgctcgggagctcttggcccgcagcttacgcgccgccccccacgcgtccgggtccccgcggcgccgcgggcggcccaaggctgccgccgccagcgagtcaggcagccgaggttccccagcttacctggccagggcgcggggctgccccg

SEQ ID NO: 35641 - DNA, 89 bp, Homo sapiens
  misc_feature 1..89: note = chr15:34729954-34730043
  misc_feature 1..89: note = hyper
  source 1..89: mol_type = genomic DNA
gagctcgcgcctagccgcacacctcgactgctgattagcccgacagctgaatagcggcgggagcctaccgcgagcggagtacggaaagc

SEQ ID NO: 35642 - DNA, 388 bp, Homo sapiens
  misc_feature 1..388: note = chr15:34786556-34786944
  misc_feature 1..388: note = hyper
  source 1..388: mol_type = genomic DNA
gccgccgcggggacccgccacccacctcccggggccgcgccgcggcctcccgtccaccgccaccatgaccgccaacggcacagccgaggcggtgcagatccggttcggcctcatcaactgcggcaacaagtacctgagggcggaggcgttcgggttcaaggttaacgcgtcggccagcagcctgaagaagcagcagatctggacgctggagcagccccctgactaggcgggcagcgcggccgtgtgcctgcgcagccacctgggccgctacctggcggcggacaaggacggcaatgtgacctgcgagcgcgaggtgcccggtcccgactgccgcttcctcaccgtggcgcacgacgacggccgctggtcgctgcagtccgaggcgcac

SEQ ID NO: 35643 - DNA, 241 bp, Homo sapiens
  misc_feature 1..241: note = chr15:34787232-34787473
  misc_feature 1..241: note = hyper
  source 1..241: mol_type = genomic DNA
cgccccgagccggccactggctacacgctgcagttccgctccggcaatgtggccttccgcgactgcgagggccgttacctggcgccgtcggggcccagcggcacgctcaaggcgggcaaggccaccaaggtgggcaaggacgagctctttgccctggagcagagctgcgcccaggtcgtgctgcaggcggccaacgggaggaatgtgtccacgcgccagggtatggacctgtctgccaatc

SEQ ID NO: 35644 - DNA, 34 bp, Homo sapiens; identical to SEQ ID NO: 12120
  misc_feature 1..34: note = chr15:34806507-34806541
  misc_feature 1..34: note = hyper
  source 1..34: mol_type = genomic DNA

SEQ ID NO: 35645 - DNA, 378 bp, Homo sapiens
  misc_feature 1..378: note = chr15:34806978-34807356
  misc_feature 1..378: note = hyper
  source 1..378: mol_type = genomic DNA
ctacggcgggaggggcgcggaaggggagcctgtccggagccgctgtcacggccgcgactacccagcggggccgcccagccgagctttcgcgactctgcctctgcctgccgcctggacccttgtgggagcgcggctggaaaatggcaagggcacggaggccttggcgggagctgtgtggcggcctggggggctgctccctttgtaaccgactccacccacaggaggcgcggctcctgtcaagccgcagcttcaaagggcaacataaccactgcccccactaccgcctgggaaagggctgcccctaccctgcccccgtcaccctcacccctcacccctcaaccaggcgggccctgcgcgcaccagtttcggcgggtgcac

SEQ ID NO: 35646 - DNA, 40 bp, Homo sapiens
  misc_feature 1..40: note = chr15:35014171-35014211
  misc_feature 1..40: note = hyper
  source 1..40: mol_type = genomic DNA
gctgagctggtgacccgggcaggaccggagccaaaggatt

SEQ ID NO: 35647 - DNA, 46 bp, Homo sapiens
  misc_feature 1..46: note = chr15:35047103-35047149
  misc_feature 1..46: note = hyper
  source 1..46: mol_type = genomic DNA
ttcctgctacttcagcgggcacctggcgctccggcgcggcagcctg

SEQ ID NO: 35648 - DNA, 424 bp, Homo sapiens
  misc_feature 1..424: note = chr15:35047293-35047717
  misc_feature 1..424: note = hyper
  source 1..424: mol_type = genomic DNA
cgtcggagcccgaggggccggggacgcgcgcggggggagaggggcaagagtcctggaggcccggcggggagcggggcgatttcgaaaggaaggactgcagcgcccctcggggcttctcggggagcccaggtaacctcacctgaccgccagacccaagcaggcggagggggagccgggagcggacgcgtgggtgagtggggaggggagtgagtaggtatcttctcttctctcggtgcatccctcaccttttcgctttttgcctcctggagacaactgaaattccttccctagatggagatgctggctgagggagggcgagtgggggcgaccacttttaaatctcccttaggggacagagtggctgagagtgcttctgcagagtggctgcggttcggtgcctctgtggatccgacagtgaagtgag

SEQ ID NO: 35649 - DNA, 44 bp, Homo sapiens
  misc_feature 1..44: note = chr15:35087666-35087710
  misc_feature 1..44: note = hyper
  source 1..44: mol_type = genomic DNA
caggcgaggagtgaacgcggagggccgggcgctgactcaccgtc

SEQ ID NO: 35650 - DNA, 30 bp, Homo sapiens
  misc_feature 1..30: note = chr15:37175266-37175296
  misc_feature 1..30: note = hyper
  source 1..30: mol_type = genomic DNA
aaatgtcaaagacatcggttattttggtgc

SEQ ID NO: 35651 - DNA, 291 bp, Homo sapiens; identical to SEQ ID NO: 1200
  misc_feature 1..291: note = chr15:37180507-37180798
  misc_feature 1..291: note = hyper
  source 1..291: mol_type = genomic DNA

SEQ ID NO: 35652 - DNA, 44 bp, Homo sapiens
  misc_feature 1..44: note = chr15:37394668-37394712
  misc_feature 1..44: note = hyper
  source 1..44: mol_type = genomic DNA
aggggctggcagaggcgcggatagcgcgacgccagggagagggg

SEQ ID NO: 35653 - DNA, 60 bp, Homo sapiens; identical to SEQ ID NO: 12125
  misc_feature 1..60: note = chr15:37403027-37403087
  misc_feature 1..60: note = hyper
  source 1..60: mol_type = genomic DNA

SEQ ID NO: 35654 - DNA, 110 bp, Homo sapiens
  misc_feature 1..110: note = chr15:37403115-37403225
  misc_feature 1..110: note = hyper
  source 1..110: mol_type = genomic DNA
cgagttctgagaccttggcaaacttccctcccccaaccgccggcgtgacttctgagttgtcactaatccgaacctgatattcaccagagctccttcggtcaccgacaacg

SEQ ID NO: 35655 - DNA, 59 bp, Homo sapiens
  misc_feature 1..59: note = chr15:39873175-39873234
  misc_feature 1..59: note = hyper
  source 1..59: mol_type = genomic DNA
ctggcccccacctcccgcttcctgcccggccgccgcccattggccggaggaatccccag

SEQ ID NO: 35656 - DNA, 30 bp, Homo sapiens
  misc_feature 1..30: note = chr15:39873453-39873483
  misc_feature 1..30: note = hyper
  source 1..30: mol_type = genomic DNA
aggaccaaagctgcccgggacatccacctg

SEQ ID NO: 35657 - DNA, 483 bp, Homo sapiens
  misc_feature 1..483: note = chr15:40211761-40212244
  misc_feature 1..483: note = hyper
  source 1..483: mol_type = genomic DNA
cacccaggagcattccgccggggccatctgaggagggggactcccgcctggatcccgctccatcctcgggccacgagaaagccctatttgaactcttctgctcccgcgtgggggctggagtccaccgtccctgcttaactacactgcagctacccgggatccttaagcttccttcaactctctgcactttgccaggcacccgaaacccacggcggctgggcggccctgctcccggctctccgagcctgtaccctcggggaggcccggtccggaggcgccccgcgggaggcttaccgagcagcgagcctatgaagatgacgacctgcacggtggtggtgaactggcggtacagctgcgcctcgccgaactccccgagcgcgctgcggttcacacccgcagcctcggcgccggacgcgttgtgcggctcgctggcatttggagagatccagctcccgttatgtcccatggcgaggctgggactcc

SEQ ID NO: 35658 - DNA, 30 bp, Homo sapiens
  misc_feature 1..30: note = chr15:40212680-40212710
  misc_feature 1..30: note = hyper
  source 1..30: mol_type = genomic DNA
gacccctctccttagcgggaggagaacgtt

SEQ ID NO: 35659 - DNA, 660 bp, Homo sapiens
  misc_feature 1..660: note = chr15:40544738-40545398
  misc_feature 1..660: note = hyper
  source 1..660: mol_type = genomic DNA
ccctgaaatcaaaatcgcggtcaggtgaagccggcgctgcaccaacgtgtaagcgcggcccctcctcggcgttcccgcgccgaggtccctcccgcggagggcgggcccggctcccacgacctcttcgagcgttcctgggcttcccgctccgcaggtgggttccccggctgccccggaggttcgcggcgagaggacgggcctcccaacacgcgcagcccccttcctgggtgcccatgccccgaagttcgggaccagccggcgccaggcgaggggccttgggcgcaggcatctggagctccgcgtccctggagcgggacctccctccgcgggcgcccgcccggcgcggggcattcgcgtccccgagagggcgcagcagtggggcctgcgagctggggccgggtggccgcgccgggtcggagtgtggctggagaggggccgccccggaagcggtgctgcgcccaacgtccccttctccccgtaagccccgcaaggagcctgccgcctcttgcacctgagccaggagttcagtcgggaggcgggcgcggagcggttcccagcgcctggacgtcagccagtcgcaacacccgcgggaacacttgctacatttgccataatgcatttctgatctgtttccgcgcaggcctgcggaggactggccca

SEQ ID NO: 35660 - DNA, 284 bp, Homo sapiens
  misc_feature 1..284: note = chr15:40575513-40575797
  misc_feature 1..284: note = hyper
  source 1..284: mol_type = genomic DNA
gagcggttcctcctccgcgctcccctgggaatgcggcggcggttgcggggcgggggcgggggctgctcgccgggggccacatgcacccaaccgggccaatcccaaagtcgcagtcttctctccccgccctccgcccccaaccgagtcggtgccctcggctccttagaaactggcgggacctcggcctcgtcggggaagactgaaagctgcccccatcggtccagggtgaaaggaattgggaccccatgagcgcagaactggaccacgcgcgagctaggggtggc

SEQ ID NO: 35661 - DNA, 156 bp, Homo sapiens
  misc_feature 1..156: note = chr15:41787106-41787262
  misc_feature 1..156: note = hyper
  source 1..156: mol_type = genomic DNA
gccgtctgctcccagcgcccgcacgaggcgtggacgcaggggagggaggggcgtgggcctgggagctctggctgggagcggaacgcagcccacccagtgcgcgccctgcctcccatcttcccggctcgccgctcctgagcgcggcagagaggggcg

SEQ ID NO: 35662 - DNA, 1079 bp, Homo sapiens
  misc_feature 1..1079: note = chr15:41804733-41805812
  misc_feature 1..1079: note = hyper
  source 1..1079: mol_type = genomic DNA
gggtaagggctaactcggtggcgactactgccaccttgaagggcactcaaggtggacctccccgcggaatagtccaagacgcaagtcggtgcgcacgtggacttcgttaccctgagggtgaaacctccaactagcaggtcactgtccaccctacctccgccgtgcacttacagatactggccagggcccggcacgcgccacagctgcacgcctctcagctgcccggcggcccccacggtcaccaccacgctggtccccgcgtacgccccgtcacattgtgtctgtgtgggcccatgccggccgctggccccgcaggtagaaaacagccaagacccctcggtgcctgagagcaaggagcgaggcaagggtcgtcgagcccctggctgggccagaggggtctggtatggtgagcgaaagaggaaggaggcgtctaaagctcacccggagaattcagcggggaggctggctccaagatactaggcggggcgctgactttcgggtcccgggggctgggacttgccagcggcaggggcgaggaccgcagaaaagtctcctgggaccccgggctagagcagagaatggcgcctgaaaggtgttgggagaaggcgcaggacgttaaggcgggtggaaataggatatgaaagaaagagagaaccccgcaacagctgcccttgcggtcgcggccacacccgtcacccggcccagccgcgctctcagcctggaagccactacccgactccggtcgcagaagccccgcgggtgcgcgctgataggtctgccagtttctctcctcgagcgcctttcccagtgaataacttaggggccgcaatgaatttggtcctgcagcctccccaatgctttcctcaacttagattggtggccccgccccaaggcggtgctgagaccccaaagaatgttcctccttcccaagctgcgtgatccagactctgggattcgcacgcacttggcgcttctcggcccgcactccagaagcacggaccggagaaatttggctgtgagagttcgaggcctctggaggaaccactgacacctggcctgttgaccggccacccccaagc

SEQ ID NO: 35663 - DNA, 54 bp, Homo sapiens
  misc_feature 1..54: note = chr15:41877632-41877686
  misc_feature 1..54: note = hyper
  source 1..54: mol_type = genomic DNA
accagcgcctttgtccgcggcgcagaagggccccagctgcggacagagccggcg

SEQ ID NO: 35664 - DNA, 45 bp, Homo sapiens
  misc_feature 1..45: note = chr15:41913327-41913372
  misc_feature 1..45: note = hyper
  source 1..45: mol_type = genomic DNA
gggacacgaaaggaacgcccgggaggtgagcgccaggagatcggg

SEQ ID NO: 35665 - DNA, 218 bp, Homo sapiens
  misc_feature 1..218: note = chr15:41913733-41913951
  misc_feature 1..218: note = hyper
  source 1..218: mol_type = genomic DNA
tccgggacccgcgagcggagcggcgcgtgggtcggttgcggtcggccccggcaggtatgcgcaggcgccttgcttgccacgcgctacgcccgtccccacgcgcctggtggcgtgttcttggcgcgaagtgttaagagtctgggtgtttttgtgcgttggggggaaggagagggtggcgggggcgggggggcgctgaggcgtcacgtggacgccacagc

SEQ ID NO: 35666 - DNA, 320 bp, Homo sapiens
  misc_feature 1..320: note = chr15:41952475-41952795
  misc_feature 1..320: note = hyper
  source 1..320: mol_type = genomic DNA
ctgctgctctggggccgtttggactcctggtgttgggggaggggtcagggaggtgctgctcgcgtctccttttgcgcctgcgcggcgggctccgagcgggtaggagcgcgtgcgcggtgacgtggacgtccggtgcgcgcgcgcaggctcttcagctggagcggacacacggtgtgcgaaccgaacagaataacccgcccccagcgggatgtgaaggactccgggtgaggccggccacgccccgcacggtaactctcgggcctgggtggagggcatcgcttagtactggcccgattggagtttttcgagagtttgaagct

SEQ ID NO: 35667 - DNA, 30 bp, Homo sapiens
  misc_feature 1..30: note = chr15:42868444-42868474
  misc_feature 1..30: note = hyper
  source 1..30: mol_type = genomic DNA
gtttctttctatgctcgacagctgatttaa

SEQ ID NO: 35668 - DNA, 57 bp, Homo sapiens
  misc_feature 1..57: note = chr15:43810817-43810874
  misc_feature 1..57: note = hyper
  source 1..57: mol_type = genomic DNA
ctgcagctgcccaaacggtccccctccccttctgcctcactgcggagacacctgccc

SEQ ID NO: 35669 - DNA, 170 bp, Homo sapiens
  misc_feature 1..170: note = chr15:44486726-44486896
  misc_feature 1..170: note = hyper
  source 1..170: mol_type = genomic DNA
gaaaagccagccatacgtccttgcccgggcagagagccaaagcctgcgcccccgacggggcggccgggctaggagcctaccgccctacccgcctccctccgggcgccccggaaaggtgcaccttactcgggcgggctcgaggaaccaggacggggcgccctcacccaggg

SEQ ID NO: 35670 - DNA, 82 bp, Homo sapiens
  misc_feature 1..82: note = chr15:45403599-45403681
  misc_feature 1..82: note = hyper
  source 1..82: mol_type = genomic DNA
cgttctgcccggtggcggggtcgggcgccgcccacatgagcagggggttctgcgagtctcgggggaaagcggggtcgggccc

SEQ ID NO: 35671 - DNA, 202 bp, Homo sapiens; identical to SEQ ID NO: 1202
  misc_feature 1..202: note = chr15:45403798-45404000
  misc_feature 1..202: note = hyper
  source 1..202: mol_type = genomic DNA

SEQ ID NO: 35672 - DNA, 80 bp, Homo sapiens
  misc_feature 1..80: note = chr15:45404102-45404182
  misc_feature 1..80: note = hyper
  source 1..80: mol_type = genomic DNA
cggggcaaccgggcgtttccacgctcaccacgtcggaaagaacatggtagcctgcgggcatggggcgccaatacgtgaca

SEQ ID NO: 35673 - DNA, 128 bp, Homo sapiens; identical to SEQ ID NO: 12136
  misc_feature 1..128: note = chr15:45405031-45405159
  misc_feature 1..128: note = hyper
  source 1..128: mol_type = genomic DNA

SEQ ID NO: 35674 - DNA, 67 bp, Homo sapiens
  misc_feature 1..67: note = chr15:45405416-45405483
  misc_feature 1..67: note = hyper
  source 1..67: mol_type = genomic DNA
tcccgctgagctgcacggcgaaatgaccttccagtctcagggagccgcttgccgcacctctccccgc

SEQ ID NO: 35675 - DNA, 239 bp, Homo sapiens
  misc_feature 1..239: note = chr15:45406627-45406866
  misc_feature 1..239: note = hyper
  source 1..239: mol_type = genomic DNA
agcagcccacctccacgcttccttaacggagaggtgcaggactcagacttcaccagcccactcggtcccagccttgtacgcaaagagacgccaaggacgcgctctcccgcgtccaggcagccccagcttgctggcttgcctgcccgcctgcgtgcagcactcggccggcgtgcagcatgaccctgtggaacggcgtactgcctttttacccccagccccggcatgccgcaggcttcagc

SEQ ID NO: 35676 - DNA, 28 bp, Homo sapiens
  misc_feature 1..28: note = chr15:45406867-45406895
  misc_feature 1..28: note = hyper
  source 1..28: mol_type = genomic DNA
ttccactgctcatcgttattctagtgtt

SEQ ID NO: 35677 - DNA, 296 bp, Homo sapiens
  misc_feature 1..296: note = chr15:45421385-45421681
  misc_feature 1..296: note = hyper
  source 1..296: mol_type = genomic DNA
tcctctcctaactcacgtaaggacccggctgtgaccggacaaaccgggtctggggtgcttccagtcactcttcaagtcactcccaaacttctcagactgcacccgaggctctgcggcgccgcctccctctcccggcctggtacagagaagggctgggtgcgccaggacagtagtaccggggtctgccagctccgcagaggtccctccaatcccccctcctcctctgcgcccccccacccatgcccagcaatcccagcagctccagcgcaaacctagcgacgcagttccgggtctgg

SEQ ID NO: 35678 - DNA, 140 bp, Homo sapiens
  misc_feature 1..140: note = chr15:45421706-45421846
  misc_feature 1..140: note = hyper
  source 1..140: mol_type = genomic DNA
cggtgggacccccaagacctcacgaggatccccggagggagacgtgactccggggtcttagaggggtttaggtcggatgggtgacttgctttgacgcctggcctggtctgtgggtggcaggtgatcgatggccttggact

SEQ ID NO: 35679 - DNA, 351 bp, Homo sapiens
  misc_feature 1..351: note = chr15:45427369-45427720
  misc_feature 1..351: note = hyper
  source 1..351: mol_type = genomic DNA
cgcatcccgcccggagaccccatgttcgaccccgaccagcgcggggacgtggtgctgcccttccagagaagccgctgggaccccgagaccggacggagtcccagcaatccccgggacccggtgaggcggggaaggcggcgggaagggaccgcaccccagccaggtgggacctgggcttcgggcctggcagggcctggaggggagaggcgcccactccccagccgcggacacccgccgggccccggccttccctagctcgccgccgcccatcgacccgggctcacccgccgcgtgccccgcaggccaaccaggtgacgggctggctggacggcagcgccatctatggttcct

SEQ ID NO: 35680 - DNA, 82 bp, Homo sapiens
  misc_feature 1..82: note = chr15:45427771-45427853
  misc_feature 1..82: note = hyper
  source 1..82: mol_type = genomic DNA
cggggcccgaccccgcttttccccgagactcgcagaaccccctgctcatgtgggcggcgcccgaccccgccaccgggcagaa

SEQ ID NO: 35681 - DNA, 71 bp, Homo sapiens; identical to SEQ ID NO: 1203
  misc_feature 1..71: note = chr15:45479446-45479517
  misc_feature 1..71: note = hyper
  source 1..71: mol_type = genomic DNA

SEQ ID NO: 35682 - DNA, 59 bp, Homo sapiens
  misc_feature 1..59: note = chr15:45479774-45479833
  misc_feature 1..59: note = hyper
  source 1..59: mol_type = genomic DNA
gggggcgacaggggtggcgagggcggcggagccggacgaccccccggagtaggggtctt

SEQ ID NO: 35683 - DNA, 78 bp, Homo sapiens
  misc_feature 1..78: note = chr15:45670588-45670666
  misc_feature 1..78: note = hyper
  source 1..78: mol_type = genomic DNA
tccgatgtagtgcaccgcctcggcgccgcggctcccgccgcgcagacaccgcacccgcagcatcgccctggcccggct

SEQ ID NO: 35684 - DNA, 13 bp, Homo sapiens
  misc_feature 1..13: note = chr15:47476968-47476981
  misc_feature 1..13: note = hyper
  source 1..13: mol_type = genomic DNA
gatttcaaaatgc

SEQ ID NO: 35685 - DNA, 253 bp, Homo sapiens
  misc_feature 1..253: note = chr15:47477012-47477265
  misc_feature 1..253: note = hyper
  source 1..253: mol_type = genomic DNA
cgcaagctgggcgagttggatccgggtcggcagccggctgaaccgccacgctgccccgctttttttattttctttttagatacggcatctaattggtgggtgctgggaggcagggctggttgggtgagcacgagtacctgggtgtagggaacgacctaccttcttgctttccttggggtttagaggggaaggggtgggggcacccagagccccgaagcccggagcgtcccgcgctagcgggcttgcgcgcggc

SEQ ID NO: 35686 - DNA, 158 bp, Homo sapiens
  misc_feature 1..158: note = chr15:47477354-47477512
  misc_feature 1..158: note = hyper
  source 1..158: mol_type = genomic DNA
cgctcaccgggctgtaaataaaagtgacgacttggaggagtgggggtcaaggctgccgggagggaaaaggcttgcccattttagaaaccgacttggagctcggaagagcaaacgtagtcgacagagaaaaccgctcctgagtgcgaaacttagatctg

SEQ ID NO: 35687 - DNA, 146 bp, Homo sapiens
  misc_feature 1..146: note = chr15:48009524-48009670
  misc_feature 1..146: note = hyper
  source 1..146: mol_type = genomic DNA
gagggcgagcgcgcccggccggccgcgcctcctgccgtccgtgcccgggggtgggacccgcgccgggagctgccgagtgcgtggagggagccaggctccggctcgcctgatggattgacttggagatggatcgaattacaccattt

SEQ ID NO: 35688 - DNA, 81 bp, Homo sapiens
  misc_feature 1..81: note = chr15:48009881-48009962
  misc_feature 1..81: note = hyper
  source 1..81: mol_type = genomic DNA
ccaatgaggtaagaccgttttcaacaatttgctaatgctcttgtggcgcccggtgggggtcggaacctgagatcccgaatc

SEQ ID NO: 35689 - DNA, 740 bp, Homo sapiens
  misc_feature 1..740: note = chr15:48010082-48010822
  misc_feature 1..740: note = hyper
  source 1..740: mol_type = genomic DNA
tggacagttgatttattttccaagctgctctctctgcctgccgtgcaagggacgcgcaaagggctagagaggtttggcggacgcgtcaaaactggcaaagctggcggcttagggggaggggcaagtggacttggaggccctcctccactgtgcacccccttggaaaaaaagcggagggggcatcaagtaaaagtttcttgccaggcagagccagctcggcgtcccccgcacatagctggggttagcaggggttgcttctctgccgggcacagcgtctccaggagccagccggggagagctgagccaaggccgaaggagccgcctgcgggcttagccgccccctcccgcccgttggccccagagcggacgctgggacgcccggggtctggcagctctgcgcccggctaggagcgggcgggcgagcattagcctgcgtcctggagaaggggcgcagcgccgcagttgaggccggagcagcccctcgcgggcgtaggatacctgtcagtgagcgcccggattgcacggcccccgggtagtgcctgccggcgaggggcgggagctcgggtgacttggccatccccatccccggcccaggcccggagggcggccgcttcccaccgtccctctccccttactggcagagcgcgctgcgggcggactcccgggcccggagcagcccaccggccaccccaccgcccacccggctcccggtgtctcctcccggccgctctacccagcaa

SEQ ID NO: 35690 - DNA, 49 bp, Homo sapiens
  misc_feature 1..49: note = chr15:48011314-48011363
  misc_feature 1..49: note = hyper
  source 1..49: mol_type = genomic DNA
gaacttgttaaaaggcgaaatgtcagggagctggcgggggtgggggtgt

SEQ ID NO: 35691 - DNA, 143 bp, Homo sapiens
  misc_feature 1..143: note = chr15:48470373-48470516
  misc_feature 1..143: note = hyper
  source 1..143: mol_type = genomic DNA
gcaggtgcgggctgtcgccaccagtggccccgggcacctcggccttgttggcgtccgccatcccgccgccgctgcctccgcctcggccgcctgagctgaggggctccgagcgcgacaatggcggctgccggggaagcggtaac

SEQ ID NO: 35692 - DNA, 72 bp, Homo sapiens
  misc_feature 1..72: note = chr15:48470517-48470589
  misc_feature 1..72: note = hyper
  source 1..72: mol_type = genomic DNA
gatcccgatttgaaaaggccccgagcgctcagtaacccggatctcgcgagaaccggtcgagactgggtgact

SEQ ID NO: 35693 - DNA, 487 bp, Homo sapiens
  misc_feature 1..487: note = chr15:48936726-48937213
  misc_feature 1..487: note = hyper
  source 1..487: mol_type = genomic DNA
gagagtcatcctgcccgttgttctggatcttgaaacttgggagacccacaccaaaggagggaaccggttcctttaccctttaagcgcgtcgtgtcctccaccgcctcttctcttggcccgactggctctggtttccttcacgttcccagcctccaaattggcgtccgccccatggctcgtgtaggacgctaaaagcacggtaaatcccagggcgatctccagcagacgccctcgacgcatgatgccgagccgccaccggctcccgccgcctcttgccgcgcccggggctcggtctgcggccgccgctgcgccctgaagcgcaccgcgccgccggggtcccgctatcccgccgcccgtcccccgggccgggctcctcccgccttctccaggcgctgctcccacttcaggcggcccctgccagctgcaacacagagacaaatccccgaggcggggagactttcagggcatcgggatgctgaagcctcgc

SEQ ID NO: 35694 - DNA, 432 bp, Homo sapiens; identical to SEQ ID NO: 1206
  misc_feature 1..432: note = chr15:48937214-48937646
  misc_feature 1..432: note = hyper
  source 1..432: mol_type = genomic DNA

SEQ ID NO: 35695 - DNA, 638 bp, Homo sapiens; identical to SEQ ID NO: 1207
  misc_feature 1..638: note = chr15:48937709-48938347
  misc_feature 1..638: note = hyper
  source 1..638: mol_type = genomic DNA

SEQ ID NO: 35696 - DNA, 242 bp, Homo sapiens
  misc_feature 1..242: note = chr15:48938348-48938590
  misc_feature 1..242: note = hyper
  source 1..242: mol_type = genomic DNA
gttgccccggaggccctggcccgagagaaaaccagtccccgctgcccgcgcctcccggtagcgcgctccctgcgcctctcccgccggacactcagcagacgccggaggccgggaggctaagactgggcgcgtcgcaggccgggaccgcggcagaggctgctgtgccgaccgaggagagggctctgccgcccccacttgccctgggtgtcgagagcccactccagacgcggctcttctgaggc

SEQ ID NO: 35697 - DNA, 374 bp, Homo sapiens
  misc_feature 1..374: note = chr15:51385846-51386220
  misc_feature 1..374: note = hyper
  source 1..374: mol_type = genomic DNA
tcagagctgcacaagcgccgggagctgtgggcacgtgaggagggcgagcgggtcctaggtgcgtagacccgtgggtggggggcggagcggaccggtggaggtgggcagagaccggcggcaagtcgacccacggctgtgggtggcttcctcctgttgctcagtatcagggagaggcgggggaggacattcattttttttcttccctaagtaagcatccacctattgctttaataactatcgattgtgaaaagccggcggggcctcttaaaggcgaagtcgggaggcgcgcgcccctgcgtctgtgttcggggaccagtccgcggggaccttctggaccttctccgccggctgcgcggcagcgatggaccctgtgc

SEQ ID NO: 35698 - DNA, 414 bp, Homo sapiens; identical to SEQ ID NO: 12151
  misc_feature 1..414: note = chr15:51559380-51559794
  misc_feature 1..414: note = hyper
  source 1..414: mol_type = genomic DNA

SEQ ID NO: 35699 - DNA, 116 bp, Homo sapiens
  misc_feature 1..116: note = chr15:51633989-51634105
  misc_feature 1..116: note = hyper
  source 1..116: mol_type = genomic DNA
gcgctgtgccagtggcgcgggctgagctcggcgctgcgggctttggaggcgcagcggggccgggagcagcgcgaggacagtgccctgcgctccttcctggccgagttgagccgcgc

SEQ ID NO: 35700 - DNA, 126 bp, Homo sapiens
  misc_feature 1..126: note = chr15:53075739-53075865
  misc_feature 1..126: note = hyper
  source 1..126: mol_type = genomic DNA
cggcctccgaaggccctttcacccaccccacacaagaggaaacaaagacttctcagctcaaggcctcagggctgcctcctgactccggtcagtttgcaggaagaggaaacaacaaaacaaaggaac

SEQ ID NO: 35701 - DNA, 1016 bp, Homo sapiens; identical to SEQ ID NO: 1210
  misc_feature 1..1016: note = chr15:53075985-53077001
  misc_feature 1..1016: note = hyper
  source 1..1016: mol_type = genomic DNA

SEQ ID NO: 35702 - DNA, 461 bp, Homo sapiens; identical to SEQ ID NO: 1211
  misc_feature 1..461: note = chr15:53077065-53077526
  misc_feature 1..461: note = hyper
  source 1..461: mol_type = genomic DNA

SEQ ID NO: 35703 - DNA, 231 bp, Homo sapiens
  misc_feature 1..231: note = chr15:53078005-53078236
  misc_feature 1..231: note = hyper
  source 1..231: mol_type = genomic DNA
ggaatttcctcctgtcgcccttcttccaccagccgctgttatttcgtgaccggaaggcgcctccccaaacacagcgccacgtgcaagagggttttgaccctctgcaacaggctgccggcaactggaggacagaggggcgtggagaagccaccactctcccgctgcggagcgaaggaaccgagctcagtgagccctgacctcgcaaggtggttggaacgagactggggaggg

SEQ ID NO: 35704 - DNA, 251 bp, Homo sapiens
  misc_feature 1..251: note = chr15:53078741-53078992
  misc_feature 1..251: note = hyper
  source 1..251: mol_type = genomic DNA
aggcaggcgctccttcgatagcctcctgggtgccacaagcacctgccaggcaccatgtttgcgcctccagcgtgcgggtcccagcactcaggctccctccccctccacagtgccgtcccctgagctcggctatgtagctctccacgcttggaggtcagagggcgctcctgcggccaggtttccatggctcagaggtcgtctctgaacagaacgtgtcagtctgtccttccagggggcgacagcaggcagtg

SEQ ID NO: 35705 - DNA, 414 bp, Homo sapiens; identical to SEQ ID NO: 4224
  misc_feature 1..414: note = chr15:53079264-53079678
  misc_feature 1..414: note = hyper
  source 1..414: mol_type = genomic DNA

SEQ ID NO: 35706 - DNA, 175 bp, Homo sapiens; identical to SEQ ID NO: 4225
  misc_feature 1..175: note = chr15:53079717-53079892
  misc_feature 1..175: note = hyper
  source 1..175: mol_type = genomic DNA

SEQ ID NO: 35707 - DNA, 96 bp, Homo sapiens
  misc_feature 1..96: note = chr15:53079970-53080066
  misc_feature 1..96: note = hyper
  source 1..96: mol_type = genomic DNA
cgaatcctcctgaaatccccggtggggttcgggctgggctcagctttcttctctgcctatccgcggtctcggggagccaggcgcggtgtctgcgct

SEQ ID NO: 35708 - DNA, 256 bp, Homo sapiens
  misc_feature 1..256: note = chr15:53080299-53080555
  misc_feature 1..256: note = hyper
  source 1..256: mol_type = genomic DNA
actgggaccttgggacggtcagcctccctctcctttccacagccaattccatgcgcagagagcgtcctaacccttacaactcgtctgtgctacacacccaccgcccaatggctctgaaactttttgcccatactcttagattgaggtcaccccagccagcgccaaaagaatgagcgcgggagggggtcacagcagccagttcggccaaacatcgacgctgctccggcacgctccagcccagcgcctgggatgtgtc

SEQ ID NO: 35709 - DNA, 58 bp, Homo sapiens
  misc_feature 1..58: note = chr15:53080933-53080991
  misc_feature 1..58: note = hyper
  source 1..58: mol_type = genomic DNA
gtgtaccttatctcccgcgcgcccagctccttggccggctcacctgctaagcggagcg

SEQ ID NO: 35710 - DNA, 243 bp, Homo sapiens; identical to SEQ ID NO: 4229
  misc_feature 1..243: note = chr15:53081054-53081297
  misc_feature 1..243: note = hyper
  source 1..243: mol_type = genomic DNA

SEQ ID NO: 35711 - DNA, 622 bp, Homo sapiens
  misc_feature 1..622: note = chr15:53081398-53082020
  misc_feature 1..622: note = hyper
  source 1..622: mol_type = genomic DNA
cggccgagcatggccgggtggtgggcttcgaagccgttgggggtgagcatcttgtcggtgggcatggcggcccccgggtgggcatagtgggggagcccttgctgggagttgtggatgctgcccagaccggagctggagaggggcgagaggctctggcccatgccggccacgtccttgtggtagggggtatagaggttattcatggaggccagcccgcgctcatcccgcatgagcgtgaagctaccgctcacgttgcccgccaggcgctggtggtggtgcgggtggtggtggtgatggtggtggtggtgatggtgggggaacttgtccgagactgtggagatgggaggcagcggctgcagaggggtcaaggtggtgtaggtggtgggcatgctcatacctgggggagtctcgcaggccatggtcatggtgggatgcagggggccggccaggctgtgctcaggggcccggtggtggtggtggtaatctccgccgccgctgccgccgtccagcagggacgccatgcccatggagcgcgggtgcgcggggggcaggtggctgccgcggtgcgccacggagctgcgcgcgtgggggctgccgcccagcaggtcggcaggggcgggca

SEQ ID NO: 35712 - DNA, 285 bp, Homo sapiens
  misc_feature 1..285: note = chr15:53082758-53083043
  misc_feature 1..285: note = hyper
  source 1..285: mol_type = genomic DNA
agcgcgacctggggccgccgctgcaatcccaggagactcgcgcctggctcgctcgcctcccttgcttgagtgggctctgtcctcccagcccggggacgctcgtgtcgggcttctagcggctggagtgctgtgcttggagacatcgcccctctctctccagttgctgcttcccggtgcagcttgcccggggagctggggactgtgtcatcaccccttcggctctagcccactaagctttatttcccggggggctgctgggagtgcgctttcccacccttgaattca

SEQ ID NO: 35713 - DNA, 19 bp, Homo sapiens
  misc_feature 1..19: note = chr15:53083116-53083135
  misc_feature 1..19: note = hyper
  source 1..19: mol_type = genomic DNA
cgttgacccggcacccttc

SEQ ID NO: 35714 - DNA, 13 bp, Homo sapiens
  misc_feature 1..13: note = chr15:53083136-53083149
  misc_feature 1..13: note = hyper
  source 1..13: mol_type = genomic DNA
tcctcccagatac

SEQ ID NO: 35715 - DNA, 1823 bp, Homo sapiens
  misc_feature 1..1823: note = chr15:53095746-53097569
  misc_feature 1..1823: note = hyper
  source 1..1823: mol_type = genomic DNA
tcaaaaaaacaaacacgaattcagccgctgctttaataacctctgaccagaggagctgattttgccaccgagttatcggtcagtgctgcgaggtcagtggcctgtgatcatgtttatagcaggtttggcttggatttggtgacacagccagcaaacctgggagattatgaaaccgtgaaccagcccagggaagtgtagtcaagtttcagtttgggcatttctccgggtgagggaatccggtgggctccatttctacaaggctcacaaacgcaggtgcagttcggccgccgcacgctgcctggcgggagaaacgcgcacaaaccgcagacgcgtgctcctgtagttgccactagctcggggcacgcccgtgttatttacaccctgctcgggggcccccctctcatttgttactttaaactcatggggaggaactgttagctgccgtggcgggactggcaggctgggaggggggcgcccccgctcggctcccgggccgtgacgcggccgctgccctccgcccctggcttccaccctgtttgcatggccacaagctcagcggtggaccagcgtggccaggcccccggagcccttgccccggcctaccgcccctacttcttccccctcaccaccccccccaaacgcttgtgagactggcttaccctggtgggcgagtcgcagcgcattagcggatttcatggcaagttgcttctgtgacatgagatcaggttcgcgttcgaggatttgccccctaggagggaaggaaaggagagtcaatctgcataatttcaaatgagaaataaatagggaaacagggaactgaatttcaagccccctaattcctccctccccccgaacctgtgagccaccccgcaccccccacaacacgccccgtgcacaggtaaaaaaaaaaaaaaaaagtaatcagcacacgtcgcaggtgataccttttattgtgctcattttaaagacaggaacaggatggcctcctgcccgaagactttctctgcagccaggcccggggcaggagggtcagctgggcagcatccgggcccgcggattcctgcaaggtcgcgaggtgagaggtgcggggaggatagacctcgggctcggcgcacagggtctgggccagacgcacaagcccaaattccctccagcttcttcggctccatctttaagtccaggcaaagatcaattccctctctctcttgaacacacacatttgcagccataaataaacagctcccagctaaatcaggaaccggagaggagaaagggaaaaagaaaggagaaaagagaaggattgagaacccaagcgcgagtctcgcctcttccgggcgccgactggctctttttggtcaggccagcctcgcatttggggatgcaacttgcatttgaatagctgcctgggcttgttatggacccgggaaagctctgaaagggaatcactatgcaaattgtcccagttacaatcgaaaggttcgatctccaggagctgcctgacggaagttgatgtcagctatctatgcattagggttgcattaccgccttcgtcggcctcctcgccacccccgctcgcgcctgcaggggaggctttttttttttttgcttatgtttatattttccctcagtaattaaaaaaaaataaaaaaagaaaataaaaggctgaaggtggtggcatagctggctagggcctgggaggcccacgggctgagaggggaggaggtgcggaagggcggggttgggtggcggggggggtcgttcttttgcagcaggtgttgatggtgcgtttgaaatcaaacatttagatttttttttcgctttgc

SEQ ID NO: 35716 - DNA, 130 bp, Homo sapiens
  misc_feature 1..130: note = chr15:53097777-53097907
  misc_feature 1..130: note = hyper
  source 1..130: mol_type = genomic DNA
gggggccttttggggcgccttttaccccagagctcagaaagctccgggcagcggggtggtggcgggatggccagtagccagggcccacctggcggcccgccgggatgtggaggcccactgggttccggcc

SEQ ID NO: 35717 - DNA, 309 bp, Homo sapiens
  misc_feature 1..309: note = chr15:53098381-53098690
  misc_feature 1..309: note = hyper
  source 1..309: mol_type = genomic DNA
cgcccgccccttgctggcagagtccgggcaggactgccggggcctggggccgcagtccccgcgccgctggccgcccgcagcttctggcgcccccgaaaatgaccatctgtcattcaattaaggtttcagggcagctgatgggggagccagggtcagcgaccccaggacaaaacggcctgctgcctcggataggagaagttcaaatgttaaatgcagaatattgtgccctctcccagtccggggccccacccggccgcaggtccggccagtggacagcagtagggtgaagggcaacggtcattagcactt

SEQ ID NO: 35718 - DNA, 111 bp, Homo sapiens
  misc_feature 1..111: note = chr15:54051776-54051887
  misc_feature 1..111: note = hyper
  source 1..111: mol_type = genomic DNA
caccagcctgggacccggcagcccgacctgcgctctgggggtgcctgccttacctgagccgtggggcggaggagcggcagaggccaggcaggctggcgggtctcgccctta

SEQ ID NO: 35719 - DNA, 399 bp, Homo sapiens
  misc_feature 1..399: note = chr15:54270498-54270897
  misc_feature 1..399: note = hyper
  source 1..399: mol_type = genomic DNA
gcagtggctacagtgcgtctcctgtgagcaggggctgtagctcaccctctcggagctacgccgtgctacggcggcaggagagggagcccgggcgctctcggtggaggaggctggggatcgcagtgccggtgctgcattcagaaaagactcagccgcagccggcgatgtgtgaagttcccagcacgcactcagcccggctgctcctcaccctcaaatgttgatgagcctgggcgctcctcaacacacgggagagatcccattttgctttctgggagaaagagatgagaaatgagccgcggaaggtatttggcaatgagaagagtgaaaggcagtttcttgccagcagctaagttgtagaattgcttcggaggctacccgggagtgcgatagaattgacaa

SEQ ID NO: 35720 - DNA, 32 bp, Homo sapiens
  misc_feature 1..32: note = chr15:55879909-55879941
  misc_feature 1..32: note = hyper
  source 1..32: mol_type = genomic DNA
gcgggacgcgggctgcgcggacttaggcccgg

SEQ ID NO: 35721 - DNA, 607 bp, Homo sapiens
  misc_feature 1..607: note = chr15:55880176-55880783
  misc_feature 1..607: note = hyper
  source 1..607: mol_type = genomic DNA
ctgcgaggcaagcctcggagccgaggcacggccgagggcggtggggacgcgggccgactttgcaaagtttgggaggaggacgaggcctcggggcggcggggcggcggggcggcgtgcgggcaccggcggggctcagcggcggtggccgggagcgcggcctgggggcggccccccacccggggccggcatgtgctgagggcgagtgcgccgccgccgccgccgcctcctcccactccttcttcttcgccgccgcctcaggagccgctgacaggggaagcaggaggctcgcggcccggccctggcggcacactcacagcgccctctgaggaggaggtctgctctctcgccgctcccgagtcgcagacacaaaagcccccagactggagccgcctgtaaaacccgctctggggcgggcgagggacgtggcgcggccccgcggcttccccgccctgagctccccagccccgcgcggggacgggcttcggggggcgggggccgctgcctcgtcccgcggcgcctcccgccaccgccgccgcctcgcgctccgcctcggcccagcccccacggcccgcgcgcgcctcttgctccaagccggggctcgcgggcc

SEQ ID NO: 35722 - DNA, 121 bp, Homo sapiens
  misc_feature 1..121: note = chr15:55880890-55881011
  misc_feature 1..121: note = hyper
  source 1..121: mol_type = genomic DNA
cgacgctaccgggcccagctttcgcaaggaaagggcatctccgaacttcgtcggaggccacagcagcaggcgtctcggcctcgcagctagggatcggaaagatgaacgtaccatgcgagga

SEQ ID NO: 35723 - DNA, 42 bp, Homo sapiens
  misc_feature 1..42: note = chr15:56034387-56034429
  misc_feature 1..42: note = hyper
  source 1..42: mol_type = genomic DNA
ttcccccctcctttccggggcacaaatcggccacttcacttc

SEQ ID NO: 35724 - DNA, 72 bp, Homo sapiens
  misc_feature 1..72: note = chr15:56034651-56034723
  misc_feature 1..72: note = hyper
  source 1..72: mol_type = genomic DNA
gccccggcgggctggcgacccggagtccggccggtcgcggaggcgcggacgcggccggagccgggacaatgg

SEQ ID NO: 35725 - DNA, 375 bp, Homo sapiens
  misc_feature 1..375: note = chr15:56034885-56035260
  misc_feature 1..375: note = hyper
  source 1..375: mol_type = genomic DNA
cgcagggcgagagcgggggccgggggtcagcgccaccacggaggaccccgccgcgcgctccccacgccccatcgtttcctctttccccatcccactcgcgcccgctcccgccccacagcggtaagagaaagcagaagaaagcgcgcccacctggcaaaggactgagcagcagcaggagcaggagcgcgcggagcagcatccccggcggtcgcagccgggcgaggggtcgcagaggaggcgccattcagcgtagccgcgcgggcatgctccccggccgcccagagcccctgtccgtctgcggcccccgccccgggcgctctctgctctgcggctggtcgcacgcagcctggctccccgctccggctccggcaccgg

SEQ ID NO: 35726 - DNA, 206 bp, Homo sapiens
  misc_feature 1..206: note = chr15:56035304-56035510
  misc_feature 1..206: note = hyper
  source 1..206: mol_type = genomic DNA
cgctcgcgagaagcaaggggcctgagagtccggctgggggcggagtgaggcggcggctgcagagggcgggggcggcggagtggacagcgccgcggccgcgggcctgggactactttctacatctggcccttggtctgggccagggaggtcggcgcggccggcggagggagacgctgggagggggccagtggcggccgggtcggagc

SEQ ID NO: 35727 - DNA, 65 bp, Homo sapiens
  misc_feature 1..65: note = chr15:58357155-58357220
  misc_feature 1..65: note = hyper
  source 1..65: mol_type = genomic DNA
cacatgaaacgctgacgttggagttactgtacttatcagtcaggtttccgtgaaatttgtcaaac

SEQ ID NO: 35728 - DNA, 21 bp, Homo sapiens
  misc_feature 1..21: note = chr15:58357799-58357820
  misc_feature 1..21: note = hyper
  source 1..21: mol_type = genomic DNA
cggggtcggccttcacctcgc

SEQ ID NO: 35729 - DNA, 241 bp, Homo sapiens
  misc_feature 1..241: note = chr15:58358522-58358763
  misc_feature 1..241: note = hyper
  source 1..241: mol_type = genomic DNA
ccgactcccctcagccgggccgaggtgcatggtggccagagggtcagggagaggtggcagtgggtgcgagtccccctcgcctcgggctcagaatgaggatccctgcgagcgggtcagcgcggggcggcccttgccaggcgtcgcccgcccagttgctgccctctgccggccgggaccgcccgggcggcttgcgctgtggcgggaggatatgggcagtgatcatccccggctcctccgagga

SEQ ID NO: 35730 - DNA, 159 bp, Homo sapiens
  misc_feature 1..159: note = chr15:59729656-59729815
  misc_feature 1..159: note = hyper
  source 1..159: mol_type = genomic DNA
tggaaagagccaggacgcgctgggaggggatgaagctgacgggagaagaaagggctgggaagaggaggggtgttcggggttcttcttctcgtcgtgtctgctgcgatgagacacgatcctgggtcccaactgcaggtgtcaaggcgattcagtaaatga

SEQ ID NO: 35731 - DNA, 30 bp, Homo sapiens
  misc_feature 1..30: note = chr15:60286804-60286834
  misc_feature 1..30: note = hyper
  source 1..30: mol_type = genomic DNA
tattcactaatccagcgcattgccaaatac

SEQ ID NO: 35732 - DNA, 548 bp, Homo sapiens; identical to SEQ ID NO: 1212
  misc_feature 1..548: note = chr15:60287038-60287586
  misc_feature 1..548: note = hyper
  source 1..548: mol_type = genomic DNA

SEQ ID NO: 35733 - DNA, 33 bp, Homo sapiens; identical to SEQ ID NO: 1213
  misc_feature 1..33: note = chr15:60287643-60287676
  misc_feature 1..33: note = hyper
  source 1..33: mol_type = genomic DNA

SEQ ID NO: 35734 - DNA, 80 bp, Homo sapiens
  misc_feature 1..80: note = chr15:60288786-60288866
  misc_feature 1..80: note = hyper
  source 1..80: mol_type = genomic DNA
aagtggcaaagttttcgaaaaacctcgccgatcctctgaagatcgggttaatgatttaccccactcgccaaccacctgat

SEQ ID NO: 35735 - DNA, 316 bp, Homo sapiens
  misc_feature 1..316: note = chr15:60289310-60289626
  misc_feature 1..316: note = hyper
  source 1..316: mol_type = genomic DNA
tcagccaacagcccccgcgctgctagagcgcccaaagcagaggccggccgcgaggagggccagagtgcaccgcgggggggtttgcaccgcgctggggttggcaccgcgcgctaggacccacgaagcggcgcgctagtcccaggtgagcacgaaatgagcggaaggactctgccgcggaggggcggcgagcgcctggctgcgctgcaggccccgccaagccccgccccctagccattcttagctgggggaggccagcacggatcagccgctttctttcttttctctctttctttttcaaacccgctttgtgggtggc

SEQ ID NO: 35736 - DNA, 30 bp, Homo sapiens
  misc_feature 1..30: note = chr15:60289876-60289906
  misc_feature 1..30: note = hyper
  source 1..30: mol_type = genomic DNA
caaacaaagcagaagcgcagggttttaagg

SEQ ID NO: 35737 - DNA, 30 bp, Homo sapiens
  misc_feature 1..30: note = chr15:60292201-60292231
  misc_feature 1..30: note = hyper
  source 1..30: mol_type = genomic DNA
tcccgaaatccagcacgttaaagccaggcc

SEQ ID NO: 35738 - DNA, 354 bp, Homo sapiens
  misc_feature 1..354: note = chr15:60295917-60296271
  misc_feature 1..354: note = hyper
  source 1..354: mol_type = genomic DNA
agtcaagtcaaatttcgacctaactctccggggactggggggcaagggtgtgttttcattattataacccatgcaaccaaccccgggtagtgctaagcgcaggaaaagggtcggcttcaggggaaagccgtgcctaaagttacctaacgatacaaaccggatacaacgcagaggaaacagaataccccagccaagcaatttccatgtcaaacatcatccgcgcggctgctccatctgtgaacgtgagtggtcgcctggctccctcttccgcggcggccgcttcctcataccttcacacggcgcacaccggccggcgcgtccagctgcctgcccagtggccgaggctcttccccc

SEQ ID NO: 35739 - DNA, 135 bp, Homo sapiens
  misc_feature 1..135: note = chr15:60296483-60296618
  misc_feature 1..135: note = hyper
  source 1..135: mol_type = genomic DNA
ttctgctcctgtcaccgcttaaaactatcagatggttcgagggaggacatggaggcagccacctagctcagcggagacgcggagcccacagcagcgccctccggagccctaacacgtcgctgccaccatccgcgc

SEQ ID NO: 35740 - DNA, 64 bp, Homo sapiens
  misc_feature 1..64: note = chr15:60296860-60296924
  misc_feature 1..64: note = hyper
  source 1..64: mol_type = genomic DNA
cgtccctgccccctattctggccccagtaccgacttacttcccggctatcctcgcgccgttcgc

SEQ ID NO: 35741 - DNA, 676 bp, Homo sapiens
  misc_feature 1..676: note = chr15:60297151-60297827
  misc_feature 1..676: note = hyper
  source 1..676: mol_type = genomic DNA
cgaggaagaagatgcctcggcccggccgcaacacgtacagcgaccagaagccgccctactcgtacatctcgctgaccgctatggccatccagagctctcccgagaagatgctgccgctgagcgagatctacaagttcatcatggaccgcttcccctactacagggagaacacgcagcgctggcagaacagtctgcgccacaacctctccttcaacgactgcttcatcaagatcccgcggcggccggaccagccaggcaagggcagcttctgggcgctgcacccaagctgcggggacatgttcgagaacggcagcttcctgcggcgccgcaagcgcttcaaggtgcttaagtccgaccacctggcgcccagcaagccagccgacgcggcgcagtacctgcagcagcaggccaagctgcggctcagcgcgctggcggcctcgggcacgcacctgccacagatgcccgccgccgcctacaacttgggcggcgtggcgcagccctcgggcttcaagcaccccttcgccatcgagaacatcatcgcgcgggaatacaagatgcctggggggctggccttctccgccatgcagccggtgcccgctgcctacccgctccccaaccagttgactaccatgggcagctcgctgggcaccggctggccacacgtgtatggctccgc

SEQ ID NO: 35742 - DNA, 238 bp, Homo sapiens
  misc_feature 1..238: note = chr15:60297941-60298179
  misc_feature 1..238: note = hyper
  source 1..238: mol_type = genomic DNA
cgtgcccattaagcccacgccggccgccgtgcccgcgctgcctgcgctgccagcgcccatccccaccttgctctcgaactcgccgccctcgctcagccccacgtcctcgcaaacagccaccagccaaagcagccccgccacccccagcgaaacgctcaccagcccggcctccgccttgcactcggtggcggtgcactgacccgcaggagcccacgccccctctcgttctcctccccac

SEQ ID NO: 35743 - DNA, 49 bp, Homo sapiens
  misc_feature 1..49: note = chr15:60883305-60883354
  misc_feature 1..49: note = hyper
  source 1..49: mol_type = genomic DNA
caggcgcttggcacccgcaccggtggctaggacccgcaggacagtctgg

SEQ ID NO: 35744 - DNA, 136 bp, Homo sapiens
  misc_feature 1..136: note = chr15:61519885-61520021
  misc_feature 1..136: note = hyper
  source 1..136: mol_type = genomic DNA
ccagccctccccaaccgccgccagaagccgagtgcaagaggagggggcgcgctgggccggtacccaagccggggctggagaaatcctctccgtccccagctccaggcggctcgcgcgagcacgcttcctccggagt

SEQ ID NO: 35745 - DNA, 54 bp, Homo sapiens
  misc_feature 1..54: note = chr15:61520408-61520462
  misc_feature 1..54: note = hyper
  source 1..54: mol_type = genomic DNA
gcttgcttttgtagacgctccctccggatgcgcgtggagcgccccacaggaccg

SEQ ID NO: 35746 - DNA, 190 bp, Homo sapiens
  misc_feature 1..190: note = chr15:61520773-61520963
  misc_feature 1..190: note = hyper
  source 1..190: mol_type = genomic DNA
tcgggcagccagggccgaaactgtcaagaggagaaaaggtaaagcggaaggagggtggccataaacagatttttttgccccttcttaaaaggacactgccgctttaaaagtttctttcccgggcccccactccccgcatctccgtattttgggggagcgtatttaattgaggcaacgcagctttcctcca

SEQ ID NO: 35747 - DNA, 94 bp, Homo sapiens
  misc_feature 1..94: note = chr15:61521200-61521294
  misc_feature 1..94: note = hyper
  source 1..94: mol_type = genomic DNA
ccgcgcccgggctcccgccgccccctccccagcccctctccagcctcctacctctgctggtgctggaatagctctgtctgcgcaccggggcagg

SEQ ID NO: 35748 - DNA, 161 bp, Homo sapiens
  misc_feature 1..161: note = chr15:61521311-61521472
  misc_feature 1..161: note = hyper
  source 1..161: mol_type = genomic DNA
cggattcctggttcagcggggtctccctggagccggcggccgcgtccgcgccgctgctgcctggctcgctggcggcggggtcgggggctgccggagctgactccatgttttttcccaatgtagagatcgctggagatggcgagctccgagactccctctat

SEQ ID NO: 35749 - DNA, 138 bp, Homo sapiens
  misc_feature 1..138: note = chr15:61521809-61521947
  misc_feature 1..138: note = hyper
  source 1..138: mol_type = genomic DNA
gagaacagagcctcccgcgccccaatcctcccctctccccagcccagggacagaaattaaaatcggtgagatgattccgtgcctacttctgagactctctcgggaacagaactcgtccccatccgctgccagcttggg

SEQ ID NO: 35750 - DNA, 32 bp, Homo sapiens
  misc_feature 1..32: note = chr15:62456269-62456301
  misc_feature 1..32: note = hyper
  source 1..32: mol_type = genomic DNA
gcgctgcattgccaacgcgcagtgcccggcgg

SEQ ID NO: 35751 - DNA, 30 bp, Homo sapiens
  misc_feature 1..30: note = chr15:62456901-62456931
  misc_feature 1..30: note = hyper
  source 1..30: mol_type = genomic DNA
cacacggggcaggtgcggcagtgacagcgc

SEQ ID NO: 35752 - DNA, 141 bp, Homo sapiens
  misc_feature 1..141: note = chr15:62457155-62457296
  misc_feature 1..141: note = hyper
  source 1..141: mol_type = genomic DNA
aggaacagagtttctcgaggagccgcatccttggaggctggggctaggagtggcgggaagaggtgcgcctgcgggggagagaagctgctgagtttgggcgcctggagctgctgcagcccctcgacgcggctggatccctcc

SEQ ID NO: 35753 - DNA, 176 bp, Homo sapiens
  misc_feature 1..176: note = chr15:63334493-63334669
  misc_feature 1..176: note = hyper
  source 1..176: mol_type = genomic DNA
ggcacaggggggcgacgcgcatccaccacctggtccgcgctctcccggcctccggcagctcagggcgggctcggttggggaccctaatggctgggtgccggccctgggagaagggcacgcggagggcggagggttgcgcctcggccccggctcggccccaacgccctctccctggc

SEQ ID NO: 35754 - DNA, 30 bp, Homo sapiens
  misc_feature 1..30: note = chr15:63335974-63336004
  misc_feature 1..30: note = hyper
  source 1..30: mol_type = genomic DNA
aggagctgcacaaggcggaggacagcctcc

SEQ ID NO: 35755 - DNA, 38 bp, Homo sapiens
  misc_feature 1..38: note = chr15:63673771-63673809
  misc_feature 1..38: note = hyper
  source 1..38: mol_type = genomic DNA
ccttcagcccaggggcggctgagcgctcaggagtgtta

SEQ ID NO: 35756 - DNA, 36 bp, Homo sapiens
  misc_feature 1..36: note = chr15:65204199-65204235
  misc_feature 1..36: note = hyper
  source 1..36: mol_type = genomic DNA
ggccgagaggacccccgcatccgtttggggagtgcc

SEQ ID NO: 35757 - DNA, 121 bp, Homo sapiens
  misc_feature 1..121: note = chr15:65360172-65360293
  misc_feature 1..121: note = hyper
  source 1..121: mol_type = genomic DNA
tggcgacgccctggacggccacgcaggtctgcggccggtgggccccgcgcagtgcgcccgcccgtcggggcccaggggagcgggatgcaggcttccctggagcgcgcggccccggacccgt

SEQ ID NO: 35758 - DNA, 76 bp, Homo sapiens
  misc_feature 1..76: note = chr15:65360323-65360399
  misc_feature 1..76: note = hyper
  source 1..76: mol_type = genomic DNA
cgggctgccaccccgcggggaggaggggccggtggagcctggcgggcggggccaccccaagcgccaccaaattcct

SEQ ID NO: 35759 - DNA, 15 bp, Homo sapiens
  misc_feature 1..15: note = chr15:65648085-65648100
  misc_feature 1..15: note = hyper
  source 1..15: mol_type = genomic DNA
gaatccggcattgtg

SEQ ID NO: 35760 - DNA, 15 bp, Homo sapiens
  misc_feature 1..15: note = chr15:65648136-65648151
  misc_feature 1..15: note = hyper
  source 1..15: mol_type = genomic DNA
cgcacgccaaacgag

SEQ ID NO: 35761 - DNA, 530 bp, Homo sapiens
  misc_feature 1..530: note = chr15:65669295-65669825
  misc_feature 1..530: note = hyper
  source 1..530: mol_type = genomic DNA
tccaggcagcagaaccggcggaccgcgagagccagggcaaggtctccgcgtgtgcacacttcggggaagggcaggggcacgtgagcatccccgcggctcgctcgctctcgctttcggtggcttctcctctccttcttggctcacgggctctgtcccgggtcgctccctagccacgcgccgccctccaggaatctccctcgtcttctcctgtctctcccgcgcactcctcagcccagtaccagctccaaatgcaggtcgtgccatctccgcccagtgcagccgtcagagtcccggtctccgctccccaggctgctgtcccctgtcttggctgcctcgggctatgtccacggccgggcacccagcaccccagctcgtccgcctcggtcagcgcttagccttgcggtctcccctggctcgtttccctcggtctccacgccagcccgccccgcttgctcccgcttcgctgcactccttgctcctcagtctgggctccgggtcctgccccagtcttcctccggggggttccgtcc

SEQ ID NO: 35762 - DNA, 151 bp, Homo sapiens
  misc_feature 1..151: note = chr15:65670634-65670785
  misc_feature 1..151: note = hyper
  source 1..151: mol_type = genomic DNA
ggaagtggacaccagcggactggggagtgggtccgggctgcggaaagacacacagctgcgggatttgctctgacccactctttctgctgcgccctcctccaagtccatattttagagataattctctaaaaagctgcgtaaagttgtcaaa

SEQ ID NO: 35763 - DNA, 185 bp, Homo sapiens
  misc_feature 1..185: note = chr15:65714138-65714323
  misc_feature 1..185: note = hyper
  source 1..185: mol_type = genomic DNA
acactccccatgagccgcccccaaacgcacaccggacaggaagcgacagagctgtgggtggaagccgcagccctagacacacacccttggggacttcgctatcccctccccagccctttctccagcttggacaactctgacttaccccgtacccactccgcactgggctgcggactggatgaggc

SEQ ID NO: 35764 - DNA, 18 bp, Homo sapiens
  misc_feature 1..18: note = chr15:65714819-65714837
  misc_feature 1..18: note = hyper
  source 1..18: mol_type = genomic DNA
ccatggcacgcactgcgg

SEQ ID NO: 35765 - DNA, 38 bp, Homo sapiens
  misc_feature 1..38: note = chr15:65715098-65715136
  misc_feature 1..38: note = hyper
  source 1..38: mol_type = genomic DNA
tcgctcctgcctctccgggcgcccgcccttaccgcgcg

SEQ ID NO: 35766 - DNA, 120 bp, Homo sapiens
  misc_feature 1..120: note = chr15:65715528-65715648
  misc_feature 1..120: note = hyper
  source 1..120: mol_type = genomic DNA
gtgcctcgccctctccgggtcgccgcgggcccccgtgaggccgcctgttgctgggtctgtctcttagtctccccgtctctgagtcttctggtctctctgcctcagcgtctctatttcttc

SEQ ID NO: 35767 - DNA, 121 bp, Homo sapiens
  misc_feature 1..121: note = chr15:68112086-68112207
  misc_feature 1..121: note = hyper
  source 1..121: mol_type = genomic DNA
cggcctcccaccaaatccggaccctctccagcctcagtctctggtccgcaacaggagtgaggtgggcccggagctctgagcaccttctcaccggctccaaggcccccgccttctcctcact

SEQ ID NO: 35768 - DNA, 89 bp, Homo sapiens
  misc_feature 1..89: note = chr15:68112552-68112641
  misc_feature 1..89: note = hyper
  source 1..89: mol_type = genomic DNA
aacctaattaactgacgaaaactgccgttaattcaactagtaaaagatatgtgcttgcggaggaggcgcgtccgcgcagcctcagccca

SEQ ID NO: 35769 - DNA, 237 bp, Homo sapiens
  misc_feature 1..237: note = chr15:68113226-68113463
  misc_feature 1..237: note = hyper
  source 1..237: mol_type = genomic DNA
gcccttgttgagaatcggctctgcaatcggtaaagtgcggtccgcggtgatattaacccgccggacgccggcccatagtagagccccagctcctacccccacgacctgctccccggtgcccagccctgagcagcggggcttccccagcctctgtccacgcgcctttctccagctcagaccagggacaggagctgggtgggtctcctggcactggccagagcgcggggagctgtccgt

SEQ ID NO: 35770 - DNA, 695 bp, Homo sapiens
  misc_feature 1..695: note = chr15:68113751-68114446
  misc_feature 1..695: note = hyper
  source 1..695: mol_type = genomic DNA
gctaagaataattaccgaacgagattgtaattatggggtgggggagcctgggccgagggagagggaatgagctggcggggacttgggggcagctctcggactgggaaggaaaataggttcctgtgttctccccggggaaggtgtgggaggaaagacagcgggatagttggagcgggacagaggcacagcctgggaaagacacccgaatggaggggccagaggcagaaagaaaggggccgagcgggttccaggactcccctgggagaaaagggaaaggcagggagatccgagacagaaagaccggaaccgaggagggggaagagggcaagaacgcgatctaaaagagaccctcagaggagacagagcccacaaacttgggagaggttttcggggcctaggagaacggtaacctacgtcagccagggtagccgggaagaaggcaaaggagtctgtgggctgggcctgccctctcctcagtcccttcaccaggcctgagctatcggttcgcgcttccagagtcccttcccagggtctctgcgagccaggagggaaaggaagagaggggagaagtggaggaaaaggggagacacgccccagaggagttggaacgcaggagggaaaggggaccatacccggtagcccgagggaaaaacgaggcgagaggggagaaggcgaccccgcgctgctacccgcgg

SEQ ID NO: 35771 - DNA, 30 bp, Homo sapiens
  misc_feature 1..30: note = chr15:68114981-68115011
  misc_feature 1..30: note = hyper
  source 1..30: mol_type = genomic DNA
tcagatcactcccaacgatgacttggctcc

SEQ ID NO: 35772 - DNA, 1309 bp, Homo sapiens
  misc_feature 1..1309: note = chr15:68115276-68116585
  misc_feature 1..1309: note = hyper
  source 1..1309: mol_type = genomic DNA
caccaccctggccctcgcctgcggccggaaagtgaagtactcctccctgcgcccgttcctcttgagtcccccttagccccatcacccggttttggcccagaccaaaactggctccttggccgggagcactgggccctccccacttcgttcttggggacaaactttatggccccagggcctttcctccctcctggcctctccagctagagcgggacgcaggtgcagggtgctggacgcaggtgtgcggccgcttacctggggcgtgcaggccttgggctgcggggaggcggcgggcgccgcgcgtggcccgcgggcgggcggacccggggagggcgctagcgactgcgcgggcggtgggtgtggcgccccggctctcagctgtcaggcgcgcctgccccgccactcgggctgtgaccgcgccgtccccgccgccgcgccatgcgctccaggcttcggcctcttcttccggccagtccccggcctcggggtcaacggctcagggttcgcatctccgcgcccggggtcccggcgccccgtgcccgctgagagcgggaggggccgcgggtgggagcgcggagaaccagggagcacggctgtgcgcgcgcgcggggaggggccgcgccgtcacccggagagcccggcggatcccggactcccgcccgccgctcctcccgccgcgcacctccgctcaccgctcgcccggctccagccgccgccgcactgtgagtacccacgtccggtagcccgccgcccccgcgctctgctcctgcagcttttttttcgtttagttctgatttgggctcctgtggctgttgtttttatgattatacctaaagacaccaccgcctcgctcccaccactgccagtctcccgcttcgctgccctccccaagctcgtccatctagctccgggagccgacgggggttcctcaagctgctctggctgctgctccttgtcgctgcatatggctcttcgcctgtgctttccgctttggcccccgaaattccgttcctttcctagggacccccttcttctgactccgggcccggacccccctcctctcactcagggaaaaccgcgcagggacccaggaccctcaactggggtacgctctcggctcgggcgctgtcttcactgtatgcgggccaggcatagttgccgatttcgagaaaccgagaagctgtcatttcccagcgctgcgcgccctccagccacctccaggagggcgcgaggcttgtcagccggggagttaggacagtgtttttgcctcctacaatgatataaaggacttcaacgcgaaataagggtc

SEQ ID NO: 35773 - DNA, 1209 bp, Homo sapiens
  misc_feature 1..1209: note = chr15:68117465-68118674
  misc_feature 1..1209: note = hyper
  source 1..1209: mol_type = genomic DNA
aatctttctgctcaacgaacgcgggcgccagccgtgagaggagaagctcgggtttgtggaaactggcaatgttgtcccctgaagccggctcgggcaccaagctgggtgcggtgggggccgcgctaggtccgggtgcgcaccgagcgctttggagagggtcaggttcagcaccgcgaacagcggtagcctccgcctctctccttccctggcagacacggttccctcctccttctcctcacccccctccttctcttcacccccctctaccccctgctgtctggagatgggcagtgaccgcccctcccccctccccacccctccttgcactgcccccgcccgcccgcgtgcatgcgcgactgagcagaggggcggccgatccccgaagtccgggcttcaggacccgggccggcagcaccggctgcgagggttgccgaaggcgcacggatctgggcgctgaaaaagccaggatttggcaatggctttgctgtgtggccttgggcaagtcactctgcgtatctgggtttcacttccttcccaatccgaaaacgggattgggttccttgcagcccgggcattcctgaggtctcctttaccccttctcctcccccaagccccgggggctgttgttaacggcgccaacatgggtctgagtaacaaaagacgcctgtccagggggtgaatgagtttggactccccactgccaagtatcccccgcgcgcccaactcggagcgccctgctgggcgggcccgagcctcggcggcggcgctgaaaatggctcatctgctctctgctttctctatttcgcaggagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaagtcgttcctgggcgagc

SEQ ID NO: 35774 - DNA, 775 bp, Homo sapiens
  misc_feature 1..775: note = chr15:68119578-68120353
  misc_feature 1..775: note = hyper
  source 1..775: mol_type = genomic DNA
cgcagcggcagtggctgcagcggccgccgccgccactgtgtacccgacgtttcccatgttctggccagcagcaggcagcctcccggtaccgtcctaccccgctgctcagagccaagccaaggccgtggcggcagccgtggcggcggcagcggcggcggcagcggcagctgctggcagcggtgccccagagcccctggacggtgccgagccagccaaagagagtggcctcggcgcggaggagcgctgcccgagcgctctgtcccgcgggcccctggacgaagacggcacggacgaggcgctgccaccgcccctggccccgttgcccccgccgcccccgccgcccgcacgcaaaggctcctacgtgtcggccttccggccggtggtcaaggacaccgagagcatcgctaagctctacgggagcgcccgggaggcgtacggcgcggggcctgctcgggggccgggacccggcgctgggagcggcggctacgtgagcccggactttctgagcgagggcagctccagctacaattccgcctcgcccgacgtggacaccgcggacgagcccgaggtggacgtggaatccaaccgcttccccgacgacgaggacgcccaagaggagaccgagcccagcgcacccagcgcagggggcggcccagacggtgaacagcccactggacccccttccgccacctcctctggcgcggacggtcccgcaaactctcccgacggcggcagcccccgcccccggcgccgcctcgggccacccccagctggc

SEQ ID NO: 35775 - DNA, 38 bp, Homo sapiens
  misc_feature 1..38: note = chr15:68120630-68120668
  misc_feature 1..38: note = hyper
  source 1..38: mol_type = genomic DNA
cgcgctgcgaaactgggcccacccgcaccctccagtga

SEQ ID NO: 35776 - skipped

SEQ ID NO: 35777 - DNA, 809 bp, Homo sapiens; identical to SEQ ID NO: 1217
  misc_feature 1..809: note = chr15:68121149-68121958
  misc_feature 1..809: note = hyper
  source 1..809: mol_type = genomic DNA

SEQ ID NO: 35778 - DNA, 239 bp, Homo sapiens
  misc_feature 1..239: note = chr15:68122469-68122708
  misc_feature 1..239: note = hyper
  source 1..239: mol_type = genomic DNA
ggcagtatccgggtcacggtttctttgcctctcttgaaattcggtttgttgccttcaagagccagataaggaagacaatcactcgcccgccgatgatttggaaacgaggaaatcctatccagaccaaaggagtatctcccagccaagtcctgcaaatacagacagaggtgagccagcccttgaacccatcgctctccaccgcacccaggagctgggacccaggtcgcccaggttcccag

SEQ ID NO: 35779 - DNA, 488 bp, Homo sapiens; identical to SEQ ID NO: 1218
  misc_feature 1..488: note = chr15:68125223-68125711
  misc_feature 1..488: note = hyper
  source 1..488: mol_type = genomic DNA

SEQ ID NO: 35780 - DNA, 297 bp, Homo sapiens
  misc_feature 1..297: note = chr15:68125947-68126244
  misc_feature 1..297: note = hyper
  source 1..297: mol_type = genomic DNA
tcctcctgatccgctcggttgagattccctgaccccaaagggttggtaaggccggggaggggaaagggtggactgcgcggtgaggtgagcctggagaggcgcccagagtgaccctcgcgactgtctccccagaagcccacgacgccctgcaccatttctcctgcaagatgctgacgccccgccactgcactggcaactgctccttcaagccaccgctgttgccctagggccggcctggccgcacccctgcgccctcaagccatgctgctccttgtaaatacccgctgctgcggtggc

SEQ ID NO: 35781 - DNA, 85 bp, Homo sapiens
  misc_feature 1..85: note = chr15:68126922-68127007
  misc_feature 1..85: note = hyper
  source 1..85: mol_type = genomic DNA
gaggtgggagtgcaccggcggagcggggcggcggaacaccgtgcaacaggtgggggtgggagccgccccgcgggttctggggctc

SEQ ID NO: 35782 - DNA, 736 bp, Homo sapiens
  misc_feature 1..736: note = chr15:68127766-68128502
  misc_feature 1..736: note = hyper
  source 1..736: mol_type = genomic DNA
ggctagtgggggtcccgggttgagcccttcttttatctttcctgggtctccgtttcggcctctatgaaataacacgcaggcctccgtccatgcggctcgtagaaggcgggcggcaggccccgcgccaccggccagcagctcgggaccgggagccctgggctgagggggccgggaagtttcgtggcgggttgtcttggtgggccttggacggagccggctagtaggggcgtgctctgggcctccccgaagctgtgcagacgaggagtcccgctgcgcggtacagccaggaagccagtccctagagtcctttgcgctgggggtcggagccttggagtcccaggatgttccgacggctaagaccagagcggacacaaaggagataacaatgaagagggcgccggcaaatggcgaagcatcgcctccggacaggccatctccgggcagggcccctctagggagcgggaacgtttcatatgcatgggacccaccagatccgctttccgctggaccggtggcgaaactgaggtccagagaggaagagactggagtctccaggccgcgccagggcccgcggaactgcgacggggcgggacagcgcgggtgtgggagtttgccggcccctttccccaccgcggattgcacctttggaagctgcacttttcttctctgtaaaatgggcatcaccattaccacccaggcaggaagttccgtggctgcggctcgacagaggagccag

SEQ ID NO: 35783 - DNA, 115 bp, Homo sapiens
  misc_feature 1..115: note = chr15:68260535-68260650
  misc_feature 1..115: note = hyper
  source 1..115: mol_type = genomic DNA
tccatgttcacaaaacgcagcccgactggtggaactcgcgactccagacgcagagaagctgtgggcagaggcggaggcagagggtgggaatgcagcctggcgttggagtggggag

SEQ ID NO: 35784 - DNA, 40 bp, Homo sapiens
  misc_feature 1..40: note = chr15:68549442-68549482
  misc_feature 1..40: note = hyper
  source 1..40: mol_type = genomic DNA
ctgcaggcctctccccgccagcgagcgcacggcagcggtg

SEQ ID NO: 35785 - DNA, 65 bp, Homo sapiens
  misc_feature 1..65: note = chr15:68569420-68569485
  misc_feature 1..65: note = hyper
  source 1..65: mol_type = genomic DNA
aagcagagcctggcacgtagtcgacctctaatattcattggataaacgatcgtttcaaatcctaa

SEQ ID NO: 35786 - DNA, 529 bp, Homo sapiens
  misc_feature 1..529: note = chr15:68723523-68724052
  misc_feature 1..529: note = hyper
  source 1..529: mol_type = genomic DNA
tcagggctggcttcccgctcccagccgcgcgcccctcgggccggaggttcctgccgcgccccgacacctggagtgcattaggcggcggcgcgcgtctaggcgacggcggctttccccagattattgaataattgcataattccgagcgcgggttgggaggcaatgccgggtccctaccccgggtgtcaggtaacgtttcgggggtcctgcgctgcgcgactgtgtcccgccgctgctggccgggcagacgagagctagcccccgcctaccggccatcgccccggggctttgctctgtctttggccggaggcactctgcgcagccctcacccccacccttcagccctccggggccgccgcgcccggctctccaaactttgagatgcttccccggagccaggcaggagggcagccagggcacactctcttggcgctgattcccttccccagccggggccgtgcgccctcggcgctcccgggacacccgagtgcccctggcagccgtgcgggaaccccggcatgggccttgg

SEQ ID NO: 35787 - DNA, 265 bp, Homo sapiens
  misc_feature 1..265: note = chr15:68870820-68871085
  misc_feature 1..265: note = hyper
  source 1..265: mol_type = genomic DNA
ggccaccctgtgccccgggccagcgcgaggtgggggtgcgggcagggctcccgggcttgcggctgccacgcccctcccagcccgccgcgccacactcacggcccacgggccgactttgcgagcctccagggggcgaacccgaccgccttctttgcccgcgcagcgcctcggccgtccagcctgtgacttcaccagcgtccccgggccagcgggacacccgagagcccggggcgccgcccgttctcccagccggcaggtgccggga

SEQ ID NO: 35788 - DNA, 173 bp, Homo sapiens
  misc_feature 1..173: note = chr15:69136224-69136397
  misc_feature 1..173: note = hyper
  source 1..173: mol_type = genomic DNA
acatacacacacacacgtgtgtgtgtttcggggctgctcaggaggacaggcggctctgcgctgcggctgtggtgggctccgtgcacaccgcgctaggctcatagggcggctggcaggtccagagagcggcgtgggagcagctgctgccacggtggcagcggagatgaaggtgt

SEQ ID NO: 35789 - DNA, 30 bp, Homo sapiens
  misc_feature 1..30: note = chr15:69366538-69366568
  misc_feature 1..30: note = hyper
  source 1..30: mol_type = genomic DNA
tctcgctgcccggggcgctctgcgctgcgc

SEQ ID NO: 35790 - DNA, 86 bp, Homo sapiens
  misc_feature 1..86: note = chr15:70877578-70877664
  misc_feature 1..86: note = hyper
  source 1..86: mol_type = genomic DNA
aagctctcttatccccgggcccctgcctcccggtaccgccgatgcgcagcgattgccaggcaggtctccgccgggctgggagagcc

SEQ ID NO: 35791 - DNA, 43 bp, Homo sapiens
  misc_feature 1..43: note = chr15:71055227-71055270
  misc_feature 1..43: note = hyper
  source 1..43: mol_type = genomic DNA
ctgccctacctggtgcgagccccggccccggggactggggagc

SEQ ID NO: 35792 - DNA, 37 bp, Homo sapiens
  misc_feature 1..37: note = chr15:71055857-71055894
  misc_feature 1..37: note = hyper
  source 1..37: mol_type = genomic DNA
cctgcctgccacctgcgggccccgggcagcagacgtc

SEQ ID NO: 35793 - DNA, 79 bp, Homo sapiens
  misc_feature 1..79: note = chr15:71146120-71146199
  misc_feature 1..79: note = hyper
  source 1..79: mol_type = genomic DNA
tcaaccccctctgcccgaggagttgtcgcgcgcagtcagcgccccgaactcgcgcgcggcccggcgccccctcggggcc

SEQ ID NO: 35794 - DNA, 131 bp, Homo sapiens
  misc_feature 1..131: note = chr15:71408456-71408587
  misc_feature 1..131: note = hyper
  source 1..131: mol_type = genomic DNA
ctcccgcctggggcccgagagccgggcaagtctcggtcagcgctccttgagtcctggcctggggcctcggatctgtgtgtctgtctgtctcagtttagttgctgcaacccagcgagcgcctggagcccgag

SEQ ID NO: 35795 - DNA, 143 bp, Homo sapiens
  misc_feature 1..143: note = chr15:72476743-72476886
  misc_feature 1..143: note = hyper
  source 1..143: mol_type = genomic DNA
cacagccagagcttgcgcaggccggggagctgccaggagtgccgcagccgtgcccccacctgctgggctcccgggaaaaggagcgcgcgcccctctgagccccttcctggtgcagtgcgtgtaccaagcgtggtaactggcct

SEQ ID NO: 35796 - DNA, 101 bp, Homo sapiens
  misc_feature 1..101: note = chr15:72490031-72490132
  misc_feature 1..101: note = hyper
  source 1..101: mol_type = genomic DNA
cggaacccccgagaccggcccccgggccgcaaccccttacccgccctcctcggtggcctcgctccggcttaaagcggtcatcccggcgcctgcacccagcg

SEQ ID NO: 35797 - DNA, 211 bp, Homo sapiens
  misc_feature 1..211: note = chr15:72564738-72564949
  misc_feature 1..211: note = hyper
  source 1..211: mol_type = genomic DNA
ccacccctgcggagacggggcgagccccgcacccttcccgtggcccggccgcaccgccctgtgcccgtggtggcggccacacaggccagcctggcgagtactcacggcgaccccgggccgcgcgcggccgcagccgacgggacgagcggcccgggacgccccgcgggggcggagcggcaggccaaggggcgggggccgggcctggcgggcg

SEQ ID NO: 35798 - DNA, 30 bp, Homo sapiens
  misc_feature 1..30: note = chr15:72565377-72565407
  misc_feature 1..30: note = hyper
  source 1..30: mol_type = genomic DNA
caggattctctggttcgacaatggaagtcg

SEQ ID NO: 35799 - DNA, 30 bp, Homo sapiens
  misc_feature 1..30: note = chr15:73611158-73611188
  misc_feature 1..30: note = hyper
  source 1..30: mol_type = genomic DNA
cctcagccattcagacgcgggggaggtgat

SEQ ID NO: 35800 - DNA, 727 bp, Homo sapiens; identical to SEQ ID NO: 12210
  misc_feature 1..727: note = chr15:73659600-73660327
  misc_feature 1..727: note = hyper
  source 1..727: mol_type = genomic DNA

SEQ ID NO: 35801 - DNA, 278 bp, Homo sapiens
  misc_feature 1..278: note = chr15:73660446-73660724
  misc_feature 1..278: note = hyper
  source 1..278: mol_type = genomic DNA
cgagggcagtggccgcagccggatgctcctgcggctggggtcttggcggcccccggccccctcctcctcggcgtcctcttcctcgtccatgatccacgccttggcccccacctgctgcgggaggctgtagagccgcttgcgcatggacggcggcagcttgtccatggcgccaggggccggggtcggaccgggccgggggcaggagcgcggcgccgcggacgggctccaggtccgcccgccggtcagtccgcccgtggggacgcgtcctttgccgccgg

SEQ ID NO: 35802 - DNA, 132 bp, Homo sapiens
  misc_feature 1..132: note = chr15:73660793-73660925
  misc_feature 1..132: note = hyper
  source 1..132: mol_type = genomic DNA
cgagtccccgggctcgccgcgctacacctcctcccgggcccggctgggcgcggggaccccgcgctcccttcttgcctccctccctccctctggcgttcaggggcgcggcgcgccgcccggctccaggcgccc

SEQ ID NO: 35803 - DNA, 245 bp, Homo sapiens
  misc_feature 1..245: note = chr15:73661607-73661852
  misc_feature 1..245: note = hyper
  source 1..245: mol_type = genomic DNA
cctcagctgggtctccgactttcctcttgggaggcgaccgggttcgtctggatgcagagtcccggccttcccgcaaccctcctggagagggggcttccggaaatgcgccgcgtcggggaggctcccacggttttcctgtgacatgggcagggtgcgaaccccgcgccagtctttcccctgcaaagcctcgcagcagccaggcaaggagggcgtggggaaacagggagacacgcacagggcgcgcg

SEQ ID NO: 35804 - DNA, 164 bp, Homo sapiens
  misc_feature 1..164: note = chr15:74044686-74044850
  misc_feature 1..164: note = hyper
  source 1..164: mol_type = genomic DNA
ggggtcgggaatgagcgagggtccggcagatttggggctccgaggccacaggtgaccggggcgcggggaggccgaggagacgccgggcaggtcccagcgcgtgagccaaagtcggagggctgggagggcgccgggatcccctcagcccacgcccggcattcccc

SEQ ID NO: 35805 - DNA, 30 bp, Homo sapiens
  misc_feature 1..30: note = chr15:74045079-74045109
  misc_feature 1..30: note = hyper
  source 1..30: mol_type = genomic DNA
ccacggctcagttcacgttccgaaaggtcc

SEQ ID NO: 35806 - DNA, 44 bp, Homo sapiens
  misc_feature 1..44: note = chr15:74045854-74045898
  misc_feature 1..44: note = hyper
  source 1..44: mol_type = genomic DNA
ggcgcggagggacagcgttctggggacttcgttcctttcccacc

SEQ ID NO: 35807 - DNA, 164 bp, Homo sapiens
  misc_feature 1..164: note = chr15:74421982-74422146
  misc_feature 1..164: note = hyper
  source 1..164: mol_type = genomic DNA
cgctgaaagaaatgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttga

SEQ ID NO: 35808 - DNA, 471 bp, Homo sapiens
  misc_feature 1..471: note = chr15:74422386-74422857
  misc_feature 1..471: note = hyper
  source 1..471: mol_type = genomic DNA
gcagtgggcttcaagcgctggtttagccacaaaagaccagaagtaaagagttccggcttaagaggctgggcagggctgcggtgggctggggaggggggtgtcccttcccagcacgccctgcagggctgtgcgttctggtgtcgggttagactagcaggcggggcgggggggttggggcggcggggcgggggagactagggcttatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccc

SEQ ID NO: 35809 - DNA, 30 bp, Homo sapiens; identical to SEQ ID NO: 12214
  misc_feature 1..30: note = chr15:74428205-74428235
  misc_feature 1..30: note = hyper
  source 1..30: mol_type = genomic DNA

SEQ ID NO: 35810 - DNA, 322 bp, Homo sapiens
  misc_feature 1..322: note = chr15:74428801-74429123
  misc_feature 1..322: note = hyper
  source 1..322: mol_type = genomic DNA
ggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtc

SEQ ID NO: 35811 - DNA, 302 bp, Homo sapiens
  misc_feature 1..302: note = chr15:74658095-74658397
  misc_feature 1..302: note = hyper
  source 1..302: mol_type = genomic DNA
ctcgggtgaacgcagcgagcgagggcagaggccagcagaggcgaggagtggatgctgcagggccgcaggccgggcagagaaacgcataccgggtcgctccctgcttcgccgccgcctcctggcagggccagcgaagccagtgctccagcgcccccgtaacacctcaaagcgcacggagtccgtgttggggaacttggcggcagagtgactgggacctaggacctgcggtggggccgccgccgcctccgcggggccgagcgcctggacctcgccctgaggtaaacgcgggtcgacccgggggg

SEQ ID NO: 35812 - DNA, 52 bp, Homo sapiens; identical to SEQ ID NO: 4248
  misc_feature 1..52: note = chr15:74658501-74658553
  misc_feature 1..52: note = hyper
  source 1..52: mol_type = genomic DNA

SEQ ID NO: 35813 - DNA, 43 bp, Homo sapiens
  misc_feature 1..43: note = chr15:74658554-74658597
  misc_feature 1..43: note = hyper
  source 1..43: mol_type = genomic DNA
ccaaacttgaccacgctgcgaccttttcactctgtgctctgac

SEQ ID NO: 35814 - DNA, 140 bp, Homo sapiens
  misc_feature 1..140: note = chr15:75119374-75119514
  misc_feature 1..140: note = hyper
  source 1..140: mol_type = genomic DNA
tgacacccaaaaccccgctccagcatcatgctccggccaagggggagtggggggaggggcgaccggacgagggaccgaccggagcctgggacgaggaagggggtgcacgtgcgtttctgacgaaacgataatcccttaat

SEQ ID NO: 35815 - DNA, 30 bp, Homo sapiens
  misc_feature 1..30: note = chr15:75250808-75250838
  misc_feature 1..30: note = hyper
  source 1..30: mol_type = genomic DNA
gggcgggcgggccaccgggaaagtgctggg

SEQ ID NO: 35816 - DNA, 320 bp, Homo sapiens
  misc_feature 1..320: note = chr15:75251094-75251414
  misc_feature 1..320: note = hyper
  source 1..320: mol_type = genomic DNA
ggctgaccccctccccgtctcctggtgggatcaggaaccctcggggtatgctccgaaccgggacttcggtctcggtccagtctccatgggccccacacagcggtgggggctggaggcacagcagccttgggaagaaacaaagactgtccgcagcgcgtagcggggcgtggagaaccgagggctgtgtaaggtcaggccctgagaaaaagcccccgaaaggctggaagttacgttggaacgggctggttgtggaaggagcgagctctccgtccccgggagtatgcaagtttgggctgcacgatcacttggaagggattggg

SEQ ID NO: 35817 - DNA, 333 bp, Homo sapiens
  misc_feature 1..333: note = chr15:75251478-75251811
  misc_feature 1..333: note = hyper
  source 1..333: mol_type = genomic DNA
cggttctgcgtccggccaggttggccctcgaggacccagccgtccccaacctcctaaactgctgtcggatgtagaagactcgcattcactgctctccacagtcggtgaagggagaacgccgaaaagggccgcattccctcctgccggtcccctccccttcccgcgctccctctgcagcacttaaaatgtaaatgtacatcgtgattagccgcggggtcgctaattacagctgaagccattcattacactgtcagcgcgcgtcgcagcccgccggctgtgcgctccctcctagccgtgaaggggtgtagggggtgggggcgggagatgcgggga

SEQ ID NO: 35818 - DNA, 15 bp, Homo sapiens
  misc_feature 1..15: note = chr15:75470896-75470911
  misc_feature 1..15: note = hyper
  source 1..15: mol_type = genomic DNA
ctgtggggggtgggg

SEQ ID NO: 35819 - DNA, 15 bp, Homo sapiens
  misc_feature 1..15: note = chr15:75471217-75471232
  misc_feature 1..15: note = hyper
  source 1..15: mol_type = genomic DNA
cggtttccccatctg

SEQ ID NO: 35820 - DNA, 34 bp, Homo sapiens
  misc_feature 1..34: note = chr15:76005149-76005183
  misc_feature 1..34: note = hyper
  source 1..34: mol_type = genomic DNA
gggagctgagtggagcgagcgcggctctgctcct

SEQ ID NO: 35821 - DNA, 26 bp, Homo sapiens
  misc_feature 1..26: note = chr15:76627511-76627537
  misc_feature 1..26: note = hyper
  source 1..26: mol_type = genomic DNA
taaaggtggaggcggagctcaaaagc

SEQ ID NO: 35822 - DNA, 276 bp, Homo sapiens
  misc_feature 1..276: note = chr15:76627575-76627851
  misc_feature 1..276: note = hyper
  source 1..276: mol_type = genomic DNA
cgcggggccggtgaggaacgttcaccgtggaccatggtcgaataatgttagcgtgcactcggggcctcgccctagccttctgcaaagcctcggcctgcgccctcggctgcatccgtttcgacgccaaccaacctcatgctcttagtagaacggcagtagcgaccgcgccctcaggcccacaagcccgaaggtctgggcagggtctggaatggcggtggagacactttatccgcaggcgtttcacctcgcgccccacccaggcgcacaccaagttct

SEQ ID NO: 35823 - DNA, 30 bp, Homo sapiens
  misc_feature 1..30: note = chr15:76628327-76628357
  misc_feature 1..30: note = hyper
  source 1..30: mol_type = genomic DNA
gaggggcagcagcagcggcagcagcagcaa

SEQ ID NO: 35824 - DNA, 462 bp, Homo sapiens; identical to SEQ ID NO: 4252
  misc_feature 1..462: note = chr15:76628564-76629026
  misc_feature 1..462: note = hyper
  source 1..462: mol_type = genomic DNA

SEQ ID NO: 35825 - DNA, 58 bp, Homo sapiens; identical to SEQ ID NO: 4253
  misc_feature 1..58: note = chr15:76629162-76629220
  misc_feature 1..58: note = hyper
  source 1..58: mol_type = genomic DNA

SEQ ID NO: 35826 - DNA, 281 bp, Homo sapiens; identical to SEQ ID NO: 1221
  misc_feature 1..281: note = chr15:76629814-76630095
  misc_feature 1..281: note = hyper
  source 1..281: mol_type = genomic DNA

SEQ ID NO: 35827 - DNA, 29 bp, Homo sapiens
  misc_feature 1..29: note = chr15:76630096-76630125
  misc_feature 1..29: note = hyper
  source 1..29: mol_type = genomic DNA
gccccgcgcccttccccggcagagaagcc

SEQ ID NO: 35828 - DNA, 490 bp, Homo sapiens
  misc_feature 1..490: note = chr15:76630519-76631009
  misc_feature 1..490: note = hyper
  source 1..490: mol_type = genomic DNA
ggagccgtagcagccagggagatgagggcggccgcaggcccagcgctgacaccgccgcaccttgggcccgcaggctgttcggcatcaagtgcgccaagtgccaggtgggcttcagcagcagcgacctggtgatgagggcgcgggacagcgtgtaccacatcgagtgcttccgctgctccgtgtgcagccgccagctgctgcctggggacgagttctcgctgcgggagcacgagctgctctgccgcgccgaccacggcctcctgctcgagcgcgccgcggccggcagcccgcgcagccccggcccgcttcccggcgcccgcggcctgcatctgcccggtaagcgcgccggggcctgtgccggggtgagcggggtgtatgtgcgtgcgtgtgtgtaggggtacgcttgtgtccctaacgagaagttgtcagttgtgtgtggttccgtctgccgggatagtgtttttctgtatcagtgcggaactgtgtgctg

SEQ ID NO: 35829 - DNA, 74 bp, Homo sapiens
  misc_feature 1..74: note = chr15:76632517-76632591
  misc_feature 1..74: note = hyper
  source 1..74: mol_type = genomic DNA
cgaaatcgggccccggggggctgggccacccggaggttgggctcggggcgggtgggtggcggcccctcgctaac

SEQ ID NO: 35830 - DNA, 159 bp, Homo sapiens
  misc_feature 1..159: note = chr15:76634951-76635110
  misc_feature 1..159: note = hyper
  source 1..159: mol_type = genomic DNA
gggggtggggctgggcgcatgcgcgctgagggccctcccagaagcaggagcgccccattggcgacccctgggcacctggcggcccaggcccgcgggcaggaggcgggacccgtttgggcgggaaacctgcggcacttgtggcggttgagcggcggactc

SEQ ID NO: 35831 - DNA, 180 bp, Homo sapiens
  misc_feature 1..180: note = chr15:76638317-76638497
  misc_feature 1..180: note = hyper
  source 1..180: mol_type = genomic DNA
ggtcagctgttagggcgtgggggagggagggggcagggagcagggacgaggaagtggaagaataggggattgtgaggagtgatttctttccagattatcgagactcaagactttccagaacgtggcaaagagccctggaagaaatgtcccaggaacgccgcggtcaggaccgaggctccc

SEQ ID NO: 35832 - DNA, 120 bp, Homo sapiens
  misc_feature 1..120: note = chr15:76638855-76638975
  misc_feature 1..120: note = hyper
  source 1..120: mol_type = genomic DNA
gctgcggcccctcagcctctggagagccggggggcggccctcgccccggcagaaagcaacctgtggcggcactgcgtccccgcgagctacaaccagacgcggccgcgctcacctgggcgt

SEQ ID NO: 35833 - DNA, 158 bp, Homo sapiens
  misc_feature 1..158: note = chr15:77924553-77924711
  misc_feature 1..158: note = hyper
  source 1..158: mol_type = genomic DNA
gcaaccccaggagggcgcagccagggccgatggcggcccccaggggcactcgccgcggggctgcccgctcggggctcggccgcggccgcctggctcacctgcatctcgggcgcgccttcggtccgctcggctcggtcaccaatcgcatgtctctccag

SEQ ID NO: 35834 - DNA, 159 bp, Homo sapiens
  misc_feature 1..159: note = chr15:77927216-77927375
  misc_feature 1..159: note = hyper
  source 1..159: mol_type = genomic DNA
caggcacccggcgggcgcgcagacccgctggggggcgggggcgggggcgagggctattcctggtgcggtgactgacgcaggcaaggcgcggccaccacatctctccgcccccgactcacctgctccctgcctcagtgatctcggcggagaaatggggga

SEQ ID NO: 35835 - DNA, 429 bp, Homo sapiens
  misc_feature 1..429: note = chr15:78111440-78111869
  misc_feature 1..429: note = hyper
  source 1..429: mol_type = genomic DNA
cacgccccccacggacgcgcacccagcaccccacccccgccgctgcccccgaggctcccgcccaatcagaggccgcgcgcgccgcgccgccggcgggcagacacaccggctccccggcctgcgcccctgcggccctggccccgctgcagcgtcccggcccggccacactcaccgtcccgggcgcgccgtccgcgcgcggctccgctccgggccggcatcccccggctcggctgcctccggtccccgctccggcctcggttcccgctccgcagggctcggctccgcgatggtggccgcggcggcgagcgcggcagggagggcgtgtgtatgcgcgtgagagcgcgcagcgtgtgcatgtgcgtgtgcgcgggagggtcccggctcccctgcgcgtcccgctcctgcctcctgctcgccacgatgcgatgc

SEQ ID NO: 35836 - DNA, 400 bp, Homo sapiens
  misc_feature 1..400: note = chr15:78111916-78112316
  misc_feature 1..400: note = hyper
  source 1..400: mol_type = genomic DNA
cgcacacacgcgcacacccaggcgcgcacacccggctccgcactcccgactcgccctcctggagcgctcacaaagaccccctgccgggacggccggagcctgcggagcgcggccctgggcccctccgggacccgccggccttaggtgccccgctgctccccgtagggaccccgcgggcggcccggctcccgcaccctgcctggccgggccgcggccgcgctcccagcccgaacctgggcccaggtgccgactcgggcttctcgcactcccgcgggaagcgccggccccctccgcggcgccgccgcccttctcccccccttccagtccggcctctccggcgcctccctgccttgtcccacctgcccagcccggtcctcgttctccccgctgctctccgtct

SEQ ID NO: 35837 - DNA, 300 bp, Homo sapiens
  misc_feature 1..300: note = chr15:78236768-78237068
  misc_feature 1..300: note = hyper
  source 1..300: mol_type = genomic DNA
gacttttctcacgcccgcacacactgtttgcggagaggccagggcagacaacctccacccgtttccggagccactggcgccccctcattcccgctccagcagcccatgcctcgcttcacccctggtgcctcatcatcgcaccaggaagccagggcccgggaatttctttttccggtccgacagggtcaactgagtcgacgatcacttgacttggactaacggcctctgggagggcggggcctgctcgagtgaggccgggagcggaccgcagcccgctggaggtgccgggggcgaaatgct

SEQ ID NO: 35838 - DNA, 113 bp, Homo sapiens
  misc_feature 1..113: note = chr15:78632556-78632669
  misc_feature 1..113: note = hyper
  source 1..113: mol_type = genomic DNA
gggctgggagttgagcgcataccgagtaggggctgcgggggagcgggggcagggccggcggggcggggccagaagcccggcggggttgggggcgctctcctagtgactcaagg

SEQ ID NO: 35839 - DNA, 39 bp, Homo sapiens
  misc_feature 1..39: note = chr15:78632683-78632722
  misc_feature 1..39: note = hyper
  source 1..39: mol_type = genomic DNA
cgcaaagcgccagtctccgccttgcgagctcagagtgtg

SEQ ID NO: 35840 - DNA, 74 bp, Homo sapiens
  misc_feature 1..74: note = chr15:78633047-78633121
  misc_feature 1..74: note = hyper
  source 1..74: mol_type = genomic DNA
ttgctgaatgtttggcgccctcctcgatggtgcggactttatctcgtgctagatcatagcgaggagagattact

SEQ ID NO: 35841 - DNA, 141 bp, Homo sapiens
  misc_feature 1..141: note = chr15:78912231-78912372
  misc_feature 1..141: note = hyper
  source 1..141: mol_type = genomic DNA
tcccaggcaggaggtcggttgagagcgtatggcgttctgagtagtgcaggcctcggcaccgagggcggaaagcgctctgagctcacagccgcacgacagaccgccggcctgggccctccaggaattccctgcagccttgcc

SEQ ID NO: 35842 - DNA, 531 bp, Homo sapiens
  misc_feature 1..531: note = chr15:78912441-78912972
  misc_feature 1..531: note = hyper
  source 1..531: mol_type = genomic DNA
cggcttcccccagcaggctcctctggagagcgggaggaagacaggaggcgctctcccggtggagggtccctcagcgacgcagccaggagcgctaggaggctacaaccggaggagaggctggcgctccagctccagccccagtcccgaagcgactcccctcttcccgaggtggccttggccaagtcttcagccatctccgtcaaatgaggaggtgggcgggatgcagacggtggagcgggaggcttgggcgcgccagtttgggagccagtgcgcggggcagggcgacgggcagcgcggggacgcgaatccccaactcctgcgcccaagacgaaggacccggtctcgacctccccatcacccggcgcgtaccagcgcccgctcagtgactcccaggtttggtggtggctaggggtgggaggtgagccgaaagggaaaaagccaccccacccaagtcgccgccgggctggagccagtctgcgcgggttccgagtccccggcgacggcgccagccctctccgctcgcccgcgcgg

SEQ ID NO: 35843 - DNA, 242 bp, Homo sapiens
  misc_feature 1..242: note = chr15:78913228-78913470
  misc_feature 1..242: note = hyper
  source 1..242: mol_type = genomic DNA
ccccagacctggagccgtgcgggcggagacgcgcggggctcctctccgcttcgccgccgctgggtttccagcgccctcggacccgcgggaggacaggaaccatccggagtgaagctgcgccaggcgcgggcgggcgggcgggcgtgcgcggggcggggcgtacgtgcggtaggggaaggggctccaggtcccagtccccagcgccgggcgagctccttctccgccgggctgggtgctccggc

SEQ ID NO: 35844 - DNA, 201 bp, Homo sapiens
  misc_feature 1..201: note = chr15:78913480-78913681
  misc_feature 1..201: note = hyper
  source 1..201: mol_type = genomic DNA
cgaccagatctgagcaggtgctgtcaccaccaccaggaaggagagggactcagtttctgtcccaggtttccggggcgtgtgcagctcccgcagggggttgggaccaccgggctaggcgggcgccgtaggagagacgctaacacaccctgggaaggacgccttgtgtatctcatgctattaaataattgttaaatattttag

SEQ ID NO: 35845 - DNA, 253 bp, Homo sapiens
  misc_feature 1..253: note = chr15:78933391-78933644
  misc_feature 1..253: note = hyper
  source 1..253: mol_type = genomic DNA
ccctccctccttccccgaaaagaactcaccgcgcccgcaaagggcgaccaggaagaaaaggaccagggaaggcgcgcgcctcatggccggcggggccgggtggcagccgccgcgagctccgctgtggggtcacagggcacccgtgagccgcgcggtcgagtgagcgccggtcctggcccccgaggtttgctggcggggcggcgctcactaggaccccgcggagagccccgccgagccccgcccactcagggat

SEQ ID NO: 35846 - DNA, 36 bp, Homo sapiens
  misc_feature 1..36: note = chr15:79103265-79103301
  misc_feature 1..36: note = hyper
  source 1..36: mol_type = genomic DNA
ccagaagcgcggcttcgctcccggcccggcccgacc

SEQ ID NO: 35847 - DNA, 900 bp, Homo sapiens; identical to SEQ ID NO: 1224
  misc_feature 1..900: note = chr15:79382098-79382998
  misc_feature 1..900: note = hyper
  source 1..900: mol_type = genomic DNA

SEQ ID NO: 35848 - DNA, 269 bp, Homo sapiens
  misc_feature 1..269: note = chr15:79382999-79383268
  misc_feature 1..269: note = hyper
  source 1..269: mol_type = genomic DNA
agccgcggcttcttgaatccagatataccattccccgctggaacctcttctccgctccgcagagccccagtacccggaagatgccgcccgaccctcctccggtgccgggcaaactgagggactggcgatctgcgcgctggcgaggggcaggcggagtcatgtgacgccgatccctcgaagagcccgtttcagcagcgcggacagggacacacgcacgcagccccgccgaggcgcagagccgcgcgcaggctgcaacttggtgcctcctc

SEQ ID NO: 35849 - DNA, 56 bp, Homo sapiens
  misc_feature 1..56: note = chr15:79383328-79383384
  misc_feature 1..56: note = hyper
  source 1..56: mol_type = genomic DNA
tcccctcatctccccttctctccctcggatgttaaaaagcaaatcagatcaatttt

SEQ ID NO: 35850 - DNA, 708 bp, Homo sapiens
  misc_feature 1..708: note = chr15:79383438-79384146
  misc_feature 1..708: note = hyper
  source 1..708: mol_type = genomic DNA
cgccccaccgcggcgcactgtagacctggggttaagtgccagttgtcattttctcctccaaaggctcgccccccccccccactttatttctaatacgaggtggaaggaggaaggtgggtggcgaaatagagctgcaaaagcgtccagtcctagtctttgcatagtcagccgggtcacattgaattccagcatccggctgcactcccggcggcttccccagctacctgaggacagtacagggggtgagatggggtggtggttggtgaacgttggttactttattttatattattttattttgagagttgccataattaccggcgccaccccccgtgcaccctgaggtctggttggcgagccgctgctgggagttttctgcaaataccccccaaagcctgaaggcgggcttcaaacgcaggcgccggggaccatgggagccttcaaatagctgcgctggcgcaatgataccttaatgatagattttccgttcttatttttagctctcattcgcctacacagttacacggcatttatccgagaacgtcacagcgcccgcatgctgcaccgggagggcgcgcgggccgccgggcgagccgggagctggggcggggagcgcgcatcgctgtctgccgcagagggcagcgagctcgccccgacccggagcaagccgcgcctggcccgggcgctttgcagcggggatgggtgccc

SEQ ID NO: 35851 - DNA, 222 bp, Homo sapiens
  misc_feature 1..222: note = chr15:79502064-79502286
  misc_feature 1..222: note = hyper
  source 1..222: mol_type = genomic DNA
cgccgggaaatcaaacgtccatttacatcttgtcctgcaaagcttcatcaaaacttctttgccggccagtcacgtccccttatcacttttccagcccagctttgtgactgtaagtgttggacggagaactgataagggtaggtgattgacactcacagcctccggaacccccgcgccgcctgcacttgcgtgatggggaaaacctggcgttcccgctctggg

SEQ ID NO: 35852 - DNA, 720 bp, Homo sapiens
  misc_feature 1..720: note = chr15:79574779-79575499
  misc_feature 1..720: note = hyper
  source 1..720: mol_type = genomic DNA
agaacaaaggggacacgagttcaaattcctgccagggtctgagacctgcaacgtcagactttgggagcgtcccctcacttctccggaccccaggagtggccgcgcctgctccgcgctcaccctcggggagtctaggagccccctgctaagttgctgagcgagtcggagccccaagagctagggtcgagggggtggggcagcaggcgcctctgccgaggctgcaggtaggcacttccccacccccgcggccccctccttcctccttcctcgcagctcgcacacccacacaaccctcgcccgtcgcggctggagagctgctctcggcgccagcgggcagcagcgcgtcgtcagccagcacagccggccgaagaccaagccggaggtctggggctgcgcagagacctgcacacccgcagcgcggaaccgggggcgattcctatctttctttcatgcttctttctttttcttaaaaccaaaccaaaccaaaccaaacccaaaactcccctgctcccaccgcaacttggaggagcggtggaccgatttgaaggaactgacgcagaggttttattcacgaaccttgaagaagttctgggcaagtgactcaacaggacccgcggggcccggggtagccccagctcccggcgctggttcagtctggcagtgccctctggcagccaacccgcagctgcaggtaggggtgctggacgccccctgattttg

SEQ ID NO: 35853 - DNA, 252 bp, Homo sapiens
  misc_feature 1..252: note = chr15:79576060-79576312
  misc_feature 1..252: note = hyper
  source 1..252: mol_type = genomic DNA
gctggcacactctgccggcgcggccggagccccggagttcagcacctcggacagagcccgagccccgccgcccgaggcgcacagtgagcgtggaacagcccggctccctagcccccggccaacgctgctctcagttcagggcagctacgtaacaccgcccctagctccgcgccagaaagggctctcgaatcgcaaaagcaaacgtgttcgatttctgatctgcttctaactgcttcccgtgactgcagaagg

SEQ ID NO: 35854 - DNA, 15 bp, Homo sapiens
  misc_feature 1..15: note = chr15:79724105-79724120
  misc_feature 1..15: note = hyper
  source 1..15: mol_type = genomic DNA
ccccgcgggtggctc

SEQ ID NO: 35855 - DNA, 210 bp, Homo sapiens; identical to SEQ ID NO: 4263
  misc_feature 1..210: note = chr15:79724351-79724561
  misc_feature 1..210: note = hyper
  source 1..210: mol_type = genomic DNA

SEQ ID NO: 35856 - DNA, 187 bp, Homo sapiens; identical to SEQ ID NO: 4264
  misc_feature 1..187: note = chr15:79724606-79724793
  misc_feature 1..187: note = hyper
  source 1..187: mol_type = genomic DNA

SEQ ID NO: 35857 - DNA, 634 bp, Homo sapiens
  misc_feature 1..634: note = chr15:79724863-79725497
  misc_feature 1..634: note = hyper
  source 1..634: mol_type = genomic DNA
cgcccggggcgcctcggaggtaagttcggagagcccgggccgggcggagggcgggagcgcacgagtgtgtgtgtgtgtgtgtgtgttcgcggtgtgcccgcggctcggtgcacacgcgcgcgggttgtaaagtcaggagctgcgggagcgcctccctgcctcggcttggccccggagcattgcgggccgcggaggtgtgggggcccttgtcgctgcgctcagggcagcggcggaaaaggtgtgtgcggatgcggggcggggccgcacctggtggacagagcagggattcgggaagagaagccacggaagatgatcatgcagtttggggcaagttttcctggttgagcatcgcttcaggaaacggtgttttgagggttaaatatgtgagctatctgtgcaaaaagcctgacacatcagaggcgcgaagtaagatggaaagctggacaagccccaggtggaccgaccggtgcatccaattcttaaattgagatttccagtcacgttgatgtggaatgggatcgttgttcttcccgagggtttgataaggatgctcaacttcacctgtcagaaagcacgggagctgggcctggcccgcggggagcgtaagctcgctcacacgcggtccaactcaggc

SEQ ID NO: 35858 - DNA, 30 bp, Homo sapiens
  misc_feature 1..30: note = chr15:80543967-80543997
  misc_feature 1..30: note = hyper
  source 1..30: mol_type = genomic DNA
tgaggctcagaacagcgagggtgcctgagc

SEQ ID NO: 35859 - DNA, 133 bp, Homo sapiens
  misc_feature 1..133: note = chr15:80544203-80544336
  misc_feature 1..133: note = hyper
  source 1..133: mol_type = genomic DNA
cggcagggctcggcccgacttcagcgagcagatcctccgcctgcggccggtgacccgcgcgacgccccggcggcaccgacaatgctgtgctccagccccgcaggcgccgcggcagcgggtcccgggatgctcc

SEQ ID NO: 35860 - DNA, 302 bp, Homo sapiens
  misc_feature 1..302: note = chr15:80544364-80544666
  misc_feature 1..302: note = hyper
  source 1..302: mol_type = genomic DNA
cgtgcgctcccggggtcctggctgggccggcgccgagcccagggcgaccgcggatcgccggctacggcgtttcccggtgacgggggcgcgggctcgcggggcgcggggggcgctgcccaggcccggctcggcaggagtcagagcccccagcggcgcgggcgagcccgggccagcagccgagagggggctctgagcggagccgcggccgtcctggcattttaaaggcgaggcagctggacgctgttcaagcggaaacgcagagagaaacttcagcccccggggcagagcgttggcagcgaggg

SEQ ID NO: 35861 - DNA, 38 bp, Homo sapiens
  misc_feature 1..38: note = chr15:81073195-81073233
  misc_feature 1..38: note = hyper
  source 1..38: mol_type = genomic DNA
ttcccagacccaaggcgttggggcgctgggaaagagga

SEQ ID NO: 35862 - DNA, 456 bp, Homo sapiens
  misc_feature 1..456: note = chr15:82336760-82337216
  misc_feature 1..456: note = hyper
  source 1..456: mol_type = genomic DNA
cgcgccgttgagtgccgtgttcttattccgggaggcgcggatcatggagaagtgctcggcagcagagatgatctccctccgagccatggccacatcctccttcctgcccgtcacaacaaagacaggctcctccccgcgaactggggtcttgatgtaagtattggtcttcgcccgcagcgctttgattttacaacctacgaaccagggtgcggaggagggagtgggagagagagacagacacgcccattatcctggggtaaccgcggggaccggggacagcccgcgtccaggacagcgagacggcaggacaagagatgggcggaaagggggcgtctccctcactgacctcgggccgcgccacgggctgggcagcggatcccacccgcgaggcgctcgaggaacagcccattggctgcctggccctcccccagtgactgcagtcgtcccgaaccaaac

SEQ ID NO: 35863 - DNA, 283 bp, Homo sapiens
  misc_feature 1..283: note = chr15:82339904-82340187
  misc_feature 1..283: note = hyper
  source 1..283: mol_type = genomic DNA
aacaatgaggccatgcggccgcagccgcacacgggctgactggggagatctcgtggtgccgcggggcggtcccggggctcgaaggcagaggctcccctaggtgtgccctgcctgaccccggctacaggaacgagcgctgtgggcctcggtttctcacccgtaaaatgaagaaaataatccccgcctttaccacctcgtgggtcgttcggaagattaaatgcgacagtggatgggcgcgcgcttacaaatcagtagacagttccgcaagcgcctttacttttga

SEQ ID NO: 35864 - DNA, 438 bp, Homo sapiens
  misc_feature 1..438: note = chr15:83314955-83315393
  misc_feature 1..438: note = hyper
  source 1..438: mol_type = genomic DNA
agcagacactcttcccgctagcaagggaccgcaccgtcacctgaggggcagccaagaggcgggcggtgcacctgtgccttccagaataggaaccccacccacttgcccctcttccccaccaacgacacagcccagtagttgactcaggtgccaggagagagcgcggggaggctgggcggtagccagggagaccaagggaagcggttgccagagaaatgcggcgtcagtcagggccggggctgcaggcgcggggcgggggaggagagacgcggcctcctcccaggcgggcctggcgggaggcaccccggcttctaagagcgaattcggctcccgactctcttcccccagctgagagcacggtgcaaggggccagggctgcagggagcaaagtgcccccgaaaaataagcgcgcgcccacgaaagcgcccaagagcccag

SEQ ID NO: 35865 - DNA, 409 bp, Homo sapiens; identical to SEQ ID NO: 4268
  misc_feature 1..409: note = chr15:83316231-83316640
  misc_feature 1..409: note = hyper
  source 1..409: mol_type = genomic DNA

SEQ ID NO: 35866 - DNA, 410 bp, Homo sapiens
  misc_feature 1..410: note = chr15:83316641-83317051
  misc_feature 1..410: note = hyper
  source 1..410: mol_type = genomic DNA
gggctgacgggctgaccggccagccggcgggcgagagacgcgcacgcacgtgggcactatttttgcagcgggccgcgcgcagccccgcaccccggcagcttatgaagctcctacgagccgctcctcggagccgccccccggccggatgcggagcacctgtgtcggccccgcccgggccctcgcctccgccccctcgcgccccgcccctcctagcaggccgagccgaggagggctccgccgcccacccggaacccggcggggactgccgccgctgctagccacagctgccccctggggggccagagacctaagcctgagcgcgccatcacctaagtgacccttgccgagtcactgtctgccctgggcctcagtttccctcttaacgaaagagggcacgatttacaagcccc

SEQ ID NO: 35867 - DNA, 700 bp, Homo sapiens
  misc_feature 1..700: note = chr15:83348912-83349612
  misc_feature 1..700: note = hyper
  source 1..700: mol_type = genomic DNA
cgtcgcaggctcacccggcgcttgatggacatggtggccacgttctggagcacaacgtactgcacctcactgcggagaggacgggtcagagcaccccgggcccctcggttggggcaagggtcagcggatgaggggaaaaggtggggcaagtcgttgcggggagaggaccagtgcggagggcaggactacggtcagtgtggagcgggtgggcagaggtggaagcggctggtgggcgtgagggggcggagccgggcagcccgtggggcggggcaggaggcgagggagggggcggggctgggggcggagcgcacctgtggctgcgcagcaggcgcaccagcgccttggcgatgacgcccacttccgccttgggcgccaggtggaagtagagctgcgccaccgccatcaccaccgcggcgctgcggctctgcagcaggggtttggtgttgcgcagcagcagccggtggtcggggtccatgacatagggctttcgggagggggcggccgcggcggccgtctcctcagaccccgcgcccttggcctcgtcctcctctgagccgtagaaggctttttccgcgttctcctctagtagggattcctggacggggagaccgacgggtctgtgggcgcctccccgggacacacttcggcccgctctgcctgggctgggcccacttacgttctgggtggggctcaggaactg

SEQ ID NO: 35868 - DNA, 65 bp, Homo sapiens
  misc_feature 1..65: note = chr15:83349671-83349736
  misc_feature 1..65: note = hyper
  source 1..65: mol_type = genomic DNA
cgatcagcaggttacagagtttccggtagtttttgtgaatcaggtcgatgcgctccgggcagacc

SEQ ID NO: 35869 - DNA, 30 bp, Homo sapiens
  misc_feature 1..30: note = chr15:83378057-83378087
  misc_feature 1..30: note = hyper
  source 1..30: mol_type = genomic DNA
agaaacacctggaaccggagggtttctcct

SEQ ID NO: 35870 - DNA, 30 bp, Homo sapiens
  misc_feature 1..30: note = chr15:83378625-83378655
  misc_feature 1..30: note = hyper
  source 1..30: mol_type = genomic DNA
tcaatcagggccgcgcgctgaggtcttaaa

SEQ ID NO: 35871 - DNA, 165 bp, Homo sapiens; identical to SEQ ID NO: 12261
  misc_feature 1..165: note = chr15:83378857-83379022
  misc_feature 1..165: note = hyper
  source 1..165: mol_type = genomic DNA

SEQ ID NO: 35872 - DNA, 127 bp, Homo sapiens
  misc_feature 1..127: note = chr15:83620954-83621081
  misc_feature 1..127: note = hyper
  source 1..127: mol_type = genomic DNA
caggggcgaagagaccgcggaatggccgaggcaggaggccggccagggcaccggtccccgtcaggtgcccccgtgcccgggctgtatgggaggggaagggccacgggctccgcgcccaggccagggt

SEQ ID NO: 35873 - DNA, 28 bp, Homo sapiens
  misc_feature 1..28: note = chr15:83775821-83775849
  misc_feature 1..28: note = hyper
  source 1..28: mol_type = genomic DNA
gccaggtttaaaaaccggatgccggctc

SEQ ID NO: 35874 - DNA, 112 bp, Homo sapiens
  misc_feature 1..112: note = chr15:83775890-83776002
  misc_feature 1..112: note = hyper
  source 1..112: mol_type = genomic DNA
cgaggtttcaggggcattttgtcctttcccacttctgggccgtgggctcccccatagacgatcccgcgggcccttcctcctctgacaccctcggatctggttccacctttcc

SEQ ID NO: 35875 - DNA, 116 bp, Homo sapiens; identical to SEQ ID NO: 4273
  misc_feature 1..116: note = chr15:83776022-83776138
  misc_feature 1..116: note = hyper
  source 1..116: mol_type = genomic DNA

SEQ ID NO: 35876 - DNA, 112 bp, Homo sapiens; identical to SEQ ID NO: 4274
  misc_feature 1..112: note = chr15:83776157-83776269
  misc_feature 1..112: note = hyper
  source 1..112: mol_type = genomic DNA

SEQ ID NO: 35877 - DNA, 37 bp, Homo sapiens; identical to SEQ ID NO: 4275
  misc_feature 1..37: note = chr15:83776270-83776307
  misc_feature 1..37: note = hyper
  source 1..37: mol_type = genomic DNA

SEQ ID NO: 35878 - DNA, 385 bp, Homo sapiens; identical to SEQ ID NO: 4276
  misc_feature 1..385: note = chr15:83776332-83776717
  misc_feature 1..385: note = hyper
  source 1..385: mol_type = genomic DNA

SEQ ID NO: 35879 - DNA, 112 bp, Homo sapiens
  misc_feature 1..112: note = chr15:83776768-83776880
  misc_feature 1..112: note = hyper
  source 1..112: mol_type = genomic DNA
cgcgccaggtgcccggggtcacaggcgtcaatacggccatgcccctgccctggaggggcccaggggccggtggggagcggaacaaacacggacactacgaacctggccgtgt

SEQ ID NO: 35880 - DNA, 378 bp, Homo sapiens
  misc_feature 1..378: note = chr15:83875705-83876083
  misc_feature 1..378: note = hyper
  source 1..378: mol_type = genomic DNA
cgttcgcccgggacccagggtatccaccaatgaccctgcccggagccgaagcctccgtcgcaggcccgctgcccggcggcgtggcttcccggtcggcaccggctttccaggaggaaggcagcgtcgggcctgcgggggccggacccgccttcgaaagtgggcggaaggatggccgccctggcggagtgcgggcgaggccgggagcccttgcctcagccccggcccggtcttcttcgtgccgcgccgccctcagccctcaccacagccggccgcgagctgcgggctcggggctgaggcgatggggaaagggggcgggcgcgccatcatgaaggggaaaatggtgggcgggcgggcccgcgcgcggccgcggtactcacc

SEQ ID NO: 35881 - DNA, 282 bp, Homo sapiens
  misc_feature 1..282: note = chr15:83876201-83876483
  misc_feature 1..282: note = hyper
  source 1..282: mol_type = genomic DNA
cgcgaagatgccgggaggccgcccccccgcgggccgacgaattgcgccgcgctccccgcgggcctcaagccgggcggacgagcggccgctccgacgaggggaagcggcgaggcggcggctgaggcaaggggtgggcggggggcgcagcaggcccggcaaatcacggcccggcagcgggggaggggagcccccggccgttcggcgctcgcccgcgtccggccgcgccaaggtccccgccgccgccgccgccgccgccgcgcgcgctgctcaccagcgccgcgt

SEQ ID NO: 35882 - DNA, 495 bp, Homo sapiens
  misc_feature 1..495: note = chr15:83876654-83877149
  misc_feature 1..495: note = hyper
  source 1..495: mol_type = genomic DNA
cgctcccctccccttccctcccgcgcgggccggttaattcctaggtacacggccggctttcgcggagaaaccgagcgcgccagcccggcttctcggctggcgggcgggcggtgggcgcgtcctcccccagcaccgaagcccgcgccgggcgggcgggagtgcctactccggaggacgcccgccgcctgctctcttttgttcttggcccggagctgcctgccgcagcccagccaatcaccacccggccgcccccttcccctcccgtccgtgccactctgggggttctccccactcgcgccccccgctcccacgcccacctcccgctgactcgaccctctcctggctacccccagccagccacttccgcggctgctctctggtgagtgggggacaaaggcgctccaggcctgggggacggcggcgcgaggggaccctctgctgggcaccaagctgccggaaagagcaccgctccggagtcagcgaccttattggatt

SEQ ID NO: 35883 - DNA, 216 bp, Homo sapiens
  misc_feature 1..216: note = chr15:83951897-83952113
  misc_feature 1..216: note = hyper
  source 1..216: mol_type = genomic DNA
gagcggtggcagccccgcagccacaaagagatgccttaaatgagaagaacatgtttctacaccgcatttgtgaaagtttggctcggagctacgcgctgattaatatcagatctccttcactcgcctcgccacaatcttgtcacatctggctgacaaatcccgaggaactccggcaaagccaggcggcggcggggctccgggtctgggcggcggctc

SEQ ID NO: 35884 - DNA, 54 bp, Homo sapiens
  misc_feature 1..54: note = chr15:83952768-83952822
  misc_feature 1..54: note = hyper
  source 1..54: mol_type = genomic DNA
cgccccgttctccagagaaacaatccccggagagaaagacggccagtgtgaaat

SEQ ID NO: 35885 - DNA, 34 bp, Homo sapiens
  misc_feature 1..34: note = chr15:84034378-84034412
  misc_feature 1..34: note = hyper
  source 1..34: mol_type = genomic DNA
ctgtacagactggtacgggcggaccgggctctgc

SEQ ID NO: 35886 - DNA, 98 bp, Homo sapiens
  misc_feature 1..98: note = chr15:84115713-84115811
  misc_feature 1..98: note = hyper
  source 1..98: mol_type = genomic DNA
ttgtccctccctaggcgcatttctgagccttcctttcttaaacatacaccgagcgaaaatgcgccggagggaggcgatgttgcctgtgagccaaagcc

SEQ ID NO: 35887 - DNA, 42 bp, Homo sapiens; identical to SEQ ID NO: 1229
  misc_feature 1..42: note = chr15:84115812-84115854
  misc_feature 1..42: note = hyper
  source 1..42: mol_type = genomic DNA

SEQ ID NO: 35888 - DNA, 206 bp, Homo sapiens
  misc_feature 1..206: note = chr15:84115931-84116137
  misc_feature 1..206: note = hyper
  source 1..206: mol_type = genomic DNA
cgacccccaggacatccccacgcccagcttcccaggccggtcttctgcgcggctcaagtagcccaggtctccacgcaacaatgaagcgtgggcggccccagcagcttcatttgcatatcgccgcggcttggccaatgggctgcgcaggggctttggaacgcagtgttgccatcggcgtgcgcgcgtgtgtgcgagtgtgacagcgg

SEQ ID NO: 35889 - DNA, 176 bp, Homo sapiens
  misc_feature 1..176: note = chr15:84116377-84116553
  misc_feature 1..176: note = hyper
  source 1..176: mol_type = genomic DNA
cggccccccgaggctcccgggcctttgggactcctgttccctgaagggcctctctcggggctcaatttcttcccgcctaggagggcgcgagggtggggtgaggggccgcctgctctctcctcggcgtcttggcgccttctccttcccattccctggcccccggctctgccctgggc

SEQ ID NO: 35890 - DNA, 113 bp, Homo sapiens
  misc_feature 1..113: note = chr15:84116651-84116764
  misc_feature 1..113: note = hyper
  source 1..113: mol_type = genomic DNA
cgcgcgaggggaggacgaccacagggagtacgatgccggcagggcctcccccgagtctccagccgtttggttgggagagcctcgtggggggcccatcctccaccggccaccgg

SEQ ID NO: 35891 - DNA, 49 bp, Homo sapiens
  misc_feature 1..49: note = chr15:84116828-84116877
  misc_feature 1..49: note = hyper
  source 1..49: mol_type = genomic DNA
cgaaatggccccgtctggactgtgcccggctccccggctggggctctct

SEQ ID NO: 35892 - DNA, 121 bp, Homo sapiens
  misc_feature 1..121: note = chr15:84322476-84322597
  misc_feature 1..121: note = hyper
  source 1..121: mol_type = genomic DNA
ggcggcggcggtggcggcgtcggcaatcccggctcttggcacaacgcctggcggccggcccagggcgaggagtggcttccaggaagcgggcggaggagcgttccagccgagtcccgccgtc

SEQ ID NO: 35893 - DNA, 44 bp, Homo sapiens; identical to SEQ ID NO: 12276
  misc_feature 1..44: note = chr15:84322993-84323037
  misc_feature 1..44: note = hyper
  source 1..44: mol_type = genomic DNA

SEQ ID NO: 35894 - DNA, 89 bp, Homo sapiens
  misc_feature 1..89: note = chr15:84748531-84748620
  misc_feature 1..89: note = hyper
  source 1..89: mol_type = genomic DNA
attatttacctggcccgggtggcattttactttgcatccttgattgggagtctcaggggctacgaacaaacgttttatccccgggtagc

SEQ ID NO: 35895 - DNA, 720 bp, Homo sapiens
  misc_feature 1..720: note = chr15:84748678-84749398
  misc_feature 1..720: note = hyper
  source 1..720: mol_type = genomic DNA
cgtcccttcatctccgggggacggccactctcagggttcccgaggagcccgctccgtgcacctaggccctaggtcggctcccaagccctggcccgccgctacaccagcggtttcttacccgcaagtacaaatgtgacacagacaccagctcctcgtgctcttggctcccagggtttctttcaccgcgcctcagcacctgcagcttctccactcttacagcgcccgccgtcgtcaaggcaacagagggatgcccggtgacagactcggcgccggcttccggcgccgtaagagaagcgtccgcgcgggcgttctggacccgcagagttctcggcgtttccgaagctcttggtgtggccgggacccgggagaaggagcagggctggtggggctgctgcagccggtgagtgtgtgctggcgctgggggctggaacctcctaggccagtctctgggcggtgccgcaggaccctgctcgctgcggctctgaggcggaaacaggggctggggccgagcgcgggctggaagctttggtccctggagtgtcgcttccagtctggggccgaggcggtcgcctgtgtagacccgggatcctcaaatagaacgaatccgggaccctgcagaaatgaagggcatgtagtgtagaggtttttcctttttatttagaaaggaatgaaagaccgacagtgcacctgcttggatagtaagcacgtgacccaaaactt

SEQ ID NO: 35896 - DNA, 778 bp, Homo sapiens
  misc_feature 1..778: note = chr15:88799221-88799999
  misc_feature 1..778: note = hyper
  source 1..778: mol_type = genomic DNA
ggaagaggttcccatcgtccggccgccggcaattgatctcagtcttgctgcagacacaatttgcagggcaagccagcacggagcccacatagtccagccagacgcttcccagcaagaaaatccgccagaaactacacttggctgggcaaagagagacatccatctccgatcgctgcttctaaaaaagaggaggaggagaggagaggggggtggggtggggggagtggggagagcagggggggaaggaaacaaagacggcgagggaggggggaagggggagggggggcctctgcctttgaaacgccgagcgatcagatgcaaaatccttcagcgtctgaaaccatcgcggacgccgccgccgccgccgccgccgccgggtgggagccgcgaggagcgcctagtggcgcggtctgccgggcatggtggccggctcggcgatcgctgactcgccgggtccgggggctctggaagcgaggcgcgctctccgactccgagactttgcagggttgcaacagacggtggggaggcaaaaaaaaaaaaggaaaaggaaaaaatggtgctaaagtcaccaagtcccacctactgggcagaattaaaacggacacaccacgcacctgcaaaacacacacactcactctcacacatacacacacccggagcccgaggaaaggaagagaaggaagatgcagtaggagctgcagcagccgccgcgaatggctcgccgcgcggctgcagaaatgtacaagtgctccgagccttacgaaacgcacgggttatc

SEQ ID NO: 35897 - DNA, 302 bp, Homo sapiens; identical to SEQ ID NO: 1234
  misc_feature 1..302: note = chr15:88800000-88800302
  misc_feature 1..302: note = hyper
  source 1..302: mol_type = genomic DNA

SEQ ID NO: 35898 - DNA, 592 bp, Homo sapiens
  misc_feature 1..592: note = chr15:88800412-88801004
  misc_feature 1..592: note = hyper
  source 1..592: mol_type = genomic DNA
cgcgctacccggttttgctgcaatccggaccgcggtaggaagtgaaatgaacgtggcggaggtgattggggagtgctcccaagccttgggtggggggcgctcccaagcctgggtgggtggggggcgcaggctcacggacggcgacggggggtgccggagcgcacagacaccccagagaagcacccagagccggggaccgggaccgcagacgcgcagtccttggtctgaatgacactcatttccgtaatctagagtctggggctctggtcttggctgggaggggactgcgggacatggcacgctaggtgccccccgtgcccgctgcgctttcttggaggtgggttttgcattcggccttgagcaggcatggatcggggaaggaagaaacaggggtcgaaagggctgcgctggagagccgaggtggccccgggcgagctgtgcgtgcaagagaaatggccgggggaaattgagatgcaaggggcatattttggcaagcgccacgccagcaccgtcagaggccggcttctcgggctcagctctcgggtgagctgagctggctgccgggtgagggggcgggcgggctgctttctcc

SEQ ID NO: 35899 - skipped

SEQ ID NO: 35900 - DNA, 152 bp, Homo sapiens
  misc_feature 1..152: note = chr15:88801088-88801240
  misc_feature 1..152: note = hyper
  source 1..152: mol_type = genomic DNA
cgagagctcagatctcatccgggaaagaagtgtgtgtggggggggccccgcttttgcgctggtagggatttttttcttaataaaacataaagatgccaagtgtgagctgtttgctgaaaaaaaaaaaaacgagcattcgctgtgggaaagga

SEQ ID NO: 35901 - DNA, 30 bp, Homo sapiens
  misc_feature 1..30: note = chr15:88801449-88801479
  misc_feature 1..30: note = hyper
  source 1..30: mol_type = genomic DNA
ggggaaggggtatgccggtgtcaccgcctg

SEQ ID NO: 35902 - DNA, 63 bp, Homo sapiens
  misc_feature 1..63: note = chr15:89147617-89147680
  misc_feature 1..63: note = hyper
  source 1..63: mol_type = genomic DNA
gtgtctcttctggtccgggcacaactggattcagcactaatgacggactctaccccagcggag

SEQ ID NO: 35903 - DNA, 1700 bp, Homo sapiens
  misc_feature 1..1700: note = chr15:89147722-89149422
  misc_feature 1..1700: note = hyper
  source 1..1700: mol_type = genomic DNA
cgcggaccggcaccccctcccccaaagctgttgccatggccacaggggacatttgatgtgaagcgcggctcccccctctccactcgctttctccgctcgccttcaggatgacgtcatgaacatccgtggccctgacaggccacccgtgggttggtctcagctttaaagcagctgttctcctctggcccggcagccgcggcgactgtgtttgcacccggcggaccatgccaggactacggacccggacaggactgatggcctcagagaggcaagtattcaaggggcacttcacaaacagcttcctcaaaccccaccccctcccccgcactgcgctgctacttgcactgcggctcctggggggaagcaaagtaccggcagctgggtggtgaggggctttcttccagaaagaaacggagagcaagtggtcttcctccctagccgcggcgacccatgccaggtaaaaatcccagccgaggtccccggtcccgtcccctcctccaggtcaagggctcgggactggagaagcagccaactggagctgatattcgggaagctaagcctgaggctgctctggagggccggagaagcgagcggccaggcttggcacccgccaaatgtgccttgccaaaatgaagaggaaggaaggcgactccggagcccagcaggtgagcgctcctacgggatgctgggcaggctagaggtgtgggggcgtctggttccagtacctgcccggggcgacgcggaaacccagcttgcagtttgtttcgctcggtcccgcgcccagtaggagaaagacggccccacagcctcgcgggagccggctctcgcaacccagccgccccaagcccgccgtcgcccctcctcccgcgcttctcgcccctgattctagatgcagctgacttgttgcatgcagaagagcagctgggttcggcgttccaagcctctcctctttgctttgcctgccaccagatctgagcgccaggctggccagcacccagagagcccagagccgcaggaaaaaatgtgaaaagtaccaggagaccactgggtaatcgccccagtgcaaagggcctttcttcctacccaccgcaattgcagcaaataactccagggaggggaatcagaggcgccggggattgcgccctgggagagccctatctgctgaaagagagcgcctaatgccgttacttcccagtgtagcctttccactcggcagaccaagcgcctctccttcgagtcgctacccgcttggagtcggctcagaatcaggctgctaaaggtccctggagcccctcccccagcgaatccgagcctgcagcttcagcaccagaggctggacagcgccccggccctagggtgcccatggtcggtgcctgcgcacggctcggcctcccagcccacgccacttgcgctcgcggcccctcagaccccacgcggaggaggtcaggaggtgacacaggttcgcggaagaaagcgggactcatcttcctcatttctccagggatttaggtgtgggattctaggagagcattctctctcgctctggccacgaccagtggaaaaacttggcgccaaatttaggcagtggtgcggggagcagaggcacgattgcaggcggtgagcaaaggggcaagcgggacagaggatctactgtgagccccaggctctggtgttccgtgaaaaatcgccacatttaaatc

SEQ ID NO: 35904 - DNA, 397 bp, Homo sapiens
  misc_feature 1..397: note = chr15:89248428-89248825
  misc_feature 1..397: note = hyper
  source 1..397: mol_type = genomic DNA
ggaggctgacgggggcgcagcttttcctcctgagtgttcgctgcccgggctggcggcgcggagccggcccgccgccgtctgcccctctgcccggcccttttttccagcagttctgccaagaggagcggggtgcggggcaggagatgaggaaggaggaggagaagaaaagggagaggagaggaggagacgcaaagggaagggaggggtgggaagggaagaggaggcaaagggtggggagaggaggggaggggaggagaggagaggggaggggagggactggatcgggcgccaatcccgcccgccgcgcgccgcccgggctccctcgggctctcatttaccccggccgctggcagcgggacccaggcgccttgccgcctcgctgcggccgcttggtccc

SEQ ID NO: 35905 - DNA, 324 bp, Homo sapiens
  misc_feature 1..324: note = chr15:89346003-89346327
  misc_feature 1..324: note = hyper
  source 1..324: mol_type = genomic DNA
gtccttggtctctcccggggaatttgaagacccagagactcgcagctccccgtgagcctccccgctgacgccttacctccccctctccaccatcccctgccatcccggtgtacgccacccccaaaaaaactttcagccagctcctcggtgagggtcgttccaaatcgtggccgacagtagcgggctgcaccctccttagatcgcgtcgtggccagcctcagctgcagaaccccgccgggcgcccgggagccctgtcccgccgcggcggcctcagagtccgggcacttggggattctctgagggtgcagccctcctgggcccctc

SEQ ID NO: 35906 - DNA, 448 bp, Homo sapiens
  misc_feature 1..448: note = chr15:89346346-89346794
  misc_feature 1..448: note = hyper
  source 1..448: mol_type = genomic DNA
cgcaatgcagatgcgggccctccagcccttctcgcgccgccttcctcccgccagccccggagctgccgggtccgcgccgccccggggagcgctcctctcccgccctgagcgcaggccggcttccccatcggcgcgccggtccggagccagggtccagcgcgctccagacgcctctgccttcccctccccctgtcggccgcccctcggtccctgggggtggggtttccctttgcgctcgccccctcccgcccccacccctcacgggccctcccctcccccgcccgtccctatgtatgtgtcacagcgcgccatgcccgcccgcccgcccacctacctccccgccgctccagagggggctcgcagagctgaggacgcgcgcagcgctgctcaaggtctctctctctcagcaccctcgccggccggcgtctgacgcgggtgccagggtctc

SEQ ID NO: 35907 - DNA, 422 bp, Homo sapiens
  misc_feature 1..422: note = chr15:89346881-89347303
  misc_feature 1..422: note = hyper
  source 1..422: mol_type = genomic DNA
cggacaggacgccggcaggaggaggggtgcgcagcgcccgcgcagagcgtctccctcgctacgcagcgagacccgggcctcccggccccaggagcccccagctgcctcgccaggtgtgtgggactgaagttcttggagaagggagtccaactcttcaaggtaactgtctccttccctccagagcgaggctctcccagggcgcccggcgagccaggaacgggactgagactgcacgccccggggctgggggctgcactgccttggtctccgccctagagctatgtgtgccgggggcgcagcacatccaccggctgcgtccgcggtggagttgagcaaactttttggctgttgcagactcagtgaatggggcaaaggaacacgtgaggaggggcacttgtctcctagtccgccaggatgaagga

SEQ ID NO: 35908 - DNA, 58 bp, Homo sapiens
  misc_feature 1..58: note = chr15:89438805-89438863
  misc_feature 1..58: note = hyper
  source 1..58: mol_type = genomic DNA
aaacccccgcgctcccgccagaccagccccttaaaggaacacgcgcacctttccctcc

SEQ ID NO: 35909 - DNA, 455 bp, Homo sapiens
  misc_feature 1..455: note = chr15:89903431-89903886
  misc_feature 1..455: note = hyper
  source 1..455: mol_type = genomic DNA
cccacaagaatcatccgaggctgcaccgtgaccagcccctcaagacagagcgagacccaaataacccccgcgggcggacccgcagcgttctgtgactccaccgcggagtccaaaaggcagctgagggtgggagcggaggggaagggaggggggccacaggcgctcgggcgagggaggcgcgtcaatgggccgcaggggccggatcggtggcctaatggattcaggcctgcacggcagaggcgcacccggcggcctgcccgcgctctcaatagcggacaatggagtcccggggtgacctgaacaaagaatttggaagtagttaaactgcagaacacgttctcggcctgggtgcctcctttcaaaaggagcgctgggagaagaaaagaaagcactggggggtgaagggagtgagaaaatgcccaggggaaaagttggtaggtcgccctagttgccgc

SEQ ID NO: 35910 - DNA, 131 bp, Homo sapiens
  misc_feature 1..131: note = chr15:89905759-89905890
  misc_feature 1..131: note = hyper
  source 1..131: mol_type = genomic DNA
gcggccaggagcccccgctccgccactgccgtgcctgcctcccgcagctgtctgccatgcgctcgccggggcaggggcgcccggagggcggctagagctgggcctgagcccgggaacgcgcctgatcaggg

SEQ ID NO: 35911 - DNA, 145 bp, Homo sapiens
  misc_feature 1..145: note = chr15:89906124-89906269
  misc_feature 1..145: note = hyper
  source 1..145: mol_type = genomic DNA
ggggcttccctttgccgctgggcgggatgagaggtgcgctcccactgcgggtgggaggcaggactcagtcatcccgggcaaagggttgtggggcagtgggaagcgcccagaggtgaggactttgggtgagcggaaaggggaaggg

SEQ ID NO: 35912 - DNA, 137 bp, Homo sapiens
  misc_feature 1..137: note = chr15:89908862-89908999
  misc_feature 1..137: note = hyper
  source 1..137: mol_type = genomic DNA
cccaaagccccaacccgccctaggcttgcaggccggcctccgcgcgcggttaccgcgagtctcgctgaggagccattttgtgcagcatcctgcttaaatcacactccgaggggctcgttcctcgctccctcttcccc

SEQ ID NO: 35913 - DNA, 30 bp, Homo sapiens; identical to SEQ ID NO: 12296
  misc_feature 1..30: note = chr15:89909322-89909352
  misc_feature 1..30: note = hyper
  source 1..30: mol_type = genomic DNA

SEQ ID NO: 35914 - DNA, 1575 bp, Homo sapiens
  misc_feature 1..1575: note = chr15:89910521-89912096
  misc_feature 1..1575: note = hyper
  source 1..1575: mol_type = genomic DNA
cggcctctccgtgagcgctctcggccctcctgtggagatcgccacgtcctatcacacgcgtccctaaaccttgtcactcgagcattcttgtctcccaaactctgatggtccgcagtgggtactgggctccctgggccctgggaggaagacggaggagtttgggtgaaagatcagacggtgcgcagccctgaggcttctgagggcagagggtgcgcttccttgccctcggggcggggaagccgtgaacgccgaggccattgtaaggctgggtggtgcggagcgcgggaagggggctgggatttgaatgggagcctgtgattggccgatccctggactgacgtcacttccccgcggggcgattagcctgcgagaggagggccggcggtccagtgcgctgggggcggccggggcgctcgaggctctctaagcgctccgcgcgggtgccctacgtgagccccgggacgccgtcgaggcaggccggcagcgccggtgccaggacgcacggaacggggagcaggggagaaatgcgccgggagggcgagggaggaagggaactgggcgggggctgcgggcctaggtggcgggagtcagcgtgtgcgtgtgtctgtccatcccctctggctctccgcgtgcgccccaggatccgggcacggcgtccgctcaggctcccgcgctcggcaggcagcagcacgtggagcccacggcgcggcagcggcactggctaagggaggcccgtttctctctttggttatctagctgtatgagtgccacagagccgtcataaagctagataaccgaaagtagaaatgattctcacaacttctgcgtgcgagcgcccgccccaccgaccgccccggcccggcccgcaagagccagaggagccgagaggagcccagcgccggcccagcggactccagctcgacggagcggccgcgccccgaccaggtacctgacctcggctctctctctggggacacttgcagtgccagctttcccccagtcctcctctttcctggtcccccacccctatcccccagcgccggagcaggaaccccaaagtggagcgggccggggagagggagggggttggggttgcagaggggtcgctggaaggggaaggcgccagccttcgccttcaccccataaatcaggctggaacaatccgctcccggagccgtggacggggattttgggatgcaaatgcgatgggagagagacagcggtcggtagggggtgggtggagggagtgaatggggtgggctgggggctgccctgccgctaacaatgcggcctttatcgaattattcgacgagtcagcccctgagcgccattagcatacggctggggggttgccggagcttcgcccctcggtgaggtcaagttcttgataatttgatcacttttcacgggctctggcagctgcctttgtgtgcagttggggggtctgtgtgcagcgtgaagcggagcagaactggcggggagtgcgctcaatggcaaggggccagggcaggggcctccctccccgacgggtcggccctgccctgcatacaaaccaagagccggcgggtgggcggg

SEQ ID NO: 35915 - DNA, 375 bp, Homo sapiens
  misc_feature 1..375: note = chr15:89913180-89913555
  misc_feature 1..375: note = hyper
  source 1..375: mol_type = genomic DNA
tcctactttggtccccggttctcctcagagataatcatgggcagaaggttttctgaatccctttgtaccccacctccattttgaaaggccagtttccctttttttctgacaggaggctggtgaagggtgactagagtgtttcgggattcacgaggctatgggctgcatcccttgggccgtccctcccttcccaatgcacctgggagcctgtgtgctgatggtgacctcatttcggaggaaaccggagcagcacttcctgcccccttgccctgcactccctgccttcctccctcaccggccaacgggtgtgggcaaaccctgggccccgggcttcgatcttcccctcccaccacccctacccgtttgctgtgttgc

SEQ ID NO: 35916 - DNA, 315 bp, Homo sapiens
  misc_feature 1..315: note = chr15:89914135-89914450
  misc_feature 1..315: note = hyper
  source 1..315: mol_type = genomic DNA
cgtttgggcttcatttttgtctccggtttgtgctactctttcttcatccaaaaaggcgttggagatcccgagaatctgctgcagcttggaagccagaatcttagagaatctcggatacttctcaccccattcctttcattttacacctagaaatggtgtaaaaaggcccagtggctcacggaaggtcgcacagaaggccactgacagggcagcgatcagtacagccaccgtggtgggcgaggcatccggggcttccttttctctggtccacgaactcccaactccgaacgctgtgggactgcatgggcctctgcc

SEQ ID NO: 35917 - DNA, 608 bp, Homo sapiens
  misc_feature 1..608: note = chr15:89914866-89915474
  misc_feature 1..608: note = hyper
  source 1..608: mol_type = genomic DNA
cgagccggcctgttcgctggctcgggcgcccggttccgggctgggcaaggagcgcttggccatgagccgcgggacagcccaggcgggacggatgcgccctccagggcccaggcgaggccgcgcggtgcagaaccgccgggatttctccaacccgggtatgcgcacccacagcagcggcctttggaggccgcggcgccattttagtggccttccttcccccttggcatctgtcgtgtatggtgtggctgggtgtccccagctccccccatcccgctctgactttggctgccccctccgccagcctggatagagtgaccaatcagctctgacctagggtgggatgcgcgtcaccatggcgacggctagggcgccctggcagtgctgcccatcgcagagggcaagtcttcactccgcctagatgggtgtgaagggaaggtggggacaggtgggggggaggggcggatggagggaggccgtgatgcctcgtccgcattcccaccccattttgcctagggtcagttcagctgggtcaggcaggggacaaatggatggtgtggaaggggcctgggtaggggcctgggtttgtcctggggcggctcttccacgag

SEQ ID NO: 35918 - DNA, 82 bp, Homo sapiens
  misc_feature 1..82: note = chr15:89921956-89922038
  misc_feature 1..82: note = hyper
  source 1..82: mol_type = genomic DNA
tctacaccagggcaccgcctgggcctacggccttccgaacccgaagcgcccgcagcccagagctggcatcaggccatcaggc

SEQ ID NO: 35919 - DNA, 248 bp, Homo sapiens; identical to SEQ ID NO: 1239
  misc_feature 1..248: note = chr15:89922499-89922747
  misc_feature 1..248: note = hyper
  source 1..248: mol_type = genomic DNA

SEQ ID NO: 35920 - DNA, 1149 bp, Homo sapiens
  misc_feature 1..1149: note = chr15:89942626-89943775
  misc_feature 1..1149: note = hyper
  source 1..1149: mol_type = genomic DNA
cgccccccagcagcccgggccgcgtttgaccactagtagggcagaaccactgaccggcaggcggcgctccccggggctcccggctcgagccccagggcaccgggaggagtaaggaccccgagcgggagggagacgactggggggcgcgcggcacaaagagctttttattcaaatttgtttagagtttcgcgaatttgcatgaaaaatgtgtgagaaaagccagctccggtgacctcatccgcacctgccattaacgttcaattagcggctgaatagcggccgccgacgcgacgtgcagagaatccggcctgccccgcgcagcgagggcggcgggccaggcccgggatagggtgggaccgagggagggggacgcggcgtagggccccggcctactcctctggcccggagacccaggacctcgtccgcactccaactctccgagggaacgcggggatctcaggactcacgagcccaagattgtttggagcgcgccgggagccttaggatgcctggctccctctgggcgcagaaaagggcgggcttgcctcctccccaggacggaaggtggccggaagagccccgtcccagctcagatgggcttccccgccatcttccggacaaagtgtcaagtacaagttcaagttcagggccaggcccgggggggggcgctgagccttacccggccgcctttgttctctggcataatcgctcccacgtccccctcccgggcggggcccagcagagacccccgccccgccccgccccgccgcgccccgcaggagcctcctcctcccgccggcgcggcgcctgtgccctggtcccggtgtccccgctcggtgccaccgaaggatctaggggctcgggccggggagggggtggaggggggagtggaggcgcgatacgaacccgtgggagcctccccaaccccgcagtcccagcggcaaactgtgcttggtcggacggatgcccgcgcggaggtaagagccctttgcgggattcgcccgtatccctgtgccccgccccccgcctgggactacgcgggccccaaggagcggggcggaggatggtgtgctgaaaaccggctgggcagccccgctgggcctccggtggggtggggggcgcactgtcgctccagggctctggggagta

SEQ ID NO: 35921 - DNA, 109 bp, Homo sapiens
  misc_feature 1..109: note = chr15:89945180-89945289
  misc_feature 1..109: note = hyper
  source 1..109: mol_type = genomic DNA
gtgtgtttagattcccgatgattcatcactgacacgctgatgtcagaggagcctgggaagatgtttacatctttttaaaaaagggaaagcgaaacgtttttctgcaaaa

SEQ ID NO: 35922 - DNA, 39 bp, Homo sapiens
  misc_feature 1..39: note = chr15:89949371-89949410
  misc_feature 1..39: note = hyper
  source 1..39: mol_type = genomic DNA
ttcggggccccctaccgaggccggccatgatcttgaggg

SEQ ID NO: 35923 - DNA, 326 bp, Homo sapiens; identical to SEQ ID NO: 1240
  misc_feature 1..326: note = chr15:89949616-89949942
  misc_feature 1..326: note = hyper
  source 1..326: mol_type = genomic DNA

SEQ ID NO: 35924 - DNA, 501 bp, Homo sapiens
  misc_feature 1..501: note = chr15:89950236-89950737
  misc_feature 1..501: note = hyper
  source 1..501: mol_type = genomic DNA
gcaggcctgaggagtcgggctgaaggtgcgccagccattattgcctcagacctccggacgctacgtaccccaagcacctgagctactagtggtatatcagacaagatttctgggagcagccccaggagtccctccgcccgctcccagtccgcaagcgcagaggatcctgcgctctgtcccccaaggtcttggcgtttgctgagctctctccgcgcgcgtcgaggagaggccgcctctcgtgagcaaaagctgggagttgttagagattccgcagccgctctgagggcgagatcgggtttgtcccacgacctcggcgccaggaagctgtagaaagagacagaccccaattttctccccttggagttgaaacaaaacctgaaagcccgaggttgcccgcaccgccagaggtggcgcctaggcggcgggggcgaccagagccgcgtgcccgcgcggttcccaggcctgggttctgtttcttcctattttagttagttacttagc

SEQ ID NO: 35925 - DNA, 205 bp, Homo sapiens
  misc_feature 1..205: note = chr15:89951081-89951286
  misc_feature 1..205: note = hyper
  source 1..205: mol_type = genomic DNA
ggatttaagtaccttggcgaggcagcgcaggcggctgttctaatcgccgtctccaagtacctgctcatgaataaacaccaaccccatttatcaggtacttagcgctcattgtgaaggggaaattggcccttttctgaaattgtctatccacaacccatctgcgcagttctggttgcagaattcccctcacccttgagacacacac

SEQ ID NO: 35926 - DNA, 31 bp, Homo sapiens
  misc_feature 1..31: note = chr15:89951346-89951377
  misc_feature 1..31: note = hyper
  source 1..31: mol_type = genomic DNA
taagataaactcgcttttcttccggtaagtg

SEQ ID NO: 35927 - DNA, 90 bp, Homo sapiens; identical to SEQ ID NO: 4295
  misc_feature 1..90: note = chr15:89951465-89951555
  misc_feature 1..90: note = hyper
  source 1..90: mol_type = genomic DNA

SEQ ID NO: 35928 - DNA, 682 bp, Homo sapiens
  misc_feature 1..682: note = chr15:89951771-89952453
  misc_feature 1..682: note = hyper
  source 1..682: mol_type = genomic DNA
gctcctctgggaacccggatgggccgaacagcagcttccggcagaggccctcaggtttcagagttctccaagtggggagaagggcggcctgctcagcccgcgcacccgtggcagcaccacagagggaataaaagcagggtaaacaatttgaagatccccacgaaggcaagagagtaaatttacaaactcatttgcgtccggaatacttgcttctttttcactcatacattccttctaaaatgtgggctttctgtgtacatgggcgcgcattcccaggactcggttccctgggtggaattcacccaggaatacaatcgattttctgaacctgcgtaaggccacaggcagctctgaaaatgaaagcgtttgctaagtgggggagatctcaccgatcgaacgtttaaaaatggctttgtcttcattcagctctcccgatttattctgtgttttacaaatagaagctcagagcttctgtcgcccagtccttgcatgactcatggcggtggccacacgggtttcagggataacgggatgtttagaaaatcgctgcatatcggagtttcctagcacgttccatttatactgaacgcaggcggccgctgaaaatccagcctcgactcttgctaatgactgggtaggaccctcggggtcctgcgacggtgctggagggtgttcccggctc

SEQ ID NO: 35929 - DNA, 419 bp, Homo sapiens
  misc_feature 1..419: note = chr15:89952699-89953118
  misc_feature 1..419: note = hyper
  source 1..419: mol_type = genomic DNA
cgctccaaacacagatgctcatttttggaatattctagaaaaataacaagatcttgtttgtcgttatgattcacgggaggtaactgatgggagggccatttacatgagggcagacactgtggggcgaaggtgacttctggacgtaggctttaaagtaggaacggctccaaattcccaatatctccggccttaccggttgcaaatcggacccctgcgggaaaaccagacacttctgtttcgtggctttcgggctgcctccagcccacgcaggctcgtttagtccccgtggagtcagccccgagccttcctagtcctggaacaagggctccaggtcgcggccgcgggaagccgccaagagggcggggagtagggattccctccagctccgcagggcatctcacaagcgccttcttctgcgc

SEQ ID NO: 35930 - DNA, 199 bp, Homo sapiens
  misc_feature 1..199: note = chr15:89954287-89954486
  misc_feature 1..199: note = hyper
  source 1..199: mol_type = genomic DNA
tttcaggttttgtcccgacagactttcagcaagcggcttagctcagccctggcgctgccttccaggaaagaggggcagcagcagcctcggctgagccgggtgcccttgtgggctatctggtgggggctcgcgggtccttgccttctctgcctggggtaggtgggaggtaggttcttgaacttcccggggcttctccctg

SEQ ID NO: 35931 - DNA, 89 bp, Homo sapiens
  misc_feature 1..89: note = chr15:89954753-89954842
  misc_feature 1..89: note = hyper
  source 1..89: mol_type = genomic DNA
atccctggctccccacggccaagccgagaactagcgggcgcaggttgcattgtgcagactcccggggtcaggtcgcagggtcacgtgca

SEQ ID NO: 35932 - DNA, 184 bp, Homo sapiens
  misc_feature 1..184: note = chr15:89955001-89955185
  misc_feature 1..184: note = hyper
  source 1..184: mol_type = genomic DNA
gggatagtcgcaccgacaaaaatcacaggaaggagcgcgcagttgactgtgggcgggcgggacggcggagccacttacagcgggacctgcgagggtgtgggtacgggactccccaacggaccctctagtttgtaaccgtgcgaacactggagggattcattatgtgcaccgtggaggcgcggac

SEQ ID NO: 35933 - DNA, 54 bp, Homo sapiens
  misc_feature 1..54: note = chr15:89956300-89956354
  misc_feature 1..54: note = hyper
  source 1..54: mol_type = genomic DNA
gtgcctgcaaagccacggctcctaatcagggtaatttaatatattttaagcccc

SEQ ID NO: 35934 - DNA, 151 bp, Homo sapiens
  misc_feature 1..151: note = chr15:89956422-89956573
  misc_feature 1..151: note = hyper
  source 1..151: mol_type = genomic DNA
cggccttatttgacggatggaaggagctgctatgagaccacagccctttgtgtcccccacataagctgggcttccccgtaattagaatggtattcccagccattgaggcttttcatgaggcagaacaaaaactccccgagatgaatatccc

SEQ ID NO: 35935 - DNA, 40 bp, Homo sapiens
  misc_feature 1..40: note = chr15:89959963-89960003
  misc_feature 1..40: note = hyper
  source 1..40: mol_type = genomic DNA
gcccggccgctatcccgagtcggtgcgtgcctatgctgca

SEQ ID NO: 35936 - DNA, 85 bp, Homo sapiens
  misc_feature 1..85: note = chr15:89962817-89962902
  misc_feature 1..85: note = hyper
  source 1..85: mol_type = genomic DNA
ctccgttggggtcaccgacagaggctcacttgttcaggcacttcctgggtcagcctttccgcctctgagacgggctctcccatct

SEQ ID NO: 35937 - DNA, 269 bp, Homo sapiens
  misc_feature 1..269: note = chr15:90039563-90039832
  misc_feature 1..269: note = hyper
  source 1..269: mol_type = genomic DNA
cgctgggcctgcaggcggcgagacttacttgggtagcgatagtagaattcgttctccatgtcgctcaagttcttgtgcgtcctctctgaccaccagtgggcgtcggcctcgaagtcgtagcgcacgaacaccccgaagagaatcaccataatcacctgcaggagcaggcaggtgagcggcagccgccagcggaggttggtgttccaggccatgctgcaggggtgcctggccgggctggcagcgggcggttcggacgctcggaggccggc

SEQ ID NO: 35938 - DNA, 65 bp, Homo sapiens
  misc_feature 1..65: note = chr15:90293501-90293566
  misc_feature 1..65: note = hyper
  source 1..65: mol_type = genomic DNA
ccttgtgcgggtgtccgcgctcgtgggctccactctcagggggcccctagcgaggggagacccag

SEQ ID NO: 35939 - DNA, 158 bp, Homo sapiens
  misc_feature 1..158: note = chr15:90319855-90320013
  misc_feature 1..158: note = hyper
  source 1..158: mol_type = genomic DNA
gagaaactgcgcatgcgcacgctggcccgcgccctgcacgagttgcgccgctttctgcctccctccttggcgccggccggccagagcctgaccaagatcgagacgctgcgcctggccatccgctacatcggccacctatcggccgtgctgggtctcag

SEQ ID NO: 35940 - DNA, 25 bp, Homo sapiens
  misc_feature 1..25: note = chr15:90320089-90320114
  misc_feature 1..25: note = hyper
  source 1..25: mol_type = genomic DNA
cgtggccccgcagaggcgcagacgc

SEQ ID NO: 35941 - DNA, 177 bp, Homo sapiens; identical to SEQ ID NO: 12318
  misc_feature 1..177: note = chr15:90357883-90358060
  misc_feature 1..177: note = hyper
  source 1..177: mol_type = genomic DNA

SEQ ID NO: 35942 - DNA, 298 bp, Homo sapiens
  misc_feature 1..298: note = chr15:90358102-90358400
  misc_feature 1..298: note = hyper
  source 1..298: mol_type = genomic DNA
cgtctttttaaagggaagtaaccggacccgaccactactccacccgattcacccctagcgggccgcccgcccgcagctccgcccgggctcctcccccgtccgcccgcggcttcccgggagccccccagggctcctccgctcctccgacggcccggccttccccccggggcctgggatgcaccagggctcctgctgcccccgacggggtccctgtcgccgcagcccgcgggacccgccggccacatctggacggcatctgccgcgggggaggggctcagagcctcgccctgagtgtccc

SEQ ID NO: 35943 - DNA, 156 bp, Homo sapiens
  misc_feature 1..156: note = chr15:91427788-91427944
  misc_feature 1..156: note = hyper
  source 1..156: mol_type = genomic DNA
ggggcctggaggagcggtgggagctgggggcgcggcaggcaggggcagagcaggcgttccgagggccagagacccacccaggtgggggtaggggccgcggaagggcggggatggccgcaggggcagggctcaggctgtgggcgcctgaggcttcag

SEQ ID NO: 35944 - DNA, 73 bp, Homo sapiens
  misc_feature 1..73: note = chr15:91642967-91643040
  misc_feature 1..73: note = hyper
  source 1..73: mol_type = genomic DNA
gaacagcaccatgatcgacgatactttgggggcggcgtgatcagaggattccccttcccgggaacttgcgtct

SEQ ID NO: 35945 - DNA, 68 bp, Homo sapiens
  misc_feature 1..68: note = chr15:91643277-91643345
  misc_feature 1..68: note = hyper
  source 1..68: mol_type = genomic DNA
agaagcagagctgcccgcagcgaatacttttaatgcccgggccgggaagaaagcgggttaggatctga

SEQ ID NO: 35946 - DNA, 142 bp, Homo sapiens
  misc_feature 1..142: note = chr15:91643657-91643799
  misc_feature 1..142: note = hyper
  source 1..142: mol_type = genomic DNA
cagggctcccagactcgcctgcctgggctgaaatatacacgctcgcacagctgagtgctgttcatagtaaatggcacaaaagatcggagagtcttgaaaaaccggcgcagaaaagcaaggacttgcccgctgcctggagctg

SEQ ID NO: 35947 - DNA, 45 bp, Homo sapiens
  misc_feature 1..45: note = chr15:92936662-92936707
  misc_feature 1..45: note = hyper
  source 1..45: mol_type = genomic DNA
ctgcctggctgaaaccgccttctcgccgcgcgctgggggctgtcc

SEQ ID NO: 35948 - DNA, 732 bp, Homo sapiens
  misc_feature 1..732: note = chr15:92936922-92937654
  misc_feature 1..732: note = hyper
  source 1..732: mol_type = genomic DNA
ctgaataaagccaggcgggagaagcaaaggctagcgcctggacgctggagttggtgggaggaggcgagcagaggcgcggagcaaagctgtcaaactgcgcgcggagccgggcgcggggcgggggaagggagaggagggagggaggggcaggcgggagccgggagggagcgagcgggctcgccgcgcctgagcaacccctgcctgtcgctgccgctgccgctgccgctgccgccgccggcccggactcgtccggagcgcagggtgtctgcccagctgcgcgcggcgcgcggaggctccggcgtccgccgctgcgccctccggcccctgctcctcgcgccggcccgcgtgggtcccggcgggcgcgaacccaccatgcagctgcagttccggagctggatgctggccgcgctcacgctgctcgtggtcttcctcatcttcgcagacatctcagagatcgaagaagaaatcgggtaaatagctgctcccaggcccgtgccacgagccctggcgggatctctccctccttctgtactctccaccctccgaccccctttgtgtgcgccgcgccccgctgtagctccgctggagagatggggacggtttggcagaaggtggcggcgacaggggcccgggacggtttggggagaggagggtgggggcgcggctgctgtggggtgtccccgggcggggttcacgggaagcccccagctggcccgcgtcgggaagcggact

SEQ ID NO: 35949 - DNA, 39 bp, Homo sapiens
  misc_feature 1..39: note = chr15:92937696-92937735
  misc_feature 1..39: note = hyper
  source 1..39: mol_type = genomic DNA
cgccggggtcgagggagggcgccggggagtgtctcgggc

SEQ ID NO: 35950 - DNA, 325 bp, Homo sapiens
  misc_feature 1..325: note = chr15:92937736-92938061
  misc_feature 1..325: note = hyper
  source 1..325: mol_type = genomic DNA
ggcggaggggccgagagtggagggaggcaggagtttctttgtctccagcacggccgctttctcgccttggcaaagtgggcagggggcgcgcagggatctctgagctgggggaggggttcctggggccggagcggagggcggggttctgcatgggctactgggaagcggaatgtcccctgcacacacagacaggcacacgcgcctcccgccggcccgggagcccggcgtaggagctggcaccactagagaagggctcgcatagctggactgagaccccccgccctcgcctggctttggacgttcagccaagccacggcaaccccgg

SEQ ID NO: 35951 - DNA, 53 bp, Homo sapiens
  misc_feature 1..53: note = chr15:92938325-92938378
  misc_feature 1..53: note = hyper
  source 1..53: mol_type = genomic DNA
ggccgggcccctctccggaacctccaaagggcggtagacgacaggtggggagg

SEQ ID NO: 35952 - DNA, 305 bp, Homo sapiens
  misc_feature 1..305: note = chr15:93198707-93199012
  misc_feature 1..305: note = hyper
  source 1..305: mol_type = genomic DNA
gccccagacccaaaccgggtggtgttcccgggccccgggccgggcggtggccgcgactcgcgctcgggttcgggccacggcgcggagacggactcggctctgctggcgcgggcggcgggagcggccaggagcgcgagcagcagcagcggcaggagcggggcgggcagcggcacggcgcgcatagtgcggtgggtcggcacaggatcgggcagggcgcgcgcggctgagctccaggatccgcaccagcacggaggcctgcaccgggggatcctgcggcggaggcggctgcgcggtgcttggcagga

SEQ ID NO: 35953 - DNA, 35 bp, Homo sapiens
  misc_feature 1..35: note = chr15:93257618-93257653
  misc_feature 1..35: note = hyper
  source 1..35: mol_type = genomic DNA
acactcgcccatatacgcaacggctgagtgcactc

SEQ ID NO: 35954 - DNA, 465 bp, Homo sapiens
  misc_feature 1..465: note = chr15:93615914-93616379
  misc_feature 1..465: note = hyper
  source 1..465: mol_type = genomic DNA
cacggctccatctcacggcaactcgggcagggtgcccctctccgggtccccaagggcaggcatcgcacccacgacggggtgcgggagaaacaaaagacccgtggaaataggaggcggggtccggaggaggtccggagaacttgagcccggactcactcgcgcacatctggcccagcattgaggggcggcccagggacccggccccgcgcgcccggccggcagtgccttacctgcggggaagctgcagagaaggaaggcgagggtcggccagaatcccagggctgaacgtcctgcccctctccccatacccatccatccagctcggcctgttaccactagcctctccctggaagaagagttcagaaaaaaagaagaaaataaatcacgctgcgaagaaagggcagcctcgctccgccggcgggagcagcgagccgggaggctccgtccacctcggccgcgggcgcc

SEQ ID NO: 35955 - DNA, 257 bp, Homo sapiens
  misc_feature 1..257: note = chr15:93616396-93616653
  misc_feature 1..257: note = hyper
  source 1..257: mol_type = genomic DNA
cgcgccgccccccgcgcgcccctccctcgccatccatcactcggttctccgccaatgtcgacgcggccccgcgccccagccgcctgcgcaccgccccctcgcgctcgggtttcagcgaggccggcgaggtagccggaggcggccgggcggggacccaggctgcccggccgcagcgctcgccgtgaggacctcggaaaaccacggccctagatcagagggcgcgccacgctccccgaccctcgcgccatctccagccc

SEQ ID NO: 35956 - DNA, 1098 bp, Homo sapiens
  misc_feature 1..1098: note = chr15:93631632-93632730
  misc_feature 1..1098: note = hyper
  source 1..1098: mol_type = genomic DNA
cgtacgccggcgcgccgaggcaaagggccgccgggacgcgagcccacgcggtgcactgcgccgacatccccgagggcaggagatggccaggcagctccgcagccgggcgtcgagcgggaggcgggggcccgggcggcgcgggccaatgggggttcacggcgggacagtcgggtggccggctccgtccggggctccgcgagccgggctgagggaaggagctcccagcccgcacacggtgtaagggacgtgtgccgggtctgcccaaccacgcgcgctggcggctgcccgggggagagtattttaggaaaaaagaacaaacaccaaaccacaaaaactttcctgctgccaacagctaaagcgatagaggcgcagcaaagctccaaatgtgggcaagatgggagcaagatgagacgcggggctaaggaagaccaaagcagcgccgtggccccggcatgtgtcggcggcgcctcggagatgtcagagccgggtctgcccggctcccgacccgcgcttaccttggcggctgcatgagcccctgcggcccgcggggggtggcgctggcggggctgcgggagaagagggggtgtcggggcgccgctcgtctgccccggggcaaggtgggaggggctccgctggcgctggtccccgccgccccggccggctcagcagcggcccggggagcgcctcctgctcccgggctgcatgcctgcgagcgcctggcggagccggcccgggagcgaacggccagtgcttccccggcccagcggctcgggcggcgcagccagcgctcgggagacaactgcagagtggggcggccgggaccagccccctccctcgcccggcccccgcccgccgccgagcgcggcgtcgcgaggttcgtttgcgcgccgaggggagggggcgggccgggcgcccgggccgcgggcggggggcgcgcgcgggcggggccggcagggaggggcggggaggagcggggtgcgggctcgcgttgccccgccccgccgcggccccaccctcccgcatcagcaccggctgggtgggtgcggagtgcgccagcggccaagtcaagactccttgaatgctcaggttagggggcgc

SEQ ID NO: 35957 - DNA, 535 bp, Homo sapiens
  misc_feature 1..535: note = chr15:93632731-93633266
  misc_feature 1..535: note = hyper
  source 1..535: mol_type = genomic DNA
ggcggcaagtgcggcgactccccggggcgcctccaactttccgaatcgcccgcagggttgcggtggagcgcacggtgtccttcagttaggcggtggtcgaggggagttcctctgagatttctggagaaggcggttacatccaagacaaatgctgttgcgctctgcggagacgcacctttgttctatagagattttgttgttgtttaagaatcttcctgaaaaaactaatacatatgtattacatgctaacacacgcatacattcttgcgtagaattgtacataactcaggagtgtctagagtgaaaagaccgtatcgcactccctcccacggccgcggctctcccacggccgcggctcccccgcggtaaccttcggtcagggtgtgctctgccgcggttctttccagtctctgcgcttttacatgcacacgcacagattgcgagtggaatctcctgggcttttcaaaagaatgttttcaacattaagcgcatgcacacagtggcttgaacacggccacgtcgggagcagtaaatc

SEQ ID NO: 35958 - DNA, 64 bp, Homo sapiens
  misc_feature 1..64: note = chr15:95388665-95388729
  misc_feature 1..64: note = hyper
  source 1..64: mol_type = genomic DNA
ggagaagaatatctcaagcccttcgtagaagttcctctttgtttccgtacggcccttgatacca

SEQ ID NO: 35959 - DNA, 144 bp, Homo sapiens
  misc_feature 1..144: note = chr15:96865078-96865222
  misc_feature 1..144: note = hyper
  source 1..144: mol_type = genomic DNA
ccgccacccggcggccgcccctgacaccgagtgggtgggaggaagaggcagctggcggggatgggccattgagacctcttgaaaaatattaaaagacaggatgggtagagatttctccgggagaaagttcgagggtgcatcggg

SEQ ID NO: 35960 - DNA, 51 bp, Homo sapiens
  misc_feature 1..51: note = chr15:96874282-96874333
  misc_feature 1..51: note = hyper
  source 1..51: mol_type = genomic DNA
cagcagcagcagcagcggctccggcggcggcagcagcggcagcagcgactt

SEQ ID NO: 35961 - DNA, 74 bp, Homo sapiens
  misc_feature 1..74: note = chr15:96884425-96884499
  misc_feature 1..74: note = hyper
  source 1..74: mol_type = genomic DNA
tgtgaaactctgcctcgaatctcgcttttgacttggtcctatgagctgagccaacatggcgtctcccactgcac

SEQ ID NO: 35962 - DNA, 30 bp, Homo sapiens
  misc_feature 1..30: note = chr15:96897398-96897428
  misc_feature 1..30: note = hyper
  source 1..30: mol_type = genomic DNA
cacacaccccacacacgcactacgagaagg

SEQ ID NO: 35963 - DNA, 157 bp, Homo sapiens
  misc_feature 1..157: note = chr15:96897853-96898010
  misc_feature 1..157: note = hyper
  source 1..157: mol_type = genomic DNA
ccgtgcggctggctgcgcctaggagttccgccacgggtccgacggggcaccctgggtccccgcagcccgtcacaggcgtttgcacatttgtgtgcacgaccactggcgggggcgttgagcctctgctagccgcctcgggctccgcacacccttgggt

SEQ ID NO: 35964 - DNA, 326 bp, Homo sapiens
  misc_feature 1..326: note = chr15:96911366-96911692
  misc_feature 1..326: note = hyper
  source 1..326: mol_type = genomic DNA
gctttcaggtgaattcgttccgggcgttcggtgtccctgggcttgcctaggggtactggggacccttagtgggccagaacccgaagctgaacgtgaataagggacagggtaggacctgaaattgcagagacatagaaaatcaatacgtggtcgggagtcaactgcgcgcgaccaagggctctgccctccctctctccgttgatttggacgctgggaagctgcccgccgtccttccccaccccctttgcccagccttggcaagacctctccggaaacatactcgcgttaaggaactgggaaagcttcctggcccggagctaggagcc

SEQ ID NO: 35965 - DNA, 198 bp, Homo sapiens
  misc_feature 1..198: note = chr15:96911763-96911961
  misc_feature 1..198: note = hyper
  source 1..198: mol_type = genomic DNA
cgctgggatccatctcctcagccccggtttcccgctctgcgagcgggggaagaacctgggaactgcaggatccgccacctcggtttttcagacacagcctctggcctctttccttggcctgccaaacctttgttcacttctctcacccgttgtctgctctgctctatccctcagcagggttctcgtttggacaagagg

SEQ ID NO: 35966 - DNA, 125 bp, Homo sapiens
  misc_feature 1..125: note = chr15:96952646-96952771
  misc_feature 1..125: note = hyper
  source 1..125: mol_type = genomic DNA
ccggcggggcagggccggggagctggggacggggtggtctttagggtggcggcttcccccgaccccggacccgggaaccggccgccggcgcggggcgcgatctgcactgccggtcccacaggagt

SEQ ID NO: 35967 - skipped

SEQ ID NO: 35968 - DNA, 36 bp, Homo sapiens; identical to SEQ ID NO: 12337
  misc_feature 1..36: note = chr15:96953131-96953167
  misc_feature 1..36: note = hyper
  source 1..36: mol_type = genomic DNA

SEQ ID NO: 35969 - DNA, 242 bp, Homo sapiens
  misc_feature 1..242: note = chr15:96959719-96959961
  misc_feature 1..242: note = hyper
  source 1..242: mol_type = genomic DNA
cgaatttcggggcttgaaagcgctaccggggcagccagattactacctcccactctcacctccatccctccccgccccttgcccgtcccacgggcctcagatttgggcgtagggctgggtagggcgcctgggaggagccagagggggcggatcaggccgggatttggcgccaggtacccccacccgcccgcgtcccggggtcgccagctgactccatgtgagcccacttggcaccggccccc

SEQ ID NO: 35970 - DNA, 36 bp, Homo sapiens
  misc_feature 1..36: note = chr15:96960508-96960544
  misc_feature 1..36: note = hyper
  source 1..36: mol_type = genomic DNA
gccgcggacgccaggcgcgagcgcaaggttaaagtc

SEQ ID NO: 35971 - DNA, 65 bp, Homo sapiens
  misc_feature 1..65: note = chr15:96960746-96960811
  misc_feature 1..65: note = hyper
  source 1..65: mol_type = genomic DNA
ccggtgggaagtcatcgaagatctcccttttaccaccagctctacggggtcgcttttctcttaag

SEQ ID NO: 35972 - DNA, 73 bp, Homo sapiens
  misc_feature 1..73: note = chr15:98504114-98504187
  misc_feature 1..73: note = hyper
  source 1..73: mol_type = genomic DNA
ggcggccgtgggtgccgagggccgcgtgaagagcctgggtctggtgttcgaggacgagcgcaagggctgctat

SEQ ID NO: 35973 - DNA, 372 bp, Homo sapiens
  misc_feature 1..372: note = chr15:98836021-98836393
  misc_feature 1..372: note = hyper
  source 1..372: mol_type = genomic DNA
taattaggtaaactacgccaagagaggctcagaaacctgcccaaaatgagctggagcatcagcaggggttccaaatggcaggcgtcctctcccctctgtcccacaaagaacagtccgtcccctgggctgggagctgggcccggagccccggggcagcccgcccggccgtgctcgctgcgcccccgggctgcgttcatcaagcgcaactccaggcgcgcgccgcaaccgcgcagggcaaccgggggctctcccgccgaacccgccctcacttacatctttctcgtcgcccttcaggggctgctagtttgctaatgctgccaggaagctctcctcccagttttctagctgccgttccagcgagcagagagagag

SEQ ID NO: 35974 - DNA, 109 bp, Homo sapiens
  misc_feature 1..109: note = chr15:98965273-98965382
  misc_feature 1..109: note = hyper
  source 1..109: mol_type = genomic DNA
ggctagtgggacccccggtgcgccgccgccgatggggtcttagggcctgtctgtctgggctagagccggcccgggagcctgtttgcggggagtgcgggtcagcaaagct

SEQ ID NO: 35975 - DNA, 267 bp, Homo sapiens
  misc_feature 1..267: note = chr15:98971698-98971965
  misc_feature 1..267: note = hyper
  source 1..267: mol_type = genomic DNA
accgactcggggctgcggacctcggagcgcgcccggcgggctttggtttgggcaaggctgccatcgtgtggccgccgtgggtatttccctcggaaagcggccgggcagcgagcaggcgcccgcgcctcttctttttacgggagtccgcgctctccgcaagtctgtcctgagatcgccgttttctcccaccagccagaatggggctcactgctgcaacccgggtctcagtcttctccagggcacctcctgggccgtgccccgagcctt

SEQ ID NO: 35976 - DNA, 138 bp, Homo sapiens
  misc_feature 1..138: note = chr15:99193529-99193667
  misc_feature 1..138: note = hyper
  source 1..138: mol_type = genomic DNA
gttcctggccttgcccgtcactttggcccgctcctcgttgggttacctgcccccggcgtcccggggctgggcggtggggtgaggggaagcgctctctgggcagccccccgggaagtgcgaggccgggagtcttcctca

SEQ ID NO: 35977 - DNA, 95 bp, Homo sapiens
  misc_feature 1..95: note = chr15:99193974-99194069
  misc_feature 1..95: note = hyper
  source 1..95: mol_type = genomic DNA
tggttttgttgtggtcggcgtcgtgtcgccctctcttctgccgccccgcacttcctttgtacgtagttaataagcagtgtcgctccacattcgct

SEQ ID NO: 35978 - DNA, 32 bp, Homo sapiens
  misc_feature 1..32: note = chr15:100346202-100346234
  misc_feature 1..32: note = hyper
  source 1..32: mol_type = genomic DNA
cagccctttcccaggcggtagcggggacggtg

SEQ ID NO: 35979 - DNA, 581 bp, Homo sapiens
  misc_feature 1..581: note = chr15:100881263-100881844
  misc_feature 1..581: note = hyper
  source 1..581: mol_type = genomic DNA
aggcgctgagcgagacgagggagccggggtggccgagcacacggcccgagtagaagcacagctcggcggggcggccgcggcgccgggccgcgcccgcctcctccacctcgaagcctcgggacaggaagcgcaggtcgcggcgcagctgaaggtacaggtcgcgcccgaaggccggcaggtgcagcagcagggcgcgctctccgggccgggcgcgcggggcggctgggggcgtgcgggggcgtcgccgccgtcggggcccgggggctgcgggcagcggcggcaggtgcacgtcgtcggggcgcacccgccacgggagcaccacctccacgtcggccgccgcgtcgccgacagctgcggggagagaggagacgcgtcagcgcggcggggcccgcccggacgcccgccctcccgctggccgccagccgcgccagcgcggggacagcgcgacccggagccggcgctgccttcccttccctcgcccggcacctccacgctggcccgcgccacccggggagggtctccggcgcagccgcgcgagcacctcccggaacggcgccgcgcatcggcgagcggagacccgg

SEQ ID NO: 35980 - DNA, 126 bp, Homo sapiens
  misc_feature 1..126: note = chr15:100881966-100882092
  misc_feature 1..126: note = hyper
  source 1..126: mol_type = genomic DNA
cgcagagggaaggtagccgcaggacgcggggtgaagagggctgtgggagggggcgctacctgtgcccgggtccagtccccaaaccagcagcagcagcacgggcaggacgagcggaggcagcagggc

SEQ ID NO: 35981 - DNA, 173 bp, Homo sapiens
  misc_feature 1..173: note = chr15:100913423-100913596
  misc_feature 1..173: note = hyper
  source 1..173: mol_type = genomic DNA
cccagggcacccctccgacccccgctgcgaggggtttcccgcgggaggtggacgaagcgtgggccaggacaggcgcctggcactggggtttcagagccgcgagtaggccctgaaggccgggagggaccgccagtccccactggaagccgcttccgtgcagcccgggacaggtg

SEQ ID NO: 35982 - DNA, 12 bp, Homo sapiens
  misc_feature 1..12: note = chr15:100914039-100914051
  misc_feature 1..12: note = hyper
  source 1..12: mol_type = genomic DNA
cgggagggaggg

SEQ ID NO: 35983 - DNA, 15 bp, Homo sapiens
  misc_feature 1..15: note = chr15:101420369-101420384
  misc_feature 1..15: note = hyper
  source 1..15: mol_type = genomic DNA
tttcgcgggacgtct

SEQ ID NO: 35984 - DNA, 240 bp, Homo sapiens
  misc_feature 1..240: note = chr15:101420425-101420665
  misc_feature 1..240: note = hyper
  source 1..240: mol_type = genomic DNA
cgaagccgggaaaccgaggccgtccagcgcccgcgcggggccgggccgcccgcatccctgcgaggccccgacgtgtccctgcgctgcccgctttgatcgcgagtggaggtgcgcgccgcgttgactcggagcgcgctggttttggggagctccctccccaaaaacccctgcgatgatttccagggtggacgagtctggctttgagagggtcggagggtccgagagcgccaagagagagtc

SEQ ID NO: 35985 - DNA, 126 bp, Homo sapiens
  misc_feature 1..126: note = chr15:101420734-101420860
  misc_feature 1..126: note = hyper
  source 1..126: mol_type = genomic DNA
cgccttccgtgcttagtttatacccggctcagcagcagaacgaggaggagtaggaaggtgctcgcttactgacgaaacctccccggagcccagaggtcccggtgtttacacacaaggcgcgcgctc

SEQ ID NO: 35986 - DNA, 18 bp, Homo sapiens
  misc_feature 1..18: note = chr15:101420971-101420989
  misc_feature 1..18: note = hyper
  source 1..18: mol_type = genomic DNA
cggcgagattacctgccc

SEQ ID NO: 35987 - DNA, 62 bp, Homo sapiens
  misc_feature 1..62: note = chr15:101459070-101459132
  misc_feature 1..62: note = hyper
  source 1..62: mol_type = genomic DNA
atgcaaattgcaggtcgttaacgctttagaacgacacatttctgtatcgccccgtgaagagc

SEQ ID NO: 35988 - DNA, 221 bp, Homo sapiens
  misc_feature 1..221: note = chr15:101460044-101460265
  misc_feature 1..221: note = hyper
  source 1..221: mol_type = genomic DNA
cctctgcctttggagcgaacccagtcccttagcggggagcgggcggagtgtgagcgcgcgggtgagcccgtgccggggtgtcggcaagagaccgcccgggagcctctcgctggtccggggcttcctggggttgcggggcggcccagcgaggcttcaccctcctcgatgtctgggtcacgcttcttgcccaggtggtctctggctggcgcagatacaactgc

SEQ ID NO: 35989 - DNA, 41 bp, Homo sapiens
  misc_feature 1..41: note = chr16:204480-204521
  misc_feature 1..41: note = hyper
  source 1..41: mol_type = genomic DNA
cgccaataaaccaatgaacgaagcagcgtccacctggtctc

SEQ ID NO: 35990 - DNA, 723 bp, Homo sapiens
  misc_feature 1..723: note = chr16:215150-215873
  misc_feature 1..723: note = hyper
  source 1..723: mol_type = genomic DNA
gctgagcgccgcctccgggacccccaggacaggctgcggcccctcccctgcccttcaccctcccacagttcctgccctgactccaataaatggatgaggacggagcgatctgggctctgtgttctcagtattggagggaaggaggggagaagctgagtgatgggtccgggggcttcgcaggaactcggtcgtccccactgtcgtcgcggcctggggttcacttggggggcgccttggggaggttctagcccctgagcaccggagctgcggcccgggtggagcggagcagtcccgggccggcccgcggcgtctcctggggtccttgagtcggacgggcgtttgtgcgtctcccggcttcccatatcgcacaaagattgtcacttcactaagcgtattggaagcgtgtcggggctcagggaacttttccacaaagcctgacgtccgaatcccgggactctggcagctacgggggtccctgaggccggtccctccccgactcctaagagagtagggggtttcctgcccggtgttctctctccggttcctcccatgtgctccctcctggcagagcagtaactttacccgaggggagtaaacagatgcccctaaagtctgcagtaaaggtgcccacgcgcaacggcgtgggtcaatgccagaaaccctgggatcccggaggtcgaggcctccacacagacgggaacccgggctggttacgttccccgg

SEQ ID NO: 35991 - DNA, 48 bp, Homo sapiens; identical to SEQ ID NO: 4305
  misc_feature 1..48: note = chr16:215912-215960
  misc_feature 1..48: note = hyper
  source 1..48: mol_type = genomic DNA

SEQ ID NO: 35992 - DNA, 285 bp, Homo sapiens
  misc_feature 1..285: note = chr16:215961-216246
  misc_feature 1..285: note = hyper
  source 1..285: mol_type = genomic DNA
gcgggcgcggcccccagagcacgtcaggcggcgccatgctcagcgcccaggagcgcgcccaaatcgcgcaggtctgggacctgattgcgggccacgaggcgcaattcggggcggagctgctgctcaggtcggtagaggcggggtctccgggagctcagggaggtggagatgagggttttgggcgcgtgggccgccaacgccatccaaggtccttcgggtgcggatccccgggctctgggcggtgtgggcgctagtgaagccccacgcagccgccctcctccccgg

SEQ ID NO: 35993 - DNA, 393 bp, Homo sapiens; identical to SEQ ID NO: 12349
  misc_feature 1..393: note = chr16:216583-216976
  misc_feature 1..393: note = hyper
  source 1..393: mol_type = genomic DNA

SEQ ID NO: 35994 - DNA, 208 bp, Homo sapiens
  misc_feature 1..208: note = chr16:223321-223529
  misc_feature 1..208: note = hyper
  source 1..208: mol_type = genomic DNA
cttcaaggtgagcggcgggccgggagcgatctgggtcgaggggcgagatggcgccttcctctcagggcagaggatcacgcgggttgcgggaggtgtagcgcaggcggcggctgcgggcctgggccgcactgaccctcttctctgcacagctcctaagccactgcctgctggtgaccctggccgcccacctccccgccgagttcacccc

SEQ ID NO: 35995 - DNA, 113 bp, Homo sapiens
  misc_feature 1..113: note = chr16:230203-230316
  misc_feature 1..113: note = hyper
  source 1..113: mol_type = genomic DNA
cgccactgcactcaccgcacccggccaatttttgtgtttttagtagagactaaataccatatagtgaacacctaagacggggggccttggatccagggcgattcagagggccc

SEQ ID NO: 35996 - DNA, 556 bp, Homo sapiens
  misc_feature 1..556: note = chr16:230496-231052
  misc_feature 1..556: note = hyper
  source 1..556: mol_type = genomic DNA
cgcggaggaccgggcgctggtgcgcgccctgtggaagaagctgggcagcaacgtcggcgtctacacgacagaggccctggaaaggtgcggcaggctgggcgcccccgcccccaggggccctccctccccaagccccccggacgcgcctcacccacgttcctctcgcaggaccttcctggctttccccgccacgaagacctacttctcccacctggacctgagccccggctcctcacaagtcagagcccacggccagaaggtggcggacgcgctgagcctcgccgtggagcgcctggacgacctaccccacgcgctgtccgcgctgagccacctgcacgcgtgccagctgcgagtggacccggccagcttccaggtgagcggctgccgtgctgggcccctgtccccgggagggccccggcggggtgggtgcggggggcgtgcggggcgggtgcaggcgagtgagccttgagcgctcgccgcagctcctgggccactgcctgctggtaaccctcgcccggcactaccccggagacttcagccccgcgctgcaggcgtc

SEQ ID NO: 35997 - DNA, 337 bp, Homo sapiens
  misc_feature 1..337: note = chr16:609979-610316
  misc_feature 1..337: note = hyper
  source 1..337: mol_type = genomic DNA
atggataagcgctgacggcccctctcccgcgccccgcgccgctgacacccatcacgccgcggcggggacccgggagacctggcggcctctgtgcacccccgcggcagcctgcgggcaacgggggcgggaggcgccgggcgcccctgactcggccgcacacctgcgccgcagtccgctctccgtccgctgcctcccgggttcccggccgctccaccgcgcgccccgagagctgagccggtcccggcgcacgaggccggtgagtgcgcgccagggggcggcggggggcgcgcgggcggcgggggcgcggggttcgggccgggggctgctccttccctcc

SEQ ID NO: 35998 - DNA, 158 bp, Homo sapiens
  misc_feature 1..158: note = chr16:610343-610501
  misc_feature 1..158: note = hyper
  source 1..158: mol_type = genomic DNA
cgccccccggagcccggagcccaggcgcacgcgcgcccgcctctgccgccaacttcgggaggtgcgagcggcgtcggggggacgcgggcggcggcggaggctgcgggagtcgctgccgctcgagggaccgcggacccgggaggtccggctcccggcgc

SEQ ID NO: 35999 - DNA, 185 bp, Homo sapiens
  misc_feature 1..185: note = chr16:680959-681144
  misc_feature 1..185: note = hyper
  source 1..185: mol_type = genomic DNA
gggcctgggagcccccgcacggttcagacagaggggccaggctgaagctggagaggaaccagcgtcacacagacggcctctgagaacttggagaccccgttacccacccagcaggggtgtcaggacaagcatctgctgcaggcttcagcctcaggggcaaaagggagccccggggtcctggtggg

SEQ ID NO: 36000 - DNA, 564 bp, Homo sapiens
  misc_feature 1..564: note = chr16:725381-725945
  misc_feature 1..564: note = hyper
  source 1..564: mol_type = genomic DNA
tcacaggcctgagcccgggaaggctgtgagagggcgaacggtcttgcatggggggttttaggtgccccccatccccgtgactccatttaccagcggctgccgtggaggtagtccagtgtgctggagctgcgccagagcgggggtgggggccggcgctgagacgcggtgctagctggaggcggttcctgtccggggtgtgcgtccgcgtgcagggtgcgcgcgtgtcttggccgcgcgtggcggcgtgtgcggcaggggcgggcaggcgggcgactcggtgacgcggcccaagcgcggcgccgagcggagcgggcggagcgggccggctggggcggagcggagtcgtccgcagagcagcccctcccggccgcggccgccgaccccggaccccggcccccggccaggctctatggacaggagctcgctgctgcagctcatccaggagcaggtgcgtcggggggtggtctggggagctggcaccgcccccaatgcggccctcctgccgctgagctgagcttgtgcgggaccgagctccccgaaagccccgctcggtacctacctcat

SEQ ID NO: 36001 - DNA, 1028 bp, Homo sapiens
  misc_feature 1..1028: note = chr16:750383-751411
  misc_feature 1..1028: note = hyper
  source 1..1028: mol_type = genomic DNA
cccatgatcagaaggcgcggcctccggaggccgacatcacaacgtttgcaagggccggctggggtcggcacatgattcgacctcacggccgcccttaggggtggaggggtcgctacctcaggtttggggaaggaacacgaggctctgaggagcgaatttgccccaggtgtccggggaggcctggcgcggggctgcctcggttccctcccagagccggggagaggggatatcgcaggatgccggcgcccgaggcggcagcaccaggcccacgggcgccccagtctaaatatcctccgtgcccctagagcggggaccctcgctccccagacccggaagcgccgccttccccgccagggacgcctgggcctccgcagaccccgccggccggcgcgccacccgcgccagcaccatggacagcggccgccccagccgcgcgctcagggccaggcccgggctggcttccaccgcggacggctgcggggtcggggcagccccgcaatcccaaatcccggcagcccccgctcagcagggaggggccccgggggcgaagagtgggggagaagccgggaaggatccggaggaggcggcgggggcggcgccaggggaggaataatcccggcgcagtgccgatttaggttgaaaacgctcccagtcatgggcctgcacgtggagcgccggggctgggggaggcattcgcggggctcctttcccgccccgctcgggagctcacgtttgccggcgcccacagtcccgtccccacctccaggcctcagggtcgagatggagaaaccaagccgcactttgagagcccacaggagggaggggacaggctgaggagcggccgtctgggtatgggtccggggcctggcttccctcatccacacccgcagcgctgccagaaggcgctgctctgcctgtggtcagccctcgacccgtgtgcttggtgggagctgcatccccgcacaggcagccccactgctccccaatctcgcgtccacgttcctgccggcccccgctgctcctcacac

SEQ ID NO: 36002 - DNA, 38 bp, Homo sapiens
  misc_feature 1..38: note = chr16:863839-863877
  misc_feature 1..38: note = hyper
  source 1..38: mol_type = genomic DNA
gtggagccacaggtccgtgtgatcgtccccgtgacccc

SEQ ID NO: 36003 - DNA, 316 bp, Homo sapiens
  misc_feature 1..316: note = chr16:1030443-1030759
  misc_feature 1..316: note = hyper
  source 1..316: mol_type = genomic DNA
cggaccagctccttctgccgaccgggccggggagaccgcgtggctcagtggctgcagcggccaccggcccgggcgtgggggctttgagggcaccggcgcggtaggtcacccgggtttcgcgggccgcaagctcggagacgcgcgtgtcccgcgttggctgcctgacccggaatggcgcagccccttcgcctccagcgcgctggttgaaaggatccgagccaccctcggggacggccgggccgaggccacctcgcggggcggccttgggcggggacccggacccgcggttggacgttcgcctcggggggggcaatgt

SEQ ID NO: 36004 - DNA, 161 bp, Homo sapiens
  misc_feature 1..161: note = chr16:1031121-1031282
  misc_feature 1..161: note = hyper
  source 1..161: mol_type = genomic DNA
cgcggccccttgaagcgcgttacctggacgtgcgctgtccgcagactctggacgagctgggcctgggcgctgcgcggcggaaccgaccctgtcctggaccgcaggcagcagctgaccccgcgccaccggcctgcgggcgagacctcaggcgcgagacgggc

SEQ ID NO: 36005 - DNA, 100 bp, Homo sapiens
  misc_feature 1..100: note = chr16:1031402-1031502
  misc_feature 1..100: note = hyper
  source 1..100: mol_type = genomic DNA
cccgaggacccgcttcctagctgagcgtcaggacggggggcggactctcaggagccgcgcggcgcccgcagaggagaggaagcgccggagacccccctgc

SEQ ID NO: 36006 - DNA, 378 bp, Homo sapiens
  misc_feature 1..378: note = chr16:1031741-1032119
  misc_feature 1..378: note = hyper
  source 1..378: mol_type = genomic DNA
taaagaaacttgttgcgggtcccgcagcgggacccgagcctcggcggcggcggcggcggcggcaggggcgagggtcggggccaccgcgcggcgacctcgggtcccggagcgaccgcagggcagccccgggcgccggccccggtgcgcgtctcctgtgcgcgcccctccgcgcgcggccccgatgctggacatgagcgaggcccgctcccagccgccctgcagcccgtccggcaccgccagctccatgtcgcacgtggaggactcggactcggacgcgccgccgtctcccgccggctccgagggcctgggccgcgcgggggtcgcggtggggggcgcccggggcgacccggcggaggcggcggacgagcgcttcccggc

SEQ ID NO: 36007 - DNA, 34 bp, Homo sapiens
  misc_feature 1..34: note = chr16:1032389-1032423
  misc_feature 1..34: note = hyper
  source 1..34: mol_type = genomic DNA
cctggtctcggactgcgagcgggggcctggaggg

SEQ ID NO: 36008 - DNA, 519 bp, Homo sapiens
  misc_feature 1..519: note = chr16:1203265-1203784
  misc_feature 1..519: note = hyper
  source 1..519: mol_type = genomic DNA
gggcgagccggagccggagtcgagccgcggccgggagccgggcgggctggggacgcgggccgggggcggaggcgctgggggccggggccggggccgggggcggaggcgctgggggccggggccggggccgggcgccgagcggggtccgcggtgaccgcgccgcccgggcgatgcccgcggggacgccgccggccagcagagcgaggtgagacgcggcgaggacgcgcgcccgggaccctcttcaacttgcgcgaagcgggccggggagcccctcggggtgggggtggggccgctggagggagggagggggcgggcgggggcggggggcgcgtttgtctctaataagaaaagacaaagacatcccggcggccgcggctgttcccgcagctccgcgccgcgggaggcagggcgggggcgtcgccaccggccccgggtcaccccctgtcctctgcaggtgctgccggccgccaccatgaccgagggcgcacgggccgccgacgaggtccgggtgcccctggg

SEQ ID NO: 36009 - DNA, 156 bp, Homo sapiens
  misc_feature 1..156: note = chr16:1203807-1203963
  misc_feature 1..156: note = hyper
  source 1..156: mol_type = genomic DNA
cgttggtgggggcgtccccggagagccccggggcgccgggacgcgaggcggagcgggggtccgagctcggcgtgtcaccctccgagagcccggcggccgagcgcggcgcggagctgggtgccgacgaggagcagcgcgtcccgtacccggccttgg

SEQ ID NO: 36010 - DNA, 109 bp, Homo sapiens; identical to SEQ ID NO: 12362
  misc_feature 1..109: note = chr16:1204002-1204111
  misc_feature 1..109: note = hyper
  source 1..109: mol_type = genomic DNA

SEQ ID NO: 36011 - DNA, 180 bp, Homo sapiens
  misc_feature 1..180: note = chr16:1204128-1204308
  misc_feature 1..180: note = hyper
  source 1..180: mol_type = genomic DNA
cgcccctgttggtgggacctggcgtgggccgggcgcgcgggggtgcagggcaggggctggaggaccgcgctctaatttctgagagtggcgggcttggggggccaccgggcgcctccggactcccttccccagggccggctccggacggagaaggtggaagcgaagcggtgaggcccccgc

SEQ ID NO: 36012 - DNA, 324 bp, Homo sapiens
  misc_feature 1..324: note = chr16:1382374-1382698
  misc_feature 1..324: note = hyper
  source 1..324: mol_type = genomic DNA
tgcccaggtgcccttcgggtgaaaactccaaagtctgaccaccccccaccccttgtccccaaagggctgcgagtgtccagctgtattcgaccaagggcaggtgcgaccggggggccgctgcgccctcggcaagtctgagagcctcaggcccccgacaggaccatgcttagcacggacttctcaaagtgtggtccctggactggcggcagcagactggagctgggaagtgcaggcgctggctggcgtggggaccacacctgtgatctcagcgccttaggaggccggggaagggggatcccttgagcctgggagtttgagaccagc

SEQ ID NO: 36013 - DNA, 324 bp, Homo sapiens
  misc_feature 1..324: note = chr16:1382818-1383142
  misc_feature 1..324: note = hyper
  source 1..324: mol_type = genomic DNA
ttgcagcgagtggagatggtgccactgcgctccaacctggttgagagctatttttgagagctttttcgagactctgtctgaaaaaaaaagggaaaaaacgcagatcgcgcccccacccagacttcgggaccagcgggttggggacaggacccatcaatgccttaacaaaccctgcaggagaccgcgggcccgctggggttccaggacagcgcagcggaggaagagcggggagccacccgggaggggctggcggggtccagtgcagaccccaggggctccgggggctctggccggctgtgaccccacaagcgccaactgggccct

SEQ ID NO: 36014 - DNA, 49 bp, Homo sapiens
  misc_feature 1..49: note = chr16:1383733-1383782
  misc_feature 1..49: note = hyper
  source 1..49: mol_type = genomic DNA
ccccgcgccggcccacggtaagtgccgcgggctgcggccagtgctgttg

SEQ ID NO: 36015 - DNA, 50 bp, Homo sapiens
  misc_feature 1..50: note = chr16:1384020-1384070
  misc_feature 1..50: note = hyper
  source 1..50: mol_type = genomic DNA
cggagcggacggggagggtatccgggcgctggcgacggcctcccccgcac

SEQ ID NO: 36016 - DNA, 254 bp, Homo sapiens
  misc_feature 1..254: note = chr16:1384494-1384748
  misc_feature 1..254: note = hyper
  source 1..254: mol_type = genomic DNA
agcgctgcgcagacacgggcgaggggaggaagaaggcgcctcgggctccggtctcctgcgctcctgctgggcgccagcggctggaccttggcagccgtctgaggcttcggggagcccaaggccaccggcagcgcttgttagaatgcagattcccggggttcgactggaatgagaccccggggagcagcgtttgcagcgggcccgccaggtgacctgcacctgggcaccgccatcggcttcgcaggggccatctg

SEQ ID NO: 36017 - DNA, 197 bp, Homo sapiens
  misc_feature 1..197: note = chr16:1922108-1922305
  misc_feature 1..197: note = hyper
  source 1..197: mol_type = genomic DNA
ctcgggccacagcctcgtgcaggtgcgacggccgcgcgaccgttagcgcgaggccccgccccgtcctcagcgactccgcccccaccgctcactgactccgcccccaccgctcactggctccgcccccaccgctcactggctccgcccccaacgcgctcagactcagccctcgggggaggggaggggagcccggttcc

SEQ ID NO: 36018 - DNA, 453 bp, Homo sapiens
  misc_feature 1..453: note = chr16:1968132-1968585
  misc_feature 1..453: note = hyper
  source 1..453: mol_type = genomic DNA
gggcgcgggggccggcgcgggggcgcgggcggccggcgggcagcggccggggagggcgcagaggcagtaggcgccgagcaccagggccacgagcagcatcggcgcgcgggacgcccgcagagcggccccttgcccggcccctgcgccctggccgcccccggccccgccgcccaggccgccgctacctgccatggggtcgcgccgctccaggcccgggagcgggggcagcaggcgggcgcgcatctcggcccgcgcgccgctcagtccgtgggtgcccggcttgtgctctgcgcccggcggtcccgcagcctgggagcgggcgcggggcgggaccgggggcggggtctggacgccctcccccctccccctcccccgcccactccgcctccgaggccactgcctgggctggacccgccggcagccgccaccacccgggcgcgactcgagctgccg

SEQ ID NO: 36019 - DNA, 114 bp, Homo sapiens; identical to SEQ ID NO: 1244
  misc_feature 1..114: note = chr16:2040847-2040961
  misc_feature 1..114: note = hyper
  source 1..114: mol_type = genomic DNA

SEQ ID NO: 36020 - skipped

SEQ ID NO: 36021 - DNA, 531 bp, Homo sapiens; identical to SEQ ID NO: 1246
  misc_feature 1..531: note = chr16:2040982-2041513
  misc_feature 1..531: note = hyper
  source 1..531: mol_type = genomic DNA

SEQ ID NO: 36022 - DNA, 619 bp, Homo sapiens; identical to SEQ ID NO: 1247
  misc_feature 1..619: note = chr16:2041581-2042200
  misc_feature 1..619: note = hyper
  source 1..619: mol_type = genomic DNA

SEQ ID NO: 36023 - DNA, 39 bp, Homo sapiens
  misc_feature 1..39: note = chr16:2042464-2042503
  misc_feature 1..39: note = hyper
  source 1..39: mol_type = genomic DNA
gcgctcccgggtgggcggggtcagcgcaggagagggagg

SEQ ID NO: 36024 - DNA, 114 bp, Homo sapiens
  misc_feature 1..114: note = chr16:2069994-2070108
  misc_feature 1..114: note = hyper
  source 1..114: mol_type = genomic DNA
cgcgtggtacaagcacgtggcgagtccccgctaccacacggtgggccgcgccgctggcctgctcatggggctgcgtcgctcaccctatctgtggcgccgcgcgctgcgcgcggc

SEQ ID NO: 36025 - DNA, 47 bp, Homo sapiens
  misc_feature 1..47: note = chr16:2070147-2070194
  misc_feature 1..47: note = hyper
  source 1..47: mol_type = genomic DNA
cgcagcccgcgaggctcctctcctgctgccctcgtgggttcaggagc

SEQ ID NO: 36026 - DNA, 32 bp, Homo sapiens
  misc_feature 1..32: note = chr16:2287088-2287120
  misc_feature 1..32: note = hyper
  source 1..32: mol_type = genomic DNA
cctcagcgccgtgtccgcgctcatggagcaga

SEQ ID NO: 36027 - DNA, 30 bp, Homo sapiens
  misc_feature 1..30: note = chr16:2287491-2287521
  misc_feature 1..30: note = hyper
  source 1..30: mol_type = genomic DNA
cccctcccctcccgccgagctctgacgccc

SEQ ID NO: 36028 - DNA, 76 bp, Homo sapiens; identical to SEQ ID NO: 12372
  misc_feature 1..76: note = chr16:2892527-2892603
  misc_feature 1..76: note = hyper
  source 1..76: mol_type = genomic DNA

SEQ ID NO: 36029 - DNA, 15 bp, Homo sapiens
  misc_feature 1..15: note = chr16:2892626-2892641
  misc_feature 1..15: note = hyper
  source 1..15: mol_type = genomic DNA
cgactctgccaacag

SEQ ID NO: 36030 - DNA, 57 bp, Homo sapiens
  misc_feature 1..57: note = chr16:3016793-3016850
  misc_feature 1..57: note = hyper
  source 1..57: mol_type = genomic DNA
aaggtgaggagtgggcggggaccaggggcctgggcgggcctcgaggtggggcctggc

SEQ ID NO: 36031 - DNA, 275 bp, Homo sapiens; identical to SEQ ID NO: 4311
  misc_feature 1..275: note = chr16:3017156-3017431
  misc_feature 1..275: note = hyper
  source 1..275: mol_type = genomic DNA

SEQ ID NO: 36032 - DNA, 259 bp, Homo sapiens
  misc_feature 1..259: note = chr16:3068171-3068430
  misc_feature 1..259: note = hyper
  source 1..259: mol_type = genomic DNA
tcctaggccgagtgtcgggacaggggcggaggcgggggtcttaaagaagcggtgacgtcactggaccaccgccccggaggaggggcagagaccctgtccctgacggcagcgggcgtgcgaatcccaggcttgtcagaggggggcgctggaggctggggtcgctgggcccgcctcgggctggcagacgtccagactcacccagggtgagggcgccaggcttagggtagaacagagcttgagactccgcttcaccacttaa

SEQ ID NO: 36033 - DNA, 73 bp, Homo sapiens
  misc_feature 1..73: note = chr16:3096869-3096942
  misc_feature 1..73: note = hyper
  source 1..73: mol_type = genomic DNA
cagccaggcccccttcgaaccccgccggcggcccgggctggggcgcaccatgcggctgcggctccggcttctg

SEQ ID NO: 36034 - DNA, 248 bp, Homo sapiens
  misc_feature 1..248: note = chr16:3209117-3209365
  misc_feature 1..248: note = hyper
  source 1..248: mol_type = genomic DNA
cttcccgcttccgtccggcttgcggcccctcgccttgcccggctacaggaaggactcgcctgcgcctcctgactggagccttccacctgggagttctgagtgcgcctaaggcctggcgctgaggcagtggaccccagatccgggacccgaaaggagggcaaacacctccaccgccgcgtctgcctctgcggacgtggccctagatcccgggtggccatggaacttggtctgggcgtgtagttttcctt

SEQ ID NO: 36035 - DNA, 119 bp, Homo sapiens
  misc_feature 1..119: note = chr16:3220438-3220557
  misc_feature 1..119: note = hyper
  source 1..119: mol_type = genomic DNA
cgccccggaatctgggaggcggcgtgaccaggtgcccgggttccatccgctggggctgggcagcccccctgcccccgcccagtacagaggctcctgccgggggaggcgtccatcgcgtt

SEQ ID NO: 36036 - DNA, 303 bp, Homo sapiens
  misc_feature 1..303: note = chr16:3220590-3220893
  misc_feature 1..303: note = hyper
  source 1..303: mol_type = genomic DNA
cggagactgagttggctgcggccaccgggtccccggacaccgtcttcattcactcccaccctcagtcaagcacctgtacccgcagtcctttcctaaaagaagaaaaacggccggtcgcgcgctgtccagagtactcagtcctggatccaggaggtggctggcggtgagctgatttccgggttcttaaacccgggcccggggcccaaggccccgcctggtggggtctcatcctgcagtttgagaaaccgaagaaggtaggagagggaggaagcgccggctttgcctgtgaaagattctttcatt

SEQ ID NO: 36037 - DNA, 560 bp, Homo sapiens; identical to SEQ ID NO: 1248
  misc_feature 1..560: note = chr16:3221141-3221701
  misc_feature 1..560: note = hyper
  source 1..560: mol_type = genomic DNA

SEQ ID NO: 36038 - DNA, 453 bp, Homo sapiens
  misc_feature 1..453: note = chr16:3221786-3222239
  misc_feature 1..453: note = hyper
  source 1..453: mol_type = genomic DNA
cgcagacccggtaaccccggcgcaggggaaaatacagcggggagccccaggctgcaggcctgaccctgagcatcccctaccaagcccagtgtggatgggctctgtctccaaggggctggttcaccagggtctccccgcagcgaccccagaattctgccaatcacttggggacggcgatgagctctatccacttcggaatcagccgatttgtgccggattggtggcaggtgtctgaaatgtcagcggaaatacacgcacgggaggctcgttggtctaggggtatgattctcgcttcgggtgcgagaggtcccgggttcaaatcccggacgagccctagaagtggttacttttcccttgtcattttagagaatatagagctagaaaatcggggaccgagcctgaagcctcaactaccagtcgcgttgctccgcttcaggtcggtccaggtctgtg

SEQ ID NO: 36039 - DNA, 232 bp, Homo sapiens
  misc_feature 1..232: note = chr16:3224952-3225184
  misc_feature 1..232: note = hyper
  source 1..232: mol_type = genomic DNA
tcagccgaacagcagcggcaaaggctaagggtcctagaaaggaacgggaaaccgtcacctgcccaggtgggacgcgaggcaaggaacccagcgcaggaggccgctgggtcacggaggtttcctgtctgcttcccgccgtcactgccggccgcctcccaccttctcccggccccctgcaacccagcccaccccagcccacctccccctggtggggacacggttttctttccgg

SEQ ID NO: 36040 - DNA, 148 bp, Homo sapiens
  misc_feature 1..148: note = chr16:3225459-3225607
  misc_feature 1..148: note = hyper
  source 1..148: mol_type = genomic DNA
acactcaggaggtgccggcctgtggggcgtccgcgggtgggcctctgacgcagagaaagacccagatccagctacctcgggggcctcctgctgcgcctcgcctttggggcaggcctgagggcaacgcttactgcggagcaactgtgtt

SEQ ID NO: 36041 - DNA, 17 bp, Homo sapiens
  misc_feature 1..17: note = chr16:3232618-3232635
  misc_feature 1..17: note = hyper
  source 1..17: mol_type = genomic DNA
ttttggaccaaaaaccg

SEQ ID NO: 36042 - DNA, 322 bp, Homo sapiens
  misc_feature 1..322: note = chr16:3232695-3233017
  misc_feature 1..322: note = hyper
  source 1..322: mol_type = genomic DNA
accaacgagccacacgccccgtagcctccggcttgtctttgtggccttcgtggagtcctcgtggccagaggtggggacccagcagagcagagctaggaggagactccgatttcctgaagtctggaagagacaagttcaagcgcgggtggacgcggagggagccctgagcccccgcttctccctgcgccgcacaaaatggggagcatcccctgtgcccccacaatccggggccccccgggccctcgcccgcctccgcctctcagccctgggctggggatccgcgcgtcacgccgcgtcgcgtagtgaggagctccagctccgg

SEQ ID NO: 36043 - DNA, 133 bp, Homo sapiens; identical to SEQ ID NO: 1252
  misc_feature 1..133: note = chr16:3233198-3233331
  misc_feature 1..133: note = hyper
  source 1..133: mol_type = genomic DNA

SEQ ID NO: 36044 - DNA, 670 bp, Homo sapiens; identical to SEQ ID NO: 1253
  misc_feature 1..670: note = chr16:3233434-3234104
  misc_feature 1..670: note = hyper
  source 1..670: mol_type = genomic DNA

SEQ ID NO: 36045 - DNA, 257 bp, Homo sapiens
  misc_feature 1..257: note = chr16:3234195-3234452
  misc_feature 1..257: note = hyper
  source 1..257: mol_type = genomic DNA
caacgagccgccgcttcccctctgttttgttgttgttgttgttgttttttgacacgtccttccgcccctgacgcagagcgagactctctccatcgccccaatagctcagtccttagcgcgcgcacctgcgaatctgggcttttgggttcgcggccaccctcagatttgcgaggcaggctttactgctgctggataaaccaaccaggttatccgttgaggttatgagctggtggtttcaatgtcgtcctgatatgaaa

SEQ ID NO: 36046 - DNA, 201 bp, Homo sapiens
  misc_feature 1..201: note = chr16:3237826-3238027
  misc_feature 1..201: note = hyper
  source 1..201: mol_type = genomic DNA
tatatcataccagcacgacattgaaaccaccagctcataacctcagcgggtaaccttgttggtttacccagcaggagtaaagcctgcctcggaaatctgagggtggccgcgaacccacaagtcaagattcgcaggtgcgcgcgctaaggactgagctattggggcgatggagagagtctcgctctgcgtcagggacggaag

SEQ ID NO: 36047 - DNA, 1500 bp, Homo sapiens
  misc_feature 1..1500: note = chr16:3238147-3239647
  misc_feature 1..1500: note = hyper
  source 1..1500: mol_type = genomic DNA
caaatcccggacgagcccccttttccttctcttttttcccatttcgcattttcagcaaggacaggagactaggaaggcggagggaggctgctattggcagggcctcagtggagacctcccggggtcccgggacgcagacggacgggcctgaatcgctcgccttggtgaaatgggatccagcgctgccaactgcggcaactgcggttaaaggagacgaccccgtgcagcaggaggaggttatttagaataaggaagaatgcgccgggctcattggtcgctacaggggcataaattttttctaggattccagagtatggctgctccagtcccaggtgagccctcctccgcttaaaattccagtttattcggagaaggggagaataccggaagcgggggagaagggaggggagtgagtgagaggagggaggcggggaagaccgggcatccgcgggcagcacttcagtcggccctggcggggtgggggtctcggcccttgtccccacccccagaccccggggccttcccactgagagcgagggaattcgcggctttgatctggaggggacagggagccccttttagcccagatctgctggattctcgggagtcaggtgaaatctggatacagggaagggcagagtgacagtaaagggtgccccggaaccgatgcccgacgcctgctgccccacggccttcattcttgctcctcctcacgtcctggggactggaggtcccgccagctccccccagtgaagggcaagggggcgcatcgcagaatcgcccctggtgcgcagcgtagttggtggcctaagccgtcttctccgagagctcagccatcctgggcacttgaggccaggcaggcgctgcggggctggttcagtcgatggagaaaagagactctcagcgtcagcctttagggttcgaggcccacgtgggaaactcgctttctgggttttggcttccctggggagaagggaggaccggagccggagaagcgtgaggtgcggcgaggtagggtgcctggtagctggtgtctcgtgcactccgtcaggcctttattgaacacccattggtgccacgctgagggactgcagcgtttccaaggcgagcttgcagtgatcgaggctcgcagaccctcagcgcagccgctgcctgctattgggaggttcccatgtcctgcggaagctggagctcctcactgcgcgcctcggagacgccgaatccccaactcaaggccgagtggcggtggcgggcgaggacccagggcccttctggattgtggtagcgccagggctgctccccattttgtgcgtcgcggaggaggggccggggctctgggcttccgccacacccatcctcacttgaaattgccccttccaggcgggtctgaaataagattctactcactgggtcctgctgggtccgccccagccgcccccaggatgctaggacgcccacaaagataaccttaatgcgtaaatcgtgtggctcgttggtcta

SEQ ID NO: 36048 - DNA, 141 bp, Homo sapiens
  misc_feature 1..141: note = chr16:3239707-3239848
  misc_feature 1..141: note = hyper
  source 1..141: mol_type = genomic DNA
cttttggtgcagggtaaaagtcgtttcctgctcttttttagattcggctcgacttacagacctcagcgcaggacgtggacgccctgcaaaggtaatttgtacaaaggtctcaagctatgttgacgccgcctactatcccac

SEQ ID NO: 36049 - DNA, 35 bp, Homo sapiens
  misc_feature 1..35: note = chr16:3241024-3241059
  misc_feature 1..35: note = hyper
  source 1..35: mol_type = genomic DNA
cagtaggttacagtgcggagcgacacctgcgagga

SEQ ID NO: 36050 - DNA, 208 bp, Homo sapiens
  misc_feature 1..208: note = chr16:3241501-3241709
  misc_feature 1..208: note = hyper
  source 1..208: mol_type = genomic DNA
cccggctagctcagtcggtagagcatgggactcttaatctcagggtcgtgggttcgagccccacgttgggcgacttgttttcttccttgctaccttggagttctggaaacagccagcatttaatgaacactaccaggtgccacatcgcgctctgtgatggtatcccctcaatgattgaattttggtctccgcgcgctcccagcagcaa

SEQ ID NO: 36051 - DNA, 37 bp, Homo sapiens
  misc_feature 1..37: note = chr16:3355197-3355234
  misc_feature 1..37: note = hyper
  source 1..37: mol_type = genomic DNA
gaggcgacccttacccggcgaggctcccgggaccaaa

SEQ ID NO: 36052 - DNA, 603 bp, Homo sapiens
  misc_feature 1..603: note = chr16:3355250-3355853
  misc_feature 1..603: note = hyper
  source 1..603: mol_type = genomic DNA
cgcagaacagacgcggcagtgcgacgcctcccccactggggacacgagacagcgacagccacgcggtgagccggtacaaggccctctaggcttcagcgggtctggatactcggtggcattaacccttccctaccgccggggaagacagcagtttctctggcgaggaagtaggccgggctcaggcgccttagccagagggcgggcctgcgccaccctcggaaagcgtcacttccacttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgaggtaaccgagaagcggcttcccctatggcttcgaccctggagccgctggagcggcggcggccgcagggaggcagccattttccgtaggcggtggccgcggcgcttccgggccgcgcggctggagcctgaggcggggccaccgtcgggcacgagaaaccattctctccccgcttttcgcagctgtatcccagaggcgcggctgaagctcgct

SEQ ID NO: 36053 - DNA, 18 bp, Homo sapiens
  misc_feature 1..18: note = chr16:3551488-3551506
  misc_feature 1..18: note = hyper
  source 1..18: mol_type = genomic DNA
aaccgaacagcaggccgg

SEQ ID NO: 36054 - DNA, 160 bp, Homo sapiens
  misc_feature 1..160: note = chr16:4363920-4364080
  misc_feature 1..160: note = hyper
  source 1..160: mol_type = genomic DNA
ctgcctgcctgaggtcggatgcggtcggctgcagggcagggctccgggctgaagcgcagcgattcccgccgccgtgagggggcgctctgcgggcctcggcctcggcccttccggacgcccgcacaggtcgccggacccagagagtcggcccttaatagcc

SEQ ID NO: 36055 - DNA, 505 bp, Homo sapiens
  misc_feature 1..505: note = chr16:4377915-4378420
  misc_feature 1..505: note = hyper
  source 1..505: mol_type = genomic DNA
acccctgggcccttgcgtgtgggggcgctgccctgggcgcatcccaggctgagtgctcgagagacgcggccctgggctctgtgcaccctccacgctgcgctgtcccaccggggggaaactgaggaacggaaggctccaccaggaggcgcagaggggcgtggggccggcgggccttgcgctgcgcccggggagcatccacggggtgcccccacctgaccgagagccggctcctgccctcgggaccccgcagtaattagcacccaggcctctggctgagcttgtccagagccaggctgtcggccttacgctggggagagccacggccacccgctcatgggcactcactcagggttccctggttgcaggcccgctgctccccgctctgggcctccgaggctttcaggagagcaggaacctagctctcgcctgcccccttcacccagccgggaacaaaagcacagagcagagcccagaactggctgctgccggtcggggcgggggtgga

SEQ ID NO: 36056 - DNA, 186 bp, Homo sapiens
  misc_feature 1..186: note = chr16:4587903-4588089
  misc_feature 1..186: note = hyper
  source 1..186: mol_type = genomic DNA
ccggggatgcgcggccgagcgccacatcccgactccacacgtcggcgagccgggcgcgggtgcaggacactgctgggctccgggacggccaaggtcacccgcggggctcggcaggggctggctcggccacggggctcctcctcgaccccctttccttgagaaaacaactcccacccctcccctccc

SEQ ID NO: 36057 - DNA, 453 bp, Homo sapiens
  misc_feature 1..453: note = chr16:4588308-4588761
  misc_feature 1..453: note = hyper
  source 1..453: mol_type = genomic DNA
cgccggccccgctttacctccagaagcccggtgcccgaggccggccgaaagcggagaggggcccgggtccggacaggcgccggcagaacaagaccctcagccccgcgcggctttgcgcgcacaacgaaaccccccaacccaccgcccaccccaccgcccagaggcttctaggacttgtagtccgcccggtcaccccccccaccacaacccgctctgagaggctggggactacggtgcccggcatgcaccgcccaggcgccgcgggcgggggcggggagggggcgccacggtccgaggtcacgccccgacctgaggagagctggcgcccagacccttcccccggggaggagggctcccgcgcgaagccgtctccgaatgcgtccagtcgactcaccgtccccgcagccctggggcagcggccgcaacagcaggaccgaacgcctcggcagctgg

SEQ ID NO: 36058 - DNA, 507 bp, Homo sapiens
  misc_feature 1..507: note = chr16:5037518-5038025
  misc_feature 1..507: note = hyper
  source 1..507: mol_type = genomic DNA
cccccccaccacggccgctcactgccgctctgcccccaggcctacgagaagcgtttccccacgtgcccacagatcccagtcttcctgggcagcgaggtcttgcgcgagtcccgcagcccggacggggctgtgcacgtggtggagcggagctgccggctgcgcgtggacgccccgcggctgctgcggaaggtgggcggccctggggctggggggcggaggaggggacctgttgcggaggtgcgggagggctgggcgcgggagctggggaccagggcggcggggtccaggaggtggagcaggggcgtgtgagttgatatttggatggaggttccaggatgagggtggcgggaccagggcccaggaggggcgagggctggaaggctgggctggggagtagcgggaactgggcggggttcgcggggccagggccggagctgggtggtgaagatgggttggcggcagggcggaagtcgggggttggtgtcctgggtccgggctgggtgggcg

SEQ ID NO: 36059 - DNA, 44 bp, Homo sapiens
  misc_feature 1..44: note = chr16:6069508-6069552
  misc_feature 1..44: note = hyper
  source 1..44: mol_type = genomic DNA
gcggtggggcgggggcgctctgccagccccgggaacagcagagg

SEQ ID NO: 36060 - DNA, 61 bp, Homo sapiens
  misc_feature 1..61: note = chr16:6070141-6070202
  misc_feature 1..61: note = hyper
  source 1..61: mol_type = genomic DNA
tgtgtggaaagatctcgaggcgtgtccccccctacccccaggaggccgagaccctgagccc

SEQ ID NO: 36061 - DNA, 289 bp, Homo sapiens
  misc_feature 1..289: note = chr16:6533425-6533714
  misc_feature 1..289: note = hyper
  source 1..289: mol_type = genomic DNA
cgtttgctgttgcctcggacttctcccgtgctgtgttttcccggtgaggaaacaggaggcactttgcagccgacaatgaaatcttggcagctaattgcagtcgtgggagatgcccttcaggtacggcgagcgaagaagactctaaaacactgtcagggaaggagagaaagagggagagagggagggagggaagggagagaccaggcagcttctgcagaggcttcctgaagcccactgactccgcgggagggggttgcagagggacgggggcgggcgacagggggaggag

SEQ ID NO: 36062 - DNA, 33 bp, Homo sapiens
  misc_feature 1..33: note = chr16:7354091-7354124
  misc_feature 1..33: note = hyper
  source 1..33: mol_type = genomic DNA
ttggaggcagaggaacgccgggatctagcacat

SEQ ID NO: 36063 - DNA, 24 bp, Homo sapiens
  misc_feature 1..24: note = chr16:7354634-7354658
  misc_feature 1..24: note = hyper
  source 1..24: mol_type = genomic DNA
gctctctgtggagcccgggcacct

SEQ ID NO: 36064 - DNA, 75 bp, Homo sapiens
  misc_feature 1..75: note = chr16:10133426-10133501
  misc_feature 1..75: note = hyper
  source 1..75: mol_type = genomic DNA
gggcagcgaggactgcgcagcagcgggagggaccggtggcgttgggcgcggggagggtctgcgcggggagggtcc

SEQ ID NO: 36065 - DNA, 64 bp, Homo sapiens
  misc_feature 1..64: note = chr16:10133502-10133566
  misc_feature 1..64: note = hyper
  source 1..64: mol_type = genomic DNA
cacccgggagcgggggcggctgctcgctctactcctgggaggggcctttcgaaggaccaggtgc

SEQ ID NO: 36066 - DNA, 726 bp, Homo sapiens
  misc_feature 1..726: note = chr16:10274299-10275025
  misc_feature 1..726: note = hyper
  source 1..726: mol_type = genomic DNA
agtgagaggcagggccgcggtgagcaaggcgaccagaagaaagggattaccaacttggcttcctgctctaggagccaggcatggaactcagcagcaggataggctgctgggatcacggactccattccgagtccccgacgccatccacatccctcgatccatctctaactctatccacaactccaattcgagctaattctccatcccccagccccttctcgcatccagcttcctcatcccctgtctccaggcacttccccatccccatctctgtccatatcccccaccgcattccccaagttcgccgcgggccacagaccctaagcgccgcgcgtgttctgtaccccaccaagctcctaggtgcacagaataaaccctccatccaacccctcccacctgggatagagaggaccaagttatcaaccccgccccctgctggcgcggagcgaactacagaccccgcagggcgtgcggaggcggcacccagaccccgcgtcccagcttgagagctcagctagttggctgaccccgccccctacgagcccgtcgtgtgcaccacacactttgctctacgcccagccccaactacagacccggctcctctcagtcagagtacaccccaagtgcttgggagtgaggacgctgcctggtgggcccaggctccgctgtgcctggggaacttggggctcgccccacctcgagccaaggggccgtggagagtccttc

SEQ ID NO: 36067 - DNA, 250 bp, Homo sapiens
  misc_feature 1..250: note = chr16:10275248-10275498
  misc_feature 1..250: note = hyper
  source 1..250: mol_type = genomic DNA
ctagcctttctactgcgggcgctgttgccaagtcctaggtgcacgtgggcagtgggccgcacacgctcataggcacgcgcgcttttctgcgcacttcctcagactgctgtagcggtgcccacggccagccggagtcctcacatgtcctcaggtggtgcacacgcatgaactgcggcaggtgcacagccctgcgtacctgcaaataccagcacggtcgtgcacgcgtgccctgacgcgcgcctctcgggac

SEQ ID NO: 36068 - DNA, 147 bp, Homo sapiens
  misc_feature 1..147: note = chr16:10275801-10275948
  misc_feature 1..147: note = hyper
  source 1..147: mol_type = genomic DNA
agccaccgggtttagcgggttcccgcatgctgcggccccagcgcgctcccctggctgtcccgcgctgtccgcatcgcccccacggggggcggctatcccagccggaggctctgcagcagggctctaacggggcggaggagagaagga

SEQ ID NO: 36069 - DNA, 30 bp, Homo sapiens
  misc_feature 1..30: note = chr16:10276341-10276371
  misc_feature 1..30: note = hyper
  source 1..30: mol_type = genomic DNA
agggggagggaaggacgcgggctcccgcgg

SEQ ID NO: 36070 - DNA, 202 bp, Homo sapiens; identical to SEQ ID NO: 4323
  misc_feature 1..202: note = chr16:10276597-10276799
  misc_feature 1..202: note = hyper
  source 1..202: mol_type = genomic DNA

SEQ ID NO: 36071 - DNA, 251 bp, Homo sapiens; identical to SEQ ID NO: 4324
  misc_feature 1..251: note = chr16:10276800-10277051
  misc_feature 1..251: note = hyper
  source 1..251: mol_type = genomic DNA

SEQ ID NO: 36072 - DNA, 334 bp, Homo sapiens
  misc_feature 1..334: note = chr16:10277071-10277405
  misc_feature 1..334: note = hyper
  source 1..334: mol_type = genomic DNA
cgctcaagcccaagaggcttcgagctccggcgggcgaaagcgtctcctgcccgcagcctctctcctaggtgggtcgagacagaccccgcagtccctcggcggcgacgcggagcgcggccacccgttccgagagcgcacggcggcaaataaggccaggataggtggctggctggcgacgggggcgcctgcggcggcgcgcgctgctgtccgtggtgttggaaccacgctctccgcccgctcccgggcgtctggtgcggctgaagaatcaattattcagatctctgctaccgcttcctcctcccccagtgcctcgcgctgggtacagttatccccc

SEQ ID NO: 36073 - DNA, 239 bp, Homo sapiens
  misc_feature 1..239: note = chr16:10480064-10480303
  misc_feature 1..239: note = hyper
  source 1..239: mol_type = genomic DNA
cggccccggaggcctcggagcgccgggcctaccggacgtttgcggcgaagctgccctgactgaaaagcgtccgcggggccgtctgacaggtccgggaagaggcccctgaggggcggacgggcgcgtctccaccgttttcgcagagggatactggtgaagcgggagtggtgtgcggcctcaggtccgggcggcactggggttagggactgcggagggaagtggtgcgtgttttttgtcct

SEQ ID NO: 36074 - DNA, 69 bp, Homo sapiens
  misc_feature 1..69: note = chr16:12897833-12897902
  misc_feature 1..69: note = hyper
  source 1..69: mol_type = genomic DNA
tctgggatcgacctgcgcgcctggcgagtggagactgtctagggcacgcgtgggcggggataaggcttt

SEQ ID NO: 36075 - DNA, 1178 bp, Homo sapiens
  misc_feature 1..1178: note = chr16:12994459-12995637
  misc_feature 1..1178: note = hyper
  source 1..1178: mol_type = genomic DNA
gaaacacagaggagacgggaggctggaagctgaggaagcaaggcagagctctgcagcccccggtgaggatttccggggggatccgtggggacaggggccagccagctccagagaccgatgcgcgggctccaggtccgggagggtggctgaggctgggtgcccaggccttgcgctgcgccagatccgggagcgcagaggcggcgccgcggtgttccctcctgtggagcgcagaaaacgctgcgggggcgaagagggacagaaagcggcaggttcgagaggctgggggacttccaaggaaagaccttccaggacacgccatagcctcggccttgttcggctgtcccctcttacccccgaccttctttgattcgttcatcccgagcccctctcccccggagggtgcttatccctggctcaggggcttgccacctgtccttcccagctccgcctgggtccttgcttgggcccagagagttgagccatgcgggttgcgctcagggctggagggcgcagccgggaagggcaaggaggccccgcacgcctgggaggggcgatcctgaccagactgcacccagtctgtcttggagtgaaagccatttagtctgtccccatcctctccgagtcatccttcccctgatgcacagatttcggccgccgctcctgcacacgcaccggtgaaaaagctacgagctgagccgcctctgcgctctggacagggctgagccgcgcctcctacccagagagggcgcgggaggtcctgccgcggttttccacctgcctggaaatccgagcggctcctctagcctcggctgctgccgagctcgctcctccccgtccgctcgcctggctcagctctgcacgccccccagctagctcccgctctagtcacctcttccccgcgcccccgcccctctagagctcgcgcccgcccccccccacccgcgcctcctctgcccgccctcctccccctcccccttccctcctgccctcccttcattccacaagtgtcgcttcgctctcttcagcgcacttggcgagctggtgaggtgagagggatactgcgagagggctaggggcggccagtccggggctgccggccaaggctaggcgctgccagcccgattctcctctgctctccacccccgcctcacccagtggccggccggacctgcaccccg

SEQ ID NO: 36076 - DNA, 1630 bp, Homo sapiens
  misc_feature 1..1630: note = chr16:12996073-12997703
  misc_feature 1..1630: note = hyper
  source 1..1630: mol_type = genomic DNA
cggagaggccagcgagggcgctgaggcatcggacgcgcccccgacccgggcgcccacgccggacttctgccggggctacttcgatgtcatgggccagtgggacccgccgttcaactgcagctcgggcgacttcatcttctgctgcgggacttgtggcttccggttctgctgcacgtttaagaagcggcgactgaaccaaagcacctgcaccaactacgacacgccgctctggctcaacaccggcaagccccccgcccgcaaggacgaccccttgcacgaccccaccaaggacaagaccaacctgatcgtctacatcatctgcggggtggtggccgtcatggtgctcgtgggcatcttcaccaagctggggctggagaaagcgcaccggccccaaagggagcacatgtccaggtgggctgcctccccttcgccctcccctcggggcttcgctctccctgctctctcctccccaccttcccccaggcaatggcgctccccacggtccccgctccccgcatcccagcctctccgctgggggatgtcaccgggaagccaacttcggcttggaacacggagaaggggcgctgggctcagcacaggtgtgggtctgagcgtgttcgtgtgtgtgtgagcgtgtgtgtgtgtgtgtgtgactctgctccctcaccctctggccgcctcctcccgctggtgactgaggcggacttgagacacgtagcctgggagcccgtggccccgaaatcttcgggtttggggagagggtccatggcacccctcggattccaggtgctagctttttggtaaacaggggcaggcgagcccgaaaggggaggggggcgtgtgtgagcccgagcgcgcgtgtgtgaaggagggagggtcagagtgagtgccgcctgcaactcgtacgactcgcgaaaaggagacgagggaggtggagtgaggggagggcgagaacaaaagccttgcttggagcggccgcctcgctttcccagagcttcgccgtccctggatttgggacctcagctgcccccgcccctttacccacctcatccctttctctggccaccacttctccctgcccggggccgtggccatcgctgcagattgagccccttgccctggctggcgtggactccgggggcccgagccccctcctcgcgcgccctcacttccaagcaccctgatttcgtcaactttcgggtttgccttgttcattatgcaagccccagcaccagctagttccagcagatgggagaaggctttgggggattaatggagctatttgccttttgctttttttaaattttttttattttaagtgtctaaatcgattcgcaaactccgtaactttggaggcggaggacgcagccactaggagcactaagcccccggccgcgggagaggctgggggttggcgtgaggtccgggcgggcggggtggaaggagtgactagcggcctgcgaacagctggatggttggggcataagctttaactgtcccctttcagagtctgggcaacgaagtcgctgtatttttctctaccctctccccaccccttcttccgcgccccctctgccgggggcctgtgtgtgtgcgcgcgtgtgtgcacgcgctccgtgtgatgcctaaa

SEQ ID NO: 36077 - DNA, 764 bp, Homo sapiens
  misc_feature 1..764: note = chr16:15528335-15529099
  misc_feature 1..764: note = hyper
  source 1..764: mol_type = genomic DNA
ccccttctgggtacccgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaagtgagtactggggcggggggcggggggccggggacagctggggatccatgcgcctgcgcgggtggtcgcgggagcgcgaggaacgccagcagtggacccagggaagcgcccccgcagcggggctggcagctcagggggatacgcagctctgcgcagcgacgcgctctccccgcgaacaaaagggggggaccctccgggctgagcctcactgggagggttgggagatggccaggcagctaaggcaggagcctgggctcgacttaggagtcccggatccgtcagctcgcagctggtcctgtgaagtcgggtctctcccacagcccagggaggaggatcctctctccgcctgggatgcgccagggcgctggagacgcgggaccgtcctggaaagcgcccacgtccctggagaggggggagtgtctgctggttttccgcttgctttcctaccccctgcgtgaggtttcggagcgcacctgaaattcc

SEQ ID NO: 36078 - DNA, 484 bp, Homo sapiens
  misc_feature 1..484: note = chr16:15950853-15951337
  misc_feature 1..484: note = hyper
  source 1..484: mol_type = genomic DNA
acgcacctcccaggccggagcgtccaaatctccctgcgcgtcctcggacgcctctctttatagacccggagctgcccgcggctgggaaaggggaggaggccgaaggggtggagttggggagggtccctcgcggccccctcgccgcgccccctgcagggcgcacccccggcgggagcgcaaggagctggggcgctcgggacaagggtgcacggaacaggtgcgcaccgcacaagggcgcacggaacaggtgcgcacagggacgggagtctcagccccggccccaggcggtcgcagacgctccggatccctagagaaagggggtcgagcaggcagtgtctgtgcgggatgcttgagaacgtcttccctgagtcggttccggccgcaaaggctttaacctcttcctccccgtgtcggggctgtggtggatctgacttgacatctcccaccccacttcccattttattggcatcgcactgtctggaaa

SEQ ID NO: 36079 - DNA, 80 bp, Homo sapiens
  misc_feature 1..80: note = chr16:15952285-15952365
  misc_feature 1..80: note = hyper
  source 1..80: mol_type = genomic DNA
tgcaggaattcccagcgccgcataccagctctgggctgccggctccccctgactaaatatggtgccgagtggccttcctg

SEQ ID NO: 36080 - DNA, 30 bp, Homo sapiens
  misc_feature 1..30: note = chr16:19422447-19422477
  misc_feature 1..30: note = hyper
  source 1..30: mol_type = genomic DNA
aagaataatcgcacccgtttctcaggtgct

SEQ ID NO: 36081 - DNA, 462 bp, Homo sapiens
  misc_feature 1..462: note = chr16:19567065-19567527
  misc_feature 1..462: note = hyper
  source 1..462: mol_type = genomic DNA
ttggtaaggaagcagcggcgggtgggctttggagaggggctgtccttacttgtgatggggtcggcctgggtctgagagtgtgaattcctctctgtcgggttctggtggtcgaccggccacccccaagttgtcttgaccgtagaatccctggccgctaccgcggtccagcggagcaatctgaagccagactggcgggttcttggttctctccccgtctgctgcctctctgcgccttccacgggcccctgtccattcattccctaaagaaaacttgagtttccaggcttccgcgtccccagaagttggcgcgggttctggggtcgctggatgagggtaatggtggactcagcttttaaagtctggacgagtcgggagatctggctgttggtcagtttcctcagctcctctgttcacctggagacttgcttttctcatctgtaaaatggccgccattcatcctat

SEQ ID NO: 36082 - DNA, 251 bp, Homo sapiens
  misc_feature 1..251: note = chr16:20084648-20084899
  misc_feature 1..251: note = hyper
  source 1..251: mol_type = genomic DNA
aacttcctttccccccgtgtggaaatatccatagttgcccttaaagcttaaactttttccgagggggcgccagggaacgcacgggggaggacgggggattctgggtagggttgcccggcacttggggttcctggcttccctccctctcccccacgcccctcacctggtaaaccgaggcacagcaagaggctgtagtagaccacgggcacgaaacccaagccgcaggccgagccgggggaccaccaagacag

SEQ ID NO: 36083 - DNA, 118 bp, Homo sapiens
  misc_feature 1..118: note = chr16:20085303-20085421
  misc_feature 1..118: note = hyper
  source 1..118: mol_type = genomic DNA
cggagtgtgtgtggggtgggagggatgcggaagaggagggggtcccagccgcctcgcttggctccactttcaggggagaagatgcagttagacctgggagccccgaaggaagaccgga

SEQ ID NO: 36084 - DNA, 372 bp, Homo sapiens
  misc_feature 1..372: note = chr16:21294924-21295296
  misc_feature 1..372: note = hyper
  source 1..372: mol_type = genomic DNA
acggatgaagtatctcggaagccggagaagggtggtctggggctcttgggagcatgcgcggggtggggcggtggggggactgaggtggcgctcccggctcctccgcgcgcccccggcaccttccgcgcgtccccggctccccacactccgtccccggctccccacactcccaccccggtctgccccgggcgcccccggttccccacctcctggtgtgcctctggcgggtccgcgcaggatcaggctacagactcgcccgcgggcggctgcgcggcgggccgttggggagggtgttgggatgaggagccccaaccagatggacgcgcaccccgcagcggcggaggcggcggcgaggcttgagcagtgagtgct

SEQ ID NO: 36085 - DNA, 34 bp, Homo sapiens
  misc_feature 1..34: note = chr16:21295340-21295374
  misc_feature 1..34: note = hyper
  source 1..34: mol_type = genomic DNA
cgctggccgctgctccagacgccagggggcccac

SEQ ID NO: 36086 - DNA, 116 bp, Homo sapiens
  misc_feature 1..116: note = chr16:21675345-21675461
  misc_feature 1..116: note = hyper
  source 1..116: mol_type = genomic DNA
ataggaagtcccaggcggggactgtgacccccgccgctgccctggctgagttcccacctgggccgctgcagggaggaggtcgcagagctgccggctggcgccgccccgccgctctc

SEQ ID NO: 36087 - DNA, 386 bp, Homo sapiens
  misc_feature 1..386: note = chr16:21831571-21831957
  misc_feature 1..386: note = hyper
  source 1..386: mol_type = genomic DNA
agctttggtcccagacgcgcagaaggaagcggcctgaatcttacccagtcctcgacgcgcccagcgtcttgactgcagaggacgaagcggccgcatctcccgacaaacaacgtgtgaagcagcggtgccgccattgggccgaactaacgcgaccgctgcgcctcaggccggatgcccagctccttccagccacagcctctgtcccggaagttgcgcgtgccagcgcaaccttcagacaatcaggggccccgtgtggggagggcgtatgctctcggcgggctagagcgccgctaaaacgcgctcttcgttctacttggaggacttgttccagccagcgtgagtgcgcgagtgtaaggagagacgggaaggatcggctccatccagcc

SEQ ID NO: 36088 - DNA, 195 bp, Homo sapiens
  misc_feature 1..195: note = chr16:22173697-22173892
  misc_feature 1..195: note = hyper
  source 1..195: mol_type = genomic DNA
gaatgcaggtgctcccgcgccgggagtgggcgggcagaagagcgggcggggggcggtccggatgcctcgtcccgccccgccccgcccctttctgccctcctcgggagaaggaggtggcccggtggccctggcggcgcggagactggcgcagcgcggggagcacgcagcgccgcgggagcccgggccaggtgagcg

SEQ ID NO: 36089 - DNA, 377 bp, Homo sapiens; identical to SEQ ID NO: 12422
  misc_feature 1..377: note = chr16:22203596-22203973
  misc_feature 1..377: note = hyper
  source 1..377: mol_type = genomic DNA

SEQ ID NO: 36090 - DNA, 604 bp, Homo sapiens
  misc_feature 1..604: note = chr16:22824473-22825077
  misc_feature 1..604: note = hyper
  source 1..604: mol_type = genomic DNA
tctggacatggtcaccgagaactgtcctgtaggcattcacttaggaatcattcgaagtggaattgctcctggatacgttctccttgtactctgtttcctcctcctagtgtctctgtgtgaagaagccctcctcactcagccctcggcgaccctctggtaccctggacagctccccggggagcagtctaccgctaggcggcggctgctaagagaggaaccctcctgacgcggagtctgccgctccggggctcgctctccggcaggcccggggagaggtggggtgacaatgggttggggtgcgcgcgtgcctcataggtgcgagacagagcgagccgccggggtgtgagtcagcgcgctgggggctaagaagctgggtgaatagtcacggaatctcactcacgctcggctcctccacccatcccgtctacagcgcgtgtcccagtccagggcgtgcgtgcgctcggtgtccgattccgggctgtgtgtgtccatttggcgagatgtcgagagcggggggagtgtccttgtcggtgtatctgggcccaggttaggggacttctcctccccacccccgcgtgggtgtgggggtgtgtccgggctaggg

SEQ ID NO: 36091 - DNA, 313 bp, Homo sapiens
  misc_feature 1..313: note = chr16:22825157-22825470
  misc_feature 1..313: note = hyper
  source 1..313: mol_type = genomic DNA
cgtctgggtctgtctggtctgcatgtcggcgcgatctcgacctggattcgtgtccctggatgtcgagaggccagcgtggtgggggtgtccagcctcccggaggagtactatgccttgacaccttcgtttcaccgccccaaagctggcctggggctccgtagggagtggcctgcatggggagggcccgcgtgctgtgtttctgggaggggtaagagagtgggggcgcagggggcgggccaggtccctgggcgcggcgcgggctcgggggacccgcgcggctgacgtcaggccactccttaaatagagccggcag

SEQ ID NO: 36092 - DNA, 140 bp, Homo sapiens
  misc_feature 1..140: note = chr16:22825885-22826025
  misc_feature 1..140: note = hyper
  source 1..140: mol_type = genomic DNA
ggtgccccctcggaaaccatgacccccggcgcgggcccatggagccatggcctatagggtcctgggccgcgcggggccacctcagccgcggagggcgcgcaggctgctcttcgccttcacgctctcgctctcctgcactt

SEQ ID NO: 36093 - DNA, 75 bp, Homo sapiens
  misc_feature 1..75: note = chr16:22826252-22826327
  misc_feature 1..75: note = hyper
  source 1..75: mol_type = genomic DNA
aagctgggtaccaagcggttgccccaagccctcattgtgggcgtgaagaaggggggcacccgggccgtgctggag

SEQ ID NO: 36094 - DNA, 122 bp, Homo sapiens
  misc_feature 1..122: note = chr16:23313400-23313522
  misc_feature 1..122: note = hyper
  source 1..122: mol_type = genomic DNA
gtatcgctggtgtcccgaggtggggagggagaatgcggagcgcgtgcgtgcggggggcgtccagtgtccctgaacctggcgtgtgggggctggagcttattgggaggcgagggaggtggcca

SEQ ID NO: 36095 - DNA, 57 bp, Homo sapiens
  misc_feature 1..57: note = chr16:23313779-23313836
  misc_feature 1..57: note = hyper
  source 1..57: mol_type = genomic DNA
cgcacccggtctcccgcgcgctgcccggagtccctgcgcgcgcgccttctcctgccc

SEQ ID NO: 36096 - DNA, 140 bp, Homo sapiens
  misc_feature 1..140: note = chr16:23706411-23706551
  misc_feature 1..140: note = hyper
  source 1..140: mol_type = genomic DNA
cgcgatccaggtccgggttttctacgtactgagcagcagcaagggccaaagcatcactctccagcccggaccttcccactcaccctccctgaaccgcaatgcaactcacctcctgcaaggaggcccggcagagctccagg

SEQ ID NO: 36097 - DNA, 104 bp, Homo sapiens
  misc_feature 1..104: note = chr16:23765896-23766000
  misc_feature 1..104: note = hyper
  source 1..104: mol_type = genomic DNA
tccccataggccacccgccttccagcagggcgtggtctctacagaggaggtcaggtctcccaggcttcctcagcgtcgacgccggggagcgccctggggttggg

SEQ ID NO: 36098 - DNA, 30 bp, Homo sapiens
  misc_feature 1..30: note = chr16:23766456-23766486
  misc_feature 1..30: note = hyper
  source 1..30: mol_type = genomic DNA
cggctgcggaggggacggggcgaacccagg

SEQ ID NO: 36099 - DNA, 262 bp, Homo sapiens
  misc_feature 1..262: note = chr16:23846792-23847054
  misc_feature 1..262: note = hyper
  source 1..262: mol_type = genomic DNA
cctacctctgcagaacgtgtgtgtgtatgtgtgtgtaagtgtgtgcggccacaagcctttccgaatgagtgacagcgggagcccatccctccaggagacgcgtgcagaatgaccaatgggatggatgggggtggatgggtaccagtctccgcagaggccggggtggaattcgctgcgccccaccccttccacccgctccccttcgccccgtaggtctttccactctcgctcctcccctgggcacatctcctgaacgcagccc

SEQ ID NO: 36100 - DNA, 15 bp, Homo sapiens
  misc_feature 1..15: note = chr16:23847310-23847325
  misc_feature 1..15: note = hyper
  source 1..15: mol_type = genomic DNA
cggcagcagctgggc

SEQ ID NO: 36101 - DNA, 186 bp, Homo sapiens; identical to SEQ ID NO: 1261
  misc_feature 1..186: note = chr16:23847326-23847512
  misc_feature 1..186: note = hyper
  source 1..186: mol_type = genomic DNA

SEQ ID NO: 36102 - DNA, 28 bp, Homo sapiens
  misc_feature 1..28: note = chr16:23847788-23847816
  misc_feature 1..28: note = hyper
  source 1..28: mol_type = genomic DNA
ggactcccggctccggaccctgctgccc

SEQ ID NO: 36103 - DNA, 58 bp, Homo sapiens; identical to SEQ ID NO: 1263
  misc_feature 1..58: note = chr16:23847817-23847875
  misc_feature 1..58: note = hyper
  source 1..58: mol_type = genomic DNA

SEQ ID NO: 36104 - DNA, 70 bp, Homo sapiens; identical to SEQ ID NO: 1264
  misc_feature 1..70: note = chr16:23847933-23848003
  misc_feature 1..70: note = hyper
  source 1..70: mol_type = genomic DNA

SEQ ID NO: 36105 - DNA, 561 bp, Homo sapiens
  misc_feature 1..561: note = chr16:23848004-23848565
  misc_feature 1..561: note = hyper
  source 1..561: mol_type = genomic DNA
cctcgggtgctctccgacccggggttccctatctctccgcctgcttccgggcgcgaggagccctcgccccccaccccttgtttccggggggggcggcgccctgggtgtccttctctatctccctgcgggcatgggacatcctttctcactcctctgtgcctccgggcagcgccctgtgttatctcccattgcccctccccgagggcctgggttcccctttccactcctcggtcacatcactgcgggcccctttcttccccagtccctccagtagtggggcatcctttcctccttcccagtccccctcccagaggacaccaccgccgcggggtcactctcgccctccctctgaatgcgtctttatctcttctcttttcccgagggtgctcggggcatctatgggtacatctgtcgcctgccttcagcccctaccccgacggaaacgctccccactatcccgccacctggtggtcgcagcctcctctcttctgcaggagtgaaggcagatgggggttacagccgagctcccacctacccccacaaaggcggaagactcttggg

SEQ ID NO: 36106 - DNA, 120 bp, Homo sapiens; identical to SEQ ID NO: 4336
  misc_feature 1..120: note = chr16:24267025-24267145
  misc_feature 1..120: note = hyper
  source 1..120: mol_type = genomic DNA

SEQ ID NO: 36107 - DNA, 379 bp, Homo sapiens
  misc_feature 1..379: note = chr16:24267220-24267599
  misc_feature 1..379: note = hyper
  source 1..379: mol_type = genomic DNA
cgagccggctggctgacccgggaaggaacgggggaagggcggggtgagggaagaaagaccctttagcaccccgggtttctagcccgggcggcggtgtgcagctgcatgagggagctgtcccttcggcaccacggaccttaaagcctaggcgttaagacgacggaggcggggcaacaggcggggagctgtcccttcagcaccacggaccttggcgcccccagggaaaccagccggcccccgccccaggactctgtcttttctccagtttgagcgggggtgtcgggagcaggcggagagctttcctgcgaggctgtggaagcagtgaacactcttctcagcggctcgcctcccagcagtgctattttttgccatccgccct

SEQ ID NO: 36108 - DNA, 153 bp, Homo sapiens
  misc_feature 1..153: note = chr16:24621912-24622065
  misc_feature 1..153: note = hyper
  source 1..153: mol_type = genomic DNA
ggctctggggagctgcggctctcgggccctgccaaacagacgcagccttcctaaggagcagcgctgcgctggctctgctggggtggaaggagcttctccttcgctgtcctccctctcccttcccagcccatcttattccgagcctctcctctc

SEQ ID NO: 36109 - DNA, 1328 bp, Homo sapiens
  misc_feature 1..1328: note = chr16:25702795-25704123
  misc_feature 1..1328: note = hyper
  source 1..1328: mol_type = genomic DNA
agagaagatggggggcggggggcggtggctggaaagatggaagttgggatgggaaagcggttgtagaaaaggattcactcctggaccgaaggcaggaggatatcccgggcgagagaagggagggtcggggatgggctgagttggagtcccagaggaaaagcggaagcgagagcttcgtcacccgctgtcttccagctcccggtgcgcggcaccggaggcaggcgttgggctttacctctctaaaagtactggggcaaaggaatggagaacacggcgtcccgagctcccaagggaggggagtaaacgaggtggggtggggaacaccccaagtgcgtgcgtgctgggggctggggggcacgatctccgttctcccgggtgccccagccctagcgcacgcctccgctcccccgcccccttcgcaggcgcgcgcgaggcgcaccccccttccctcggcggcgccgggcgcgcgcccggccccctcctcctcccctccgcgcctctcctctctcccggcagaaagttagcagcggggaaggaactccgggctgcaacagcgcgcggcggcggcggcagaggctgaagcagaagccgcggcggagccggggaagcgggggcgctgcagacggagcaggtgccgccggcgggtccgcgcgcccccctcggtccccttgcctgaggctgaggggggggcggtggtgggggggccacccggactcggcgggcagcgtggggcggggggccatgcggccgggctcccccctggcgcagcgggacagcggccagggccgggggcgcagcggcgtcgcttcatgcagccggggcggctgggcagcggcggcggcggcggcggcggcggcggcggcgggggcggcggctgaaaccatgtccgggcagcgccgggggctgccgccgccgccgccgccgccgcgagccgggagccgcgatggcccggtggcccgcacctcctccgcctccgcctccgcctccacctctggccgcgccgccgccgcccggcgcctctgctaaggggccgccggcgcgcaagctgctttttatgtgcaccttgtccctgtctgtcacctacctgtgctacagcctcctgggcggctcgggctccctgcaattccctctggcgctgcaggagtcgccgggcgccgccgccgagcccccgccgagcccgccgccaccctctctgctgcctacccccgtgcgcctcggcgccccctcgcagccgcccgcgccgccgccgctggacaacgcgagccacggggagccgcccgagcccccagagcagccagccgcccccgggaccgacggctgggggctgc

SEQ ID NO: 36110 - DNA, 255 bp, Homo sapiens; identical to SEQ ID NO: 4339
  misc_feature 1..255: note = chr16:25704389-25704644
  misc_feature 1..255: note = hyper
  source 1..255: mol_type = genomic DNA

SEQ ID NO: 36111 - DNA, 43 bp, Homo sapiens
  misc_feature 1..43: note = chr16:28073999-28074042
  misc_feature 1..43: note = hyper
  source 1..43: mol_type = genomic DNA
gggcatctagtgccccgcgaaaggaagaggaggagggggcgag

SEQ ID NO: 36112 - DNA, 179 bp, Homo sapiens
  misc_feature 1..179: note = chr16:28074076-28074255
  misc_feature 1..179: note = hyper
  source 1..179: mol_type = genomic DNA
cgcccctccgaccggcagcgggggtgggcgccttcccggggcgcgggagcgtccccaaagccgcggggcgtccgcagcgggtaggagctctgccttgcacctctccacggcggggcgtcccgcacgtccccccatgctggtccccggccccggaacggcgcgcgccccctgccccggaa

SEQ ID NO: 36113 - DNA, 520 bp, Homo sapiens
  misc_feature 1..520: note = chr16:28074417-28074937
  misc_feature 1..520: note = hyper
  source 1..520: mol_type = genomic DNA
cgcacgagtaccagatgccggtgtggaaattcctgaagaggaagcggtcgtcgccggtctcccagctgtagagcgcgccgccaggggggccgttccccgaggcggtggcggcggcggcggcggcggcgggggcggcggtgccgttggccgtggcgttggcgcccgagttggggcagttggcgcgcccgccctggccgcagcccggcttggggacccgctgcgtgccctggcaccagtgcgtggtgaggaaagcggtggtggcgaacagcagcgccagcaggttcagggccacggccaggagcgctcggccgcggcggctagtcttcatgccgcccgcgccgccgggacgggactgcaccgccggggagctccgcgcgcgaagttggcagctggcgccccgcgtcagcggccgctgcccgccgcgccccggggctcgggtgcctgagatcggcggcggcggacgcggcgcgggcccatgccccccccaaccccggggtgggggcgcggcgcggggggcgtg

SEQ ID NO: 36114 - DNA, 432 bp, Homo sapiens
  misc_feature 1..432: note = chr16:28074955-28075387
  misc_feature 1..432: note = hyper
  source 1..432: mol_type = genomic DNA
cgggcggcggtggaggagcggctacggcgcgcccggagcccggagcgcgagtgcacctcggctaggagccgctggcgcctggcagcggccacggcgcagggacgcgcgcccctccgtggggagacacctgcaggcggccggcgacactgttccggagcccgcccgcacggggagagggggccgccacgccgggcgcgggcgggggcctgggagtggagggacgcccccgaaagaaatccgagccagggtgagggtctgagacgcaaggagaatcccaggcaaggcgctcctgagaaaagatccccacggcggacgtggggcaacaaaacccgccgggagcgggcatctcatgagacccagagaggccctgccccaggagacaagggcagagcctgctggggctccccaagagggacacggaccagcaggacc

SEQ ID NO: 36115 - DNA, 120 bp, Homo sapiens
  misc_feature 1..120: note = chr16:28304473-28304593
  misc_feature 1..120: note = hyper
  source 1..120: mol_type = genomic DNA
gctccaggacttgggcgactgagcccctggcggcaccgcttgcaccccggtccatggtcgtggcgccctgagcccccggggccgggcagacgaagaccgcgacggcgcccaggccccctg

SEQ ID NO: 36116 - DNA, 51 bp, Homo sapiens
  misc_feature 1..51: note = chr16:28891741-28891792
  misc_feature 1..51: note = hyper
  source 1..51: mol_type = genomic DNA
tggcaacagctggggcggggcgcgcgcaggaggccccgtaaccctatcccc

SEQ ID NO: 36117 - DNA, 123 bp, Homo sapiens
  misc_feature 1..123: note = chr16:29888624-29888747
  misc_feature 1..123: note = hyper
  source 1..123: mol_type = genomic DNA
ctggatttgggggcccgggcggtgcctgaaactgcagtgtgaggtcgggcccagaggagagaaggcggcggcgcggctgaggtccccgcagctgggccaagactcgggcgctgggaccgtccc

SEQ ID NO: 36118 - DNA, 30 bp, Homo sapiens
  misc_feature 1..30: note = chr16:30023074-30023104
  misc_feature 1..30: note = hyper
  source 1..30: mol_type = genomic DNA
ccccctccctttggccgttcaggcctctct

SEQ ID NO: 36119 - DNA, 30 bp, Homo sapiens
  misc_feature 1..30: note = chr16:31022167-31022197
  misc_feature 1..30: note = hyper
  source 1..30: mol_type = genomic DNA
gagcagggagagatgcggagagccaagcgg

SEQ ID NO: 36120 - DNA, 138 bp, Homo sapiens
  misc_feature 1..138: note = chr16:31226609-31226747
  misc_feature 1..138: note = hyper
  source 1..138: mol_type = genomic DNA
ctgaggagcttaaggcggggctggcagaggaaagccgcgcagggatggagcctggcgataagggcgctgagcaaacgtaggtttcccggccttagtccctagaggaaactggagatgggcgggcggagccccagggcg

SEQ ID NO: 36121 - DNA, 47 bp, Homo sapiens
  misc_feature 1..47: note = chr16:31227038-31227085
  misc_feature 1..47: note = hyper
  source 1..47: mol_type = genomic DNA
ctgcacttatgtgtgcgggcccagggtggcaccgagagccccgtcca

SEQ ID NO: 36122 - skipped

SEQ ID NO: 36123 - DNA, 93 bp, Homo sapiens
  misc_feature 1..93: note = chr16:31483566-31483659
  misc_feature 1..93: note = hyper
  source 1..93: mol_type = genomic DNA
ccagagctgcctccccgccgtcgctctcccgcatctccccatccctgtcttcttacttctgcttttcgcctctgcccgcgcctcctttccaac

SEQ ID NO: 36124 - DNA, 156 bp, Homo sapiens
  misc_feature 1..156: note = chr16:31498557-31498713
  misc_feature 1..156: note = hyper
  source 1..156: mol_type = genomic DNA
aaattcccacaaagacgccttattgctaaggccagcctgtaacataaacagctgggctgtcccctgaccccggcctgttgcaggagggctggccgcgctgatgtacacggacacggtacagaccttcgtcattctggggggcgcctgcatcctcat

SEQ ID NO: 36125 - DNA, 91 bp, Homo sapiens
  misc_feature 1..91: note = chr16:31499538-31499629
  misc_feature 1..91: note = hyper
  source 1..91: mol_type = genomic DNA
cccgtcgcccagttccgtcaccctcctaagactcggcagtttgggcccggagtcccgcctccctccgggggtcgcacgcctcctctgctag

SEQ ID NO: 36126 - DNA, 249 bp, Homo sapiens
  misc_feature 1..249: note = chr16:31540812-31541061
  misc_feature 1..249: note = hyper
  source 1..249: mol_type = genomic DNA
agagctttttaaaaacgaaatgaaggtgttagacccgcggcgcagtctccaggaaaagcctccacgcgcagaggggagggccctccgggggagggtgcgcggggcgggggcgcgcggggggagggggttcccggggtgctgagcgggggcgggggtgcgcggggcgggggcgcggctaggaggcgccgcacagcaatcagacgcggctcagggtgcgcgcggggagctggagggcgcagttctggacct

SEQ ID NO: 36127 - DNA, 259 bp, Homo sapiens; identical to SEQ ID NO: 4341
  misc_feature 1..259: note = chr16:31580480-31580739
  misc_feature 1..259: note = hyper
  source 1..259: mol_type = genomic DNA

SEQ ID NO: 36128 - DNA, 992 bp, Homo sapiens
  misc_feature 1..992: note = chr16:47176772-47177764
  misc_feature 1..992: note = hyper
  source 1..992: mol_type = genomic DNA
caaattagtaagaaccgaacaccagcggcggggaattctgagacctctggcggagcgcgaggagcgccgcgtcccgggaagcacccgagcagcagcgctccccgggggccgggacaagccgggtccgcggcgcccgcgcgccgcccccggagcccgcagtggtgccgcagcctccgtggccgcagcaggtgggacccggctggcccagcaggccccgttccccgccgcgaggtgcaggcgccgcggggctattcgaaaaccactgcacgacgtcacggccgcggcttttattgttctcgtggaattactttttgccatcacatctggagaaagagcggcctccgctccacgacaggaatctcacaactttgcaaagggatgcgcggaattctacggaagcggcgcgagggcgcagcccggagggccctgctgggcccaggggcctcctggccgccttcccgacccgatccctcttcccacacgcgccccgcgaacgtcggccggactcgcaggggtcggaagcggcgcgcccggagagccggcggagccgggcagggctcgcgccccgcggtccgctccgagtagccgcgagccccgccagacaaagaggcgcgtcgggtcccgggcgcgggtaagggacgcagaggcgcgggcagggcggcgcgccagcctcggcccgcagggggcgccgtccgtggccccagccccggtccttacctttgaggaccgagcagagccgctccagggccatgttcccgagctgcccggcgcttcgcgaagggctgaggtagcggcggcggtggctcggcgctcacggctcggcgcggcggcgacggccccactccgtccccatcgccggccagcagctgcctccccgctcccctgaggagagctcaggtcctgcggcccgccatgcccgagccccacagtgggctcccgcgcggcccgagcaccccgacgggcgccgcctcctgctccgcggcgccccgtcc

SEQ ID NO: 36129 - DNA, 31 bp, Homo sapiens
  misc_feature 1..31: note = chr16:47177824-47177855
  misc_feature 1..31: note = hyper
  source 1..31: mol_type = genomic DNA
gcccgcggccccggcgcgggatccactgaag

SEQ ID NO: 36130 - DNA, 33 bp, Homo sapiens
  misc_feature 1..33: note = chr16:47178260-47178293
  misc_feature 1..33: note = hyper
  source 1..33: mol_type = genomic DNA
gcagacagagaggggcgccggtccctagtcccc

SEQ ID NO: 36131 - DNA, 15 bp, Homo sapiens
  misc_feature 1..15: note = chr16:48845119-48845134
  misc_feature 1..15: note = hyper
  source 1..15: mol_type = genomic DNA
cggggctctgccctc

SEQ ID NO: 36132 - DNA, 351 bp, Homo sapiens
  misc_feature 1..351: note = chr16:49309108-49309459
  misc_feature 1..351: note = hyper
  source 1..351: mol_type = genomic DNA
tgttctcattaagagcggatgcgcccgggctctgagcattagcgctccagtgcagcttggaaggcatgctcccagctcggctaatggtggaagcggcggccgggcagcaagcgagctggggggcaggcgcggggcccagcgcaacccagcgctgctccgcagacagcagacaccacagtgatcaccctcggctcctcgcctgcgcggctcccggggcgcttagcgcggtgtggagaacccgggcggagaagccaggtctgggcttgttgggtcctagaagcctccctgagttcccctcacagtacctttaagcctggctgggtgccggaaacgctgcgcagaataggaaac

SEQ ID NO: 36133 - DNA, 545 bp, Homo sapiens
  misc_feature 1..545: note = chr16:49311445-49311990
  misc_feature 1..545: note = hyper
  source 1..545: mol_type = genomic DNA
tatctctgtgggtcccggaggcacagggctgcaagggcgcccgctagagctgctccacggcttaccggattgcatgcggagaagaaacgggcccgggtttcaacagaggccccgtgctccgtgaatttctaactcgaaccagccgctgggataaatccgagaaacgttgtttattgtgctattattaactttcccttctccccacgcccctagaggaaataaaattcattcctgaatattgggccaggaaaacgtttctctgaaaggaaccacaactgcaggggaccacccggctgcagctcccagctcccggcccttcgccctaggctgcccactcgctccggctcccgacctccccgctgccgaagcaactgggtcagcctttcagacttaaaacgaagtcgtttatttcatttttgctttcacattatgttccgatacaatcaaaactcctggacgaacctcttgaataaagtcctgtgaatgagcggaatcataggtcctgggcgcccgagtatgcggcgggtggactccggattcagagg

SEQ ID NO: 36134 - DNA, 499 bp, Homo sapiens
  misc_feature 1..499: note = chr16:49312032-49312531
  misc_feature 1..499: note = hyper
  source 1..499: mol_type = genomic DNA
cgcggtgggagacatccggggacagaaggcctgaggagtctgccgctccaggcagggtcgtttgggtcctcaaactgggactattcctgatgcatttggaatgcaaagaaaaaaatcaaacttcgctcctgggccggcggccgcgcctggcctagcaagatttcggccacatttcttacgtttccgccaaagctgtgaacacaggcgaatgcagtgctggtccccggcctggcgcaggaaggagcgcaaggccggctttgcaaggaagccctcgcgcccaggcctttctatggttgcgttcccccaagtctcctgcctttcggaacctcgccctttggcaccccagacccccaacctcgcagctggggaagatgcggattttagaaagctgtttcagaaaaataaaagtcccacttcgactttattagattaaagcaaaattaaaccttgactattcacacgtatgttacagaggaagaggaggcgtccggaagaagct

SEQ ID NO: 36135 - DNA, 1616 bp, Homo sapiens
  misc_feature 1..1616: note = chr16:49313206-49314822
  misc_feature 1..1616: note = hyper
  source 1..1616: mol_type = genomic DNA
taggaagtttcaagtcgtgctgctttctcgccctcttaatttcagcctctttctcactccccttcctgccttcgccctctccctgcctcccttccggctacgagccagtcagagaggaaacaccaggaatccggagaaggtcgagtacttccagccccccatcaagtttccccgctccagcttgaggtatgctcggtcgcctttctccatttggattaggactccgttgctggcggcctcccgggtcacgtcctggtcaccagcgaaggctgaaatcaccggccacccgtttagcatgaggctcacctgagaaagagaaaggcccgcttcagaggcgcaacctaggcaggcaccgaagccgcggtggagcgaacctcctccttgcttggctaacagcctgtaaggcctggaagcacggagaggtggggggtggggggggcgaatggaggaaaaggggctttgcagcttactgctgaggctccagtggggcgaaagaccacacatctgggtgacaggaagggcctgtccccaaaacgggagttgctcttattccagtttctcaaatgagcgcgccaagcgaatctcgactgtgctctgtgatccaatttaataaacccatgaggtggctctagcgccctgagacctttgacctctctcccgtttcccctcagcctcaaaaaacaaacaacaaacaaaaaaaacccagcaactcaggctccttctggcgctaccggaaaaacaaaaacgaacaaacaaaaagcccctgatccctcctggacccagctgccaggacacagtggagaagccactgtgatttgtgattagaagtctcgcaccgagcggcacaatgtatttcctccccaaaccacgggctcaattccctcccccatccagccgcgcccgccaccgcctggttttgcccctgtggtggcaccgtcagccaagggcctcgcgccctctccccagctgtgcgtcccacctctctcggcgcccaagggaaacctggacatctttggggacccggagagccggcgagtgattgctgggacacggctggagccgggagagagtagcactacgccccctccctccctcctctctctacccctcaccctccggggctaaatgctgctagctcaaaaacccacagtccgcacggggtggggattggggacaagtgggagaaaacgggggccccgtccgtggtgctgaagacaagcacgcaagccgcatcgcaggcttctgagccggggcaaggggtagggtgtactgtcgcggtgcttcctggggagtccgggaaggcttcccaagcggcagctgtctggggcgctaacaacagccgttacaaggaagtccctgaaatccagggaacccttcggagaggcccggaaggcagaagcagaaaattctgtctctcgggggatggggctggatcccaagagccagagacagggaaagcagaggacagttgaagccacagaactgagaggccccgctatctgtccctccaagcagcccgaagtacatgcagccgccacttctgcctaccacctccggacagcccgagcacccctgaggccagtaacccccctacggggccagggcccggcacgagg

SEQ ID NO: 36136 - DNA, 1244 bp, Homo sapiens
  misc_feature 1..1244: note = chr16:49315072-49316316
  misc_feature 1..1244: note = hyper
  source 1..1244: mol_type = genomic DNA
ccagcccaatctgcacgccgcgggaggaaggaacactcacctggtcgaagtagatgatcatggtgcgattactcatctcggacggctcgtggttggtgctcctgatggcagagaaagccaccttggcgctgccagagcgcacagagatgcccagggcagtgcccgtggggtcggacgtggggttggagtcgcacaccaccaggcacttgccctccagcacgatgggctccgtctcattctgcccgcgggccgggcccgccagccacgcagcccccagcagcagcagctccaggacgcccagcatcgcgccgccggcgcccaccccgccccccacccccagggctgctcgcgccagccgccccccccgtcccagtcccgctccgaagccccctcctcagctccgtgcgcagctccgccgccgccgctctggacactacacctcttcctcgcactccgggactagcgtcccctccgcgactagcgtcccctccgcgctgtgttcccggagcccctcccgggcctcaggggtgccgcggctgcccagccgcacttggatgcatagccgctgctgctcggtcccgctgctgccgccgcctcctgcccgcacccgccgctgccgccgccgccgccgctctgaattattgatgcagccggcgctgcagccggagcgggcggagagcgcgcgccgggcacaaaggcgcggacctcggcctggccccgcccccgccgcctcccggcccgcctccctccgaggccctgcccccgccccggccgaggccacgccccccagccaatcctgacgcgccgcgctccccaccgagccaatggcggcgctgtccgcgctcggccacctgaccccgggcgccgttgttattaggcgcggcgaggcgggtggcgcgcggcagcagggttgggctctcgccgtgagtcgacgaagggagcgcgggcgcgcgcccgcgtccgcgcactgagagtcgcctcggccgctcgctttctcgactcccgcctcgcgcctcgatcctgttccgcctccctcggccctcctgcccgcccccactcgtcggccctcaggtaggaggcggcgcgccccggggtcgggagtggaatcgctggaggctgcgagtcgcctgcccgcctgtgggcgcgcccgttgggaggggagcgccccccagcgggcgcgggcgcgagggcagccggcgcgctgggcgagcctggctcagggtcccggcggccggggtgcaggg

SEQ ID NO: 36137 - DNA, 115 bp, Homo sapiens
  misc_feature 1..115: note = chr16:49316508-49316623
  misc_feature 1..115: note = hyper
  source 1..115: mol_type = genomic DNA
gactgctctgccggccgcggaggtcggatcgagcggtcattcattcatttgttaattcgttcacttattcaggggagatcattgaacccctacggagtaccgggtactgggccgg

SEQ ID NO: 36138 - DNA, 49 bp, Homo sapiens
  misc_feature 1..49: note = chr16:49317153-49317202
  misc_feature 1..49: note = hyper
  source 1..49: mol_type = genomic DNA
cccacaggctcctggcgctccggtccccaccaggcgaccttgatcctgg

SEQ ID NO: 36139 - DNA, 35 bp, Homo sapiens; identical to SEQ ID NO: 12458
  misc_feature 1..35: note = chr16:49317700-49317735
  misc_feature 1..35: note = hyper
  source 1..35: mol_type = genomic DNA

SEQ ID NO: 36140 - DNA, 30 bp, Homo sapiens
  misc_feature 1..30: note = chr16:50699376-50699406
  misc_feature 1..30: note = hyper
  source 1..30: mol_type = genomic DNA
gcctggagaaagtttcggtttcccagctgt

SEQ ID NO: 36141 - DNA, 96 bp, Homo sapiens
  misc_feature 1..96: note = chr16:51167714-51167810
  misc_feature 1..96: note = hyper
  source 1..96: mol_type = genomic DNA
atttcaataccaccacgaggcacctctagtgaggcgtagcggggcaagggtcggggagtaggtgaggagggggtgcgcgcccgtcagctgccttca

SEQ ID NO: 36142 - DNA, 45 bp, Homo sapiens; identical to SEQ ID NO: 12459
  misc_feature 1..45: note = chr16:51183963-51184008
  misc_feature 1..45: note = hyper
  source 1..45: mol_type = genomic DNA

SEQ ID NO: 36143 - DNA, 100 bp, Homo sapiens; identical to SEQ ID NO: 4348
  misc_feature 1..100: note = chr16:51184324-51184424
  misc_feature 1..100: note = hyper
  source 1..100: mol_type = genomic DNA

SEQ ID NO: 36144 - DNA, 263 bp, Homo sapiens
  misc_feature 1..263: note = chr16:51184695-51184958
  misc_feature 1..263: note = hyper
  source 1..263: mol_type = genomic DNA
gcggtcaggccggggcgacctccacccgcacccacgcctcatggggctcccgggtcttggccgcggctgggatccccggaaaagcagggacggagaagccaggccggcatgcccgccctccttcccccgggaggacccaacaactccggaaagatcctgccgggagatgtgctcgctttccccggggcagcgggggaaagcccagcaaaggcacattgaaaattaaaaagaaaaaaaaaattacgccgagtggaagaagcaat

SEQ ID NO: 36145 - DNA, 238 bp, Homo sapiens; identical to SEQ ID NO: 4350
  misc_feature 1..238: note = chr16:51185054-51185292
  misc_feature 1..238: note = hyper
  source 1..238: mol_type = genomic DNA

SEQ ID NO: 36146 - DNA, 423 bp, Homo sapiens; identical to SEQ ID NO: 4351
  misc_feature 1..423: note = chr16:51185542-51185965
  misc_feature 1..423: note = hyper
  source 1..423: mol_type = genomic DNA

SEQ ID NO: 36147 - DNA, 304 bp, Homo sapiens
  misc_feature 1..304: note = chr16:51186025-51186329
  misc_feature 1..304: note = hyper
  source 1..304: mol_type = genomic DNA
cgagttctccatcccctggatcccgggctcgcgggggcgcggagaagaggatccaggaaaggtttgggaacctgatgggtttgtggctggggggaggggcagttctcccgccaccccatcccctccccgccaggggcactgatcctccagcttcttgcttgctccctcgctccctttctctacctcggacattcccaggacaattagggctgaagttttcgggagaagcagccccgagcccgtgggataagggggcggcccggctccgcccaggacccctcccggacctcccccccggctgccc

SEQ ID NO: 36148 - DNA, 532 bp, Homo sapiens
  misc_feature 1..532: note = chr16:51186595-51187127
  misc_feature 1..532: note = hyper
  source 1..532: mol_type = genomic DNA
gggacgaggtggcggcgcagagccggaaagcggggtggggggagggcggtggggaggtgttctgtccgaggctgcctggcggcgccgaagctcgcctccactttttgggcacttgccgagcgcggcgcccgaacttttcgctctatcaccatctccctcaagctgagatgcaacctccctaccctcgccccagagcccagagccaggagcccgatccctctgccgggctcaggcgcccgcgaacctgagactcggtacgcggctcagcctagctctttcccctcgcgcctcggggtctcctcgctccaaggttctcgaagtcttgcgcccgaaggactaaactaaactaaacttcggctgagtaatgggggaggaggggggtgcagatacacaatccctgccctatctcacgatcaggaaaggagagggctcataaggacgccccaattcgcgagcgcccttgagtctggccggtgccacggtcggttcgcgcgaagtgggcaccggtctcccgagccgacttcgtgtactc

SEQ ID NO: 36149 - DNA, 134 bp, Homo sapiens
  misc_feature 1..134: note = chr16:51187416-51187550
  misc_feature 1..134: note = hyper
  source 1..134: mol_type = genomic DNA
tgataaaaagacaaacgaagctatcagtggggctgatgttgaagaatgaagataataatgtttccataggtggtgcttcaaatgccattatttctcactgaatatttaaagagatccctcggcaaagatggatc

SEQ ID NO: 36150 - DNA, 79 bp, Homo sapiens
  misc_feature 1..79: note = chr16:51189282-51189361
  misc_feature 1..79: note = hyper
  source 1..79: mol_type = genomic DNA
cggcgccccgggggcgggggacgaggcacatcgatggtatcaacattattgatggggaaaagttcggggcaggagcccg

SEQ ID NO: 36151 - DNA, 82 bp, Homo sapiens
  misc_feature 1..82: note = chr16:51189956-51190038
  misc_feature 1..82: note = hyper
  source 1..82: mol_type = genomic DNA
ctatctccagacgggcgccgggtgcagcgccgtgaccgggcgccctggcgccggctcgggcgcgaaattcagcggtggcaag

SEQ ID NO: 36152 - DNA, 94 bp, Homo sapiens
  misc_feature 1..94: note = chr16:51190121-51190215
  misc_feature 1..94: note = hyper
  source 1..94: mol_type = genomic DNA
cgcttggagggctgttcctacaccggtattaagaaaccgacttcgctagcgactgcaagtgcttgcgattttgactttccgtccacagttgagc

SEQ ID NO: 36153 - DNA, 49 bp, Homo sapiens
  misc_feature 1..49: note = chr16:54317177-54317226
  misc_feature 1..49: note = hyper
  source 1..49: mol_type = genomic DNA
accaccaaacagatccgtcgagggggcagacaggcgggttatagtcaaa

SEQ ID NO: 36154 - DNA, 80 bp, Homo sapiens
  misc_feature 1..80: note = chr16:54318670-54318750
  misc_feature 1..80: note = hyper
  source 1..80: mol_type = genomic DNA
cggtggagacccccccgcgccgggaggcgagcggcgcgggttgtccgggcttgtggcagtctccgcgagggaccagatct

SEQ ID NO: 36155 - DNA, 33 bp, Homo sapiens
  misc_feature 1..33: note = chr16:54318955-54318988
  misc_feature 1..33: note = hyper
  source 1..33: mol_type = genomic DNA
gtcgccatccctgcgcgccgccccagccaggga

SEQ ID NO: 36156 - DNA, 168 bp, Homo sapiens
  misc_feature 1..168: note = chr16:54319377-54319545
  misc_feature 1..168: note = hyper
  source 1..168: mol_type = genomic DNA
tgctctccctggtggcgttcttgggacgggacgggtccccgaactggtactggccatacgggtagaaggcggggtgcgggtgcggaaacgcggcagccgcggccggatgctgcaccccggggctgtccttcagctcatactgcgcgccctgtacgcacatggagaagg

SEQ ID NO: 36157 - DNA, 47 bp, Homo sapiens
  misc_feature 1..47: note = chr16:54320739-54320786
  misc_feature 1..47: note = hyper
  source 1..47: mol_type = genomic DNA
aaatctcgggtctgacgtcgcgccctcttattcgacttttccccgcg

SEQ ID NO: 36158 - DNA, 30 bp, Homo sapiens
  misc_feature 1..30: note = chr16:54321354-54321384
  misc_feature 1..30: note = hyper
  source 1..30: mol_type = genomic DNA
ggagccgccacaaatcggtgaagcaggccc

SEQ ID NO: 36159 - DNA, 165 bp, Homo sapiens
  misc_feature 1..165: note = chr16:54321654-54321819
  misc_feature 1..165: note = hyper
  source 1..165: mol_type = genomic DNA
gggcgcccaccttcacggattagggcgtgcagtcgatagcggcattgaaattcccagcattgccgcggctgggggctcagagctttaggccgcggcggcgacccacaagccggccaggcctgcagtgggcacgccccggagacaaaacgggggtggtgactctgc

SEQ ID NO: 36160 - DNA, 33 bp, Homo sapiens
  misc_feature 1..33: note = chr16:54325062-54325095
  misc_feature 1..33: note = hyper
  source 1..33: mol_type = genomic DNA
gtggatctgcctccccggcgccccctcctcatt

SEQ ID NO: 36161 - DNA, 259 bp, Homo sapiens
  misc_feature 1..259: note = chr16:54628691-54628950
  misc_feature 1..259: note = hyper
  source 1..259: mol_type = genomic DNA
gggagcagagttaatcgaataaactaatcttcgctgtggagattaactctcagtagctgcaggaaaccgggcaagggagaatgcaaatagcagagacctcaaggtgctggaggagttaggaatctcccctccctcactctaacgctgccgccgccgcaccccgccacctccccccctccccacccccgccgcccacccgccctcaggttttaaatttggaagatattgtggaaatggacaaactcgcctttgcctgctg

SEQ ID NO: 36162 - DNA, 34 bp, Homo sapiens
  misc_feature 1..34: note = chr16:54962651-54962685
  misc_feature 1..34: note = hyper
  source 1..34: mol_type = genomic DNA
ccagagggcctggcccgggcgggggctcacctct

SEQ ID NO: 36163 - DNA, 33 bp, Homo sapiens
  misc_feature 1..33: note = chr16:54963623-54963656
  misc_feature 1..33: note = hyper
  source 1..33: mol_type = genomic DNA
ttctaactgtgtggccgtcgtgggcaagggctc

SEQ ID NO: 36164 - DNA, 44 bp, Homo sapiens
  misc_feature 1..44: note = chr16:54964141-54964185
  misc_feature 1..44: note = hyper
  source 1..44: mol_type = genomic DNA
ttcctgcgccctgggcgcgggccatccatcggctctcccagaga

SEQ ID NO: 36165 - DNA, 117 bp, Homo sapiens
  misc_feature 1..117: note = chr16:54965018-54965135
  misc_feature 1..117: note = hyper
  source 1..117: mol_type = genomic DNA
cagaggccaggtgcccgcccgctcgccctcgcagggcgccgcccggctcgttggcggccgcggcgcggcgcgccccatgcccgtgtgtggccatgtcctatccgcagggctacttgt

SEQ ID NO: 36166 - DNA, 59 bp, Homo sapiens
  misc_feature 1..59: note = chr16:54966792-54966851
  misc_feature 1..59: note = hyper
  source 1..59: mol_type = genomic DNA
cgaccccgagggccccgaagcaggttggtggacatgggaaagggcgtgttgggcgggag

SEQ ID NO: 36167 - DNA, 140 bp, Homo sapiens
  misc_feature 1..140: note = chr16:54967122-54967262
  misc_feature 1..140: note = hyper
  source 1..140: mol_type = genomic DNA
ctgcagggccccccccgcaccggcgggccctccccggctgggccagcggcggcgcggctggcggaggacccggcccctcactaccccgccggagcgccggcgcccggcccgcatccagccgcgggcgaggtgcctccggg

SEQ ID NO: 36168 - DNA, 95 bp, Homo sapiens
  misc_feature 1..95: note = chr16:54971471-54971566
  misc_feature 1..95: note = hyper
  source 1..95: mol_type = genomic DNA
cccctgggagccatgcgattcgaagggagggggacctagaggagacccccgctatccccccacccaccgtggggccttagctttgaactccggcc

SEQ ID NO: 36169 - DNA, 46 bp, Homo sapiens
  misc_feature 1..46: note = chr16:54972930-54972976
  misc_feature 1..46: note = hyper
  source 1..46: mol_type = genomic DNA
gggaaagtgagaaggcgtggtgttggcattgcgcttgcaaataccc

SEQ ID NO: 36170 - DNA, 184 bp, Homo sapiens
  misc_feature 1..184: note = chr16:55090677-55090861
  misc_feature 1..184: note = hyper
  source 1..184: mol_type = genomic DNA
ttcccgcgccccaagcgccgaagccccagaactgccgccggccgggcccatccccagcccaggctcgtaatcaaaaggcagatttccgcgccgggcacctgtttgcagggctgcgcctccttccgctgcggtgttttatctcggcgcggcggtgaataattcatggccccgggtctgctttgca

SEQ ID NO: 36171 - DNA, 129 bp, Homo sapiens
  misc_feature 1..129: note = chr16:55357444-55357573
  misc_feature 1..129: note = hyper
  source 1..129: mol_type = genomic DNA
ctcccccacccctgccgccgcccacccatcagtgcccctttgaagacccctgggatggagtgagggggtggtcagaccgctgggcccagccgggcgtccaggaggagcgcagggaatgggccgccctcc

SEQ ID NO: 36172 - DNA, 330 bp, Homo sapiens
  misc_feature 1..330: note = chr16:55357611-55357941
  misc_feature 1..330: note = hyper
  source 1..330: mol_type = genomic DNA
cggagcgcaggggctgcagcccggaccgggagccttcttcaggctccctggctgccccgcggccactgcgggaggcgcgcgcgcgaggcagccaagccttgccttcggaggagatgcccagggatcttagcaagcagcctgcggctgccagggatcggacctggcgagtttcccgacggaatctgagggatcccgaacctcggcctcgagggggcgctatccggcctactcgaggaccaggcagctgcagagaagctccaaggtcaaggccctgggccaggccagggcttggagagccggaatctagcccgagtcctggggaggctgagg

SEQ ID NO: 36173 - DNA, 360 bp, Homo sapiens; identical to SEQ ID NO: 12479
  misc_feature 1..360: note = chr16:55357991-55358351
  misc_feature 1..360: note = hyper
  source 1..360: mol_type = genomic DNA

SEQ ID NO: 36174 - DNA, 110 bp, Homo sapiens
  misc_feature 1..110: note = chr16:55358566-55358676
  misc_feature 1..110: note = hyper
  source 1..110: mol_type = genomic DNA
gcttggcacgcttggtggcccagggtcccggggcccggggtcccgtctggcggcccgggattaccgtgacgtcacattgagcctctggccaccttggactgggacacctc

SEQ ID NO: 36175 - DNA, 341 bp, Homo sapiens
  misc_feature 1..341: note = chr16:55358784-55359125
  misc_feature 1..341: note = hyper
  source 1..341: mol_type = genomic DNA
cggaccccacgggccggaggggcgccttccggagcgcagggctcggcagccgggctgccctcggctctgcctccactggggccaaccaggcgaaggaaccggcgctgggcatccgcagcggtgtaaggaactgagacacctcactgctgggggcgcggaacagctgggctgagacgggaactcgacagggaagagagagacgggccagggacagccaccatgtccttcccacactttggacacccgtaccgcggcgcttcccaggtaagaggcgcctctatgggggataggggacagactgggtggagggagtgcctagtgcacggcgcctgcctctgatc

SEQ ID NO: 36176 - DNA, 274 bp, Homo sapiens
  misc_feature 1..274: note = chr16:55362982-55363256
  misc_feature 1..274: note = hyper
  source 1..274: mol_type = genomic DNA
ggtgcacccccagcccggcctaggccacgaagtcctgagtgccgtatgattcctggacagcctcctgcctctgcccggcgactctcagtccccagagactccgcgtgcgacgagtcttcctgcatacccaaagcctttggaaaccccaagtttgccctgcagggactaccgctgaactgtgcgccgtgcccgcggaggagcgagcctgtagtgcagtgccagtacccgtctggagcagaaggtagtgggcccccagcggcgctgggagtatcta

SEQ ID NO: 36177 - DNA, 503 bp, Homo sapiens
  misc_feature 1..503: note = chr16:55364716-55365219
  misc_feature 1..503: note = hyper
  source 1..503: mol_type = genomic DNA
ggcaaagatgcattgcggccagggattcttgcgacagcgcggcgtgggctgcatacctcagttcctttagtagctgggaaagaaactgacaaggtaacagacaaggccgtggcgcctgcagctcagcggactaaccgctgcgtaaccaatccgtggagccaagctgaccacctcgcgggtcctgcgcatgggaagtggtgggacttgtcaggatgtttatctggaaactgcatctgtttccgggttcgtatttgggttgtaagtttactgggggaggggtgacgaggaccgcgctcctccgatcgaactgaacctaatggggaggtcaggcagctttcagggtcggtgtgaggcgagagggggcattcttcccgttttatcaaaagtgtcagcaaacacttccggtacaggccaaccaatgggaactgacgggcagggaaggggtctttgtcccccttgctaggagtgtcgagcgaccgggttgggggtaagagatttaaaga

SEQ ID NO: 36178 - DNA, 27 bp, Homo sapiens
  misc_feature 1..27: note = chr16:55365434-55365461
  misc_feature 1..27: note = hyper
  source 1..27: mol_type = genomic DNA
cgtttccaacgccgggtcccggccagg

SEQ ID NO: 36179 - DNA, 228 bp, Homo sapiens
  misc_feature 1..228: note = chr16:55404972-55405200
  misc_feature 1..228: note = hyper
  source 1..228: mol_type = genomic DNA
tctttgagcatcaaacgtgtcctccttccctctacctacttcggctccggtttctctcccgaagcctaaataaagaaggtaacagacaacacctctattggcagaggcttctgccttttccgtcaggctggctgcagcacatccgtaatccttatgtcagcctgcactctagcgttgccggcccggtccagcatctgacagccgcgaatccaaagctgccggcctctc

SEQ ID NO: 36180 - DNA, 13 bp, Homo sapiens
  misc_feature 1..13: note = chr16:55405201-55405214
  misc_feature 1..13: note = hyper
  source 1..13: mol_type = genomic DNA
tttctaagcagca

SEQ ID NO: 36181 - DNA, 19 bp, Homo sapiens
  misc_feature 1..19: note = chr16:55512935-55512954
  misc_feature 1..19: note = hyper
  source 1..19: mol_type = genomic DNA
cggccggggaaaagaggtg

SEQ ID NO: 36182 - DNA, 138 bp, Homo sapiens; identical to SEQ ID NO: 12486
  misc_feature 1..138: note = chr16:55513226-55513364
  misc_feature 1..138: note = hyper
  source 1..138: mol_type = genomic DNA

SEQ ID NO: 36183 - DNA, 57 bp, Homo sapiens
  misc_feature 1..57: note = chr16:55513482-55513539
  misc_feature 1..57: note = hyper
  source 1..57: mol_type = genomic DNA
cgtcgcccatcatcaagttccccggcgatgtcgcccccaaaacggacaaagagttgg

SEQ ID NO: 36184 - DNA, 251 bp, Homo sapiens
  misc_feature 1..251: note = chr16:55514076-55514327
  misc_feature 1..251: note = hyper
  source 1..251: mol_type = genomic DNA
ggagcttggtcaaagcggggcttggcaaatttctaggaaccttcggcacagatccggagagggacctttaaacaaacagctcgagggggccatttgggaagtgattggggcaggagggaagcagagagcgcatcttttttctcctggcttaatggacaaattggtcaagggctgggcctcggaaagtttcctcgaacttctccaaagggtcggagaaaagaaggagagagctggcccggcaggagggagga

SEQ ID NO: 36185 - DNA, 462 bp, Homo sapiens
  misc_feature 1..462: note = chr16:55689918-55690380
  misc_feature 1..462: note = hyper
  source 1..462: mol_type = genomic DNA
ccgcgccctgccggccgccccgcgcctccagctcttccccggccccgcccgaacgccacacggcggagcccagccccagcccgcgccctagagcctgccaaggcgccgccggtcgggggccggcagggcgcaaggcaccagggatcccctcgccgccggacacgtgagtgcgccctgagcgcgggacagggctaggtctgcctgggaggcccgggccgagacgcgccagcagagggctagcgagtttgtagtgcagtgacgttaagtgtccgagaaggctcctgtggctgttgaagtgtcgcggacctgagctggggagggggtcggcacgctgccctcagcctcggtgagttcaatcccagccatttggggcaggcgagagtgggtgaacgaggaaaagtgctgcagggtcttcagccgcccccagagggctgtcagaagtctccaactcttgagttccgg

SEQ ID NO: 36186 - DNA, 124 bp, Homo sapiens; identical to SEQ ID NO: 12490
  misc_feature 1..124: note = chr16:55690453-55690577
  misc_feature 1..124: note = hyper
  source 1..124: mol_type = genomic DNA

SEQ ID NO: 36187 - DNA, 25 bp, Homo sapiens
  misc_feature 1..25: note = chr16:55690761-55690786
  misc_feature 1..25: note = hyper
  source 1..25: mol_type = genomic DNA
cgcgcagccccgggagacctggggc

SEQ ID NO: 36188 - DNA, 265 bp, Homo sapiens
  misc_feature 1..265: note = chr16:56224517-56224782
  misc_feature 1..265: note = hyper
  source 1..265: mol_type = genomic DNA
cctgtccctccactccgggcaccctggcctccccagggtgggcacccctcctgcacggagagcggcggctgggatctcggagcagggtcggctatggccctggaggcagcggctcacagagaaaaagctctggcttttctccgcccgctgcgttcctcttcttacagcctcgggtgtcacatattaggtgctcaataaatgtggacataggaaacgaaaagtccgaatctgtccttacgcccccaaggcgaattctggggcgcgc

SEQ ID NO: 36189 - DNA, 10 bp, Homo sapiens
  misc_feature 1..10: note = chr16:56224783-56224793
  misc_feature 1..10: note = hyper
  source 1..10: mol_type = genomic DNA
ggtttattcc

SEQ ID NO: 36190 - DNA, 39 bp, Homo sapiens; identical to SEQ ID NO: 4358
  misc_feature 1..39: note = chr16:56224794-56224833
  misc_feature 1..39: note = hyper
  source 1..39: mol_type = genomic DNA

SEQ ID NO: 36191 - DNA, 113 bp, Homo sapiens
  misc_feature 1..113: note = chr16:56224880-56224993
  misc_feature 1..113: note = hyper
  source 1..113: mol_type = genomic DNA
cgggcgacaagatggagagccggcccgagagggacagaggccgcgctggcagcgagctggggggcccacctgaccgtcctgcgggcagcccggccccgcgctcccattgacaa

SEQ ID NO: 36192 - DNA, 490 bp, Homo sapiens
  misc_feature 1..490: note = chr16:56225199-56225689
  misc_feature 1..490: note = hyper
  source 1..490: mol_type = genomic DNA
gcctcccccgccccgcgccctccccgtcccgggggcccggcgcgcggccctgctgacgtcagctggcggcccgcggagccgggtgcgcagagccgctggcgcactcgcgcgctgcgctggcctcctccccgccccgggcccaggcgcgcgcgcgcttgttcgctctcccattttttttttcccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgcgccgccgccgccgcctcctccacctc

SEQ ID NO: 36193 - DNA, 45 bp, Homo sapiens
  misc_feature 1..45: note = chr16:56226280-56226325
  misc_feature 1..45: note = hyper
  source 1..45: mol_type = genomic DNA
gctacccccatcccccgaccccggccactccgcaccccctgccac

SEQ ID NO: 36194 - DNA, 48 bp, Homo sapiens
  misc_feature 1..48: note = chr16:56228369-56228417
  misc_feature 1..48: note = hyper
  source 1..48: mol_type = genomic DNA
ggatgaggtttcaggcgttgcaagtggtggacagcgcccagccgaggc

SEQ ID NO: 36195 - DNA, 14 bp, Homo sapiens
  misc_feature 1..14: note = chr16:56228577-56228591
  misc_feature 1..14: note = hyper
  source 1..14: mol_type = genomic DNA
gggggaggggagtg

SEQ ID NO: 36196 - DNA, 215 bp, Homo sapiens
  misc_feature 1..215: note = chr16:56623169-56623384
  misc_feature 1..215: note = hyper
  source 1..215: mol_type = genomic DNA
agtgggctggcagtgcgcgcacagcggcggcgagtgggtcgtgcacgcggatgcggggtgggagtgggggcgcacgcgcgggcgtgggcgagcgggccccggcagtgcacacacacggcaggggcgggcgacagatgcagtgcgtgcgccggagcccaagcgcacaaacggaaagagcgggcgcggtgcgcaggggcgggcgcccagcgggcttg

SEQ ID NO: 36197 - DNA, 202 bp, Homo sapiens
  misc_feature 1..202: note = chr16:56623667-56623869
  misc_feature 1..202: note = hyper
  source 1..202: mol_type = genomic DNA
cgggcatgcctgtgtcgcggagaacagggagacttggcaccccatctcctcgtgacaggcgtggggacccgagttcgtccacattaacccttcctgtggcgtcgccctctctaggtggctcctgcacctgcgcggactcctgcaagtgcgagggatgcaaatgcacctcctgcaagaagagtgagtgcggggacccttcccc

SEQ ID NO: 36198 - DNA, 84 bp, Homo sapiens; identical to SEQ ID NO: 12499
  misc_feature 1..84: note = chr16:56651238-56651322
  misc_feature 1..84: note = hyper
  source 1..84: mol_type = genomic DNA

SEQ ID NO: 36199 - DNA, 646 bp, Homo sapiens
  misc_feature 1..646: note = chr16:56659128-56659774
  misc_feature 1..646: note = hyper
  source 1..646: mol_type = genomic DNA
ctatgtaaggaggtgcgggaccgaggaacctaggtgtggacagggacaggcaaggcgggggacgaagagaaatgaaagccacatcggtggcggatgttctgaacacaactcgctcgctaccgcacgttccccgctccgcactcagcggatcccgggacggcagcaggtgggctgcacacggactctgggacaagtcgagctgaaaaccgcggagctaggggtggggtggagacgcccgcgacgccaaggctggggtcccggaacacgctgggaggagggtggaaggcaacctcggggaaactgggaaaggcggcctggacttcgggaacaccgcgtacctgcgggggcacagccccacccgagcgaacgggctccaaaggggaggtcccgcggtgcccaccgcgcagagctcagggggtggtgcgcccggcccttctgcggcgcacagcccagcccaggaacgcgggcggtgcggactcagcgggccgggtgcaggcgcggagctgggcctctgcgcccggcccgacctccgtctataaatagagcagccagttgcagggctccattctgctttccaactgcctgactgcttgttcgtctcactggtgtgagctccagcatcccctttgctcgaaatggaccccaa

SEQ ID NO: 36200 - DNA, 549 bp, Homo sapiens
  misc_feature 1..549: note = chr16:56665957-56666506
  misc_feature 1..549: note = hyper
  source 1..549: mol_type = genomic DNA
acgggagagagaggccgaccagtgttccccgtgttgctgtgtacggaggagccagtccgagggaccgcggtgtggacagggacaggcaaggcggggaaggaggagaaacgaaagccacattggtggcgggtgctctgcacacgactcgctccctaccacacgccccccgctccgcacacgaccgatccggggactggagcaggagggctgcaccgggactccgggacaggcccagttgaaaacggcggggcgagggggtggggtggagacgcccgcgacgccaaggctggggtcccggaaagcgcggggaggagggtggaaggcaaaggcaacttcggggaaactgggaaaggcggccgggacctcggggacactgcgtaccacccggcgcacagcccctcccgcgcaaacccgagccaaaggggcggtcgagcggcgcactcggagcggagctcaggggatggtgcgcccggcacttatgctgggctcagcccagcccagcccaggaccgctggcggtgcgaacccagccgggcgggtgcaagcgcgg

SEQ ID NO: 36201 - DNA, 15 bp, Homo sapiens
  misc_feature 1..15: note = chr16:56672158-56672173
  misc_feature 1..15: note = hyper
  source 1..15: mol_type = genomic DNA
gctgcactcagactt

SEQ ID NO: 36202 - DNA, 165 bp, Homo sapiens
  misc_feature 1..165: note = chr16:56672221-56672386
  misc_feature 1..165: note = hyper
  source 1..165: mol_type = genomic DNA
cgaaacgccaaggctgggttcccggaacgcgcggggactagggtggaaggcaacttcggggaaactgggaaaggcgaccgggacctcggggacgccccgtaccccgggcgtaaactcactcccgcgttagcggccccaaagcggggagggggtggtcccgtggtc

SEQ ID NO: 36203 - DNA, 61 bp, Homo sapiens
  misc_feature 1..61: note = chr16:56672513-56672574
  misc_feature 1..61: note = hyper
  source 1..61: mol_type = genomic DNA
cgggtcctttgcgtccggccctctttcccctgaccataaaagcagccgctggctgctgggc

SEQ ID NO: 36204 - DNA, 374 bp, Homo sapiens
  misc_feature 1..374: note = chr16:56677138-56677512
  misc_feature 1..374: note = hyper
  source 1..374: mol_type = genomic DNA
ggtcttatctggggacgtgagcactaggctggggtagcacatggactcccacagagccgaagctcacgtcactggtgcggggtgcgggggtggggataccgcgaccacctgaggctgggttcccggaccgcccaagggcaggaatggagtgcaatctccgggaaattcgggagggccgggattatagcagggacgccgcgtaccgccaggagcacagcccctccaaagcgagcgtgagccaaagggccgcccccagggtgcgcaacagccacgttaaggaggatcctgcgcccggcccgcctggtgcgcacagccccgccctgaaccctgggcagcgctgacactgagctgggctggtgcgagacctggggcgg

SEQ ID NO: 36205 - DNA, 52 bp, Homo sapiens
  misc_feature 1..52: note = chr16:56701956-56702008
  misc_feature 1..52: note = hyper
  source 1..52: mol_type = genomic DNA
ggtgcacgtggaaggcggagtggagcccaacagccagcggctgtttttatag

SEQ ID NO: 36206 - DNA, 79 bp, Homo sapiens
  misc_feature 1..79: note = chr16:56709814-56709893
  misc_feature 1..79: note = hyper
  source 1..79: mol_type = genomic DNA
cagcatagcccctcccgcacgagcgggccccaaaagggcggtccccgggagcccaccaggctgcactcaggggatggtg

SEQ ID NO: 36207 - DNA, 100 bp, Homo sapiens; identical to SEQ ID NO: 12506
  misc_feature 1..100: note = chr16:56709949-56710049
  misc_feature 1..100: note = hyper
  source 1..100: mol_type = genomic DNA

SEQ ID NO: 36208 - DNA, 919 bp, Homo sapiens
  misc_feature 1..919: note = chr16:58018565-58019484
  misc_feature 1..919: note = hyper
  source 1..919: mol_type = genomic DNA
tcgcaacaggtaccacgagggaaagctggcgcccatcgcgccaggcatcaaccgagtggactggccctgcttcacgcgcgccatcgaggactggtcccacttcgtgtcctcggccggggagttcaagctgccttgcctgaggaagcgaggtcagtctacgggccgctgaaggaactgccgggcaggtgggccgcggggctggagcagggaacgtggactgcggacgggaacgcaggcggcgggccaggcagaaacagggcggggccgctgagatgaagctgtggcacttgcggtgggtggagccgagacgtgcgcgcggatctggaggcaggactgcccttggggagggggcggagccaggcggagccttcgggccgggggctttgccctggtggggcagcggaggcgggacctgttctccgtacacgtgtgggtggggctggattgtgggcggggctggattgtgggcggggcttagatgaggaggcggggcttgtcctgggggggggcggatgagcgctcgagaggggctttctgttcgcagcggagggtctcagcggctacgcggtgcggtacttgaagcccgacgtgacccagacctggcgggtagggagcgctgcgcgcagacccgtccctgagcggggagcgggggtcctggtggggagcggcttaagccgggggttgaggggggaggagacccagagcagggcctcccagtcttcaggaccacggtctctagcaggaagccctgtgtggggcgtgggcagggcgtccgtgctcccccgactcaccgcgcccctatccctgctgcccgcctcagtactgcctcagccagaaccccagcctggaccgctacggacagaagcccctgcctttcgactccctgtaagtgacgccacgcgcccggggaccccatatc

SEQ ID NO: 36209 - DNA, 122 bp, Homo sapiens; identical to SEQ ID NO: 12509
  misc_feature 1..122: note = chr16:58497214-58497336
  misc_feature 1..122: note = hyper
  source 1..122: mol_type = genomic DNA

SEQ ID NO: 36210 - DNA, 1116 bp, Homo sapiens
  misc_feature 1..1116: note = chr16:58497469-58498585
  misc_feature 1..1116: note = hyper
  source 1..1116: mol_type = genomic DNA
cgcggtccgtccgggactagccccaggcccggcaccgccccgcgggccgagcgcccacacccgccaaacccacgcgggcacgcccccgcggcgcaccgcccccagcccggcctccgcccctgcagccgcgggcacgcggaggggctcctggctgcccgcacctgcacccgcgcgtcggcggcgccgaagccccgctccccgcctgcgcgtctgtctcgtccgcatctccgcggtgagtcggcggcgccctcgcccctgagcccagggccagcttctctcgccgccgcggctgctgcgcgcgtccccgcccagcccagcccagccccgagcacgaccccagccccacgcacgaccctagccccgcgagtcccgcaccgactcgctcccgccccatttcgcctccgcgggggcggcgccccctcctccccgcggctcccgctctccttcctcgccttcccggccgcgctggggacccccagccgccgtccgcgaccccccaccgcgacgcccggaggcggcggggtctctttgttcgggcggcgggcacgggggaccacctcccacggtgtcaccgcacccaccccgcgcccttcctccgcctcctggagttcaccgggaccaggtggcggcgggtgcctttttgggggtgcgcggccatgcaattggtggatttttttaaaccgttttggaggggggagcgcggcgttgggggcgggagagcgctcctggctgtgagctgctcctgccgcttcgctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggtaccgcccgcctgccccgcagccggccgccactttccgagttggagcggactccgggcgcggcggccggggactggggcggctcgggtctgagcaggaaggggtgcggaccccaactaagtcctagttttgtgctacctgtttgtgtgcggagcccagccccgggagaggacttgaggttgtggcgagtccctggcgctggcgtccgggctgc

SEQ ID NO: 36211 - DNA, 64 bp, Homo sapiens; identical to SEQ ID NO: 12512
  misc_feature 1..64: note = chr16:58498586-58498650
  misc_feature 1..64: note = hyper
  source 1..64: mol_type = genomic DNA

SEQ ID NO: 36212 - DNA, 30 bp, Homo sapiens
  misc_feature 1..30: note = chr16:58499185-58499215
  misc_feature 1..30: note = hyper
  source 1..30: mol_type = genomic DNA
caggaccttaatgtccgatgagggagcaga

SEQ ID NO: 36213 - DNA, 85 bp, Homo sapiens
  misc_feature 1..85: note = chr16:62068463-62068548
  misc_feature 1..85: note = hyper
  source 1..85: mol_type = genomic DNA
agaggacagtactctcgcttaccttccctagcgtcccctcgttcccattgtcagcccccagatatcatgacgccaggtgaaagaa

SEQ ID NO: 36214 - DNA, 75 bp, Homo sapiens
  misc_feature 1..75: note = chr16:62069009-62069084
  misc_feature 1..75: note = hyper
  source 1..75: mol_type = genomic DNA
agcacgtttttttaccgtttcccagccttggctggatcctgggagaaccggagtaggtcccttatgaacctctta

SEQ ID NO: 36215 - DNA, 138 bp, Homo sapiens; identical to SEQ ID NO: 12513
  misc_feature 1..138: note = chr16:62069136-62069274
  misc_feature 1..138: note = hyper
  source 1..138: mol_type = genomic DNA

SEQ ID NO: 36216 - DNA, 35 bp, Homo sapiens; identical to SEQ ID NO: 12514
  misc_feature 1..35: note = chr16:62069336-62069371
  misc_feature 1..35: note = hyper
  source 1..35: mol_type = genomic DNA

SEQ ID NO: 36217 - DNA, 43 bp, Homo sapiens
  misc_feature 1..43: note = chr16:62070743-62070786
  misc_feature 1..43: note = hyper
  source 1..43: mol_type = genomic DNA
agcgtctcagtgacccgcagctattttccgtaggaggaagagg

SEQ ID NO: 36218 - DNA, 232 bp, Homo sapiens
  misc_feature 1..232: note = chr16:65154985-65155217
  misc_feature 1..232: note = hyper
  source 1..232: mol_type = genomic DNA
ggttctcaaagttaacgttgaccctggcagctttcgccaatcccaagccagaggcgagcccgagtctgggccgctcatggacctactcctgcgctggtgggagcttacaaacgggcgccagagctcccgcagagactcgggctggagggctgtagcgcaccgcagcctgctgccccagaaccacagtcggcggccccaaacccacgctattaaagtgcgggcaatctccttc

SEQ ID NO: 36219 - DNA, 925 bp, Homo sapiens
  misc_feature 1..925: note = chr16:65155737-65156662
  misc_feature 1..925: note = hyper
  source 1..925: mol_type = genomic DNA
gaagccccaaccaggcgagaggaagggactggcggcgcacctcacctggggcccttgagggtggacgcaacctccgagccgccagtccctggcgcagggcaagcgctgcggtgtcagtcccggccccagtcccggtcccattcacaagtcagcggcggctgcgagcggcccccgcggcatctgctcctcggcccgcgacgctcccctcagctggcggcggccgcggaatgagccgccgagcgcgctagtggcaggaatgagaaaccggggggaggtggcgggcgggcaggcgggtgcggggcggggggggcgggaggagggaggctgccgctgtgagggaaggaaagggcgggggctgagagaagccgaggctgcgagaggcagcgagatgggcctcgcagaggctgcgggggccgaccccgtccgcgcccctccccccaggggcccagagatgctaacccctggattcgtggccgcccctcccgccccgtggcgcggcgctccgactccctcagggctcagatggagtctggagcgactgaagttgggctccagggacgcacagccaatcagggagggcggcggagggaagctggagaggggttgggagcccccattttcctccttcccccaaatccgctccagctggccaggctgggctctcgcctggcgggccgggatggtggttgggggaaggtatcgtccaagtgagggaagcaattgggaattcgggagcgcgttctattctttctcactccaccaccccaccttccaaaaatccctcaacgttggcggctcctgcccagcccccacccctctcaatctcccatcccttgcaaactcttctggtggctctggtggtgaagtcgggcggggagggagacttaggacttgggaagagcccagtctccgttctctctcagct

SEQ ID NO: 36220 - DNA, 23 bp, Homo sapiens
  misc_feature 1..23: note = chr16:65156872-65156895
  misc_feature 1..23: note = hyper
  source 1..23: mol_type = genomic DNA
aagggcctaatggggcgcagcgc

SEQ ID NO: 36221 - DNA, 347 bp, Homo sapiens
  misc_feature 1..347: note = chr16:65156939-65157286
  misc_feature 1..347: note = hyper
  source 1..347: mol_type = genomic DNA
cgctaccgtgagggttccccgggcctgcttcctgccctccctccccgagtcgccgggagaaagggctggcagggccggggcttaggaatcacgccaaggactgggcggggcgctcgcggtaccgggaacggcgtggggatccgcacacccagcagggaacaaccatgcctgtgtggggacccctggcttgaacaagtttgcagggtgggaggtggaggcaagagaggaggcggaggaaggtggagacgccagtgggtgaaggctaaaaaggaaccgcctagggggacggggatgaggctgggaaaggagaagagatggacccgcgaaaaagacggggaaggaggctg

SEQ ID NO: 36222 - DNA, 15 bp, Homo sapiens
  misc_feature 1..15: note = chr16:65157823-65157838
  misc_feature 1..15: note = hyper
  source 1..15: mol_type = genomic DNA
gtaaccccccaacct

SEQ ID NO: 36223 - DNA, 15 bp, Homo sapiens
  misc_feature 1..15: note = chr16:65157863-65157878
  misc_feature 1..15: note = hyper
  source 1..15: mol_type = genomic DNA
cgcgaggacattgac

SEQ ID NO: 36224 - DNA, 478 bp, Homo sapiens
  misc_feature 1..478: note = chr16:66461511-66461989
  misc_feature 1..478: note = hyper
  source 1..478: mol_type = genomic DNA
cggagcgggatcccgggtctcccgcggaccctcgaccccgggctggccactgggatctgcgcgagccgaggctgaccctgatcgcgccctcgggcctcggggaaggggaggtatccaggttttctgcctgactcgagtccccgacgagcatcaaccgcatttggggaacccaagacagcctccccagcagcttgccctcggtttcggggacccctgaacaacccaaccaagaagggaaaactagggcgcactctcggtcggggtgggagaggaaaggggctggggcttcacggagtttggagtttgaacccacccgcacccctttgagctaggaagtttgacccttcgacgagcaggtcgcctggggtatgcccctgtctccgtgcctctgtctcagcaccgagcgtcggagagagagcgcgccctccgcaccttctcccactttgggacagactttcccttgcgctgtcagagggac

SEQ ID NO: 36225 - DNA, 362 bp, Homo sapiens
  misc_feature 1..362: note = chr16:66612734-66613096
  misc_feature 1..362: note = hyper
  source 1..362: mol_type = genomic DNA
ccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaacacctgcttcctctcgttgccttgtgtgaaagtcgcgttgtattttcctgcgcttggc

SEQ ID NO: 36226 - DNA, 175 bp, Homo sapiens
  misc_feature 1..175: note = chr16:66638277-66638452
  misc_feature 1..175: note = hyper
  source 1..175: mol_type = genomic DNA
tctttgctgtttagacgcctgggttcccggatcccagacacgcgcacgggcaggaagttagaccggagacagcgagtatagacagcccttctggataggggcagacgggtgggagctccgaaggggtgccggggcggtgatcgggaggtctccagcggcccgaaccagggtgaag

SEQ ID NO: 36227 - DNA, 85 bp, Homo sapiens
  misc_feature 1..85: note = chr16:66878235-66878320
  misc_feature 1..85: note = hyper
  source 1..85: mol_type = genomic DNA
ctggggggtggggggcgggtcccccgggaactgctcctcccgccagccgctgctttaagaggctgctccgcggtagcgagcgggg

SEQ ID NO: 36228 - DNA, 106 bp, Homo sapiens; identical to SEQ ID NO: 12525
  misc_feature 1..106: note = chr16:66878819-66878925
  misc_feature 1..106: note = hyper
  source 1..106: mol_type = genomic DNA

SEQ ID NO: 36229 - DNA, 39 bp, Homo sapiens
  misc_feature 1..39: note = chr16:66958838-66958877
  misc_feature 1..39: note = hyper
  source 1..39: mol_type = genomic DNA
agctgagcgagtcctcggagtcctcgggccagtccagcc

SEQ ID NO: 36230 - DNA, 178 bp, Homo sapiens
  misc_feature 1..178: note = chr16:67184208-67184386
  misc_feature 1..178: note = hyper
  source 1..178: mol_type = genomic DNA
gtcgggtaactggaacgcgcggggtccgggggtgggcctcggtgccgccctccctcgccctcgcggcgcgctcgccgtcggggccgcgccgtcgcgctgcgcatagagtaagaggcccagggaggcgccaaggagcagcgtgagcaatgcgtccctgcgtaggcgcagcctcctcctc

SEQ ID NO: 36231 - DNA, 68 bp, Homo sapiens
  misc_feature 1..68: note = chr16:67189168-67189236
  misc_feature 1..68: note = hyper
  source 1..68: mol_type = genomic DNA
gccagttcttcatcccggagccggtcgggctaggggaatggaacgtgccgtcacgggggacttaaccg

SEQ ID NO: 36232 - DNA, 665 bp, Homo sapiens
  misc_feature 1..665: note = chr16:67197617-67198282
  misc_feature 1..665: note = hyper
  source 1..665: mol_type = genomic DNA
ccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacgtaagcgctctgagagggaacggggggggtgtccaggcgcgccccgagtgctagtgccttcttttgggattgttgccccccgggtctttaccgagttgggaactgtgatggcatcgggaccagtcctgggcgccctgagaccactcgctgctctcaccctctgcagacgccccacccgctcggtcctggacacactgcccccctctcttgcctccacccctctgcggactctgcagctccgcggccccggcgcagggagagggagggcacgggcgcgggccgggcctcaagggtgagtgtgaaataaacaaatcctgcagtgtttctgcgtcctattaaaggcggggtcggatctgaaagggaaggacagggaacgcgcggggtaccggaggagccatcccggcagaggttgggtttcctcaagagcctctggacgacacagctgcggggggtcagggtcggggcactcacacccttggaatgactacgtcccggggttcggcgggagggggcgtgcttccctgccc

SEQ ID NO: 36233 - DNA, 400 bp, Homo sapiens
  misc_feature 1..400: note = chr16:67198557-67198957
  misc_feature 1..400: note = hyper
  source 1..400: mol_type = genomic DNA
gtccgagccccgccccgcgggcttgcacgtggcccccgcctgacccggcgccccggggcggagtagggcggagcgggcggcaaacgcagcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccggtgagggccggggcccctcgattccccctgtggtcccggggtccctccacgtcagtgaacacccatgcccgcccaaccccctcctgagactgggccgtggatccccggatttggccattc

SEQ ID NO: 36234 - DNA, 146 bp, Homo sapiens
  misc_feature 1..146: note = chr16:67199375-67199521
  misc_feature 1..146: note = hyper
  source 1..146: mol_type = genomic DNA
caccctcctggtctccgcccgcacggtgggcgggcggcgttcttggtagagcgggaccagtttcctcgtaagcgaccagagccgtttcgccaaggaagtgctgccccagtatttcaagcatagcaacatggcgagcttcgtgcgcc

SEQ ID NO: 36235 - DNA, 44 bp, Homo sapiens
  misc_feature 1..44: note = chr16:67360535-67360579
  misc_feature 1..44: note = hyper
  source 1..44: mol_type = genomic DNA
aatccttggccacagcggcccccattcgccgctttggtgctttt

SEQ ID NO: 36236 - DNA, 30 bp, Homo sapiens
  misc_feature 1..30: note = chr16:67427344-67427374
  misc_feature 1..30: note = hyper
  source 1..30: mol_type = genomic DNA
acgcgggagaccaggcggctccgcagctcc

SEQ ID NO: 36237 - DNA, 40 bp, Homo sapiens
  misc_feature 1..40: note = chr16:67433365-67433405
  misc_feature 1..40: note = hyper
  source 1..40: mol_type = genomic DNA
ggagagggggcacagcgcgattggccggctcattccccgc

SEQ ID NO: 36238 - DNA, 30 bp, Homo sapiens
  misc_feature 1..30: note = chr16:67572408-67572438
  misc_feature 1..30: note = hyper
  source 1..30: mol_type = genomic DNA
ccagtccttcgcaggcgtcctcggcagcca

SEQ ID NO: 36239 - DNA, 63 bp, Homo sapiens
  misc_feature 1..63: note = chr16:67679073-67679136
  misc_feature 1..63: note = hyper
  source 1..63: mol_type = genomic DNA
caggcttcctgtgtgcgcgctcgtcctctgctgtttcccgccggagctcgttgggcctccccg

SEQ ID NO: 36240 - DNA, 103 bp, Homo sapiens
  misc_feature 1..103: note = chr16:67700928-67701031
  misc_feature 1..103: note = hyper
  source 1..103: mol_type = genomic DNA
ggcagggacagctcacggaggagcccggcagcgctcagacctccgaggtgaccgtcaggctgtttaaccttcaaacacagggccgcagcgctctgagaggtgg

SEQ ID NO: 36241 - DNA, 99 bp, Homo sapiens
  misc_feature 1..99: note = chr16:67877035-67877134
  misc_feature 1..99: note = hyper
  source 1..99: mol_type = genomic DNA
agtggagtttgcagccgcagagggcgcagccgctgcggccgccgcgtcggagttacaggctgctaccgcagggctggaggctgccgagtgccctatggg

SEQ ID NO: 36242 - DNA, 45 bp, Homo sapiens; identical to SEQ ID NO: 12529
  misc_feature 1..45: note = chr16:68118410-68118455
  misc_feature 1..45: note = hyper
  source 1..45: mol_type = genomic DNA

SEQ ID NO: 36243 - DNA, 156 bp, Homo sapiens
  misc_feature 1..156: note = chr16:68118759-68118915
  misc_feature 1..156: note = hyper
  source 1..156: mol_type = genomic DNA
ggtccctgccctctggagactcagccattaaagttgaggtggggggatgaggatgtgggcggcgtccaggtaactctgaggggccctgatgccttccctagagccagccatcaggagtaacacgatgcgcccccacatcaccgaacccagaacctc

SEQ ID NO: 36244 - DNA, 224 bp, Homo sapiens
  misc_feature 1..224: note = chr16:68504068-68504292
  misc_feature 1..224: note = hyper
  source 1..224: mol_type = genomic DNA
gtaaaggaagcaacacggaacaaccacgtttttgttattcgaaatgcagctacacgtgtttacagtccttaaccatttcatctgacagcctggggagacagacttctaatttgtgttttgataaactgagagtgacagagcggttgttggccctgcttggaggtggagtgatggtgtggtcagaagggaagccggagggaagttacactcgtggggtgtgtgtt

SEQ ID NO: 36245 - DNA, 184 bp, Homo sapiens
  misc_feature 1..184: note = chr16:68544194-68544378
  misc_feature 1..184: note = hyper
  source 1..184: mol_type = genomic DNA
cggcccggacacccacgggccaccgcgtcgaggcagcgcgagccccgggcgccccctgcaggttgtacgggcctcagctgcgcagcgcagacggaggagggcgctggcggttaagaactcctacttgtcaaccggaaaaacatcccccataaaaaaacggtcaaagggccgggacagaagcatt

SEQ ID NO: 36246 - DNA, 245 bp, Homo sapiens; identical to SEQ ID NO: 4365
  misc_feature 1..245: note = chr16:68676360-68676605
  misc_feature 1..245: note = hyper
  source 1..245: mol_type = genomic DNA

SEQ ID NO: 36247 - DNA, 198 bp, Homo sapiens
  misc_feature 1..198: note = chr16:68676841-68677039
  misc_feature 1..198: note = hyper
  source 1..198: mol_type = genomic DNA
cgtggtccacccccagcctcagtcccagccccagctgctgggctcacccgccggctaagggaatgctcccgagataccagatgccagttgctcgttgtaccctcagccatgaaattggaggattacaacgcttctcattctcttaattcaggggatgtggggatgctagaaagagagacggctcgccagacatctgag

SEQ ID NO: 36248 - DNA, 99 bp, Homo sapiens
  misc_feature 1..99: note = chr16:68679959-68680058
  misc_feature 1..99: note = hyper
  source 1..99: mol_type = genomic DNA
cccagcagaggaatgcgccggccacattcttcccccaacccgcgcgcaggtgtggggatgagccgtgccccgggcagcccccttcgcccctctcgggcc

SEQ ID NO: 36249 - DNA, 66 bp, Homo sapiens
  misc_feature 1..66: note = chr16:68771258-68771324
  misc_feature 1..66: note = hyper
  source 1..66: mol_type = genomic DNA
cagcccggcccgacccgaccgcacccggcgcctgccctcgctcggcgtccccggccagccatgggc

SEQ ID NO: 36250 - DNA, 133 bp, Homo sapiens
  misc_feature 1..133: note = chr16:71459956-71460089
  misc_feature 1..133: note = hyper
  source 1..133: mol_type = genomic DNA
cgtgcttgccggttcttgccaccctccgccgcttgcaccggacccaggcgctcatcccccgcttcccccgcgccccagcccggtcacgcctcggagcttgtccccacctggccgtgctcagagtctgcctgcc

SEQ ID NO: 36251 - DNA, 247 bp, Homo sapiens
  misc_feature 1..247: note = chr16:71460270-71460517
  misc_feature 1..247: note = hyper
  source 1..247: mol_type = genomic DNA
cgcacaagcccggggtgagaccagaagctgctgcctgcagagcccgaccttgcgtagatgactccgcgagtgcaaggggctgcaggcattttcttacaggaggtagcaagcttgtctaagcagaggccctcttagcgcagtgggcagcgcgtcagtctcataatctgaaggtcctgagttcgagcctcagagagggcagctgttttgttgtgctacgaatgcagcaaatgttcggatgtaacccagc

SEQ ID NO: 36252 - DNA, 28 bp, Homo sapiens
  misc_feature 1..28: note = chr16:73100271-73100299
  misc_feature 1..28: note = hyper
  source 1..28: mol_type = genomic DNA
cggagccagcgtgcgcgtccctaatgcc

SEQ ID NO: 36253 - skipped

SEQ ID NO: 36254 - DNA, 107 bp, Homo sapiens
  misc_feature 1..107: note = chr16:75528762-75528869
  misc_feature 1..107: note = hyper
  source 1..107: mol_type = genomic DNA
gctgtgccaccagcccggcccccagccgacccgagtgtggggacatcccccgcggagaatgaagaaccaacgtaccccaaagcttggcggctctgcccgagctgcag

SEQ ID NO: 36255 - DNA, 412 bp, Homo sapiens
  misc_feature 1..412: note = chr16:75528922-75529334
  misc_feature 1..412: note = hyper
  source 1..412: mol_type = genomic DNA
cgtctcttccaaattccaccgcacagccagctctttctcttcactgggagggtccgcaggggctgacttgctccttaaggtcccaagactattaagcgacacccggtgaggccgggaaaggggctctaagaggcatggacgagagttggcggtgaccaagccactggaagctcctggagactcgaggtagaacgaatgtgggaacagggcaggagtcccagaatgggatgttgaggctgggggtgtcctggggctaccacagggaaggacccggcgcagagctccctctggaacccggcactgcggcccgcgccctctactccccgcgcgccggccggcaaccctcggcgctgcccggtgcagcccgcccgagcgcacacaatgaggcgctttcagacgtggctgcggtccc

SEQ ID NO: 36256 - DNA, 41 bp, Homo sapiens
  misc_feature 1..41: note = chr16:76311161-76311202
  misc_feature 1..41: note = hyper
  source 1..41: mol_type = genomic DNA
cgcctctgggtgcagcggagctcgagcgctgttgtgtgttt

SEQ ID NO: 36257 - DNA, 65 bp, Homo sapiens
  misc_feature 1..65: note = chr16:77246006-77246071
  misc_feature 1..65: note = hyper
  source 1..65: mol_type = genomic DNA
cctcctctttgtcctcgcagatgctggagcagcgactggcccgggagatccgtgccctggagaga

SEQ ID NO: 36258 - DNA, 623 bp, Homo sapiens
  misc_feature 1..623: note = chr16:77246307-77246930
  misc_feature 1..623: note = hyper
  source 1..623: mol_type = genomic DNA
gggcggaggggaacccgcccaggtcccccgctccgcccccgactgccgcttccccggcctgtgcctccctcggcgtcgtcgggtctccgcgtctcggtggcttcctcctcgtcccctggactctcgctctcttcctcctgtctcctcggccccttctccgcaggctgaaggcggagctggagatattcggggagcaggtccggagcgcccccgaggtcggggccggcgagggagaggtagggagcccgaggaagggaggcggggcgggcagggaccgagtcaggagagagcgggcgggggtcctgggagcggcccccgagagtggggtctgtggggagcagggcggccccggggacagaggaagccgcggtggaggcctagggcagacgcgggcggacgcgaggagcgtaggaacctggtccgcagcctcacccagcccccggcaggccggacctgagctcccccgcgctcgcgacgaggaggatcccgagccgccggtggctgcccctgacgccctctaggccagcaggacccgcccgttcccgaccttccctcgagacccgccaagaaataaaggcgatgatttccgaccatgctcgcgttctccgcggagtctgtgctac

SEQ ID NO: 36259 - DNA, 37 bp, Homo sapiens
  misc_feature 1..37: note = chr16:77468421-77468458
  misc_feature 1..37: note = hyper
  source 1..37: mol_type = genomic DNA
atcgcgcgtgaggggcgcggcggggctggcgtcgggc

SEQ ID NO: 36260 - DNA, 59 bp, Homo sapiens
  misc_feature 1..59: note = chr16:77469028-77469087
  misc_feature 1..59: note = hyper
  source 1..59: mol_type = genomic DNA
gggctcgtccgagcccccgggctggtgcaagggcgtgggattcccggctccagctctga

SEQ ID NO: 36261 - DNA, 266 bp, Homo sapiens
  misc_feature 1..266: note = chr16:77822153-77822419
  misc_feature 1..266: note = hyper
  source 1..266: mol_type = genomic DNA
cccagacattagtctcggtccatttcaaggcacccgagcctgtgccgtatataaccaagtactgggcccacaggaagggggatgacagggtggtctctctaggctcgttttagtcacagatcttcggcaaatttgggtttagggccgcgatcccgaccctaacttgggactatttcaggaactggagttgaggcttcgttgggacaggaaagaagggtggggcgggggtgaagcgcttagggcacggctcttgtgaggattacggc

SEQ ID NO: 36262 - DNA, 727 bp, Homo sapiens
  misc_feature 1..727: note = chr16:77822420-77823147
  misc_feature 1..727: note = hyper
  source 1..727: mol_type = genomic DNA
gaggctgtggaccgcggcggcgctcgcagaggctgcagccattgcacagccgagcatcccacattcaacaggaggaacccgcgggagaggagccccactcccccagcgccgcagccaccgcagccaccgcagcccgtgcgccccgcgccctcgagcgccatggccaaggaaggcgtggagaaggcggaggagacggagcaaatgatcgagaaggaggcaggcaaggagccggcggagggcggcggcggcgacggctcgcaccgcctcggggacgcccaggagatgcgcgcggtggtgctggctggcttcggggggctcaacaagctgcggctcttcaggaaggccatgcccgagcctcaggacggcgagctcaagatccgcgtcaaagcctggtccagtatccgcgcctttctcgctttctctctttttgcgcgctgggcgctggggagggggtgggaaagctgcggctgggatgctgcccgggtagaaccgccgcgcgcaccccctccgcgccctcacccgggtctcagagcctccccgggccaaagctggggaggatgcagaggggcggcctccccaagccagatctaggggtgacgggaggagaatgtgagctcctgggcgcggggagaatgctggcgcccaggcaccccgggtctggaagattgcgctacgggagttctccgtctgagaggacaactcagctttcgcacgggagggttgatgc

SEQ ID NO: 36263 - DNA, 374 bp, Homo sapiens
  misc_feature 1..374: note = chr16:78079785-78080159
  misc_feature 1..374: note = hyper
  source 1..374: mol_type = genomic DNA
ggggagcggctacagcgcgggatcctggggagatagctcaaggcaggccagggaaggacaggccgggcaatgggcgcggagacgaaggggccggacagcggcgaggcgctggctccggtcgcggcacccggctgctgagggcagtgctgctgcttgggacgttccaggcgaccaagtaccctcggcggccctggcagggcggtgcctggggtgggcgctgggcctccaggcctgcagccacgcttggcgctgtccgctagggccaggtgctgaagtgttggccgcgagcggagctgctgcagcgctggcttccccgggccgctgcgggtggacttggacaacataaagggctgattgagcggggccactttttc

SEQ ID NO: 36264 - DNA, 32 bp, Homo sapiens
  misc_feature 1..32: note = chr16:79623822-79623854
  misc_feature 1..32: note = hyper
  source 1..32: mol_type = genomic DNA
ctccctgggcactgccgcgggtctgggactgc

SEQ ID NO: 36265 - DNA, 167 bp, Homo sapiens
  misc_feature 1..167: note = chr16:79632650-79632817
  misc_feature 1..167: note = hyper
  source 1..167: mol_type = genomic DNA
gtggctagctggaatcgcgtgtcagactcacatgaaaaactcgggagaggacgggttgtcgctgctcgagccgttttctcggaagccgctgctcaccaacttctcgtatttctccttgtacgcgtccctctcgcgcaccagcctggagatctcctgcttgaggtggt

SEQ ID NO: 36266 - DNA, 95 bp, Homo sapiens
  misc_feature 1..95: note = chr16:79633073-79633168
  misc_feature 1..95: note = hyper
  source 1..95: mol_type = genomic DNA
cgcccccgccgcgcccccgccgcctccgccgccgccgccgccgccgccgcccccagcgctggccgggccaccgccgcccgcgcccccagcgccac

SEQ ID NO: 36267 - DNA, 59 bp, Homo sapiens
  misc_feature 1..59: note = chr16:79633469-79633528
  misc_feature 1..59: note = hyper
  source 1..59: mol_type = genomic DNA
ggggctgaagcccagcgcctcggggttcagctgctgcgggtagccggtcatccagtagt

SEQ ID NO: 36268 - DNA, 51 bp, Homo sapiens
  misc_feature 1..51: note = chr16:79633792-79633843
  misc_feature 1..51: note = hyper
  source 1..51: mol_type = genomic DNA
atgccattctcctgccgccgccgccgccgccgccgccgctccgccagatgg

SEQ ID NO: 36269 - DNA, 30 bp, Homo sapiens
  misc_feature 1..30: note = chr16:79634970-79635000
  misc_feature 1..30: note = hyper
  source 1..30: mol_type = genomic DNA
gacaggcctcccatccggagccccagctcg

SEQ ID NO: 36270 - DNA, 32 bp, Homo sapiens
  misc_feature 1..32: note = chr16:79635617-79635649
  misc_feature 1..32: note = hyper
  source 1..32: mol_type = genomic DNA
tttatcagggtcaggcgcgccctttgcacttt

SEQ ID NO: 36271 - DNA, 58 bp, Homo sapiens
  misc_feature 1..58: note = chr16:79804242-79804300
  misc_feature 1..58: note = hyper
  source 1..58: mol_type = genomic DNA
gacagaggcaagacacgcagcgagtgctctcgcgagagttcaccgagttgataaaatt

SEQ ID NO: 36272 - DNA, 369 bp, Homo sapiens
  misc_feature 1..369: note = chr16:80574670-80575039
  misc_feature 1..369: note = hyper
  source 1..369: mol_type = genomic DNA
tggacaaacacaggccgggagcctgacccacttccctcttccctcccgggacccactgctccaggattgggcgaacctcaggtgagcgcctgctcccctcttccgcgaaccttcgcctacggcggccgggaggcatcaggagcgcggtcagggcgaaaaagccgactcgcgagcgcgcaggcgcagccctgacgcttccgtggggccacttccttttttgtctcctagcaacggcgggtagcgttgttgacatcccgggaggctgtgccgccggcctgagcccagagtttcgcggcctccgcgatggtaaatctggggtctccgtccacgccccgccgttccaagcacgccgaccgtcaaggaccttcg

SEQ ID NO: 36273 - DNA, 32 bp, Homo sapiens
  misc_feature 1..32: note = chr16:80966399-80966431
  misc_feature 1..32: note = hyper
  source 1..32: mol_type = genomic DNA
ctctcgggaaggccccgcgggttcccaccagg

SEQ ID NO: 36274 - DNA, 30 bp, Homo sapiens
  misc_feature 1..30: note = chr16:81779906-81779936
  misc_feature 1..30: note = hyper
  source 1..30: mol_type = genomic DNA
gagtgcttgagttttcgcccccagcacagg

SEQ ID NO: 36275 - DNA, 30 bp, Homo sapiens
  misc_feature 1..30: note = chr16:81813567-81813597
  misc_feature 1..30: note = hyper
  source 1..30: mol_type = genomic DNA
atgcgtgtgtctgtgcgtgttgtgttttgt

SEQ ID NO: 36276 - DNA, 256 bp, Homo sapiens
  misc_feature 1..256: note = chr16:82660312-82660568
  misc_feature 1..256: note = hyper
  source 1..256: mol_type = genomic DNA
tggccgccagtcccccgtgcaattccattctctggaaaagtggaatcagctggcattgcccagcgtgatttgtgaggctgagccccaacagtccaaagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgct

SEQ ID NO: 36277 - DNA, 124 bp, Homo sapiens
  misc_feature 1..124: note = chr16:82660780-82660904
  misc_feature 1..124: note = hyper
  source 1..124: mol_type = genomic DNA
tttctgcattcggatcgcccggcacgggcagggtgagggggctttcggggggtcggggcctccggtcgcggcggcgaagacagatcggggctcggtagggaggtcattccgagcccagagatcc

SEQ ID NO: 36278 - DNA, 161 bp, Homo sapiens
  misc_feature 1..161: note = chr16:82661251-82661412
  misc_feature 1..161: note = hyper
  source 1..161: mol_type = genomic DNA
ccccctggtacagcccggctgcccgctggaaggcgcctcggggcagcagagagcctcagcccggctgctgctgtcgctcaaaggcgccggcgccggccgcacccgcatcggggtccttttgctcccagaccccgggcccgaaagggccggagcgtgtcccc

SEQ ID NO: 36279 - DNA, 292 bp, Homo sapiens
  misc_feature 1..292: note = chr16:82661468-82661760
  misc_feature 1..292: note = hyper
  source 1..292: mol_type = genomic DNA
cggccagatcccgggctgccgcctctgctgccttccctgagcgggagcggagcgcagagaaaagttcaagccttgcccacccgggctgcagctgcttgttaaccctcagagcgccacggcgcgagggaagggcacgccaaccaggagagggggcgagggagatgcggtccgcctgcagtcacctctgcacctcagagatttcgggaagtttgagtgcaggaaagcagcgctccgaggccaggcctggggtgctggccgctgcggggggcacgccctgcgctgctcaggggcc

SEQ ID NO: 36280 - DNA, 30 bp, Homo sapiens
  misc_feature 1..30: note = chr16:84001873-84001903
  misc_feature 1..30: note = hyper
  source 1..30: mol_type = genomic DNA
gggggactttagaagcggggagagcaggag

SEQ ID NO: 36281 - DNA, 52 bp, Homo sapiens
  misc_feature 1..52: note = chr16:84402140-84402192
  misc_feature 1..52: note = hyper
  source 1..52: mol_type = genomic DNA
cccaggaggcttgggcgcgcgcagccatcccgggcctcgccggggacctagg

SEQ ID NO: 36282 - DNA, 125 bp, Homo sapiens
  misc_feature 1..125: note = chr16:84633325-84633450
  misc_feature 1..125: note = hyper
  source 1..125: mol_type = genomic DNA
actttacagagactccggagaggttatgcaaacacggctcaggaagggaaaaaacaacccacacaccaaaaagctgagctgtcagcttccaccgagggagctccctggagcgaggatgaaaggaa

SEQ ID NO: 36283 - DNA, 297 bp, Homo sapiens
  misc_feature 1..297: note = chr16:84853364-84853661
  misc_feature 1..297: note = hyper
  source 1..297: mol_type = genomic DNA
ctccttgtccctagccggccctggaggccagcggccccgccttcctcgcccacccggcgcccgcgcctcagctgccccccgcctccttcagcccgctgagcctgcggggcggggccgggggcggggccggtgatgctcggtcctaccagcgccgccagcgatctgggggcgtggcctccgggctccggggagcctacaagaggcggtacgctgagccccggcacccactcgcatcccagggcgtctccggctgctcctattgagctgtctgctcgctgtgcccgctgtgcctgctgt

SEQ ID NO: 36284 - DNA, 183 bp, Homo sapiens
  misc_feature 1..183: note = chr16:85203399-85203582
  misc_feature 1..183: note = hyper
  source 1..183: mol_type = genomic DNA
ccgctgcttcctgggcgagcagtgggccgccttcgagcgcgcccgcacgccggtggacaagcgcatgtactggctcaagcggccccaccagtgcgacgcgggcgcaggcggccgccgtggcggcgccggggccccccgcgagtggaacgtcgcctacgcgctgggcagcgccaccggcgacga

SEQ ID NO: 36285 - DNA, 360 bp, Homo sapiens
  misc_feature 1..360: note = chr16:85932306-85932666
  misc_feature 1..360: note = hyper
  source 1..360: mol_type = genomic DNA
cagcgctcgtgaaggcggagaccggcggggcagctagtttctggctgtggattctgattaatgggccgcaggcgcacggtctgcaccgtccggctcgttgctagtggctcgctcgggagccgccgcactcccggggctgtccgcccgagccggcctggaaggcggaggacgcctccaggtcgctccgcggggcctccggaattcctgggaaagcccccctgcagcgccgcccctggaccccaggtgtgaggagcggggctcggccagcggctccagaagaggcccggaccccactgccgtggctgccgggggcgggaaagtgatttctcggaaagcagagcacttcgaagaaggcgggcc

SEQ ID NO: 36286 - skipped

SEQ ID NO: 36287 - DNA, 304 bp, Homo sapiens
  misc_feature 1..304: note = chr16:85932669-85932973
  misc_feature 1..304: note = hyper
  source 1..304: mol_type = genomic DNA
cgagccaagctgacgctattggtcggtgtggccgtcgctctgcgcaccgcccgtcccccccacgaccctttttaaggccgcgcgaccgctggcgcatcgcctggagcgcggcagcaagcgtgggaacgcgggcggcgagacggcggcaggacggcggcaggtaggcacagtgggcgggtagggcgcccgtgtcccgcgcggtccggtcccgcggggtccccgacgccaggcggggcgtgggggtggaactacctaccgtaatgtccccgggcgcagctcagtggccacccgtgtccctctctgc

SEQ ID NO: 36288 - DNA, 30 bp, Homo sapiens
  misc_feature 1..30: note = chr16:86081925-86081955
  misc_feature 1..30: note = hyper
  source 1..30: mol_type = genomic DNA
gctcgccactctgcccggaagggggagggg

SEQ ID NO: 36289 - DNA, 205 bp, Homo sapiens
  misc_feature 1..205: note = chr16:86320284-86320489
  misc_feature 1..205: note = hyper
  source 1..205: mol_type = genomic DNA
gggctccagaaaccccgaccctcgcaggggagagccagccgaaccagacgtgtgggggcagcagccgccgcggcggtctgggacgcgggtgtcgccttccacgggacttgggtccagggacccaagacggggatctgggaggagggggatgcccttggggcctgagacccgggcggtttccgaagcgaagtagttacccagaacc

SEQ ID NO: 36290 - DNA, 569 bp, Homo sapiens
  misc_feature 1..569: note = chr16:86320490-86321059
  misc_feature 1..569: note = hyper
  source 1..569: mol_type = genomic DNA
ctccctaccttctccccgcctccctgtctttctgcccctctgtcccctgcagctgctcggccctccctcctctgaaacccaccgcccgcccaaggctcactccttcctgctgttcccgcccgcgaagctgttgcagggacggtgcgcccttgggctgcactcaccaccgcccctcgcccgcgacgtcctggccccctaaccccagctttcccgccgccgctcactcccgcgctccgctgcagctcagcccggtctgcaactctccctctgttttctgccccgctcctcagttctgcgctctcctcttctccaggcttccctctcctcctccttctgcctctcccctgtccccgttccattctcctgcgcccctcgccagcgcgctcgcagcccatcggctcctgccggggcccctctggtgccagccgccttcaggctgtgggtccgtccgctggtggaggggaaggtcggggctggccccgggccccgcgctgctgggccccatggtcagtggagacgcctcctggtctcccttcagagctcctcgtcgtcgtcggagtcatcggagg

SEQ ID NO: 36291 - DNA, 46 bp, Homo sapiens; identical to SEQ ID NO: 4372
  misc_feature 1..46: note = chr16:86530947-86530993
  misc_feature 1..46: note = hyper
  source 1..46: mol_type = genomic DNA

SEQ ID NO: 36292 - DNA, 273 bp, Homo sapiens; identical to SEQ ID NO: 4373
  misc_feature 1..273: note = chr16:86531016-86531289
  misc_feature 1..273: note = hyper
  source 1..273: mol_type = genomic DNA

SEQ ID NO: 36293 - DNA, 107 bp, Homo sapiens; identical to SEQ ID NO: 4374
  misc_feature 1..107: note = chr16:86531374-86531481
  misc_feature 1..107: note = hyper
  source 1..107: mol_type = genomic DNA

SEQ ID NO: 36294 - DNA, 98 bp, Homo sapiens
  misc_feature 1..98: note = chr16:86531527-86531625
  misc_feature 1..98: note = hyper
  source 1..98: mol_type = genomic DNA
cgttccctggttcacaaccaccccacccccacgcgcctgtgcacatgtccctcccgccgcgcagggtctccgcgggcgcgccccgccccaaatagagc

SEQ ID NO: 36295 - DNA, 324 bp, Homo sapiens
  misc_feature 1..324: note = chr16:86539103-86539427
  misc_feature 1..324: note = hyper
  source 1..324: mol_type = genomic DNA
cacaaatatccctcccgcgctcctccggcagccgtgaagtttcgtttcccccggccgggtcctccttccctcccttccgaagccccgaggacaggccgcttccctcccgcccagctcccgcgtcgggtcctggctggccgccctaccttgaggcgtcgtttgaacctcgcctcgcggggggttggagggagcgggggcgggcgaggagggcgcgggcccggcgttaatgcggagcgggggcggcggcggccggcggggcggctgccctcgcggtgggtggtcggcggccccctgccccgcccgcgcggccggcctgggctccct

SEQ ID NO: 36296 - DNA, 36 bp, Homo sapiens
  misc_feature 1..36: note = chr16:86539463-86539499
  misc_feature 1..36: note = hyper
  source 1..36: mol_type = genomic DNA
cgctctcggcccgggcggcttcgcttaagcaattag

SEQ ID NO: 36297 - DNA, 226 bp, Homo sapiens
  misc_feature 1..226: note = chr16:86541633-86541859
  misc_feature 1..226: note = hyper
  source 1..226: mol_type = genomic DNA
aagggtgtttgaggccgtgggcggtgcggagcgtgtctgtgtgcgcggaggctgagctggttgtgtgaagtggtagcgggtctgccagagagcgtttacctgcgtgaatgcacaaccacacactacgggtcacgtcccacactcattctttccctaggcgggccaggctgtctgcacgcggagacccagagaggccagcggaagggcagcgcgggaaggcggctct

SEQ ID NO: 36298 - DNA, 50 bp, Homo sapiens; identical to SEQ ID NO: 12561
  misc_feature 1..50: note = chr16:86542388-86542438
  misc_feature 1..50: note = hyper
  source 1..50: mol_type = genomic DNA

SEQ ID NO: 36299 - DNA, 101 bp, Homo sapiens
  misc_feature 1..101: note = chr16:86543663-86543764
  misc_feature 1..101: note = hyper
  source 1..101: mol_type = genomic DNA
gagtgaaggctgcctcgcccggaatctcggagccgagcgccgcgggcggcggggactcagggctgctcccggctggggcgcacggccgtaagacctggagg

SEQ ID NO: 36300 - DNA, 367 bp, Homo sapiens
  misc_feature 1..367: note = chr16:86544191-86544558
  misc_feature 1..367: note = hyper
  source 1..367: mol_type = genomic DNA
agaagcagcagccaccgcacggcggcggcggcggcggcggcgggggaggcggcgcggccatggaccccgcgtcgtccggcccgtccaaggccaagaagaccaacgccggcatccggcgcccggagaagccgccctattcctacatcgcgctcatcgtcatggccatccagagttcacccaccaagcgcctgacgctgagcgagatctaccagttcctgcagagccgcttccccttcttccggggctcctaccagggctggaagaactccgtgcgccacaacctctcgctcaacgagtgcttcatcaagctacccaagggccttgggcggcccggcaagggccactactggaccatcgacccggccag

SEQ ID NO: 36301 - DNA, 163 bp, Homo sapiens
  misc_feature 1..163: note = chr16:86599222-86599385
  misc_feature 1..163: note = hyper
  source 1..163: mol_type = genomic DNA
cacccagtcttcccacggagcgcgctccctaactcaccctacccacccaacaaaacaaaaaaaaggctgaaatatagaaaagcaacttggaggctcccagggggacgttgccaggagcaggaggcagggacagcgccctagggtcggtgttagcggccggcgc

SEQ ID NO: 36302 - DNA, 512 bp, Homo sapiens
  misc_feature 1..512: note = chr16:86599480-86599992
  misc_feature 1..512: note = hyper
  source 1..512: mol_type = genomic DNA
cgggtttctcctcgcagggcccaggaactcggctctgcctggcccgggtgggtcgctgcattgtcccggtcttctgggagtgcggggtcagcttgttagagggaatttctacctgggaaaagggagacgagtttcgaagctgaagttggtaggctgcgagtgtccacgcgggagacgaaagggggaaatagcagagtcacttcacccttttccccaaaccccacaaaactgctcgcagcgacgcggatgatctaccgaattccccgcgaattcggaggattaagttgtcagtcagcacgttgctaccttcccctctatgcactccgctgcctggctcctcggcggggagcgagggaaactcagtttgtagggtttacctctaaaacctcgataggttatccttgacgaccccgagcctggaaactccctgttgatgattaattatttgattaaataagtataacatccaggagaggccctgccattccaatccagcgcgtttgctttgaatc

SEQ ID NO: 36303 - DNA, 648 bp, Homo sapiens
  misc_feature 1..648: note = chr16:86600315-86600963
  misc_feature 1..648: note = hyper
  source 1..648: mol_type = genomic DNA
ctgcgctcctcgccccgattggcgccgactcctctcagctgccgggtgattggctcaaagttccgggagggggcgtggcccgaggaaagtaaaaactcgctttcagcaagaagacttttgaaacttttcccaatccctaaaagggacttggcctctttttctgggctcagcggggcagccgctcggaccccggcgcgctgaccctcggggctgccgattcgctgggggcttggagagcctcctgcgcccctcctcgcgcgggccgagggtccacctgggtccccaggccgcggcgtctccgctgggtccgcggccgcccgcctgcccgcgctgccgccgccgggtcctggagccagcgaggagcggggccggcgctgcgcttgcccggggcgcgccctccaggatgccgatccgcccggtccgctgaaagcgcgcgcccctgctcggcccgagcgccgccgcccgcgcaccctcgccccggaggctgccaggagcccggggccgcccctcccgctcccctcctctccccctctggctctctcgcgctctctcgctctcagggcccccctcgctcccccggccgcagtccgtgcgcgagggcgccggcgagccgtctcggaagcagcatgcaggcgcgctactccgtgt

SEQ ID NO: 36304 - DNA, 326 bp, Homo sapiens
  misc_feature 1..326: note = chr16:86601213-86601539
  misc_feature 1..326: note = hyper
  source 1..326: mol_type = genomic DNA
gaagatcaccttgaacggcatctaccagttcatcatggaccgcttccccttctaccgggagaacaagcagggctggcagaacagcatccgccacaacctctcgctcaacgagtgcttcgtcaaggtgccccgcgacgacaagaagcccggcaagggcagttactggaccctggacccggactcctacaacatgttcgagaacggcagcttcctgcggcgccggcggcgcttcaaaaagaaggacgtgtccaaggagaaggaggagcgggcccacctcaaggagccgcccccggcggcgtccaagggcgccccggccaccccccacc

SEQ ID NO: 36305 - DNA, 464 bp, Homo sapiens
  misc_feature 1..464: note = chr16:86602037-86602501
  misc_feature 1..464: note = hyper
  source 1..464: mol_type = genomic DNA
cgtcgcccctgagcgctctcaacctcgccgccggccaggagggcgcgctcgccgccacgggccaccaccaccagcaccacggccaccaccacccgcaggcgccgccgcccccgccggctccccagccccagccgacgccgcagcccggggccgccgcggcgcaggcggcctcctggtatctcaaccacagcggggacctgaaccacctccccggccacacgttcgcggcccagcagcaaactttccccaacgtgcgggagatgttcaactcccaccggctggggattgagaactcgaccctcggggagtcccaggtgagtggcaatgccagctgccagctgccctacagatccacgccgcctctctatcgccacgcagccccctactcctacgactgcacgaaatactgacgtgtcccgggacctcccctccccggcccgctccggcttcgcttcccagccccg

SEQ ID NO: 36306 - DNA, 84 bp, Homo sapiens; identical to SEQ ID NO: 12569
  misc_feature 1..84: note = chr16:86775022-86775106
  misc_feature 1..84: note = hyper
  source 1..84: mol_type = genomic DNA

SEQ ID NO: 36307 - DNA, 30 bp, Homo sapiens
  misc_feature 1..30: note = chr16:87622644-87622674
  misc_feature 1..30: note = hyper
  source 1..30: mol_type = genomic DNA
cactgcgaagggctccggccttttccagtg

SEQ ID NO: 36308 - DNA, 129 bp, Homo sapiens
  misc_feature 1..129: note = chr16:87635070-87635199
  misc_feature 1..129: note = hyper
  source 1..129: mol_type = genomic DNA
cagtttctggctcaccgcgctgcggtcaccggcccacactcccaggagcgaggaccctgggcagcctccacacccccatcagcccactgcaccggtctgctgccatttcccgcacgcatttcaggaggg

SEQ ID NO: 36309 - DNA, 37 bp, Homo sapiens
  misc_feature 1..37: note = chr16:87635424-87635461
  misc_feature 1..37: note = hyper
  source 1..37: mol_type = genomic DNA
agggcgcagggcgcacggaattcgggtgactttgctc

SEQ ID NO: 36310 - DNA, 294 bp, Homo sapiens
  misc_feature 1..294: note = chr16:87636197-87636491
  misc_feature 1..294: note = hyper
  source 1..294: mol_type = genomic DNA
gccgccgccgccccgcgcccggcccgcggcccccaatatggtgcagccgccagcgccgccgcccgtgccgccgccgccgcccgcgggccccgccgccgccctcgggcgcccgcagcgcggcagccgcaggtggggggccgcggcccgggcctgagctgccccccgcccggcctcggcgcggcgccctccccgcggggctgccggcgaggggccctctcgccgctgaggtggagccgcgggccccgccgccgccgctcctgccccctccctccctcctcccctccccctcccctc

SEQ ID NO: 36311 - DNA, 156 bp, Homo sapiens; identical to SEQ ID NO: 12571
  misc_feature 1..156: note = chr16:87636626-87636782
  misc_feature 1..156: note = hyper
  source 1..156: mol_type = genomic DNA

SEQ ID NO: 36312 - DNA, 537 bp, Homo sapiens
  misc_feature 1..537: note = chr16:87636783-87637320
  misc_feature 1..537: note = hyper
  source 1..537: mol_type = genomic DNA
acggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggaggtaggtgccgcgggccgggccgggccggggcgggagggacgtgcttccgatcgcgccccttctgtggatctctggggaagttgagctgcgtcctccggttgggccgtgggcaccaggggcctttcccgggcttccctggaagccacggcggctcctggctacaggttgccccgctgcctggtgggg

SEQ ID NO: 36313 - DNA, 78 bp, Homo sapiens
  misc_feature 1..78: note = chr16:87637599-87637677
  misc_feature 1..78: note = hyper
  source 1..78: mol_type = genomic DNA
cgaatctgcccaagccgagagaaagggagtgatggggagcgctaggggcgggggatgccaacccgaaccaaaacagcc

SEQ ID NO: 36314 - DNA, 120 bp, Homo sapiens
  misc_feature 1..120: note = chr16:88449303-88449423
  misc_feature 1..120: note = hyper
  source 1..120: mol_type = genomic DNA
gctggggggagggtgcgggggcggcggagtctgtaacctaagccgccccagcctccggggggcagaccccgcggccgccggccggcgtccggccttcccagcacccggcccagggctgga

SEQ ID NO: 36315 - DNA, 302 bp, Homo sapiens
  misc_feature 1..302: note = chr16:88449693-88449995
  misc_feature 1..302: note = hyper
  source 1..302: mol_type = genomic DNA
ggtgcctggggaccccgggctggaacgcggggcgggggtgtcaccgggctgcgcgggggtctccggcccggctcccgctcctgcgccctcgggggccgctccccggcggggccggaccctcccagcgctcgcggcgcccggcccggctcccccgacctcctcctcccgggcccggacgtgcggggcagcgagcgccggggcccggcgggggccgcagccttgcccggagcggagcgttggcagcgcggggtccggctccgtgggcagtttgggaagcgcccgggcaacgtactggcgagggc

SEQ ID NO: 36316 - DNA, 65 bp, Homo sapiens; identical to SEQ ID NO: 12576
  misc_feature 1..65: note = chr16:88450363-88450428
  misc_feature 1..65: note = hyper
  source 1..65: mol_type = genomic DNA

SEQ ID NO: 36317 - DNA, 178 bp, Homo sapiens
  misc_feature 1..178: note = chr16:89006356-89006534
  misc_feature 1..178: note = hyper
  source 1..178: mol_type = genomic DNA
tatccccggccgacccgtccgccgaggtggctgccctgggaacctcctgttcctcgtccaggagaggaaacgcacacccgggccggacgcacagaagccgcaccctggctggggccacaagcctgacagctaccgacaagcccccacccacaggagcacgcgacgtgctctcttttca

SEQ ID NO: 36318 - DNA, 30 bp, Homo sapiens
  misc_feature 1..30: note = chr16:89006819-89006849
  misc_feature 1..30: note = hyper
  source 1..30: mol_type = genomic DNA
tcccacagcctggctcggggcctgcccaac

SEQ ID NO: 36319 - DNA, 271 bp, Homo sapiens
  misc_feature 1..271: note = chr16:89007509-89007780
  misc_feature 1..271: note = hyper
  source 1..271: mol_type = genomic DNA
tggtccccgcctccacgactcaggggcggctgcgcgctgtcttctggcgccgcaccgggctcaggcgcgcggcggggctggggcgcgcggggcggccgcctgggccatgccggggactcggctccggccaccccgcgcgggaacaaagcgcgcaccccgcccggggcggtctccggcctccgcggcccgcgccgggtccagccgccgcgcctgtggctccaacgccgcgcgctcgcccgagagtctcacggggccccgcggcccccgcccc

SEQ ID NO: 36320 - DNA, 505 bp, Homo sapiens
  misc_feature 1..505: note = chr16:89267320-89267825
  misc_feature 1..505: note = hyper
  source 1..505: mol_type = genomic DNA
gccagcccaaagccacggtctgctgaagacgctggtggtcctgaagcaaattccaggccctgctcccccaccggcgccttcggctccaatcctccagcgccccaggccgccccgcgcctggcagctcccaggcccagattcagcccccgcccggcccctctccgcgggtccggcccgtgcgcgcccgtctgcggcaccgtcgggccggcggccgccccggagcaggaagcccaggaggacggccggggggcccgggtcagaggcgccaggtaggatggagaaaggacacccagggcctcggcgggctgggggcggggagggctgcggggcagcagggacgggggcgcacctgggtgaccgggctttgcaggaggccggcgccgggcagcgcgtagagccagccgcgtgtgcagggccgggtgccgttgcgtgcgggcgcggggcgcgggcccggggcgggtgcagggcgcgggatcggggtagcgcaggagcaggcaggggctcg

SEQ ID NO: 36321 - DNA, 95 bp, Homo sapiens
  misc_feature 1..95: note = chr16:89268397-89268492
  misc_feature 1..95: note = hyper
  source 1..95: mol_type = genomic DNA
tgcactcaggttgcccgggggcgcgcgggctccggccggcgtcccggggtggtccccgcgtggggccgggggcgtccgcgcgggcggggcgaggt

SEQ ID NO: 36322 - DNA, 30 bp, Homo sapiens
  misc_feature 1..30: note = chr16:89268813-89268843
  misc_feature 1..30: note = hyper
  source 1..30: mol_type = genomic DNA
ctcgcgttaacaattcgaatgggcacgttt

SEQ ID NO: 36323 - DNA, 61 bp, Homo sapiens
  misc_feature 1..61: note = chr16:89778723-89778784
  misc_feature 1..61: note = hyper
  source 1..61: mol_type = genomic DNA
cctgcctctgcaaagcggggagcccctcggccctgtaccccgaccccggaacctccgctcc

SEQ ID NO: 36324 - DNA, 83 bp, Homo sapiens
  misc_feature 1..83: note = chr16:89992890-89992973
  misc_feature 1..83: note = hyper
  source 1..83: mol_type = genomic DNA
ggaccccaagcgctgcgcgaggtcagcaccaaggacagcgcccgggccgagcgcctggcctcgaacgccgggttctgctttgt

SEQ ID NO: 36325 - DNA, 208 bp, Homo sapiens
  misc_feature 1..208: note = chr17:1083533-1083741
  misc_feature 1..208: note = hyper
  source 1..208: mol_type = genomic DNA
aggatcctggcgatccgcaaaccaggtgccgtggggggcccgggagcccacaggggtgacatcacctcccgcccgggatctccaagcgcggcttcgcgggcgggagcggcggccgggcccctccccagccagacccgctgcgggacccacggggtgaacgtcctgcgcgccgcgggacgcgcctctctcctcccgaaccttcccccgc

SEQ ID NO: 36326 - DNA, 89 bp, Homo sapiens
  misc_feature 1..89: note = chr17:1174273-1174362
  misc_feature 1..89: note = hyper
  source 1..89: mol_type = genomic DNA
ggccgcgcgcggggacaccggggacacaggcgccagccccccgccgcctgcagggcccagcctcgcgcgcccagacgccgcccgcccct

SEQ ID NO: 36327 - DNA, 165 bp, Homo sapiens
  misc_feature 1..165: note = chr17:1174384-1174549
  misc_feature 1..165: note = hyper
  source 1..165: mol_type = genomic DNA
cgcctcgtgccccccgcacgcgcccctggcacggcccagtgcggtggccgaggggccgggcctagcacaggcctccgggggaagctggcgccgctgtccgggggcttcctctgccgggccgcctccctggccgcggggctacctgcgatccgcccccgggatggg

SEQ ID NO: 36328 - DNA, 30 bp, Homo sapiens
  misc_feature 1..30: note = chr17:1811643-1811673
  misc_feature 1..30: note = hyper
  source 1..30: mol_type = genomic DNA
tcgcccgggacttcccgtcctccaagcctg

SEQ ID NO: 36329 - DNA, 212 bp, Homo sapiens
  misc_feature 1..212: note = chr17:1901506-1901718
  misc_feature 1..212: note = hyper
  source 1..212: mol_type = genomic DNA
ggcggggagggctgtcgcattgatccggagctgcagggcgagggcggtgcccagacccggcgccccaaggcctcccgcaggccgacccgagccgagcgcgccctttgggcaccggccccgcccgggagggtcttctcgctctagagccgggggcccgcgctgagagatcggggttaccgcgcggggagccgcggccgcgctgggatccgttc

SEQ ID NO: 36330 - DNA, 50 bp, Homo sapiens
  misc_feature 1..50: note = chr17:1901920-1901970
  misc_feature 1..50: note = hyper
  source 1..50: mol_type = genomic DNA
tcctcctgggctcgccgggatgtggcctccgaggtcgccgcggcgctttc

SEQ ID NO: 36331 - DNA, 272 bp, Homo sapiens
  misc_feature 1..272: note = chr17:1927434-1927706
  misc_feature 1..272: note = hyper
  source 1..272: mol_type = genomic DNA
gccgggctgctggggcgtctagctacggtggtcgcgaagccagctgtcctcaagttgagctgtgcaccggtcgcgcacactggcggcacggctttcgcgtccctccgctcccagcataatgaaagtttgaggaactggacatcaggcgctggccgctccccaccctcagccgctgggtgcccagagcccatccctagcgatcagagcagaactgcagagaagacgtccgcgtccgggccccgtctggggagctagggcgcgcggggagcgcc

SEQ ID NO: 36332 - DNA, 176 bp, Homo sapiens
  misc_feature 1..176: note = chr17:1927990-1928166
  misc_feature 1..176: note = hyper
  source 1..176: mol_type = genomic DNA
ccagcagcagcccctcggcgggtgcgcccggcaaaacccaccagcccgccgggggctacttcccagaccgggagccccggcgccgggcggcgcccgggctcgcggctctttccggagcgcattcaacttcaacttgcccctgcggctccaactcacctttgcgaagcatgttggcc

SEQ ID NO: 36333 - DNA, 34 bp, Homo sapiens
  misc_feature 1..34: note = chr17:1957561-1957595
  misc_feature 1..34: note = hyper
  source 1..34: mol_type = genomic DNA
ccctgttgtttccttcgggcgggtgggttggaga

SEQ ID NO: 36334 - DNA, 132 bp, Homo sapiens
  misc_feature 1..132: note = chr17:1959132-1959264
  misc_feature 1..132: note = hyper
  source 1..132: mol_type = genomic DNA
gggggagaaggggccgggggagccgcggagggaggcgccgggcccgcgcgtgtagggcccaggccgaggccgggacgcgggtggggcgcaggcccgggtcagggccgcagccggctgtgcgccgtgcccgcc

SEQ ID NO: 36335 - DNA, 129 bp, Homo sapiens
  misc_feature 1..129: note = chr17:1959436-1959565
  misc_feature 1..129: note = hyper
  source 1..129: mol_type = genomic DNA
gggccccgaccgagggttgacagcccccggccagggcggcgccagggcgggcaccgcgctcccctcctccgtatcacttcccccaactggggcaacttctcccgaggcgggaggcgctggttcctcggc

SEQ ID NO: 36336 - DNA, 49 bp, Homo sapiens
  misc_feature 1..49: note = chr17:2627535-2627584
  misc_feature 1..49: note = hyper
  source 1..49: mol_type = genomic DNA
agtacaaaaggctggcggttcggggatttggggggagccggggccgcct

SEQ ID NO: 36337 - DNA, 517 bp, Homo sapiens
  misc_feature 1..517: note = chr17:2627798-2628315
  misc_feature 1..517: note = hyper
  source 1..517: mol_type = genomic DNA
cgggcgctgggccgcagcggcctgcgtgcatagaggaagagcgcggggtcgggcatggggtcggcgtcgtcgagggcgccggccccgcggtcccaggcggcccagtcccggccggggcccttggcggcggcctcgtgggcagcaggcgggcggcgggctcgcagtgcgcggcggcgtggcctgggctcggcggtggcgccggggcccgggcgcggggcctgcagtctctggcgcgccgcgtgcagctggcaggagaggtaggcggccgcctcggtgtgcttctgcagctcggtgcccagcacggtggcgcggtggctgcggcggcgcagctcctccaggaagcggcgctcctcggtgcgcaggctgcagcgcagcgcggacaccagcgcctcgcgctgcgccacctcccgccgcagctccgcgttggccgcagcacgcgcctccagctgcgactccagcgcgcggcacttgctctccagctcccgggacgccgcctctggaacggggcagaggccag

SEQ ID NO: 36338 - DNA, 89 bp, Homo sapiens
  misc_feature 1..89: note = chr17:2652543-2652632
  misc_feature 1..89: note = hyper
  source 1..89: mol_type = genomic DNA
cttctgccagcagcccgccgcgagtcctgtccgcctcccgcgcgctgcggtgcccagccccgcgccagccctcccgggggagctggagc

SEQ ID NO: 36339 - DNA, 61 bp, Homo sapiens
  misc_feature 1..61: note = chr17:2659604-2659665
  misc_feature 1..61: note = hyper
  source 1..61: mol_type = genomic DNA
caggggaggggtccccgtgtagcggggcagtcgccctttccccctccgcagtcctggcccg

SEQ ID NO: 36340 - DNA, 294 bp, Homo sapiens
  misc_feature 1..294: note = chr17:2680204-2680498
  misc_feature 1..294: note = hyper
  source 1..294: mol_type = genomic DNA
gggtccagaggcagccgcgcgccaggcggcgcagaaggtcagtggccccggggctgggattccgcagccagcctggatcgggacgtgagtcctggtgtgactgacggggaatcggagcgtgtgtggagtgtgaacgcgtgtgtttgcagacagacatcggcacgtatggacggcgcgagccggtactgcgttccggaggagccatccggcgtcacaggctgtgctggggaggtggggtgaccgtcctcagaaacccccgcgggcggggcgctgcacacacgtccacctataggg

SEQ ID NO: 36341 - DNA, 136 bp, Homo sapiens
  misc_feature 1..136: note = chr17:2756282-2756418
  misc_feature 1..136: note = hyper
  source 1..136: mol_type = genomic DNA
tgggcgcggggagggcggagtggggggcgcccggcccgccaggaggaagcggggtcgccgtgaagttggttattgaacccatgtggagtcaaactcccagggccgggagagccagtgttcgcggggagccgacccc

SEQ ID NO: 36342 - DNA, 72 bp, Homo sapiens
  misc_feature 1..72: note = chr17:3438866-3438938
  misc_feature 1..72: note = hyper
  source 1..72: mol_type = genomic DNA
cgaagtagaagccttcgtgttggtacttggggttgaagaaggcccccttggcgtgcgcgttgacgtcggcgc

SEQ ID NO: 36343 - DNA, 74 bp, Homo sapiens
  misc_feature 1..74: note = chr17:3599635-3599709
  misc_feature 1..74: note = hyper
  source 1..74: mol_type = genomic DNA
gcagccccccggatgcgcaggaccgccctgtgctgttgcccagctgaaagcagcgatcgcggaggagaggaagt

SEQ ID NO: 36344 - DNA, 183 bp, Homo sapiens
  misc_feature 1..183: note = chr17:3866983-3867166
  misc_feature 1..183: note = hyper
  source 1..183: mol_type = genomic DNA
ctgctagctgataagcggcaccttcctgggcgttttctggagccctcaggggagaccctggggccagctgggaggccgagcctgagtctccggccgtccctcgcccgccggtgtctgcgctgcacctgcaggatgccagcgggagcggcgcggcgttggggtggaatacggtccaggatgggg

SEQ ID NO: 36345 - DNA, 513 bp, Homo sapiens
  misc_feature 1..513: note = chr17:4544491-4545004
  misc_feature 1..513: note = hyper
  source 1..513: mol_type = genomic DNA
agaaagcgagaggaccgacggcggctccagtgactgctgagtttccagacaagggagctttgtgcaatgaggggcgcacaggagcatgccctcaattccaaggagatcgggtagcggcaacatttattgagcgcttactgtgtgccaccgactgccctaaagccccccacccccgtggcctccgcgcgctttgagcccaatgcgcgggcccttggcaaagagaatcggccagaggccaacgggggcgcatgtcctccccggtatttgactgactcggagccaggggcgcagcccaccccgcccggctctggggagctcaccttgccccgtgcgggccacagtcgcttcccgagcgccgcctccccgtgctggccgaccagccacagctgcacctggttgttggaaccggcatagagcgaggccccagtggacacgcggatgcggtagagacccatcttgctcaaagatgtttcgctccttctggtggagaagggtggacgagctaaataaccc

SEQ ID NO: 36346 - DNA, 154 bp, Homo sapiens
  misc_feature 1..154: note = chr17:4981395-4981549
  misc_feature 1..154: note = hyper
  source 1..154: mol_type = genomic DNA
gtccccgcgggaatgcgaagcggattctcgagttcttgagcctagagcaatgcttggggagcgacacgagggcgcagagcggcagatcgcggagcggaagttcatccccggagccgttctaggaaacccggaggactcaggtcgtcaatgattc

SEQ ID NO: 36347 - DNA, 34 bp, Homo sapiens
  misc_feature 1..34: note = chr17:4981951-4981985
  misc_feature 1..34: note = hyper
  source 1..34: mol_type = genomic DNA
cgtttaggcccgttctgaccggggttcgctgtgt

SEQ ID NO: 36348 - DNA, 282 bp, Homo sapiens
  misc_feature 1..282: note = chr17:5000354-5000636
  misc_feature 1..282: note = hyper
  source 1..282: mol_type = genomic DNA
cccagtgggaaggagcggggacgattctggcgatcacatgaggaagggagcagcctcagcagcgcaggtggacacagtcgtcaaccactcgctggccgcctgcgacgtgaagcacctgcgctgggcgcggcgggtaagcgccgacactagcgggcgcctgaacagtccagcggcgtcagcgctgcggagcaggaaagggtcccaaacgcagggcggccatgcagcgtggcgcccacctgtccctctcctcgaagcgctgagccagcacgatgcacataaggg

SEQ ID NO: 36349 - DNA, 57 bp, Homo sapiens
  misc_feature 1..57: note = chr17:5000879-5000936
  misc_feature 1..57: note = hyper
  source 1..57: mol_type = genomic DNA
aaaagtccccaaatgcgctagaggccagccagcccggtatccgagaggtaagagccc

SEQ ID NO: 36350 - DNA, 58 bp, Homo sapiens
  misc_feature 1..58: note = chr17:5001149-5001207
  misc_feature 1..58: note = hyper
  source 1..58: mol_type = genomic DNA
gggcgggctctggggcgtccgcggaggctcccgcgtgcgtgtgcggggtggggtcggg

SEQ ID NO: 36351 - DNA, 37 bp, Homo sapiens
  misc_feature 1..37: note = chr17:5973300-5973337
  misc_feature 1..37: note = hyper
  source 1..37: mol_type = genomic DNA
gtgtcaggcagtgtgcggctgtcgctgtgagtctgca

SEQ ID NO: 36352 - DNA, 270 bp, Homo sapiens
  misc_feature 1..270: note = chr17:5973825-5974095
  misc_feature 1..270: note = hyper
  source 1..270: mol_type = genomic DNA
cgtgggtccgcttgccgcgggcggccggagacgtgcgggcgccggggcttctgggctccgggcactgcggggggctgcgggctcggcgcccggggaaggcgggccatgggcgcgggtgcgggcgccccagccggccgcgatcgcggggtgagtcctgtctctcggcgctccagccggacccccgcgcgggctgcgagcagggtgttccccttgccgcgggcaaacaagtttgtgcagacgcggttgggagcgcggcggggctgcacctgc

SEQ ID NO: 36353 - DNA, 612 bp, Homo sapiens
  misc_feature 1..612: note = chr17:6616271-6616883
  misc_feature 1..612: note = hyper
  source 1..612: mol_type = genomic DNA
gatctgtgctcacttcgaggtttccgtgcttgcctggacggctcttgcgccctgggatctgtaaaccccaagggtggtgcgccctggggtcgccatgcccctcagattctttacagggcacctcccatccggcacctggagctcctgagtgcgcgcgccccgggagagctgtgctccccgcgaaatccgtgcgctccagctcagggctcccgggatcggtgcccgttagtgggcacaggacgccgggtgtccgaagggctgcctggagatgcaactgaccttggcgggcatcagaatgacgagtggcagcagcaggagcggggtgacgaacaagatcacgaaggacttgaacttggagacatagctcagcgccgaggccatcgcgcgggagggagactggcgggcgagacgagtgaggggcagctagaggcgccgcgggcttaagaaggggccacagtccccggggattggggagggggcggtgacaactccgccccgcacgggggcgcctccccgcggccctggggcggggccacccctcggggtctgtgggacgcgcctgcccccaattctgccacccggcggcggtgggaggcgtctttggactccaac

SEQ ID NO: 36354 - DNA, 174 bp, Homo sapiens; identical to SEQ ID NO: 4380
  misc_feature 1..174: note = chr17:6616884-6617058
  misc_feature 1..174: note = hyper
  source 1..174: mol_type = genomic DNA

SEQ ID NO: 36355 - DNA, 36 bp, Homo sapiens
  misc_feature 1..36: note = chr17:6679303-6679339
  misc_feature 1..36: note = hyper
  source 1..36: mol_type = genomic DNA
gcgcagaagcaagggcgggggcgtgccatcctcacc

SEQ ID NO: 36356 - DNA, 214 bp, Homo sapiens
  misc_feature 1..214: note = chr17:6679581-6679795
  misc_feature 1..214: note = hyper
  source 1..214: mol_type = genomic DNA
ggcggagcaggtaggcgcgctccagtccctgcagcccgagcggggttcagcgaacgggtaacgggagaatgcgggccggagcaggctggggtggcggtgggatgccccgaggcccgcggcggggaggcgggctgctctcatcaccccctctgggaagcatctttggctgcaggagttgccaggccaactccccctcccgcggtgggtaggacat

SEQ ID NO: 36357 - DNA, 30 bp, Homo sapiens
  misc_feature 1..30: note = chr17:6735130-6735160
  misc_feature 1..30: note = hyper
  source 1..30: mol_type = genomic DNA
tggccaaaggcttagcgcaggcgcaaattc

SEQ ID NO: 36358 - DNA, 230 bp, Homo sapiens
  misc_feature 1..230: note = chr17:6926198-6926428
  misc_feature 1..230: note = hyper
  source 1..230: mol_type = genomic DNA
cgaccaccccttgtttctgaggtcccgccctcgagacggagaccccgccctggactcgccatctggagagcgagggaggaaggaaggatacagacccaggcgttcaccccacctccacccccgcccccgacatcccggccagataaaggagccgaggccaagaggggagagagaccccgccccccttaagaagagaagccgcggcccctgcaggacgggggtaagaacaa

SEQ ID NO: 36359 - DNA, 36 bp, Homo sapiens
  misc_feature 1..36: note = chr17:7197656-7197692
  misc_feature 1..36: note = hyper
  source 1..36: mol_type = genomic DNA
cagcggggcccgaggcggctccgcccccgccgcccg

SEQ ID NO: 36360 - DNA, 30 bp, Homo sapiens
  misc_feature 1..30: note = chr17:7348931-7348961
  misc_feature 1..30: note = hyper
  source 1..30: mol_type = genomic DNA
gggtagggtgaaggacggacctgtgatcgg

SEQ ID NO: 36361 - DNA, 181 bp, Homo sapiens
  misc_feature 1..181: note = chr17:7554612-7554793
  misc_feature 1..181: note = hyper
  source 1..181: mol_type = genomic DNA
tggggggcctaggatcggtgcatcttccgccgcgctgccagcaccccgcagcgcgtggtcgtgcaccccggaatctgcagcagctgcatatctgaggggggtctcctttgcccgcgccgccttcgctccccgtgcttttgggtgtgtggagggcttcagcgcgcggcgcccccgcttctcc

SEQ ID NO: 36362 - DNA, 30 bp, Homo sapiens
  misc_feature 1..30: note = chr17:7621433-7621463
  misc_feature 1..30: note = hyper
  source 1..30: mol_type = genomic DNA
tactgctggcccctgcggtatttcctagta

SEQ ID NO: 36363 - DNA, 49 bp, Homo sapiens
  misc_feature 1..49: note = chr17:7976269-7976318
  misc_feature 1..49: note = hyper
  source 1..49: mol_type = genomic DNA
tgcgggcagagagctcgacagctgggaccagggccggccagcaccccct

SEQ ID NO: 36364 - DNA, 589 bp, Homo sapiens
  misc_feature 1..589: note = chr17:8055166-8055755
  misc_feature 1..589: note = hyper
  source 1..589: mol_type = genomic DNA
tgagcattttctgagcgccaggggaaaagggaaggttgtggccaacagcaggaaccagcgctgggaacgggatgttctagtccgaagtgggctgacatcacaggcggcgcagggccagggactggagaacagagacacggggagcgctgaaagcctaatagggtcctggtaccggggcaaacctggggcccctcgagtaacgagcaagaagaccggggcatgcccgctgagagtcggctgtggggccgggaaagctgggacggggaggtggggacaagctggaggtaagatgagtgggtcaggagtgcagactcccggtgcaagatttcgaggaggacttcggtccttgggggcagggagagggtgggtagcggtaaggacgacagtgtgccctctgcctgggccgaaagtagcccatcagattggaagtggcagcggtccggctcagggacggagatcggccccaggatggccgcagagatgcctacctggtcgcaggagtgtcctccgcacgcctgcccgccgccgctccagcccgcagccgagtggaagctccaccgggcgggcggggaggcgggttgcataatgc

SEQ ID NO: 36365 - DNA, 78 bp, Homo sapiens
  misc_feature 1..78: note = chr17:8230272-8230350
  misc_feature 1..78: note = hyper
  source 1..78: mol_type = genomic DNA
gtcgtctccaagccacggtctcaccaccctccatcagcctcgggcgacaccaaggggaacagagcgctggagctcctc

SEQ ID NO: 36366 - DNA, 470 bp, Homo sapiens
  misc_feature 1..470: note = chr17:8230351-8230821
  misc_feature 1..470: note = hyper
  source 1..470: mol_type = genomic DNA
aagtcctcccgaccttagcggggctccgttcatcctcccggacgtggccaggccccgctctggccccgcgcccgcccctcccgcggggctgcccctgtctctctgccggagacccggactcagtgagtgagcgcagcgcggccatagggcttcctgcagcggggtctcagcacgtcttctggctggactctggggtctcctggcctggctgtgtctcctggttctcagcgctcgcctcccacgcggggcggagtatgggagtgggctgctcccgcggaagaatcctggggaagttgaggcactggctcccgctgttcagaacactgcccgacgtccccagagctagccactcctccttcccacccacccgcagcactctcgaggtcgcaacggcagtcaccaggtcccggggcctgcgttcagctgcttgatccgactaggtttggcttcggacccgaatgggtcagctc

SEQ ID NO: 36367 - DNA, 38 bp, Homo sapiens
  misc_feature 1..38: note = chr17:8533161-8533199
  misc_feature 1..38: note = hyper
  source 1..38: mol_type = genomic DNA
gctccacggagggcgcggcaggacgccctcctcccgcg

SEQ ID NO: 36368 - DNA, 86 bp, Homo sapiens
  misc_feature 1..86: note = chr17:8868582-8868668
  misc_feature 1..86: note = hyper
  source 1..86: mol_type = genomic DNA
ccctacgacacagggcgtcctgtgtcagaggcaggaggctgaggacacagctgcgcagagccgcccagcagaggttacccggataa

SEQ ID NO: 36369 - DNA, 399 bp, Homo sapiens; identical to SEQ ID NO: 1275
  misc_feature 1..399: note = chr17:8868814-8869213
  misc_feature 1..399: note = hyper
  source 1..399: mol_type = genomic DNA

SEQ ID NO: 36370 - DNA, 257 bp, Homo sapiens
  misc_feature 1..257: note = chr17:8869214-8869471
  misc_feature 1..257: note = hyper
  source 1..257: mol_type = genomic DNA
gctctgacccgccagccctcggaagaagcagaccctggccggtccatggcagtggcccgaggggcaccagcgcggagcaccagcgacccccaaggagtaaggggaggttaggcccccgcgtcggaagcgcggctttggccccgcaggagggctgggcggagcaggggggcaggtctggggtaggggcttaggggaaagacgagaaagaggaagctccgacgagctgcttccttctctcactgcgacccacttcctct

SEQ ID NO: 36371 - DNA, 947 bp, Homo sapiens
  misc_feature 1..947: note = chr17:8906266-8907213
  misc_feature 1..947: note = hyper
  source 1..947: mol_type = genomic DNA
ggctggtgttctgcccgcgatgggcaggggagccgggtggccgcggggcgaggagccgcgagggccgggccggcgtgacaccacctggcggagtctcggggaagagtcttaaaggcgcgcgctcctccgtgccccgcgcactcgaacgggagccgcggagagctcgcctcccgctgccgccggcgcctcggggaggtaagtgccacccgcggatcccgagtcgcggccgggtgggggcggcccgcggctgccccgcgctcgggaagctctggctggggctgcggtcggagggcggcgcccaagttttcttgaaggcctcggagggcagctggagcggcgtagagcctgcgcggggatggcgggggtggccgcgggccggggccgtctgggggcggccatcccgggcggtgcgtggaaaagtaggcactggtgcgcggcgaggggcgcacgccagagccccagccccgcgtcctgcgcacttggcgcgctctggccgcggtcccggcgagccccagcctgctccgggccgcgaccccggctccgcgccttcctgcccgcccgggtcctttgtagcccgctggccccgcggtcgcgcacggtcacgccggcaggtcgcgctcggcggccggccaagccagccccggccctgccgcgcccgcgccccgggccaccccgcccggccccctcggcgctgcacccctcgctttccccatctccagccgctcgctattttcacacctcccggtgccccggccccggcgcctgattcagtgcttagtaattaatttggcgtttcagaatggtcagcgggctggataatgggtgcattcatcccccgggctaatctgaacagaggtgggaagaaaggctttcacagacagaaaatgccattcgccgagcgctcaaaggggctgtcactcccagaataaatcgccgccgcgcccgcc

SEQ ID NO: 36372 - DNA, 514 bp, Homo sapiens
  misc_feature 1..514: note = chr17:8907214-8907728
  misc_feature 1..514: note = hyper
  source 1..514: mol_type = genomic DNA
gctcctctggccatttccatacagctccggcccgcgccgcggacccgccggcctcggcctcggctcccgggaatcactcactcgagtgccttcgacgggaaagtcgggcgagagctggacccaggcgggggccgagggaaacggggaaactggagactcgggtgaaggccgcaggggacaaagagattgattagaaaatcaaacgcgcatctagaaggaggcgcaggcgactgctcaaggcgcggacggcggagctggggctcgggagcgtccgtccaaaacccccgaggttcgccaaagaggagggcccgcggcccagaccctccggagcgtgcccgaggcgacacggcaagcttctggggctcccaaattgtgaatggagttcaatgcacaagcatagatagtagaaacagggtcgacctgcacagactttttattccgagttccttgtgctatcagccccgtcgccctcgcggcctggaaggtgacacggtgtcttccccggcctcctgct

SEQ ID NO: 36373 - DNA, 22 bp, Homo sapiens
  misc_feature 1..22: note = chr17:8907776-8907798
  misc_feature 1..22: note = hyper
  source 1..22: mol_type = genomic DNA
cgggtgacggaggctttatcct

SEQ ID NO: 36374 - DNA, 123 bp, Homo sapiens
  misc_feature 1..123: note = chr17:8925590-8925713
  misc_feature 1..123: note = hyper
  source 1..123: mol_type = genomic DNA
ggcgggctggctgagcgcagctcccttctctccgcaggcgccttctgcggcaggcggacagatcctcggcgcggcagggccggggcaagctggacgcagcatgatgcgcgcagtgtgggaggc

SEQ ID NO: 36375 - DNA, 26 bp, Homo sapiens
  misc_feature 1..26: note = chr17:10101084-10101110
  misc_feature 1..26: note = hyper
  source 1..26: mol_type = genomic DNA
tcaggctctagactccggggtggaga

SEQ ID NO: 36376 - DNA, 317 bp, Homo sapiens; identical to SEQ ID NO: 1280
  misc_feature 1..317: note = chr17:10101131-10101448
  misc_feature 1..317: note = hyper
  source 1..317: mol_type = genomic DNA

SEQ ID NO: 36377 - DNA, 401 bp, Homo sapiens
  misc_feature 1..401: note = chr17:10102264-10102665
  misc_feature 1..401: note = hyper
  source 1..401: mol_type = genomic DNA
cggagggctgcgcgctccctcgcagaggggcctgtcactggggagaggggctcccactcgcgcccccaccgccggggaccgcgggaatggaaacgcccctctgttctgtgcctgctttgtaggcctggcggcccgtggcgtgcgggcggcttcttcgaggtgtctgcgagggatcgtttgtggttgtcattgtagtggttgaacctggggttgaacttgtctcaccggaaactgaacaatgggtgaaagacaggtttgaagcctggcgcctgagcccagcagcctggtggcagcgtggcacgctggagggacggaatggagagaagacggggtcggagttgatagaattggaaacagtcgatggggataaatggaggaaaggcgaacggtgagaggaacag

SEQ ID NO: 36378 - DNA, 432 bp, Homo sapiens
  misc_feature 1..432: note = chr17:10632918-10633350
  misc_feature 1..432: note = hyper
  source 1..432: mol_type = genomic DNA
tccgcgtctcttagacgggggagaaagtgggggctccccaagcagaaagcccaagtcccgtcctccccactaactgtgcgcccctgcgactctgcccgctagtcagttacacggcccgctaggccagggggcggagctgggagccgggcgggtccccctcccaccgcggccgcctgacctgcaccaaggccgccagcgcgaagaaggcggccatgagtccgttgcaggcccgccacagcgctggcgccatggctcggagaacacggcgcggggcggtgagtcctgccacgtgcggggcggtgagtcctgccacgtacggtccgccttcctccttgcgcggagggaccgagacccccgcctcggtttcggtgccttggggacactgccgtggccgtcgctccgcccgggggcggggagcgaagggcgtgggtg

SEQ ID NO: 36379 - DNA, 60 bp, Homo sapiens
  misc_feature 1..60: note = chr17:11145224-11145284
  misc_feature 1..60: note = hyper
  source 1..60: mol_type = genomic DNA
gcccgagaacaagtacgacccggagaaggacaagaccaacttcaccgtctacatcacctg

SEQ ID NO: 36380 - DNA, 32 bp, Homo sapiens
  misc_feature 1..32: note = chr17:11501937-11501969
  misc_feature 1..32: note = hyper
  source 1..32: mol_type = genomic DNA
cgcctgggagcgttgcgcggggagtgctgagg

SEQ ID NO: 36381 - DNA, 50 bp, Homo sapiens
  misc_feature 1..50: note = chr17:12568739-12568789
  misc_feature 1..50: note = hyper
  source 1..50: mol_type = genomic DNA
ccgcgtgaactgtcccgcgggcgcgcacgccctttcgcgcagcctttgca

SEQ ID NO: 36382 - DNA, 33 bp, Homo sapiens
  misc_feature 1..33: note = chr17:12877698-12877731
  misc_feature 1..33: note = hyper
  source 1..33: mol_type = genomic DNA
aggcctcttggatttcgtcgtttcccatgcccc

SEQ ID NO: 36383 - DNA, 103 bp, Homo sapiens
  misc_feature 1..103: note = chr17:13503842-13503945
  misc_feature 1..103: note = hyper
  source 1..103: mol_type = genomic DNA
ctcaccggtaccaggcgaggcccttgtcgtagctgcggtcgaagaagtggggctcggcgcccacggcgcgcacgtcggggtgcacgcgcaggaactccagcag

SEQ ID NO: 36384 - DNA, 116 bp, Homo sapiens
  misc_feature 1..116: note = chr17:13504194-13504310
  misc_feature 1..116: note = hyper
  source 1..116: mol_type = genomic DNA
cgccgccggccacaccgccagctccctcgggcctccggccaggacgccgccaccaggggcccccgcctcctcgccgccgccggacagccccacgacggggccggacagggtctggc

SEQ ID NO: 36385 - DNA, 213 bp, Homo sapiens
  misc_feature 1..213: note = chr17:13504557-13504770
  misc_feature 1..213: note = hyper
  source 1..213: mol_type = genomic DNA
gtgcgcccctgtggccgtgcgaactgtcccgggaggcagcggccggggctccgcggggaaacggaatcccgggggccccgcgcaggatccctgcctccagtcgagggagcgggaaggggaacgcgggtccgtgcttaagaaaccatcgtcttagactcgcccaagtcctgagcttggggcagccttggcccctcggttccccgcaagagtcgc

SEQ ID NO: 36386 - DNA, 571 bp, Homo sapiens
  misc_feature 1..571: note = chr17:13505001-13505572
  misc_feature 1..571: note = hyper
  source 1..571: mol_type = genomic DNA
cgcccgagttcaggttctctcagccaaggagcgaggtccccccgagtccctctgcccgagcgggagacaggaggcccgtgcagagccgtccacccctctccgtagcgccgggttgctccaaactgctcttggaccccacctgtgagccgcgtggctgggctgggctgggctgcgcgggacctgtcagcggcccccgccactctgctcgcaggcgctcaccggctgcctcctgggccgccgctggccgccgccacacgtgggacgccgagggcagcaaacttgctggtgacgtcaaaggcccgggccggaccagcccccggacgagcgcagcggggcgcggaccagcggccaggcggggccagacgggcggggtgggatggagaaaaggtggcgcgggctccgcagcagccgcccaatggcactggagagggcgggggcggcaggggcgacgccccttccccagtgtcccccattcctccccgcggcttcgcccccttccagtggatccggtgtctgcggcggctccggggttgcctgagtgacagctaaggccggccggatctctgggggc

SEQ ID NO: 36387 - DNA, 152 bp, Homo sapiens
  misc_feature 1..152: note = chr17:14200755-14200907
  misc_feature 1..152: note = hyper
  source 1..152: mol_type = genomic DNA
gttcccttcccagtccgctggggagacaactggccgcggctgccctctgctccgctcccggctgtcccgcagctgcgaggccggggccagagcgctcccttccgggcgggcatcggagccgctgcggcgccgaccgcccttcgcgcccgggc

SEQ ID NO: 36388 - DNA, 278 bp, Homo sapiens
  misc_feature 1..278: note = chr17:14200930-14201208
  misc_feature 1..278: note = hyper
  source 1..278: mol_type = genomic DNA
cgcagctgctaacccccgaggggccgcctcgctggcgaggggagcgggaggaaggtccggattccggtggcaggaactggggctctgggccaccggttcaggctgccccaggaaatgcctgctttgcggtgccgcagagggtatagaggagctcggccccagagggtggctgttggggaggcggagctggccgcaggctggagcagctgcggagcctcccatcccgagcctagaatcggagaaatttcaggcggaaaatactgcggggatggtttggc

SEQ ID NO: 36389 - DNA, 244 bp, Homo sapiens
  misc_feature 1..244: note = chr17:14203027-14203271
  misc_feature 1..244: note = hyper
  source 1..244: mol_type = genomic DNA
ttctgtccccggaaccgcttgcagccaggagttggaggccctctggccccgcagaggctgggttgcaggcatcgaaaacttcctgaacacgaccagtaagaatttgatctcgagcttccgaactccaaacgcctgggcaagaattcagcaaagcgcagcaccgctcacccgcacttcccccagctagcggttgctgtttcttggaagacgcgtttatccgccccagtcccgggtgggtgggtca

SEQ ID NO: 36390 - DNA, 231 bp, Homo sapiens
  misc_feature 1..231: note = chr17:14204011-14204242
  misc_feature 1..231: note = hyper
  source 1..231: mol_type = genomic DNA
catctgggcaactaccgccaaggctggcttctagggaacgagtgcggaaatgcgtgcgggtgtgggagcgcaccactcagtagggtaggacctctcccagcgctaggtcactgcagcattcttcccaccatctgctcctgtcaccagcccctaactccgcccctttgggcccgccccttgttccgaagccaatagcaacccctgaccgccctacaccgcccagaagccttt

SEQ ID NO: 36391 - DNA, 103 bp, Homo sapiens
  misc_feature 1..103: note = chr17:14204731-14204834
  misc_feature 1..103: note = hyper
  source 1..103: mol_type = genomic DNA
cacccgggcgtccagcgtgccggggaaccctctctgcgctcactgcccggcgggacccacgccatgtgctgagccatgtccctggccgcgcccgcgggcagcg

SEQ ID NO: 36392 - DNA, 566 bp, Homo sapiens
  misc_feature 1..566: note = chr17:14205251-14205817
  misc_feature 1..566: note = hyper
  source 1..566: mol_type = genomic DNA
ggccatcatcatcggcgtgaagaagggcggcacgcgggcgctgctggagtttctgcgcgtgcaccccgacgtgcgcgccgtgggcgccgagccccatttcttcgatcgcagctacgacaagggcctcgcttggtaccggtgagtttccctgccaggggcagggtctccatcgtcgattcagaccctgagctaagggagacatggcgtatgatagggaattggcagggttacagcttcggaccacccggggtagggcagggaaactacggcagattgcgcagcgcatcctgtccgggtgcggtgagggttgcgctccgcttggttctcgtcacaacccacagaaagttctcgcggagcactggtgcccttgaattcatcaggcgacctcgccgcaaagaagaagggcagcgactgagaccgccctcagcaaagcgagccaccctctaaccatgggggtatccgactcgaatcgtattttatgactcgttttaaattttttcctcccggagcccgagacgctgggaatgttctgagcccctttggtcggtctccgccctcaaggaact

SEQ ID NO: 36393 - DNA, 134 bp, Homo sapiens
  misc_feature 1..134: note = chr17:14206209-14206343
  misc_feature 1..134: note = hyper
  source 1..134: mol_type = genomic DNA
ggagcaaagaatattcggggcccattgattgagaaatgagggttgcttcgaggtcgcggcttccggaaattctgttctcgagtcgggttgcgggtcaggttccaaagggacagtggccccggggtcacaatcac

SEQ ID NO: 36394 - skipped

SEQ ID NO: 36395 - DNA, 30 bp, Homo sapiens; identical to SEQ ID NO: 12624
  misc_feature 1..30: note = chr17:15164652-15164682
  misc_feature 1..30: note = hyper
  source 1..30: mol_type = genomic DNA

SEQ ID NO: 36396 - DNA, 786 bp, Homo sapiens
  misc_feature 1..786: note = chr17:15166015-15166801
  misc_feature 1..786: note = hyper
  source 1..786: mol_type = genomic DNA
acttggccttaaatgcgcctcaagaaaaagtcggtccctgcaaaaccgcggcgacttttactcgaaaccagaggcggctgagctttctcacctcccacctcccttctcccctggccccgtggagacctagtgttgaccgagaaactggctcctcagcccactctgggaagacccagccaaatgtagctcagcggatgcccagggctgggcttctgggcccgccgacgccgaccgcgcccgcgcggggctgaggctggattcctttcccactaatagagggcagcgggcgcttgagcgctggaagaagtccctctcctctcgggtcctggagcccctgccctgtcctggcgtcttagccggacacacctgccccgcgccggtccccgctattactgtctgcacctacgaagcatgccagcttcctaggattggcggggattgatctagcgggctcctcttgggtgcgaattaggggaagaaaagtccggccgactactggatagcatggtctgggattgggctcctcctagcctaggcaaaaccagactaccaccgaataagctctaggcaaagtgttcctgcagcagtcgggcttggctgtcagccttggctggagtcctggccatggggtttggcgggcgggtgcgaggtggccatttgaggtggggttggagcagccaaggaaatcagctgattcatagcctcctaacgtggcccgcccagcgttacagggagagaggctagcccccttcagtctcggcttggcagaggcgcgcccaactgaga

SEQ ID NO: 36397 - DNA, 86 bp, Homo sapiens
  misc_feature 1..86: note = chr17:15244447-15244533
  misc_feature 1..86: note = hyper
  source 1..86: mol_type = genomic DNA
tgaagcagagggggacgaggaacagcgtgcggggcggccagcaccgcagtggaaaggcacagcgctgctaacgggtaattattaga

SEQ ID NO: 36398 - DNA, 145 bp, Homo sapiens; identical to SEQ ID NO: 12627
  misc_feature 1..145: note = chr17:15244987-15245132
  misc_feature 1..145: note = hyper
  source 1..145: mol_type = genomic DNA

SEQ ID NO: 36399 - DNA, 253 bp, Homo sapiens
  misc_feature 1..253: note = chr17:15820777-15821030
  misc_feature 1..253: note = hyper
  source 1..253: mol_type = genomic DNA
cgcccatcctgggaccgcgcccctgcaccatgtggacggtgcaggctgggctggggtctgacgcccgaggaccccttccccctgcccagccctgcccccgcaggcactggagggctcccctaggcggggctccgggctagggaacagggatgcccagcaatctcgcgctcccggggccggactccagcggcaggggcctccccaggctgcggctccgcgccggtgacgggggctctgccgaagggctcctgcc

SEQ ID NO: 36400 - DNA, 84 bp, Homo sapiens
  misc_feature 1..84: note = chr17:15847883-15847967
  misc_feature 1..84: note = hyper
  source 1..84: mol_type = genomic DNA
gggggctgcagcccccgagggctccttgcagtccggccccgcagcctggagacagctccggtggtgctgcgctgcccgagactg

SEQ ID NO: 36401 - DNA, 30 bp, Homo sapiens
  misc_feature 1..30: note = chr17:15849181-15849211
  misc_feature 1..30: note = hyper
  source 1..30: mol_type = genomic DNA
aaaccccggggaaagcgtcacccccgggga

SEQ ID NO: 36402 - DNA, 25 bp, Homo sapiens
  misc_feature 1..25: note = chr17:16310306-16310331
  misc_feature 1..25: note = hyper
  source 1..25: mol_type = genomic DNA
cgtcccaaggcgcctggctcaccgc

SEQ ID NO: 36403 - DNA, 393 bp, Homo sapiens
  misc_feature 1..393: note = chr17:16472011-16472404
  misc_feature 1..393: note = hyper
  source 1..393: mol_type = genomic DNA
tgccttgcctcctgtcgcctccccttcccggccaagtccctctgcctcttactcctcttcagccgcagggtcgaggtcgagggcagcgggggagtcggggaccgtgcgacgcgcaacgctgggactgggcccacagcagcctccaccccgtctttgccctcccgcaagccacgagcacgggagcccgcgcgtggacgggctcgggctgtcactgatcgcgcggacactcgcgcgctgcgcccggacatcaatacctgtcgctgggacccggccgacgggcagccggagcggccctaaggccacaggcaacaatggcgacgctggcacaggcgcctgcgtggcgggctcagtcccgagcggcagcggatcctcgggctccgccacttcccttcc

SEQ ID NO: 36404 - DNA, 149 bp, Homo sapiens
  misc_feature 1..149: note = chr17:16472622-16472771
  misc_feature 1..149: note = hyper
  source 1..149: mol_type = genomic DNA
acctcctccacccatcgctctgacttgcttgtcagcctgcgaggttccgaagggaacttcaaagtttccccgggcagacgcaggtctggtagacgtcttggaggccagggaggtgccagtagctggaggagcgccgggagttgaagccc

SEQ ID NO: 36405 - DNA, 39 bp, Homo sapiens
  misc_feature 1..39: note = chr17:16492416-16492455
  misc_feature 1..39: note = hyper
  source 1..39: mol_type = genomic DNA
cgcccacccccttcccgccgtcagcgattcctcctcctc

SEQ ID NO: 36406 - DNA, 64 bp, Homo sapiens
  misc_feature 1..64: note = chr17:16570208-16570272
  misc_feature 1..64: note = hyper
  source 1..64: mol_type = genomic DNA
cgtggagggagcgatgcccccgcccgggactcctggtgggtgatggcgccgggaggccttggct

SEQ ID NO: 36407 - DNA, 285 bp, Homo sapiens
  misc_feature 1..285: note = chr17:16570654-16570939
  misc_feature 1..285: note = hyper
  source 1..285: mol_type = genomic DNA
ctgaggagctgaggggctgaggcggctgaggggctgaggctggtgaggggcttgaggggccgagcggataaggcggctgacgcggctgaagggactgaggggctgaggtggctcaggggctgacgcgggtgaggggctgaggggctgaaaggctgaagggcgggcagcgtgccgggtccctgcggctgggtccaccgcacgtcacgtggcagaatcccggggctgctttctctccggctgctcagccacttgttttctcactgtgaacctcgtgggctcctgctc

SEQ ID NO: 36408 - DNA, 30 bp, Homo sapiens
  misc_feature 1..30: note = chr17:17204181-17204211
  misc_feature 1..30: note = hyper
  source 1..30: mol_type = genomic DNA
gcagttgccctgctgcggctctggcccagc

SEQ ID NO: 36409 - DNA, 63 bp, Homo sapiens
  misc_feature 1..63: note = chr17:17398606-17398669
  misc_feature 1..63: note = hyper
  source 1..63: mol_type = genomic DNA
cttcttgttccgcagcgccttcttgtgcagcacgtcgcagtactgcaccgagaccttgcggtg

SEQ ID NO: 36410 - DNA, 74 bp, Homo sapiens; identical to SEQ ID NO: 12631
  misc_feature 1..74: note = chr17:17398902-17398976
  misc_feature 1..74: note = hyper
  source 1..74: mol_type = genomic DNA

SEQ ID NO: 36411 - DNA, 30 bp, Homo sapiens
  misc_feature 1..30: note = chr17:18314944-18314974
  misc_feature 1..30: note = hyper
  source 1..30: mol_type = genomic DNA
ttctcctctcccaatcgtcttctttcccag

SEQ ID NO: 36412 - DNA, 95 bp, Homo sapiens
  misc_feature 1..95: note = chr17:18538190-18538285
  misc_feature 1..95: note = hyper
  source 1..95: mol_type = genomic DNA
tcagcccctcagccgcccacgcctctgctcgctcacccgcccggctgccttaggggtcggcgctgcccagcgggctccagcgcagcctcctaccc

SEQ ID NO: 36413 - DNA, 618 bp, Homo sapiens
  misc_feature 1..618: note = chr17:19436820-19437438
  misc_feature 1..618: note = hyper
  source 1..618: mol_type = genomic DNA
ctctgggtccttccacgccaggtcattcagaacctgaaacccccagcggaggtggagagccggggtgagtcctggcgtccgagacgtggaggacccagcccccggagcgcgttccgttagtttacagagctttttcaaactttgccttccaagtgcaggagttccttggtctttgcaagacccgcaggcgtccgcagtggtgcagagagaggtgcaaggggcgcgcccaaggtcgcaggctgcctggctgcgcgctcagtcgggcccccgggcgccaggcgcggggcgggctctgggcgggcggccggggcggggactgcagagcaggctgcactgcgcggtacccactgccggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcggtgagtaaggtggcctcagtggcaggccggtaccggcgggctggggacctg

SEQ ID NO: 36414 - DNA, 222 bp, Homo sapiens
  misc_feature 1..222: note = chr17:19483136-19483358
  misc_feature 1..222: note = hyper
  source 1..222: mol_type = genomic DNA
cgggacggggaggggcggggctgggtgggatcgggtcgcccccctcacccccacaccgcgctgcggtcccgcgcccgcgccgccgccagccgctcccagcctccgcatggaggcccctgcggccgccgacgccccggtccccgccgagctccccgccgccgccaaggaccggcccccatagcggctccgggccctcggatggcgtgacggcttgtggggcct

SEQ ID NO: 36415 - DNA, 34 bp, Homo sapiens
  misc_feature 1..34: note = chr17:20747407-20747441
  misc_feature 1..34: note = hyper
  source 1..34: mol_type = genomic DNA
aggtgatcgacttctcgcacgggctggcgctcta

SEQ ID NO: 36416 - DNA, 121 bp, Homo sapiens
  misc_feature 1..121: note = chr17:20755828-20755949
  misc_feature 1..121: note = hyper
  source 1..121: mol_type = genomic DNA
agtcctgttggttcacgccccgggtgcgaataccaaaagcaactcccgctggaaagcctgcaggaaactcgagacaaagacagaggcaaacgcaacgctgggaagagccaggggtgctgcc

SEQ ID NO: 36417 - DNA, 43 bp, Homo sapiens
  misc_feature 1..43: note = chr17:20755950-20755993
  misc_feature 1..43: note = hyper
  source 1..43: mol_type = genomic DNA
tctgcaaaagcagagacgcgtctcccttcgggcaaagtgactg

SEQ ID NO: 36418 - DNA, 166 bp, Homo sapiens
  misc_feature 1..166: note = chr17:26120495-26120661
  misc_feature 1..166: note = hyper
  source 1..166: mol_type = genomic DNA
aggaatcccacagagcgcacatccccgccctccgatttctcccagagagagatggggccccgcccgggctcggagcccaccgcttccctcccagggcggacttcggcccgcggggtacctggctctgcgcgggcagcagtcaggcttcggccggaggatcctgcag

SEQ ID NO: 36419 - DNA, 197 bp, Homo sapiens; identical to SEQ ID NO: 12637
  misc_feature 1..197: note = chr17:26554556-26554753
  misc_feature 1..197: note = hyper
  source 1..197: mol_type = genomic DNA

SEQ ID NO: 36420 - DNA, 178 bp, Homo sapiens; identical to SEQ ID NO: 12638
  misc_feature 1..178: note = chr17:26554791-26554969
  misc_feature 1..178: note = hyper
  source 1..178: mol_type = genomic DNA

SEQ ID NO: 36421 - DNA, 335 bp, Homo sapiens
  misc_feature 1..335: note = chr17:26578290-26578625
  misc_feature 1..335: note = hyper
  source 1..335: mol_type = genomic DNA
gcacctgcagcccctcgcccagggcgccctccggcggcagcagcacccacacgaggccggccacgaccagagcgcatgagcagcgcagagcccgcgtctggagggggcagggcggacagagccgcgggcggtcacgtgaccccacggctggggtcggcgcgatccctgacggtagcttgcgggtgttccgcgccgtgggcagcctggcgtgcaggggcgctcagccgagggacgtggctatttctgggacacacaccagtgcacggacgccctaagggacatcctggtgcccaggggaatggtgcacacctggacatgcccggtgatgcacgcag

SEQ ID NO: 36422 - DNA, 202 bp, Homo sapiens
  misc_feature 1..202: note = chr17:27038906-27039108
  misc_feature 1..202: note = hyper
  source 1..202: mol_type = genomic DNA
ggggcctccggcgcctcccaggcccctctttatctcagaccttaaccttacaggcccagctctcaccacccatctctggttccagcttgcagtccaaaccccagattttcaccctgcctccagatcgtagccccaattcttagtgttacaacgagccttgcccccagccccattcttagccccgccccggccattctctaaa

SEQ ID NO: 36423 - skipped

SEQ ID NO: 36424 - DNA, 294 bp, Homo sapiens
  misc_feature 1..294: note = chr17:27332416-27332710
  misc_feature 1..294: note = hyper
  source 1..294: mol_type = genomic DNA
ggggaagcgggaccacgggccgccagctggaccgtcccgactcactgccttgcgccccccggcacgcgccccagcaccctgagatgcctagagtgtggcgaggtagcgcgcgggtgagcgcgtgtgtgcggggagtgggtggcgtgatgaattgcatcagagaaatcccattagatctggggagatgattaaagacgaggtctcggccgggcgcgaatggcgggagccgcggcagcttcccgcccgcgaagcccgcgccccgcccggcttggccggcgccgggggcagcgcagc

SEQ ID NO: 36425 - DNA, 30 bp, Homo sapiens
  misc_feature 1..30: note = chr17:27466437-27466467
  misc_feature 1..30: note = hyper
  source 1..30: mol_type = genomic DNA
cctctcccccacccccgggcatactgccca

SEQ ID NO: 36426 - DNA, 113 bp, Homo sapiens
  misc_feature 1..113: note = chr17:27940225-27940338
  misc_feature 1..113: note = hyper
  source 1..113: mol_type = genomic DNA
aggtgggggccaggacgccgcgggactgaccgcctccactagagggtggtggccgcgggccgccctggagcctccacgccgtgtcccggccccggccggtgggtgggtgcgcc

SEQ ID NO: 36427 - DNA, 321 bp, Homo sapiens
  misc_feature 1..321: note = chr17:27940590-27940911
  misc_feature 1..321: note = hyper
  source 1..321: mol_type = genomic DNA
cgagcagtagcgccccctgccgggaccctcgccagcgccacgcgcgccacgcccagggccaggagccagacaaaccccggcctgcgcgcctgcagagcggcggctggagactggagccaccgcctcgcgggtgcagcagcacagcaggcacggttcggggagggattcggcatggccgcggggtaccttcccaggccagggccctggaggcaactggcacggcctggtccccctgctttgctgtattctgattccccaacccgctcccctgggctcagatctgtcctgtcctagggcggagccaggcggtcctgaggggga

SEQ ID NO: 36428 - DNA, 671 bp, Homo sapiens
  misc_feature 1..671: note = chr17:27949457-27950128
  misc_feature 1..671: note = hyper
  source 1..671: mol_type = genomic DNA
cccgagcctgaggcccggcctccctgcacccttcttcagcctgctgccctgacactgcgttcttgcgagacgaggtgtctgcgccctccgggagcgctggctgctgtccggccaaatatagacaccacgtcctccccgcccgaaaccgaatttggcggcgcggggggaggaggcgcagacctctgcccctcagggaccccgcccgctccgctggctgcggtgacggccgggtgtggggggctgggtacctggtcctgagcgggctgcggggcgctcacgctgcgaatcctctgcggaaggggcccgagtgcgtagggggccgaggaaggcttcagggcgaaggagccacctctccgggtgtctgtagtatctgggacccgggtgtccagctccgcactctggccgatcctgcggctctctagagcccggcgccgctgcagccccagctgccgctgccatcaacctaagagggcggggctagcataggggcggggccagagcccaagttgccccgccccctccagcggcgggaaagtcgagcgaccccgactcccctcccagcttccgccggcctcggagaaccatcgaaaataaatgtgcagctgtgtgctaggtgcgcacgctgcttccctccctccatgactcccgggtaggctggggaggctcgggtt

SEQ ID NO: 36429 - DNA, 36 bp, Homo sapiens
  misc_feature 1..36: note = chr17:28088606-28088642
  misc_feature 1..36: note = hyper
  source 1..36: mol_type = genomic DNA
ggccccaagacactgctgcctcggtaagggagtgaa

SEQ ID NO: 36430 - DNA, 315 bp, Homo sapiens
  misc_feature 1..315: note = chr17:28562701-28563016
  misc_feature 1..315: note = hyper
  source 1..315: mol_type = genomic DNA
gcggcgctggctgtgcggaggggcgccggcgcggccgtatttgtacccgcgggccctcacatggtctgatctctagatagccgccgccaaagagctcttgaagaatttttgcgtcactttgaggcgaataaacttaatgcttccccgcggccgcggctccgcgctcccgctggatggggttgcgctcgccagggaggggccgcgctacggggcggggtgcgcgcccgaccccagagccaggaggggagggacccccgacacacacacacgctcgcagggaggagcggagcgcggagcagccggcagggcagggcc

SEQ ID NO: 36431 - DNA, 61 bp, Homo sapiens
  misc_feature 1..61: note = chr17:28563999-28564060
  misc_feature 1..61: note = hyper
  source 1..61: mol_type = genomic DNA
acaaccacgggcaagcgagggcagctcccagcgggtggagtccgcgcgggattctggtgcc

SEQ ID NO: 36432 - DNA, 175 bp, Homo sapiens
  misc_feature 1..175: note = chr17:28705281-28705456
  misc_feature 1..175: note = hyper
  source 1..175: mol_type = genomic DNA
aaagggagcctactacgtagcacatttccgctaggcataaaagagacacctttccagaaagcaactctaaaaatgaatgcaccgcctagtgaggtgcgagccttcctccccacgaggcgtcccgtgcaaccgcacgcggacagcggggctccagcggaggcggggtggatgcgga

SEQ ID NO: 36433 - DNA, 127 bp, Homo sapiens
  misc_feature 1..127: note = chr17:29020895-29021022
  misc_feature 1..127: note = hyper
  source 1..127: mol_type = genomic DNA
actttcccgcaagctcgcagagagcatcctccgcccacccggcaagcaccacttcatcacgccaccgccagggtgtcaggcggggctgagcggttgtcatttctctctaacccgtcagaactctgca

SEQ ID NO: 36434 - DNA, 482 bp, Homo sapiens
  misc_feature 1..482: note = chr17:29249457-29249939
  misc_feature 1..482: note = hyper
  source 1..482: mol_type = genomic DNA
cgcccgagtccgggctctcgatgtctgcgcacccaggcgcgccccacgccctcggactcagacatcccagccagggctaaacgtcgggcccaggccgccgacagtcctgtgccccctgcccgctcccagacgccccccgaaggcctccccagcgccccacctcggggacgccgagggccccctaactcagcctccccacctgcagctccgcgccgagccccgcggtgcgccccccgcgccctcctctcggttccttctgagtcccttcacttccacgtcgcgcagcctcagactctctccccgggccctgaactgcctccaggatcttcaccccggtcgccgcgcagcggccggtgggctaaccagaaggtgccaggctggccgcttagttcgccttaggtgggagaaggggcgccccacctgccccagtgccccgagcccagccctggtttcttcaccgcgctttccgctcagctcctctc

SEQ ID NO: 36435 - DNA, 30 bp, Homo sapiens
  misc_feature 1..30: note = chr17:29335681-29335711
  misc_feature 1..30: note = hyper
  source 1..30: mol_type = genomic DNA
ggcctcagcccctgacgctgtggtgactcc

SEQ ID NO: 36436 - DNA, 398 bp, Homo sapiens
  misc_feature 1..398: note = chr17:29718142-29718540
  misc_feature 1..398: note = hyper
  source 1..398: mol_type = genomic DNA
ctccagagatggcagcgaatcccggccctgcctcttgccagctgtgtggcctagagtgagtccgacctctctgggcctcagcttcctccgggatgaatgcagtcacggaacgcgccaatgcaggaggcccccaggacatcctgagcgctcgggagacgccaggcgcggcagcgggcacggatagcggaaaggggcgcgaccccgcggaatcctccggcagggcagggcctttgggtggctccgggtgtccagaggaaggggtgggctcggggacgcggagggaaactggggacgcggagggaaactgaggtcgcggaggacgcggccgttggcagctcgctgcgcctgccggccccgcgtgggccgccccactcgggaggacgcgggctccttttgtc

SEQ ID NO: 36437 - DNA, 464 bp, Homo sapiens
  misc_feature 1..464: note = chr17:29718778-29719242
  misc_feature 1..464: note = hyper
  source 1..464: mol_type = genomic DNA
ggcggccccggagggcgcgcggcgatggcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtaagctggcccgaccccagtcccggcccggggaccccagcccagccccgccgcccctcccccagctcccccgccgggtcacccgcgtggcccgaggcggtggcctccctcccaatcccctccctccgccggagcccaggacctcggccccccccgggtatccctggcccagccgggccctcgctttccgccccccggcgcccgtgccccgag

SEQ ID NO: 36438 - DNA, 243 bp, Homo sapiens
  misc_feature 1..243: note = chr17:29886485-29886728
  misc_feature 1..243: note = hyper
  source 1..243: mol_type = genomic DNA
tcggggcgcgggccccggctagcggctatggcccccgtgcccaggcagcggtgcgggctcggccttgcgggagggtgcggcctgctgcgagaggtcggccacggctcctgccccgcgccccgcgcccctcgcccgccgagctgagcgcaggtaaccgaggcagagcggagctgggcctcgcaggcgcggcgtgggagcgtggcgaagtttctcggcgcataactcttgcgccccactcgggag

SEQ ID NO: 36439 - DNA, 76 bp, Homo sapiens
  misc_feature 1..76: note = chr17:30846530-30846606
  misc_feature 1..76: note = hyper
  source 1..76: mol_type = genomic DNA
cggtcgccaaggcaacgccggccccagcgcccgcggctgaaacgaagccgctgcccgagcccgagcgccagcgcac

SEQ ID NO: 36440 - DNA, 118 bp, Homo sapiens; identical to SEQ ID NO: 1281
  misc_feature 1..118: note = chr17:31618291-31618409
  misc_feature 1..118: note = hyper
  source 1..118: mol_type = genomic DNA

SEQ ID NO: 36441 - DNA, 987 bp, Homo sapiens
  misc_feature 1..987: note = chr17:31618410-31619397
  misc_feature 1..987: note = hyper
  source 1..987: mol_type = genomic DNA
cggagggcaactcacggaggagaagttgtgcggcccgcagagctcgccgcggtacttgcaggagagcagcatgtcctccagctggtggcccaggcggtccatgaaggcggcgctgattccctcgaagtggcgcggaggcaggaagaggcggaagtccgccagcttgcggaaccactggcggcgcggctcgtcgccccgcagcagctcgctgacaagcgggcgcgcggtgcggttgggcagcagcagcccgagccagtggccggcatagtagaggtcccccttggagaggcgcgggaagcgcagcgggttgttgttgcacacagtgacggcggggaagggtaactggcggctccactcgcggtgcacccgcgtgtgtgacgggaagctgagccagtagagcaagcggttcgaggaccaggacagcagcaagccgaaggatgtacagaaggccagcacccacagcgcccgccgctggaaggagcccccagccgccgtgcgcccggcacacatgtgccgcagcccgtgcagtttagcgcggctcagcgatggccgccccctgcgggcgacccctggcccctgcagcgcccgctcgccgcctctgccgcccccgggctgcccggcagccgccaacgccgcgggcgccggctcctcgcgggccatgcggaagcgtcccgggccggtgagcgcggctgcgggcagcccggctccgccaatccggctcattcattcagcccgcggctggcggcagcggcggcggccccggccgggcggagccgccatgggagtccgcagcagcagtggaagcagcagcagcggcagccgcgcgcagcccgcgccagggaagcgtgcgcccgaaaggagctccggtggcgcggcatgcccgcccggcgccgccgctgccgcctccgcgggcgcccgcccggggctgagcgccgcctcagcccgcagcccctggcagtggcctctcccgagcgcctcccaggcttt

SEQ ID NO: 36442 - DNA, 760 bp, Homo sapiens
  misc_feature 1..760: note = chr17:31619687-31620447
  misc_feature 1..760: note = hyper
  source 1..760: mol_type = genomic DNA
gagcgcccccagaggcgcaccgcggctcctggctgggcgggcggggtgggtgtgtacgggggtgagtggtcgccttgccggctgccgccttctttcccttcccctccaggacccttccttgttactgctccctgggctgcgctcggcagagacctgcttaggcttccccaagtcctgcgcctaagtcctgccaggcgcccgctctcgcctggggctgagagcttctcagggcgtcctgcgggaggctgttcgccgccggggtccttcaaggatgctagccgcagggaagtgtcgcttctcgcctcggctctcccaggtgcctcgcgtctccagaaaagcccagccttgctgtctctcgcgtcttctctctgcccccgcggcgacaagagctggggactgcggggacccgccaacacctcccgggggtgacccggactcgctgctccgcgcgcccttctcctctcgagactccgagctcgcggtggccgtgacgccggctaagctccttccccggttgcccgggagaaccctctttgggccccaggcgaacttgggcagcggccgcgcgacgctggcgcggctgggctccgagcacctgctcctcagctcgctggccccgcggctccgggcgggcggggcggcggcggccgtgagcgccgtgcgctcctggagacgcggtgctgacgcgcccggctcctcctcgctgcattttaattcctggccactgtggccgctgcacaccgagcgggaagcctcttgc

SEQ ID NO: 36443 - DNA, 127 bp, Homo sapiens
  misc_feature 1..127: note = chr17:32483992-32484119
  misc_feature 1..127: note = hyper
  source 1..127: mol_type = genomic DNA
tgggggatgtcagggcggccacgctgatgcactgcggtcgggcgcagcggcacagccttcagagccgccgccgctcggttccttttcccatgatgttttggactccgaatgccgtttctcgccgccg

SEQ ID NO: 36444 - DNA, 57 bp, Homo sapiens; identical to SEQ ID NO: 12653
  misc_feature 1..57: note = chr17:32906021-32906078
  misc_feature 1..57: note = hyper
  source 1..57: mol_type = genomic DNA

SEQ ID NO: 36445 - DNA, 244 bp, Homo sapiens
  misc_feature 1..244: note = chr17:32906312-32906556
  misc_feature 1..244: note = hyper
  source 1..244: mol_type = genomic DNA
gcggaatcgcgaggtcggcccttggcccgagtctcattaaggagccgcgcgcgccgccaggctaggaatgcggaatggacacgtggacagaggagggggagctaggagtcggggagtctccgtggcgcgcgagctgtgggccgcgcgctcgggggccacgtgaccacggggaatctgggaggggtgggagtgagcgcgccaagctcggcgcccgcttctgcccgggtgggcgctgaatcccgga

SEQ ID NO: 36446 - DNA, 216 bp, Homo sapiens
  misc_feature 1..216: note = chr17:32906598-32906814
  misc_feature 1..216: note = hyper
  source 1..216: mol_type = genomic DNA
cgagtcatttacggcggagcagccggcgcgagcgccgaggaggcggcgacggcggcggcggctgcttcgtgcaactgtggcttcccccacctcctcttcctttttgctcctcgattcttcttcttcccccacacacgtccatggggagccggctcccctgccagcacctcctctcctctcggccccgtaggcaccagctgccgcttccctggccgc

SEQ ID NO: 36447 - DNA, 153 bp, Homo sapiens; identical to SEQ ID NO: 12654
  misc_feature 1..153: note = chr17:32907265-32907418
  misc_feature 1..153: note = hyper
  source 1..153: mol_type = genomic DNA

SEQ ID NO: 36448 - DNA, 85 bp, Homo sapiens; identical to SEQ ID NO: 4393
  misc_feature 1..85: note = chr17:32907620-32907705
  misc_feature 1..85: note = hyper
  source 1..85: mol_type = genomic DNA

SEQ ID NO: 36449 - DNA, 99 bp, Homo sapiens; identical to SEQ ID NO: 4394
  misc_feature 1..99: note = chr17:32907706-32907805
  misc_feature 1..99: note = hyper
  source 1..99: mol_type = genomic DNA

SEQ ID NO: 36450 - DNA, 274 bp, Homo sapiens; identical to SEQ ID NO: 4395
  misc_feature 1..274: note = chr17:32907873-32908147
  misc_feature 1..274: note = hyper
  source 1..274: mol_type = genomic DNA

SEQ ID NO: 36451 - DNA, 761 bp, Homo sapiens
  misc_feature 1..761: note = chr17:32908170-32908931
  misc_feature 1..761: note = hyper
  source 1..761: mol_type = genomic DNA
cgcggcgcggactgggggtgaggatgcggcaggcgccactggagggggtacggggaagactggggagaggagcacccacaccccctggactcgcagccgccactccgggtttggcgtctctggctgcagctcgagttaccgccagcccccgagccctccggcgagctcagctgaggggaccgagcccggcgccagaaaagggtggggggagggtgtcgctccagtcctctcctggttataaagaagggttcgaacccgaaggtctggggtcgtgtccgcccacggaaatctagagggatccgagggatcctccggatcgcgtccaggccgccccccgcccccgtctctccctgcagccggccgggctgggggctgttgggatccgccgggatcgcgtctttcctcgccccgggcgcgcaggccggtgcggggccgcgccgcccgtcgcctcgcttcctgcggcggtcctcgggaagggaagtggactgactccgggccggggagccgccgcggctcgcacgcccgcggtcctgtgagctgcatctaaatggccggcttaggcgagcccggagggcgggggtctgggcacccgcacaggccggggcggtgggccgcgggccgcgcgcggagggagcgggctccgcgctctcgcattctgcaatctgttgcgtctgctccccaggctcgccccgggctccgcggtaaagggggtgggagaaggagggattgaggttggcgcgctttggcggtgggacagcggg

SEQ ID NO: 36452 - DNA, 32 bp, Homo sapiens
  misc_feature 1..32: note = chr17:33672862-33672894
  misc_feature 1..32: note = hyper
  source 1..32: mol_type = genomic DNA
gagaaaaaaaaaagacgcggaactgtcttcag

SEQ ID NO: 36453 - DNA, 164 bp, Homo sapiens
  misc_feature 1..164: note = chr17:33673326-33673490
  misc_feature 1..164: note = hyper
  source 1..164: mol_type = genomic DNA
gctagttcctgtttcaaaaaagaaaaaattcctcaaatgttaattatgaaatatttcagaagtacgaaaaagtgtaccaccaccggcgctaccacttccaccttggcaagtgaagccccactacaatggaagcgtcgggcgtatcctcccgggcctctttccct

SEQ ID NO: 36454 - DNA, 301 bp, Homo sapiens; identical to SEQ ID NO: 12660
  misc_feature 1..301: note = chr17:33700472-33700773
  misc_feature 1..301: note = hyper
  source 1..301: mol_type = genomic DNA

SEQ ID NO: 36455 - DNA, 402 bp, Homo sapiens; identical to SEQ ID NO: 12661
  misc_feature 1..402: note = chr17:33700974-33701376
  misc_feature 1..402: note = hyper
  source 1..402: mol_type = genomic DNA

SEQ ID NO: 36456 - DNA, 117 bp, Homo sapiens
  misc_feature 1..117: note = chr17:33775327-33775444
  misc_feature 1..117: note = hyper
  source 1..117: mol_type = genomic DNA
tctgcctgtttgttccgcccccgcggaaaccgctgctcgctgggcaggggctttctgttttgcagccggaacaggaacacagatagcccgccaagccgccggcgacaccttccaacc

SEQ ID NO: 36457 - DNA, 399 bp, Homo sapiens
  misc_feature 1..399: note = chr17:35014243-35014642
  misc_feature 1..399: note = hyper
  source 1..399: mol_type = genomic DNA
aggggagggaagggacgcggggcggaggacgcagcgggcggcctgcggaggcggcctggctcggggtgggggctcggccggagttcccgcggctgctcggcggcggccggctcgggagcaaccttgagcgcggtcgcggaggcagtgatttaggtgccggcaccggagcgtgaaggtaaatggccacatttcaccgtcgggaggtgagccggaggcgcccgccctggcccttcccccaaggccccgggccggtgggggcgggagttttgcttcccctctctgacccgctccgaggcccgcctgggagggcggcgcccccacggtgcaggacaggagggctgcgccgggctgcggggtgagcaagacccctagagctgcctttcccgaccccttcctatt

SEQ ID NO: 36458 - DNA, 362 bp, Homo sapiens
  misc_feature 1..362: note = chr17:35060253-35060615
  misc_feature 1..362: note = hyper
  source 1..362: mol_type = genomic DNA
aggggaggcacaaaccgttcagctcagctgggaagaaatcggctcaagcccatcagagtgacagatacccggggaggctgggcgtgccaagctggaccggtccggccaggctggaagcccagctgcccgctttttctcagtgcctggagaccgcccgccttttcagcaccacggtcagcggccttttcgcaggcgcgcgccccagccccgccccgggttgggctggcatccagcctcccggcccttctgcgtgtccctcggcccaccggcatcccgggctggaggtgtgggtggggcaggcgaccggggtatgagaggcggtggggtgcctcctccgcgcgtctctgcgagtatctgtctcc

SEQ ID NO: 36459 - DNA, 372 bp, Homo sapiens
  misc_feature 1..372: note = chr17:35078532-35078904
  misc_feature 1..372: note = hyper
  source 1..372: mol_type = genomic DNA
gggggaggtcagggacggaaataaacaggcggtttggtcttctctttcttccctggcagccttaattgctacttaagcgtgggccctgcacttaacatccggggggcaggcccggtgcgtggtgcacgccgggcgcgctgtgcacagtctccggaggccgccagtgcgaccccgccccacccgcgcacccccgcccggagggccccagcgcgcatgcgctcgccgcagggcggcctgcggggctgtggacgcgaggccagctcgtagggggctgggcggtcagcggggtcaagggacagccacgctgggacggaggacggggacaggggagcccctgcggcgccacttcttcctctccgagtcctgtctgcc

SEQ ID NO: 36460 - DNA, 30 bp, Homo sapiens
  misc_feature 1..30: note = chr17:35165346-35165376
  misc_feature 1..30: note = hyper
  source 1..30: mol_type = genomic DNA
cccgcatttccaccccgctcccactgctgg

SEQ ID NO: 36461 - DNA, 251 bp, Homo sapiens
  misc_feature 1..251: note = chr17:35165593-35165844
  misc_feature 1..251: note = hyper
  source 1..251: mol_type = genomic DNA
cttcaattttatcagcggccggggagccgggcgggagataggaggccggccctgacacgaattagcccggagattgtccgatacgccttggccagggcgccggcgccgcgcgctcgcctccctcgcctctcctttgtgtccgcctcgcctcgcctctcggcctcgccgcgctccattcccgcggcgctggcccgggccgagcgaactgctttgcctttggccacgttgagcgcgccgaggcagccgggggc

SEQ ID NO: 36462 - DNA, 188 bp, Homo sapiens
  misc_feature 1..188: note = chr17:35165845-35166033
  misc_feature 1..188: note = hyper
  source 1..188: mol_type = genomic DNA
cggggctccaggacccgtctgctcctggtgcccccagctcctcagggtccggccgggtcacctgggccgatccaggcgggcaggggcctcgctgctcctcccccgcagcccctctcgccctcccggggaccgtgtgcggggagcagctgggagctgcgtctggaggggctgtccgactggggaacttg

SEQ ID NO: 36463 - DNA, 30 bp, Homo sapiens
  misc_feature 1..30: note = chr17:35242096-35242126
  misc_feature 1..30: note = hyper
  source 1..30: mol_type = genomic DNA
gagaaggcaagggggcgggagcgggagggg

SEQ ID NO: 36464 - DNA, 358 bp, Homo sapiens; identical to SEQ ID NO: 12667
  misc_feature 1..358: note = chr17:35285437-35285795
  misc_feature 1..358: note = hyper
  source 1..358: mol_type = genomic DNA

SEQ ID NO: 36465 - DNA, 290 bp, Homo sapiens
  misc_feature 1..290: note = chr17:35289328-35289618
  misc_feature 1..290: note = hyper
  source 1..290: mol_type = genomic DNA
aattactgtgaggcacgagccccgtttgtcttccttactgggtgttcagacagaggaacacgggcacgcacccaaatacacattgttgtcacgccgtcttagacgttttatttatttgttggattcctgcccagagccgcttttccacgggcgcagagtctcccaccaaacacgctgcctctttctctcagcacgcactcgcctgtcccaaagccgcacacccccagacccgcgggacgccccctccgtgcctgcagggccctcggctccgcgcccgtccccgcggcctt

SEQ ID NO: 36466 - DNA, 550 bp, Homo sapiens
  misc_feature 1..550: note = chr17:35290388-35290938
  misc_feature 1..550: note = hyper
  source 1..550: mol_type = genomic DNA
aaggcaatttgagtccggagagaactagacgggaaggagaggcgggagaccttggcgctcagatccgagcgaccttatccacgcagttccctgcgtggcattactgcggcctcaccgagtctgggcggagtttgcgtggcctctgggaccggcagagtccaggggtgctccgggctggctatttcctccctcctccgggatgggtgtagcagggtgtgtactccgcatggggtaacctcctagagccggctacgccccaggcgcctcctttcacggccttgtcactcttttctgctccttgggctgttctggaaccgaagagagaggagggaaatggctaggggcggccatcatcctcgggatcaatagcagccgagagtgactgggcaggctctgtccatgggccgagcgtcattctggaacctggagggggcgggggcgggggaaggaagggaagtggaagtttgagaggggcaccttcaggctccccaaactgcatggcagctggagagggctgacagaaccctctccaacccgggttctgaccagg

SEQ ID NO: 36467 - DNA, 359 bp, Homo sapiens
  misc_feature 1..359: note = chr17:35291540-35291899
  misc_feature 1..359: note = hyper
  source 1..359: mol_type = genomic DNA
atctggacaccaggacgagcggagcctgacgccctagagcgagcgtcctgtcctcatcctcaactctcctgcctcgctggtccgtctgtggggaggggccttctttcccctatacctaggtcccaaggttcttacacccctaaatggatggagcaacctcctcctgcccaccagagggaggtgacaggccctgggttggggaagggccgacagctaggtccagctgtcgtccggtaggtcccactgaccgccccacactccaccgtgacccctctgctttgcatgagaaggagcccagctgggacgggggcggaggcaagccacccgggactggggccactatagattccagaaagggg

SEQ ID NO: 36468 - DNA, 735 bp, Homo sapiens
  misc_feature 1..735: note = chr17:35291920-35292655
  misc_feature 1..735: note = hyper
  source 1..735: mol_type = genomic DNA
cggcgagaaccgggacagctgcggggaggggaggagtgtgaggacagcagggctggactggccccctccccgcaggcctcacgcagcgcagcaggctgggaggcgcctgggggtccgggtggaagaagtggggaccccatgccacacggcttttggcgcttgcgggggtgccagaagcctaccgagtaccggtcgtcttccgccgggaagtgccgggtccgcaggaggagcgcgaagccgagtccgagcccgcggagcccgccccctagatcgcagaaccgccttctccatcctctgccctgccccgcgtcggggtctgggagcgaccggcggaggccggcggcgcgccggagctgactagtcccctacgctcctccggcccgcagcggggagcccacatgtgtatgtgcaagaaggtgtggagaaggcgttagggtcccggcacccacgggtcagggcagaacgccaacgagtcgcactgcgggtctccgcggcttcggtttccatgacatggtgacgccggcggcaaggcggggggctgcctgtgggccttgaggttgctgggcggtgcgggcggagtcagcaaaggggcgttggcaaagccctaaaaccccacggttccacggagcgcaagccagattctctgaagcagcttccccgttcgtccgaagagggtattccatctgcacagcgggattccctgccagcccaggttcactgcgactccgcttcccc

SEQ ID NO: 36469 - DNA, 35 bp, Homo sapiens
  misc_feature 1..35: note = chr17:35292896-35292931
  misc_feature 1..35: note = hyper
  source 1..35: mol_type = genomic DNA
cagaacaggtgtggtcgaaacggaatttagggttt

SEQ ID NO: 36470 - DNA, 475 bp, Homo sapiens; identical to SEQ ID NO: 4398
  misc_feature 1..475: note = chr17:35294006-35294481
  misc_feature 1..475: note = hyper
  source 1..475: mol_type = genomic DNA

SEQ ID NO: 36471 - skipped

SEQ ID NO: 36472 - DNA, 1133 bp, Homo sapiens; identical to SEQ ID NO: 4400
  misc_feature 1..1133: note = chr17:35294492-35295625
  misc_feature 1..1133: note = hyper
  source 1..1133: mol_type = genomic DNA

SEQ ID NO: 36473 - DNA, 1130 bp, Homo sapiens
  misc_feature 1..1130: note = chr17:35296016-35297146
  misc_feature 1..1130: note = hyper
  source 1..1130: mol_type = genomic DNA
cattctccaggccttcggggttgtttgccctccaggcagagcccaggctccctcccggccactaccttttccgaccccgagcggtcttggcggtaagctccgagccttttgcgtagagtgtctgggccaactgccctgtcagcggcaggaaagaactcggccttaaagccgatcctgcacgcccgggggtcttccccaaacccggacatgcctccgagtgcagacctggacaaactgctgcactgtagcctgcgaagtgcccggagctttttcctgcttccctggctgccgaagttgtctggtggttcggcttcagccccaggtgactccgactcccacgggctccgctcagtagtcctcctaggaaactgccagccacagccagcaacctccttgatgaaacctgggggaaagccgagacctccagcttgctggtggggagacttctccctaccccccttattcgtttagcattttaattatattatcgtacactcacaattttgccgctccattcacacaaacacacaagtcaacagagaagaacgggcacaaatgcgaattgtaattccaccctacggatgtgaaatatcgcaatttactcggctgacttggtctctgcttttctgagtttgtggtcatagttcaaaccagggagcaggaggaagagggattcaaagccactcagagggccaagacgcgctgtccccagtgccgctccaggactcgtggctggggttgggttgcgtggaaccatgaagcaaagctccgtgctcgctggtatttcgggagaacgcgcaggctgagcctctgagcctccgcgggctgcccggttttcctcaaggactggatcatagcgggagggtggcaaaccgtactcgtacccgctgccagtgggtccctgagcctggcttccacaacccgcggcagagcgcccagagccagctcccgcagctcccgcttttgccaacctgtcccgctttaggcaagagcgtggcggcggccccgctaaggctacggaggggggctctccgcggctatgtttgtttaccaacagcggggctagacatcgccaaccccatgcctatgtgcgggtccttttgcgatgaaggagagaaaagcggcgctcc

SEQ ID NO: 36474 - DNA, 460 bp, Homo sapiens
  misc_feature 1..460: note = chr17:35297147-35297607
  misc_feature 1..460: note = hyper
  source 1..460: mol_type = genomic DNA
cgcacgtttatatagagttctaattgtaattcgacttttctgaatctaatcggaaaataagtgccccgttccccccgcccacacaggtcactgccttgccaccttctttagacgatgcatctttcctctgggataacgctgggagtgaggctggggcttggcgggtagcttgggcccctggctctaaccgcgtgtatcccctccctaactcttccctggtgccgcgctctctctcctgctgcctcctcacctgcttaaccggaattctgcctctctttatctctctcttcccttctttctgtgctccattcctcctctcctacttcctccactttttacatcttccctctttctcgctgtcatctttctctccgcctgtctccccttgcccctggctgacccatccccgcccccgccccccacccccacccccccgcaggtgtttcggtaccaaatgcgc

SEQ ID NO: 36475 - DNA, 314 bp, Homo sapiens
  misc_feature 1..314: note = chr17:35297897-35298211
  misc_feature 1..314: note = hyper
  source 1..314: mol_type = genomic DNA
ccctcttagccaccacgggcagtgaccccagtttgtctccggattcccaagacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcctcaacatgcgcgtcattcaggtcaggccccggcgcgcctctccatcc

SEQ ID NO: 36476 - DNA, 259 bp, Homo sapiens; identical to SEQ ID NO: 1284
  misc_feature 1..259: note = chr17:35299185-35299444
  misc_feature 1..259: note = hyper
  source 1..259: mol_type = genomic DNA

SEQ ID NO: 36477 - DNA, 366 bp, Homo sapiens
  misc_feature 1..366: note = chr17:35299600-35299966
  misc_feature 1..366: note = hyper
  source 1..366: mol_type = genomic DNA
gctggtggaccgcctggagccgggcgagctcatccccaatggtcccttctccttctacggaggtgggtgcgcgccgaatggcggggcacggccaggtcggggcgggcttcgttggaagcgggtggcagcgcgggggggcacgcctcgctctctgtaagccactggagagttggggcgagtagggagaaggctgggagtaaatcaaggggaggcggcgagaccgaggacccaattcacggccctgaataacgggggtagctggtaaggggcagctcccgggcttgcgcccagcctcctccctgcacccaggcccgcgagggctccccgcgatccgcgagttccccgcgtggccttcctcagcccgcc

SEQ ID NO: 36478 - DNA, 453 bp, Homo sapiens; identical to SEQ ID NO: 1287
  misc_feature 1..453: note = chr17:35300260-35300713
  misc_feature 1..453: note = hyper
  source 1..453: mol_type = genomic DNA

SEQ ID NO: 36479 - DNA, 42 bp, Homo sapiens
  misc_feature 1..42: note = chr17:35300812-35300854
  misc_feature 1..42: note = hyper
  source 1..42: mol_type = genomic DNA
cgtggggagggaggccgtgagcacagccgggtgaaggaagtg

SEQ ID NO: 36480 - DNA, 30 bp, Homo sapiens
  misc_feature 1..30: note = chr17:35301109-35301139
  misc_feature 1..30: note = hyper
  source 1..30: mol_type = genomic DNA
atacacacatacacacgtacacggacacac

SEQ ID NO: 36481 - DNA, 237 bp, Homo sapiens
  misc_feature 1..237: note = chr17:35303314-35303551
  misc_feature 1..237: note = hyper
  source 1..237: mol_type = genomic DNA
cgattcttctaacaacgtggttgtggcgcagtctctcccctcgtcgcgggattcagaatcctggcgaaaacccgaacaggtggcaacgctcagcagtcaaatttggagccgaaggccccaaggaggaggcctggaaatgtcagggcctgttctccttcccatcagtgctgtgccgcccacctctggccccgaggtgcggggacgtgcggcaccatacctaggcggagctcccgcagg

SEQ ID NO: 36482 - DNA, 885 bp, Homo sapiens
  misc_feature 1..885: note = chr17:36102404-36103289
  misc_feature 1..885: note = hyper
  source 1..885: mol_type = genomic DNA
tttctctttgcttttcgtcttaagggaacacggtgggcaaaagaagggagtgcgtgtgcccgaggcttgggagccccctgtgcagtgacctaggaaccgctagcgatttcttgaaaaattactttaatcaagtccggcgctcccgggagcgggggaggaaaggcagcacccgctcgggacgggagaaaaaagcctccaggtctgtcccgcgtctccaactcggcgagggtctccggctccccagtccctctccctgccctgctggggcctggggctttggggagggaagagcggggctggggtctaaggaccctgggccgggcctggctctccgccggccgggcctgcgggtgtcggcgacccgggggctccgcgggcggctcgggcgctcacagagcccgcgtcccgcgccagagcggtgaggccgcggggccgcacggggcgcctggctgggtgcgcgctgggagcggcgagcagccccgcgcccgcgttttgatctccttcccccctctaagccgcgtttacaacttcaccaatgaataacccgcctctcttttcaacctaatcacggctctttgtgtatctttctgttgatgatttatagaaataaattaataacaccccaactccacgtgctgcagtttatgttacgtctcagctgcggccagcccggcgcggggctgggtgcggaggggcgccccaggtccttccagcgccgcgctagaaagcgggcgcctgcggccgggtgggagggcctaggccctgtggcccccggtggccggcggtgggagcctggttcatccgccaggtcctgagcgacctccccggcagccctggcgccccagccgctcctaggggccactctctcgacccctcttagcctcc

SEQ ID NO: 36483 - DNA, 36 bp, Homo sapiens; identical to SEQ ID NO: 12690
  misc_feature 1..36: note = chr17:36103290-36103326
  misc_feature 1..36: note = hyper
  source 1..36: mol_type = genomic DNA

SEQ ID NO: 36484 - DNA, 495 bp, Homo sapiens
  misc_feature 1..495: note = chr17:36103540-36104035
  misc_feature 1..495: note = hyper
  source 1..495: mol_type = genomic DNA
gccaaggctcagccccgaaatcgcggcgcttcagtgtccgaagccacgcgatgggctctgtcctaaagcggagtggcccgggagcgacgtgctgtctcagggaaccgctcggctccttagataattagtaaccagctgtcaaagtctagggcggtcggggaggacccacaaacgatcccggccctggggatacactgccagccggcctgaactcccggggagaggccgggggtgggcagcgaggtctggaaacgccctcctttctcagactgagaccagatcctctgcgaactgaggtctgagacgcgttcgcccccacaccaccgcgcttcgtttctttggccccgcgcgtgtccacccggaccctgcatggaacatgccctttgcaaatctaaacccgcgttggggatcccggataattccgggccttgcatgggcgcggctaacaagagtgcccaccagggaactcgcctcccagatcccggctccggatgc

SEQ ID NO: 36485 - DNA, 334 bp, Homo sapiens; identical to SEQ ID NO: 4411
  misc_feature 1..334: note = chr17:36104217-36104551
  misc_feature 1..334: note = hyper
  source 1..334: mol_type = genomic DNA

SEQ ID NO: 36486 - DNA, 707 bp, Homo sapiens
  misc_feature 1..707: note = chr17:36104643-36105350
  misc_feature 1..707: note = hyper
  source 1..707: mol_type = genomic DNA
cgtcgccggacaagcggcccttggcgtggccgttggtgagagtatggaagaccggcttggtgtcgggctcggccccgctgccaggggacaggggcagcgtctccagcttcaccccgaagttcggggatggcagcaactcctccaaggcctgaaccagcacctccttggtgaccccggagctcagcagggcgctcaggagttcttgctggagcgacgtgagcttggacaccattttccaaggacggaaaaagaagggggtgagggggtgggtgggtgcgagagaggagggtggaggggagtttcacaagcaaaccccaaatccaggaacccctccacccttcagcctccagacacctgttactccccggggtcccggaggctcctccgaaaggagtcagaaaacttctaacttgccatgatcgccaccattaggccatataagatatgcaaattagtgggaagggcccagctttcggctggatgcaaatgatggtggggagggggaaacccggagagagggagagccggaggggcagacctggagagcagaagacctgggccgggagcggggctttgccagggtccattgtactcacgctggggggctagagaccttcttttactggttctgcttatcagccaaacttcacctaacctttggacttgttaagccagtgccttgcagcctaggcgcggggcttttccac

SEQ ID NO: 36487 - DNA, 270 bp, Homo sapiens
  misc_feature 1..270: note = chr17:36105458-36105728
  misc_feature 1..270: note = hyper
  source 1..270: mol_type = genomic DNA
cgaagagtagagaccctggatgcgtcccggccgacgcaggtggtgggccaggagagcccgcagggcggaagagaaactgaccacttaggaaggggcgccgaggccacgggggaggtgaggcagcgttaggtgtggtgagcatgccctggagggactccatttatttctacctcggttactacctccaggccccagaacctccctggcctggtctggcggtttgggtttgcagaactgcccgccagagagcgtaggcgagggtgaaggagt

SEQ ID NO: 36488 - DNA, 75 bp, Homo sapiens
  misc_feature 1..75: note = chr17:36715017-36715092
  misc_feature 1..75: note = hyper
  source 1..75: mol_type = genomic DNA
ggttgggaatatttgcgggacagggtgtagccctatgtaggtccctgccgacagtgcggccgcatggctatggct

SEQ ID NO: 36489 - DNA, 136 bp, Homo sapiens
  misc_feature 1..136: note = chr17:36729051-36729187
  misc_feature 1..136: note = hyper
  source 1..136: mol_type = genomic DNA
ccctttgctgcaatgcgagagccgccgcggccgccgccgtgccggcccgggccccagtcgccccggtaaccgcgactccacctggcgcggcgctgcgcgccgccgtgcacatcccctctcgcggccccctccctcg

SEQ ID NO: 36490 - DNA, 46 bp, Homo sapiens
  misc_feature 1..46: note = chr17:36829977-36830023
  misc_feature 1..46: note = hyper
  source 1..46: mol_type = genomic DNA
gtaacaccaaagtttcgaccggcggatcagacgatcgaaatgttcc

SEQ ID NO: 36491 - DNA, 40 bp, Homo sapiens
  misc_feature 1..40: note = chr17:36905467-36905507
  misc_feature 1..40: note = hyper
  source 1..40: mol_type = genomic DNA
ttttctcctgcctggcgctgattcccgcatttttcgctcg

SEQ ID NO: 36492 - DNA, 422 bp, Homo sapiens
  misc_feature 1..422: note = chr17:37321203-37321625
  misc_feature 1..422: note = hyper
  source 1..422: mol_type = genomic DNA
gcccaatcgctcctccggactacagaggagcccgggaacccagggaagagctccagtgattggtccccctgcctgtcagtctggtgggaggcccagctctctaccctccccgcccgagagtcacttacaaccggtagagaatggtggtctttccttcattgtccagtcccacgatgatgaccgtgtgctctggaagcgtcggaggaagggcagcgtcagggccaaacccgaagaccaagggactgtgtgcccccaccagacctcccaggaaggagatagcgctccccgcaggctggggacctctgcccaccgtaccgcgtctgcttcccacccagctccgacacctgccccactccgggacggtggaaaagacagctgagcccccacctcccttcacattccagaaaagtgtctgaaaggcc

SEQ ID NO: 36493 - DNA, 88 bp, Homo sapiens
  misc_feature 1..88: note = chr17:37321787-37321875
  misc_feature 1..88: note = hyper
  source 1..88: mol_type = genomic DNA
cgccgggacccaagaggagcaggcagggacgggggcaggggaggccgcggggcagtcgaggagcgcccatatacgaccctcggagccc

SEQ ID NO: 36494 - DNA, 512 bp, Homo sapiens
  misc_feature 1..512: note = chr17:37366040-37366552
  misc_feature 1..512: note = hyper
  source 1..512: mol_type = genomic DNA
cccccactctgcatccgggcagcgccagcagtgccccagcacccccgcagcccgcctctccttggcgccccgctcccctccgcctataaatagcacaggacgtgctcgccgtggcgatgacgcggctgggcaggcggaggggaaggaggcagctctgccagagcggtgggcggcgagcgcggcggcgggaggggtgcggcccctccatgctgggctccgatgacaggggcgactgagtcatcccggggacccacgggccacgactgtccccgccgccagcgtttctgtctccggcttgggggactgcggggacgaggctgacctcggatgggtactgagccctcccagacccccggcacgcccggtctcggagggcacctctgggtgggcaagatcggcctcgacggccctggcgcgcaggagcatgtccgcccctgcgcgactcaggtgcacatggaggcggaaagtgaccgcagccccaagccgtttccctccagcgtccccagacctcc

SEQ ID NO: 36495 - DNA, 423 bp, Homo sapiens; identical to SEQ ID NO: 1290
  misc_feature 1..423: note = chr17:37381007-37381430
  misc_feature 1..423: note = hyper
  source 1..423: mol_type = genomic DNA

SEQ ID NO: 36496 - DNA, 157 bp, Homo sapiens; identical to SEQ ID NO: 1291
  misc_feature 1..157: note = chr17:37381570-37381727
  misc_feature 1..157: note = hyper
  source 1..157: mol_type = genomic DNA

SEQ ID NO: 36497 - DNA, 409 bp, Homo sapiens
  misc_feature 1..409: note = chr17:37381825-37382234
  misc_feature 1..409: note = hyper
  source 1..409: mol_type = genomic DNA
cgggcgtctccgggactctgaagccgttctccagaggctgcccccagttagcccccggcacggcagcccccaacccgcgggagcgggcagagaaagttgccggggtggcgggcgaggggaggccaccacgctgagccgcaggagcgggacgaccccgggcgcgaggaccgagggtctgcagaggatgctgctcgcagcgcggggaggagggaagtggggccgcggggatgagccgagggagggagccaaggagctgtccgtgtccagccggctccgccgtccgctgcgcccgccccccatcccctcccctcccccgccggccccagcccggcacccggcggcccctccgcccagtcctcgccgcccaactttgatttaggaggtcgcctggtcccgccccctgccctac

SEQ ID NO: 36498 - DNA, 52 bp, Homo sapiens
  misc_feature 1..52: note = chr17:37388387-37388439
  misc_feature 1..52: note = hyper
  source 1..52: mol_type = genomic DNA
ctcccttggggttaacgcctggggagagatcctgtggcgggggagtctagac

SEQ ID NO: 36499 - DNA, 131 bp, Homo sapiens
  misc_feature 1..131: note = chr17:37752808-37752939
  misc_feature 1..131: note = hyper
  source 1..131: mol_type = genomic DNA
aatccatcagtggggcggcagctcccgcgcccccaccccctgcccctgctggatcccgcggttgacgccctcctctcctcctccccgcactggccgcgtaggtggcctcgggtgcggaggtcccggcctgg

SEQ ID NO: 36500 - DNA, 361 bp, Homo sapiens
  misc_feature 1..361: note = chr17:37753021-37753382
  misc_feature 1..361: note = hyper
  source 1..361: mol_type = genomic DNA
cggaattttagatgtgctctccgcccctcctcgcaataactccccccaccacccccgcagctggcaccggctgtggcgtggcgccctcctcctcccccaactcccaatagcaaaaccgggtgatggatccgggagcacggctggaggcttgggccaggaggcccgggaggcccgcggcgtggcagtggcggctcccagcgcggagggaaccattgggcgctgttcggacctcttcccttgtgtccttccttcccttctcccgcatccactcactcccatctctccactgtctatgtccttctcgacctctgccccaccctacagcccatcccagccaccgcgtctacgaagatcctctaca

SEQ ID NO: 36501 - DNA, 144 bp, Homo sapiens
  misc_feature 1..144: note = chr17:37755368-37755512
  misc_feature 1..144: note = hyper
  source 1..144: mol_type = genomic DNA
gccgcgccccagcctcggcctgggagcccggccgagcgcgagttcgctgcaagcgggatccgctctgagcccggccggccggcagcctccgcggtattcccggcgcgggcccctccaggggctcccctgcggctcctgggggca

SEQ ID NO: 36502 - DNA, 117 bp, Homo sapiens
  misc_feature 1..117: note = chr17:37756218-37756335
  misc_feature 1..117: note = hyper
  source 1..117: mol_type = genomic DNA
ctccctgggcatggccggcgcctagaggttccctcttctcctcccctcggagcgccccagcttcccttccctgccctagggaactaaggtgactccgctcctcgcatctccctcctg

SEQ ID NO: 36503 - DNA, 30 bp, Homo sapiens
  misc_feature 1..30: note = chr17:37760128-37760158
  misc_feature 1..30: note = hyper
  source 1..30: mol_type = genomic DNA
aggaaggtaaaattgcgtgtgtgtgggtga

SEQ ID NO: 36504 - DNA, 292 bp, Homo sapiens
  misc_feature 1..292: note = chr17:37760367-37760659
  misc_feature 1..292: note = hyper
  source 1..292: mol_type = genomic DNA
ccaggtggcacccaccgaggcacagtccgggcaggggtggggctgcccccaggtctccatccccacccctcaccccaggaggggacagaatggccgcggggaggaggagccggcgagctcacctccttctgccccccggacgccggcgccgggcctgcttgtgcgtgcggtgtggtgtgcgtgtgtctttcatgcaaaccctccctccccaaaccgaccccccaacagtttgccattccatacaaatttggaaacaggtttttaaaaaacagcatgacgcacaacggggacg

SEQ ID NO: 36505 - DNA, 1545 bp, Homo sapiens
  misc_feature 1..1545: note = chr17:37761235-37762780
  misc_feature 1..1545: note = hyper
  source 1..1545: mol_type = genomic DNA
tcaagaaagagggagcgcctggctcctttttgcctcggcagctgggtgtctgtttttaaaataataatgagagggggaaacgcgttccattgctcagctgcccccttaccaacgccttgggcctgcagggaggagggggaggaggaaacctcagcgaagatattgggaatgggggaggggtgcctccagggagcccccggagagaggtccctggagaagcactccttgggagagaggaggagggaaccccttggggagagagaaggcgagtcccctgggggaagcgaggcccctgggacaggccacccacaggtaacaggactgcgctgccccaggagagcggcaggaccggtggcccgctccccgcgcccggcgccggggtaggatgggggtgtccctgcgctctgggggctggggacaggggggcgggcaaaggcaaaagaaaaagaagggagccggcgcgaagtctcagttatgaaaaaacgcattgagctcctcgtacatggggccccggtcgtggtgaaggtgcatatcgtaagacaagagattctccgagtggacgcccccgcgcacagccgacgagccgaagactagcccgtggcccgtgggccgcgaaccgggcagcgccgagtagtgcatagagtagtggtagcttttctcgtggtcgggcgaggagtcctgcttgagtgagaagttgccattgagacagagcggggggctgagcgggccctcgtactcggagctgttgtagtccgggctcgcgccgccaccgcctgccgccgcatacagcgtctcgtaggcggcgcagtagccgtgggtccgcagggcgtgcgccgcgccgccgcccaggccgccggccgcctggcactgtgcgcccgccaggcgcgagcacgggtacgggtaggggtgcatggcgaacgggccgcccgagccgtggaagcggccggcaccgtcggcgccttgctccgtgaggaagttgcgagagttgagctgcagacagccggccaccagattggtggtgggctgcgacagacccttgcacagagtctgcacgtaggacactaggtctggccgcttgccggagcgcaggatctccgagagcgcccagatatagttcttggctaggcgcagcgtctcgatcttggacagcttctgcgtcttggagtagcagggcaccaccttgcgcaggttgtccagggctgcgttcaggtcgtgcatgcggttgcgctcccgcgcgttcgccttctgccgccgaagcttggagcgctccaagcgcgccttggtcatcttgcgcttcttgggcccgcgcttcttgggccgctcgccctccgcctcgtccagtccttcttcctcctcctcttcctcctcctcctctccccccagctcgccttcctccttgacctcggccaacgtggcctccgtcccctcttctccacggagagggactggcttggccgcccgggctggccccggagcccctggcccgggcgcaggcggtggcggtggcggcgcgtcgcccttgtcgctcctcggctcgtcgtcttc

SEQ ID NO: 36506 - DNA, 45 bp, Homo sapiens
  misc_feature 1..45: note = chr17:37763928-37763973
  misc_feature 1..45: note = hyper
  source 1..45: mol_type = genomic DNA
gcccctcctcccaaccggcgggtcagatctcgctccctttcggac

SEQ ID NO: 36507 - DNA, 186 bp, Homo sapiens
  misc_feature 1..186: note = chr17:37783470-37783656
  misc_feature 1..186: note = hyper
  source 1..186: mol_type = genomic DNA
ccctcctcccgctcccgcgccctcccctcggcgggcacggtatttttatccgtgcgcgaacagccctcctcctcctctcgccgcacagcccgccgcctgcgcgggggagcccagcacagaccgccgccgggaccccgagtcgcgcaccccagccccaccgcccaccccgcgcgccatggaccccaa

SEQ ID NO: 36508 - DNA, 30 bp, Homo sapiens
  misc_feature 1..30: note = chr17:37794096-37794126
  misc_feature 1..30: note = hyper
  source 1..30: mol_type = genomic DNA
tgtcgcccaacccctcgctctgtacactga

SEQ ID NO: 36509 - DNA, 269 bp, Homo sapiens
  misc_feature 1..269: note = chr17:37856457-37856726
  misc_feature 1..269: note = hyper
  source 1..269: mol_type = genomic DNA
ccggagccatggggccggagccgcagtgagcaccatggagctggcggccttgtgccgctgggggctcctcctcgccctcttgccccccggagccgcgagcacccaaggtgggtctggtgtggggaggggacggagcagcggcgggaccctgccctgtggatgccccgccgaggtcccgcggccggcggggccagaggggcccggacgagctctcctatcccgaagttgtggacagtcgagacgctcagggcagccgggccctggggccc

SEQ ID NO: 36510 - DNA, 94 bp, Homo sapiens
  misc_feature 1..94: note = chr17:37857113-37857207
  misc_feature 1..94: note = hyper
  source 1..94: mol_type = genomic DNA
tgtcccaaccagagccggggaggaaagggtggcccggagggtggcctcttgctggggtctgggttgggggcgggggagacgtttgctttgaaca

SEQ ID NO: 36511 - DNA, 306 bp, Homo sapiens
  misc_feature 1..306: note = chr17:38264389-38264695
  misc_feature 1..306: note = hyper
  source 1..306: mol_type = genomic DNA
agaagcaggataaagcgcaaggagacaagaagggagccccgcgcgctttccctccttcctcatcttgcctcctgtttctctggcccacggaggaaggggcccagtgtgtttgtgccggctcgaggctcacgcgggctgccggggtcacatggcccgggcatgtgcagcctgctccatttctaccacaacaactcgctcataaacagcccggctgctgcggcggtggcggtggagacatgtgcaagcgagggggtggggcacgtggccctgcccgagccaagggaaggcgctcgctcagcactgcct

SEQ ID NO: 36512 - DNA, 142 bp, Homo sapiens
  misc_feature 1..142: note = chr17:38347474-38347616
  misc_feature 1..142: note = hyper
  source 1..142: mol_type = genomic DNA
cctttcgctcctcatcgccttgcactgccatcttcccacccactcccctcaccccctggcgccctggccgcccctccgctgccgtgggtgcagctggagttcgtggactacgtgttccacggggagcgcggccgccgggaga

SEQ ID NO: 36513 - DNA, 25 bp, Homo sapiens
  misc_feature 1..25: note = chr17:38347753-38347778
  misc_feature 1..25: note = hyper
  source 1..25: mol_type = genomic DNA
cggccgtcggcgggatggggggccg

SEQ ID NO: 36514 - DNA, 114 bp, Homo sapiens
  misc_feature 1..114: note = chr17:38478719-38478833
  misc_feature 1..114: note = hyper
  source 1..114: mol_type = genomic DNA
tgtgtcactgtaccccgcaggcagtgtcaccgtgacccactcgctgtgtgtctgtgtgtacacacctaccttggagtggctttatcccggccctccccccggagcctctgtccc

SEQ ID NO: 36515 - DNA, 30 bp, Homo sapiens
  misc_feature 1..30: note = chr17:39683809-39683839
  misc_feature 1..30: note = hyper
  source 1..30: mol_type = genomic DNA
ctccaaccttgcccccgccacctccagagg

SEQ ID NO: 36516 - DNA, 235 bp, Homo sapiens
  misc_feature 1..235: note = chr17:40332839-40333074
  misc_feature 1..235: note = hyper
  source 1..235: mol_type = genomic DNA
acttgccccccagctcgaacctcaagccccgacctccgtcccactcacgcgttccgtcaaaacgggtggcgatggtgtccaggaaggtgttttgcggggccagcaaccccttcatgaccggcatggccccggggcgtgggttcaaggcgcggcgctggggagctttcagcgcggccgggccggagggggcgcgctgtcggaggggccggggcgccccatgcgccctcctgcctcc

SEQ ID NO: 36517 - DNA, 30 bp, Homo sapiens
  misc_feature 1..30: note = chr17:40400826-40400856
  misc_feature 1..30: note = hyper
  source 1..30: mol_type = genomic DNA
ccaaacagaaagcagcgaattcttgccaac

SEQ ID NO: 36518 - DNA, 197 bp, Homo sapiens
  misc_feature 1..197: note = chr17:40464190-40464387
  misc_feature 1..197: note = hyper
  source 1..197: mol_type = genomic DNA
aaaaagcaggggactcgaggtttggggaaatgatggagatgggcgcgggtgggcagaactctgacccaggcttctccttagcagctgctgctcccagcagcctcgaagctggcggctgagggcccggcgccaagatgcttctcaaccctcggggccaggggcagtcccagagccgcaacaaccgtcccatcctcctc

SEQ ID NO: 36519 - DNA, 36 bp, Homo sapiens
  misc_feature 1..36: note = chr17:40573790-40573826
  misc_feature 1..36: note = hyper
  source 1..36: mol_type = genomic DNA
gctgcgcctggcccccgcccccgcaggcatgcgggg

SEQ ID NO: 36520 - DNA, 30 bp, Homo sapiens
  misc_feature 1..30: note = chr17:40669662-40669692
  misc_feature 1..30: note = hyper
  source 1..30: mol_type = genomic DNA
caaaatgcggctgtgcgtccaggatgcctg

SEQ ID NO: 36521 - DNA, 106 bp, Homo sapiens
  misc_feature 1..106: note = chr17:40912947-40913053
  misc_feature 1..106: note = hyper
  source 1..106: mol_type = genomic DNA
ctggagagtcctgggcgccacgcagccgagcccccgaaatagatcccggttccggggttccgggagctgtccagcctcgcggggtgagctacgagagggtgggcca

SEQ ID NO: 36522 - DNA, 261 bp, Homo sapiens
  misc_feature 1..261: note = chr17:40932562-40932823
  misc_feature 1..261: note = hyper
  source 1..261: mol_type = genomic DNA
gccgcggggcggcgacgggggcggggccaggccgagctgggggctggggccgcagccgctcagccggagcgcagcgcacccagcgagtccgtctgtcaggccgcctcctctccggccgtctgattttctacccttcggcgccctgctcttcctcatgttggcatccccggccacggagaccaccgtcctcatgtcccagactgaggccgacctggccctgcggcccccgcctcctcttggcaccgcggggcagccccgcct

SEQ ID NO: 36523 - DNA, 59 bp, Homo sapiens; identical to SEQ ID NO: 12713
  misc_feature 1..59: note = chr17:40932843-40932902
  misc_feature 1..59: note = hyper
  source 1..59: mol_type = genomic DNA

SEQ ID NO: 36524 - DNA, 30 bp, Homo sapiens
  misc_feature 1..30: note = chr17:40933234-40933264
  misc_feature 1..30: note = hyper
  source 1..30: mol_type = genomic DNA
cctcaagtttgacatcgagattggacgtgg

SEQ ID NO: 36525 - DNA, 80 bp, Homo sapiens
  misc_feature 1..80: note = chr17:41723454-41723534
  misc_feature 1..80: note = hyper
  source 1..80: mol_type = genomic DNA
ccgatccgggttggccgcccgcggggcgcgcccggggagcagggcagggggccgagttcctggcgcgggctgcctgcccg

SEQ ID NO: 36526 - DNA, 56 bp, Homo sapiens
  misc_feature 1..56: note = chr17:41723778-41723834
  misc_feature 1..56: note = hyper
  source 1..56: mol_type = genomic DNA
gacgacgggcgcggtcggggactggtttcccaatcttctcccgtcccgaggcttag

SEQ ID NO: 36527 - DNA, 32 bp, Homo sapiens
  misc_feature 1..32: note = chr17:41832619-41832651
  misc_feature 1..32: note = hyper
  source 1..32: mol_type = genomic DNA
taaacaatcaaaccacgcgcagaggacagaaa

SEQ ID NO: 36528 - DNA, 217 bp, Homo sapiens
  misc_feature 1..217: note = chr17:41983831-41984048
  misc_feature 1..217: note = hyper
  source 1..217: mol_type = genomic DNA
atcacccatagtgtccgcaggcgagcggaccagcagtgaaagggagaggtttcttccaacctcccacccatccctccatccatacacatacaaagaggtgcggagaagaaaggtctgacaaaggcgctttggagagcgagaggtcgcggggaggtctggacagaactgagggccagaggatggggtcgaaaggccaggcggacgtgcatgcttggac

SEQ ID NO: 36529 - DNA, 81 bp, Homo sapiens
  misc_feature 1..81: note = chr17:41984266-41984347
  misc_feature 1..81: note = hyper
  source 1..81: mol_type = genomic DNA
cttcgcttctggcaccggtcccctcccaagtctccagaccctaaccctggctcccgacccgccccgctacagcttgggaag

SEQ ID NO: 36530 - DNA, 209 bp, Homo sapiens
  misc_feature 1..209: note = chr17:41984363-41984572
  misc_feature 1..209: note = hyper
  source 1..209: mol_type = genomic DNA
cgcccttctgcggaccccctcccagggaagattgtggtgttagctgcctagggggaccagggggccaccgggacccagcgcaacctctgtctcgctccccaacccccggaagcgctaacagcacggttcttacgtaatgccgggcttctaagtacccccaacccgcacagcccccggggaggccgcgcagataccggggcccctcacag

SEQ ID NO: 36531 - DNA, 422 bp, Homo sapiens
  misc_feature 1..422: note = chr17:42030329-42030751
  misc_feature 1..422: note = hyper
  source 1..422: mol_type = genomic DNA
caggtctgggccctccgacctgcggaagcgaaggggaaggaattggatctggggaggcgagcctgggagacgtcgttaagtgatgttgccagggtagggccaggccgcgctctcggatgcaggatgtgtggtaacgggcgcttttaccgcgacctgacggggcggtcctcgccgtcggggaagaacgttttggaaagaagcgtgtccgggccgtctcttttcccatacctgggggcggggaagggaagagcgtggtcagatctggccacgcccccaggtggagcggggccgcagggtgagagccccaggggtcccgctccgcgcctgcgctcaccgctgccgggtgaccaggttgaggtagtggcgcagggaggcgtagtagcggttcagctcctccggcgaggcgtcttcgcggggagcct

SEQ ID NO: 36532 - DNA, 163 bp, Homo sapiens
  misc_feature 1..163: note = chr17:42061257-42061420
  misc_feature 1..163: note = hyper
  source 1..163: mol_type = genomic DNA
ccgggctgagtgttccgaggcgagcggctgctgtttgcgcagctaagtggcgtctgtgtacccagcggggcgcagcggtcgcgcgcttatctcccgcaaacaccgcgcccggatccgccggaaccacggccgcgccgccccatttgcacgccccggccgccgg

SEQ ID NO: 36533 - DNA, 88 bp, Homo sapiens
  misc_feature 1..88: note = chr17:42082176-42082264
  misc_feature 1..88: note = hyper
  source 1..88: mol_type = genomic DNA
tcagcaccgcctggtcgcagccccagcccccgcccgaggagtacgcgggcgcggacgacgtctcccagtcgcccgtcgccgaggagcc

SEQ ID NO: 36534 - DNA, 88 bp, Homo sapiens
  misc_feature 1..88: note = chr17:42082469-42082557
  misc_feature 1..88: note = hyper
  source 1..88: mol_type = genomic DNA
cggcgtgggccgtgacgcagcgaggggatggggttgtgcggccacctgtcctcaggcatggcaggatacgctgcgggctctgcgcagc

SEQ ID NO: 36535 - DNA, 138 bp, Homo sapiens
  misc_feature 1..138: note = chr17:42082805-42082943
  misc_feature 1..138: note = hyper
  source 1..138: mol_type = genomic DNA
cgggaggtaccccagcgtgagacaagggagtggcaagacccaacggggcaaagggcggagcaggtgggcactggtggccagaactgggtcctgacagcttctggaagggtagggtcaccgagacggccctgcaggcca

SEQ ID NO: 36536 - DNA, 160 bp, Homo sapiens
  misc_feature 1..160: note = chr17:42083143-42083303
  misc_feature 1..160: note = hyper
  source 1..160: mol_type = genomic DNA
tctgggaggccaaggcgcagctggccaagagctgcaaggtgctggtagacgcgcttcgacacaacgccgccgctgctgtgccattttttggcggcgggtctgtgctacgcgctgccgagccggctccccatgccaggtgagtgcccgccctgcccgccca

SEQ ID NO: 36537 - DNA, 98 bp, Homo sapiens
  misc_feature 1..98: note = chr17:42083525-42083623
  misc_feature 1..98: note = hyper
  source 1..98: mol_type = genomic DNA
cgtcgctggccaaggcgctgcggcccaccaaaatcatcttcctcaataacacaggcggcctgcgcgacagcagtcataaggtgcggccctttctttca

SEQ ID NO: 36538 - DNA, 30 bp, Homo sapiens
  misc_feature 1..30: note = chr17:42091732-42091762
  misc_feature 1..30: note = hyper
  source 1..30: mol_type = genomic DNA
agtccccgtagtggacgtagcccccgatgt

SEQ ID NO: 36539 - DNA, 97 bp, Homo sapiens
  misc_feature 1..97: note = chr17:42393478-42393575
  misc_feature 1..97: note = hyper
  source 1..97: mol_type = genomic DNA
actatcctccactgacgtccccatcaccccagctgaccccaacaacactgcaccattccctccaactcccaatatttgtgcacgaatccctgtcacc

SEQ ID NO: 36540 - DNA, 236 bp, Homo sapiens
  misc_feature 1..236: note = chr17:42393870-42394106
  misc_feature 1..236: note = hyper
  source 1..236: mol_type = genomic DNA
aactccaagctctaccggaggtaagccccagccaggtggggcttgggcctgagagcgggtcgtcctggggaagaagggcttcctctaccggcgcaccagctctcgctctgccgcagacacagcttcatgagcacggagccgctgtcagctgaagccagtctgagctcggactcccagcgcctgggagagggcacgcgggacgaggagccctggggtcccatcggtgagctccccca

SEQ ID NO: 36541 - DNA, 487 bp, Homo sapiens
  misc_feature 1..487: note = chr17:42635273-42635760
  misc_feature 1..487: note = hyper
  source 1..487: mol_type = genomic DNA
tgcaccagttctatccgctggtgaaggtgcagtgctcgcccgaactgcgcttcttcctgtgctccatgtacgcacccgtgtgcaccgtgctggaacaggccatcccgccgtgccgctctatctgtgagcgcgcgcgccagggctgcgaagccctcatgaacaagttcggttttcagtggcccgagcgcctgcgctgcgagcacttcccgcgccacggcgccgagcagatctgcgtcggccagaaccactccgaggacggagctcccgcgctactcaccaccgcgccgccgccgggactgcagccgggtgccgggggcaccccgggtggcccgggcggcggcggcgctcccccgcgctacgccacgctggagcaccccttccactgcccgcgcgtcctcaaggtgccatcctatctcagctacaagtttctgggcgagcgtgattgtgctgcgccctgcgaacctgcgcggcccgatggttccatgtt

SEQ ID NO: 36542 - DNA, 380 bp, Homo sapiens
  misc_feature 1..380: note = chr17:42733526-42733906
  misc_feature 1..380: note = hyper
  source 1..380: mol_type = genomic DNA
cggtgcctgccagtccgggccaatcccgaacacatttactttgagcgggaaaagctcagaagcggcgagagagcgtggtccgctaaccgccccttcctctccttgtctctggggggtaacggagcctggagtggtcgcccattggatgggcatcggaccaatggcgggctgcgaaacgggaggggcgggcctcacagcggggcggggcgcgcctgtgccgtgtcgcgtgccgagccgcgagccccaggcaggccaggtaacggcctctgcccccgcccctccctccccgctcggacttcccttacccgcacactggctccaggcagcgcccgggcggcggaggcggctgcggagacggcggggtgcgggctgagggagcc

SEQ ID NO: 36543 - DNA, 66 bp, Homo sapiens
  misc_feature 1..66: note = chr17:42906582-42906648
  misc_feature 1..66: note = hyper
  source 1..66: mol_type = genomic DNA
tcccaatcagacaatcgcaaaaaaaagaacaaaatctaaaccatacattcacgtacatcttttcaa

SEQ ID NO: 36544 - DNA, 182 bp, Homo sapiens
  misc_feature 1..182: note = chr17:42907014-42907196
  misc_feature 1..182: note = hyper
  source 1..182: mol_type = genomic DNA
ggggcggcccggctccgccctgcgcccctaaccgcccgggtagttgtcggcaccgccggggcgccgccgagtgcgcgccgcttctgtccgggctccccgaccgtcgcccgacacctccgcggcccaggacacccccgagccgtttccctcccgatttgggagccgcgcgcctggggacaaag

SEQ ID NO: 36545 - DNA, 416 bp, Homo sapiens; identical to SEQ ID NO: 12728
  misc_feature 1..416: note = chr17:42907735-42908151
  misc_feature 1..416: note = hyper
  source 1..416: mol_type = genomic DNA

SEQ ID NO: 36546 - DNA, 80 bp, Homo sapiens; identical to SEQ ID NO: 12729
  misc_feature 1..80: note = chr17:42988684-42988764
  misc_feature 1..80: note = hyper
  source 1..80: mol_type = genomic DNA

SEQ ID NO: 36547 - DNA, 299 bp, Homo sapiens
  misc_feature 1..299: note = chr17:43044508-43044807
  misc_feature 1..299: note = hyper
  source 1..299: mol_type = genomic DNA
ccccaagggcaagtccgtgcacctgggagccctgcgctctgactagttgggttcatttcccgcatttccagtagcgttccagacggtgcccagcagcgtctgtcttggagcgggaacccaggaactgaggatcggcgatgtccgctggctccgaccatccccacacgtgatgaccaagcggggccgctgtggggtgggatctccacctgcgtccgcctggcgcccccgccaactccgatcaggtacccatttgccccgggctccctgggtgccctgggcccagcccagccccatgcccc

SEQ ID NO: 36548 - skipped

SEQ ID NO: 36549 - DNA, 228 bp, Homo sapiens; identical to SEQ ID NO: 12730
  misc_feature 1..228: note = chr17:43045038-43045266
  misc_feature 1..228: note = hyper
  source 1..228: mol_type = genomic DNA

SEQ ID NO: 36550 - DNA, 141 bp, Homo sapiens
  misc_feature 1..141: note = chr17:43045371-43045512
  misc_feature 1..141: note = hyper
  source 1..141: mol_type = genomic DNA
cgagctcaccagcacggggatgagcaccaccagcaccagcagcatcaccacacccgcggcggccgctagcagcgtctttcggcccgcgcggagcctggggagcgccgggccgcccggccgcgccgtcggggcaatggtgcc

SEQ ID NO: 36551 - DNA, 233 bp, Homo sapiens
  misc_feature 1..233: note = chr17:43047752-43047985
  misc_feature 1..233: note = hyper
  source 1..233: mol_type = genomic DNA
cgcagagccctccgggcacaccgcggctggccgcccggggccaaggatggggcgggagcgcccacccacccccgcgccggccggggcatccaagaggcgcgctcgcagccacacggcgccccgcctcccgctccgaaaaagctcctgctcccctggcgcggtgtggcgtctccgtcagcccagccggattctccccgcttcgctggagtggaaaataacggcttcaaactttg

SEQ ID NO: 36552 - DNA, 224 bp, Homo sapiens
  misc_feature 1..224: note = chr17:43339109-43339333
  misc_feature 1..224: note = hyper
  source 1..224: mol_type = genomic DNA
gtccctactccaaggcgcgcatgcgtgtccgtgagagcacatgggtgtgcaccgcgcaggggctgaggctgggagccgtagtcaggggcaccgggtgggctttggcggcgggtcgacctgcctttcaggtgccgggggtttgggagcaggggaacgggccctgggcggattcctgaccgcccccttcgcgcccctccccctctcactttcgctttccccgcctg

SEQ ID NO: 36553 - DNA, 296 bp, Homo sapiens
  misc_feature 1..296: note = chr17:43339641-43339937
  misc_feature 1..296: note = hyper
  source 1..296: mol_type = genomic DNA
cctctccgaagacctcgggggtggggctcgcgcttccgcagcgggcctagagcgagaggcaggcggcaggtaagcctggctgtgctggacaggacttgcacccgctctgcacgccagcggctcagggctgccgcccttttcgtggtcccagggcccttccaagaaccggctaaaccaacccaagccgcgcgcacacacacttgtgcacacagggagtgtggagccagattcgataaggcaccccgtgtgccccagctccatgaccaaggaactcagcaccccgtgtgccccagctc

SEQ ID NO: 36554 - DNA, 169 bp, Homo sapiens
  misc_feature 1..169: note = chr17:43974231-43974400
  misc_feature 1..169: note = hyper
  source 1..169: mol_type = genomic DNA
gtgatgaacctggtacgcacggttttctggttaattctatcgctgaaaactggtgcggggggcgcacttctgagacggaagagcatctaggagctgaatcctccacgcgggtcgcccaggttgatctgaatttctggggaatggcttggctgcccgcccgggaccaggc

SEQ ID NO: 36555 - DNA, 102 bp, Homo sapiens
  misc_feature 1..102: note = chr17:44919159-44919261
  misc_feature 1..102: note = hyper
  source 1..102: mol_type = genomic DNA
gaccttgagcaaccacgtcctcctctgagctccgcgtttgccgtgtgcaaagtgaaggggtaggccgaccccgcagggcccttcttgcgctcctctgcggtg

SEQ ID NO: 36556 - DNA, 88 bp, Homo sapiens
  misc_feature 1..88: note = chr17:44928630-44928718
  misc_feature 1..88: note = hyper
  source 1..88: mol_type = genomic DNA
aatctcctccgtccccgcctcgtaccctcctccccgcctctccaggcccggggggcttcacgttcagccaccgcgaccccgggcgggc

SEQ ID NO: 36557 - DNA, 101 bp, Homo sapiens
  misc_feature 1..101: note = chr17:44929256-44929357
  misc_feature 1..101: note = hyper
  source 1..101: mol_type = genomic DNA
ggtctccagcttccccggctccgaatccatcgccctgttcagtgtccgagtctctggtcgccccccagccgccgctctcctcatcccgccgggtctcggac

SEQ ID NO: 36558 - DNA, 130 bp, Homo sapiens
  misc_feature 1..130: note = chr17:44929573-44929703
  misc_feature 1..130: note = hyper
  source 1..130: mol_type = genomic DNA
ggctgttcccggtctcggggcagaggatcgtgcgcgtccagggagaatgggggaaacctcggacggtgagagcgccagctggagacgcaggaaggaaccgtgcgctggggaaatgcgaccacatctcaga

SEQ ID NO: 36559 - DNA, 34 bp, Homo sapiens; identical to SEQ ID NO: 12740
  misc_feature 1..34: note = chr17:45055871-45055905
  misc_feature 1..34: note = hyper
  source 1..34: mol_type = genomic DNA

SEQ ID NO: 36560 - DNA, 117 bp, Homo sapiens
  misc_feature 1..117: note = chr17:45056144-45056261
  misc_feature 1..117: note = hyper
  source 1..117: mol_type = genomic DNA
acagcacgcagagcacggcgatctgcgccacccgcgacacccacaggctgcgctcgtcgggcgccagccccgcggggaccccgtcgctggcggccagcggtgcgccccctggacagc

SEQ ID NO: 36561 - DNA, 37 bp, Homo sapiens
  misc_feature 1..37: note = chr17:45056814-45056851
  misc_feature 1..37: note = hyper
  source 1..37: mol_type = genomic DNA
ccccctcctggcacccgctgtccgttcttggctagaa

SEQ ID NO: 36562 - DNA, 30 bp, Homo sapiens
  misc_feature 1..30: note = chr17:45331645-45331675
  misc_feature 1..30: note = hyper
  source 1..30: mol_type = genomic DNA
tggtcgggccaaggacgactggcccaggag

SEQ ID NO: 36563 - DNA, 873 bp, Homo sapiens
  misc_feature 1..873: note = chr17:45810546-45811419
  misc_feature 1..873: note = hyper
  source 1..873: mol_type = genomic DNA
ggagtgggggggagccggagagcttcataaagccacagcaaagcgctgcgactctagtgacagcggcccgctggagaggaagcccgagagctgccgcgcgcctgccggacgagggcgtagaagccaggcgtcagagcccgggctccggtggggtcccccacccggccctcgggtcccccgccccctgctccctgcccatcccagcccacgcgaccctctcgcgcgcggaggggcgggtcctcgacggctacgggaaggtgccagcccgccccggatgggcatcgtggagccgggttgcggagacatgctgacgggcaccgagccgatgccggggagcgacgagggccgggcgcctggcgccgacccgcagcaccgctacttctacccggagccgggcgcgcaggacgcggacgagcgtcgcgggggcggcagcctggggtctccctacccggggggcgccttggtgcccgccccgccgagccgcttccttggagcctacgcctacccgccgcgaccccaggcggccggcttccccggcgcgggcgagtccttcccgccgcccgcggacgccgagggctaccagccgggcgagggctacgccgccccggacccgcgcgccgggctctacccggggccgcgtgaggactacgcgctacccgcgggactggaggtgtcggggaaactgagggtcgcgctcaacaaccacctgttgtggtccaagtttaatcagcaccagacagagatgatcatcaccaagcagggacggtgagtgcggcgcgccggcccttggggcctctgtgcccgcgccggaacaagaacgtctcgtctgtttttctggctcgacaatgcttctgactccgtgtccctcactgc

SEQ ID NO: 36564 - DNA, 457 bp, Homo sapiens
  misc_feature 1..457: note = chr17:45867027-45867484
  misc_feature 1..457: note = hyper
  source 1..457: mol_type = genomic DNA
acttgtactttcaaccacgtcccccactccaaaattctgcgcctccctcaagccagttcctcctctgcttcctcctcgcagcagccggcgcgtctttgttccgtccaggcatcttcaacgcgtccctccctctggacgctgccgaggaaatactgaagtggtagaggatgtggggaggccgtccaagagtggaggtgtcccgggcctgctctctccaggaggaggagtgcaggctggggtccacctccccggtccagcagtgctggggaggggaccccgcacgtgtgcccggagcgcggacacggtgatgcggctgcccctcgccccggccccaggctcgctgcgccctccctccccggtcgcctctgcgtttctcccgccagcaggagaccgagtctgagcgcagccgccgaccctgcgccttccctgtgcactcaaagaccgccagctctggggg

SEQ ID NO: 36565 - DNA, 156 bp, Homo sapiens
  misc_feature 1..156: note = chr17:46089946-46090102
  misc_feature 1..156: note = hyper
  source 1..156: mol_type = genomic DNA
cccgcgcatccctgacggtgcccaggaaggcagagtgggggagagacgacccgcactcagcctgtgtttagggaggactggacccagtgcggttcgcaagaggttctgtgtccccaggccatctttggtgacattgaaccccgggagtccagctcc

SEQ ID NO: 36566 - DNA, 30 bp, Homo sapiens
  misc_feature 1..30: note = chr17:46507708-46507738
  misc_feature 1..30: note = hyper
  source 1..30: mol_type = genomic DNA
cacgccggagccccacggtagaaggattgg

SEQ ID NO: 36567 - DNA, 36 bp, Homo sapiens
  misc_feature 1..36: note = chr17:46619087-46619123
  misc_feature 1..36: note = hyper
  source 1..36: mol_type = genomic DNA
cgcaggggcgggggcagatcccggctgggccggcgc

SEQ ID NO: 36568 - DNA, 882 bp, Homo sapiens
  misc_feature 1..882: note = chr17:46620552-46621434
  misc_feature 1..882: note = hyper
  source 1..882: mol_type = genomic DNA
gagacaggagtcggccgcgaagaagttgaggtcgggaaggaaaggtgaatcctggcgccccgagaagacgtcttctggcaatggcccgggctccagcccgccggccccgcgcagcgcgcagccgggactcgacgcgcctgcgccctctaagcgaacggctaaaggccgggggtccgcgcttaaggcccccggcaccacctccggcgggtgacagcaggcttcccacgccgcccgcgaggcggaggggccgcccgggctggccgcgggttcctcggcagggtcgcagatgtcctccagggctcccgggcaggcaggctccccatccggcggctctcggtgctgcgtctgccgcttgtgcttcatgcgccggttctgaaaccagactttgacctgcctttcggtgaggtccagcaaggccgcgatctcgacgcggcgtggccggcacaggtacttattaaagtggaattccttctccagttccagcagctgcgtgttggtgtaagccgtgcgcagcctgcgcgccccgccgccaccagcctccggcagtcccaggccatctgcagggaaaacaggctcggcgtcatagcgggccgtgtactcagcccaacctcagttcggactaccccatcctccaaaaccagtatcacctctccccttcctcgccaccccacccccgcccccaccccaaagccgctcgctttactgcttttgggttttcttctctccctctctagtctacagccccggcccgggtcagggcaaagcattcagagccgcccacgggccacgcagggggcggagagcggctcccttcggcgccggaacctcagatccccctcccaagccctcccagtggacccctcaattcggaactttccaact

SEQ ID NO: 36569 - DNA, 232 bp, Homo sapiens
  misc_feature 1..232: note = chr17:46621779-46622011
  misc_feature 1..232: note = hyper
  source 1..232: mol_type = genomic DNA
gaaccccaacaggctcgccaccattttttttaaacctccttccactgctttttctccccctcttctagctgcccctcaccccacccccaccacgcttaccgacctgcaggcgatccgaccccggaggccggaacggcggaggcggccggagaaggagacgtggcggattggctgggtttcttggcggatttcttctctttcatccaagggaactcgggggccgggggggcag

SEQ ID NO: 36570 - DNA, 324 bp, Homo sapiens; identical to SEQ ID NO: 1295
  misc_feature 1..324: note = chr17:46655070-46655394
  misc_feature 1..324: note = hyper
  source 1..324: mol_type = genomic DNA

SEQ ID NO: 36571 - DNA, 24 bp, Homo sapiens
  misc_feature 1..24: note = chr17:46655395-46655419
  misc_feature 1..24: note = hyper
  source 1..24: mol_type = genomic DNA
gcgcaggagcccgaggggacagac

SEQ ID NO: 36572 - DNA, 111 bp, Homo sapiens; identical to SEQ ID NO: 1297
  misc_feature 1..111: note = chr17:46655450-46655561
  misc_feature 1..111: note = hyper
  source 1..111: mol_type = genomic DNA

SEQ ID NO: 36573 - DNA, 437 bp, Homo sapiens; identical to SEQ ID NO: 1298
  misc_feature 1..437: note = chr17:46655562-46655999
  misc_feature 1..437: note = hyper
  source 1..437: mol_type = genomic DNA

SEQ ID NO: 36574 - DNA, 350 bp, Homo sapiens
  misc_feature 1..350: note = chr17:46656057-46656407
  misc_feature 1..350: note = hyper
  source 1..350: mol_type = genomic DNA
cgcaaaccctagatcccttaagaagttggggctcccggtgtagccctcctgttctgcctcacctctgcccagcattctgtaccttccaaaggccccagtctcctcccctcggcgggagggagcgctagcaccctgcgtctctatggggagttaggttactggcgggttgggggctccgtctcgaaaggggaacccatacgggggccagagcacagagcttggggcttttctctgcagctggatggggaagggtaggggtgagagaggaggcgtccagagctagagggcgggtgcgcagagggacttgtcagagatgaatggaaccgcgggcggatcgataggaaattcat

SEQ ID NO: 36575 - DNA, 480 bp, Homo sapiens; identical to SEQ ID NO: 4434
  misc_feature 1..480: note = chr17:46659429-46659909
  misc_feature 1..480: note = hyper
  source 1..480: mol_type = genomic DNA

SEQ ID NO: 36576 - DNA, 237 bp, Homo sapiens
  misc_feature 1..237: note = chr17:46663552-46663789
  misc_feature 1..237: note = hyper
  source 1..237: mol_type = genomic DNA
agacaagagaggagacgcctaaatcactgagaaaaggaataagaagagagggaagagaaacgttaaaacttggggacaaggtgctttttgggatccgacaggttcccgaattgcccgaagtccaatactctccaggctcccaaatttcccctcttcctcttggagcctgcaatcagtaaattcgccaaaagaaagaacgaaagatccgcctaaacctgccggcgtgcccccaccccc

SEQ ID NO: 36577 - DNA, 553 bp, Homo sapiens
  misc_feature 1..553: note = chr17:46670978-46671531
  misc_feature 1..553: note = hyper
  source 1..553: mol_type = genomic DNA
tagcaactgatagtccgggccatttggataacgccccgagaaggagtttacaaagtacgagctcatttgggtgattttggagggcttgatttgtggatcgtggtcgttataaccctgtgcttcacgatttatgatgtattaatgaattatagcgatgcactgtacttcgttttgctatgtatgcggccaaatatggggggggggttggaaggggggtggggggcgttagggaatcacgtgcttttgttgaccagtcgtaaattctcgctgatgacctcaagaggtaattcatgctctatggttacaaataatgacgatccgagaatcgttagggccgattcaatgcgagcctccgagagagggggaaaaaaggagaagggggagaaacagagagaaggttggctttggcctctgagcagagcgcgccacctcccggcgaccgacgggagcgcgggcgtgagaccgccatggcggcgggcggctgcctccctgctggctccctgcaggctccctgcagtcgccgggagagaaagaaacccggccaaggctcagc

SEQ ID NO: 36578 - DNA, 835 bp, Homo sapiens
  misc_feature 1..835: note = chr17:46674922-46675757
  misc_feature 1..835: note = hyper
  source 1..835: mol_type = genomic DNA
taataggggacacagcgagagacccccggccggcgcccaatcttcttctatctcctaactgagatgcccacccagcaccctgtgggagattggggcagggggcgctcactagttctgtgtcccggggtgggcgcccaggggagccggggcgacggcgacgggaagtctcactcactgttgcacgaattcatccgctgcatccacgggtagaccggagtggagcacttctgctcttctgtctcgccgaacacgctcttgtcctgcgcgcagtccgacttccgcggctcggggtggaacgggggctgctcgtcggcgccggagagtgcgcaggccgactctttctcgcggtagaaggccggcgccggcccgtagtcgcagggcgccgctcggccgtagccaccgcccgccggcgggtaataggaggaagtggcaaagcccttgtcctggcccggccctggcccgtagggcgcggggtaatgtctcagcgggtccgcatagcccgacgaatagagcggtagctggcccaggaaggactcctgcccgctggccagagtgacggggaaggtggagttcacgaaataggaactcattgggaggggaggcgcgcgcggccgctgctgctccgccgggtttatgatttgttgtgttttatagtccgagcgccgcgcctattagtagtatatccgagattgggttttagctgaggggggatggcgaggtgccagtgagggccagaaggaaatacaaccatctgatccaacactgaccaatggcagaggcaggaattgtcaaatagcacccaggaggagcgcagcccgcacgagggacccgcgca

SEQ ID NO: 36579 - DNA, 1002 bp, Homo sapiens
  misc_feature 1..1002: note = chr17:46687804-46688806
  misc_feature 1..1002: note = hyper
  source 1..1002: mol_type = genomic DNA
cagccgggaaggaggcgccttcagggtaatgtgccccggcccctggggctcaggacagctcggtgcgcggcgttacctgagcttcgcatccaggggtagatccggaagttactctcggccgccaagtccgagtccctctgctccttggcgcccgccgccttggcggagtcgccgggacacaccccggagaggttctgctcaaagggcgcgcagtgcatgttgaaggaactcggctcgagcccatagccggccgcgtagacgccggccgcgctctggcccgccatgccccccccgccggggtacaagccctgcatcgaggcggcgaaggaagcgcccgaacccgctccatagcccgggcgctgggggttggaagcaaacgcacaagaagtttgttctgggaaggctccggtagcgaaaaccgaacttgaggctggatatttagaaaataaagtattcgcataatacaatgaactcataatttggccggatgatttgtaggcagggacgttttagtgtcggttttacgagattccttgatatattacagaattagagtccagatttacaccaaaaaggaccccctttttcctctccggaccacgtgaccccgcccacgtgacgtcccctccgccaatggccgggccgtctccccacggctcccggtaatgtggaaaaaattgtgtggcgttggatttataaaatatgatcaataatgaatgggaaagccgagccctgtggattggggctgggggctcaagggccgctgccgactcccgcgggctggaggccgcttgcaggcgagatttggggaggaagagattgagtggaagggaaaataaataacctcggggcgatccgtgtcaccctccacccatcctcttcagcccgttaccgagcgagagacaaacgcagggattgaatgcacgcaactgggtgggtgggtgcttggggcaggtctgttctttattaaaccaggccaattctgcacggcaaggccttttg

SEQ ID NO: 36580 - DNA, 378 bp, Homo sapiens
  misc_feature 1..378: note = chr17:46689986-46690364
  misc_feature 1..378: note = hyper
  source 1..378: mol_type = genomic DNA
cagagagaaagccagcgagctggggggttgcagaggggagagaggattgggaggggaaatgaggacgcagcgagagagagcgagagcgagagcgagcgagcgagagagagagagagaagggagacagaaagaattacggcgtgaataggcagtttcatgttgttgggagaacttagcagaaatcggtaccttggtcattacaaagaagcacgttcaaaggaaaaaaaagacaattgcacaaggaggctttttacacggggaggggaggggcatggggggctcagccgggcctttgccgctcgccctcacagggcgagggagcctttgcttaaatccttttctttccccccggcccccaagagaagggaaggagatcca

SEQ ID NO: 36581 - DNA, 276 bp, Homo sapiens
  misc_feature 1..276: note = chr17:46690429-46690705
  misc_feature 1..276: note = hyper
  source 1..276: mol_type = genomic DNA
cgctgcggtgggaggcccggctcctggccccgctagcggggccagagctctctcgggcaggggcgcgcggcggcggcgcggccgggacccgcggacgtgcgggcggccgcggccctggcagtcccagctgaagcctacttcttgtcgcccttctgcgcgtcgccctcgtccgccgcctctggggcccgctccagcttctgtttctccagctcctcctgctcgcatttgctgctggggaacttgtctttgttgttctcttttttccacttcatcctc

SEQ ID NO: 36582 - DNA, 53 bp, Homo sapiens
  misc_feature 1..53: note = chr17:46690852-46690905
  misc_feature 1..53: note = hyper
  source 1..53: mol_type = genomic DNA
cgcctgcgtccggcggctgctgggaatgggggaaagggcgagacagaggggag

SEQ ID NO: 36583 - DNA, 377 bp, Homo sapiens
  misc_feature 1..377: note = chr17:46691442-46691819
  misc_feature 1..377: note = hyper
  source 1..377: mol_type = genomic DNA
ggaaatgtttctaagcgacccccttcaagggaaagaaaaaagaaagaagaaagaaagataagaaagaaaggggaaaagcggcaggcgatcggaacggagccggcaagtcttccagaagctggaggaaatgcgccccggcctgccaggccttgggcccttccggccccctcctgcccttgtcggccccgaggcgagctcaccttgcgggcgcatccaggggaagagctgtgtgggcgacgggctctgctcggagccctcggcctcctcgcccaggccgctggcggcggcaagcttgcagtctgcgtactgcaccaggtctggatcctgcgcaccgaataggctctggcgttgcagcgggtcgtagccgtagaaattgc

SEQ ID NO: 36584 - DNA, 378 bp, Homo sapiens; identical to SEQ ID NO: 4440
  misc_feature 1..378: note = chr17:46691987-46692365
  misc_feature 1..378: note = hyper
  source 1..378: mol_type = genomic DNA

SEQ ID NO: 36585 - DNA, 141 bp, Homo sapiens
  misc_feature 1..141: note = chr17:46702566-46702707
  misc_feature 1..141: note = hyper
  source 1..141: mol_type = genomic DNA
ctaggaacaatcctccgccaagctgttgcatcgcaaataaaatcctaatgagctccctcccccttccccttggccggcttttacggtctgcgcgtggcgcggggagctctgccagccgcacggccccgggcagcccagtgc

SEQ ID NO: 36586 - DNA, 50 bp, Homo sapiens
  misc_feature 1..50: note = chr17:46710940-46710990
  misc_feature 1..50: note = hyper
  source 1..50: mol_type = genomic DNA
gtccaggctccctcccgccctcgcccagaagcgagggtccgagtggccac

SEQ ID NO: 36587 - DNA, 181 bp, Homo sapiens
  misc_feature 1..181: note = chr17:46713949-46714130
  misc_feature 1..181: note = hyper
  source 1..181: mol_type = genomic DNA
tctgtggtctcccggcgggtgaggccgagacagagaccaacctctaggcggcgccctggcgttgagtccgcgctgaacaagattctctcgcagctctgcgtcccgcgccgggtgaaggggcgtgttcctgcaggcgctcggggctcggcctggagctggcggccggcacgtcgcctttggc

SEQ ID NO: 36588 - DNA, 154 bp, Homo sapiens; identical to SEQ ID NO: 12768
  misc_feature 1..154: note = chr17:46714131-46714285
  misc_feature 1..154: note = hyper
  source 1..154: mol_type = genomic DNA

SEQ ID NO: 36589 - DNA, 301 bp, Homo sapiens
  misc_feature 1..301: note = chr17:46723899-46724200
  misc_feature 1..301: note = hyper
  source 1..301: mol_type = genomic DNA
gagaggggcctttcacgccgcagtccccagctgcgagaggaagggctgcgcccgcctcctcacctacctctcggaaccacgccgtcccccgcgcgtcttcgtagactgcaggagtccagggcgtctggggactgtgacggcgcccaaggcgggggatgtggcggctctgggtcgccgccttctgcccccgcctctgtgaggcctctcgaggcagtgtctgtgtctggggcagcgacgccgacggcgctgggggcgcgaaggggctcacgctcctgcgttcccctggcgccggtgagtggcg

SEQ ID NO: 36590 - DNA, 43 bp, Homo sapiens
  misc_feature 1..43: note = chr17:46755656-46755699
  misc_feature 1..43: note = hyper
  source 1..43: mol_type = genomic DNA
ctcaagtctcaaacacggtgcggggctgcgcggcaaggagaaa

SEQ ID NO: 36591 - DNA, 938 bp, Homo sapiens; identical to SEQ ID NO: 1300
  misc_feature 1..938: note = chr17:46795436-46796374
  misc_feature 1..938: note = hyper
  source 1..938: mol_type = genomic DNA

SEQ ID NO: 36592 - DNA, 55 bp, Homo sapiens; identical to SEQ ID NO: 1301
  misc_feature 1..55: note = chr17:46796498-46796553
  misc_feature 1..55: note = hyper
  source 1..55: mol_type = genomic DNA

SEQ ID NO: 36593 - DNA, 25 bp, Homo sapiens
  misc_feature 1..25: note = chr17:46796613-46796638
  misc_feature 1..25: note = hyper
  source 1..25: mol_type = genomic DNA
cagcactactaccgtctgagcaggc

SEQ ID NO: 36594 - DNA, 365 bp, Homo sapiens
  misc_feature 1..365: note = chr17:46796849-46797214
  misc_feature 1..365: note = hyper
  source 1..365: mol_type = genomic DNA
cgggcgacagccccccggataaccccgccgagggaggggcgcttgtaaaaccgagcggcgacggcctcgttacgaccgactcgaacattctctaataaatcatcggccttagctagtattcgtttgtgtacgcatctgtttatcctgattattaaaataaattaaggattagactgcctagaataaggtaaacgaacatgaaatgccaaggaggaaaacagaaaaagttacaccatgtcgatcccgaccaaaacattggcctgacttgccggatggcctcaagaatccggcttttagctgcaggcccggcgggtgttccccggaaggcaaggattggaagctctttgataaagccgcgcgaggcc

SEQ ID NO: 36595 - DNA, 455 bp, Homo sapiens
  misc_feature 1..455: note = chr17:46797274-46797729
  misc_feature 1..455: note = hyper
  source 1..455: mol_type = genomic DNA
cgtctcggcctggctccggaggggtgaaggaatgtttatagcctgactcaagttcaatgacaaaaacctgcctggaatgggaggtgcggcgagcttcagccatcaacatgacaaaggctggacgcaggtctcgggcgggggcgacgggctgggcccacctagagatggggagctgagggcccacaggatgggtacggaccccgcagaccaagagctgcctctctgccctcagcctggggtctgcggagtttggcgagtagtgcgggtgtgtgcccgcctggatgagggtaaggcgatcagcctctgagtgggcaaggggacgtctgattactgcccaggcttcgcctgggggtccaggaccctgtgagatgcccctgctctctgcctggccagctctagctcacccggagtaaggatccgcaccgtccttctatccaccgcgacctgcattttct

SEQ ID NO: 36596 - DNA, 172 bp, Homo sapiens
  misc_feature 1..172: note = chr17:46799288-46799460
  misc_feature 1..172: note = hyper
  source 1..172: mol_type = genomic DNA
tttaaataataataacgttatcaatattaattttgcttatgccaggactccatcccattggagacaaacattaagtcttatggcagaccttacagcgggtgctagttcccactcccaagcctctcccccgcctaggtcctgcaggtcccgcgtgctgcgaaacattttcttt

SEQ ID NO: 36597 - DNA, 95 bp, Homo sapiens
  misc_feature 1..95: note = chr17:46799801-46799896
  misc_feature 1..95: note = hyper
  source 1..95: mol_type = genomic DNA
cttgcaagcaagcatcggcctaaaggtttcagcctcccagtggcgctctgtttgcacgccttaggctaggagaggaaggacgggagcacagcact

SEQ ID NO: 36598 - DNA, 30 bp, Homo sapiens
  misc_feature 1..30: note = chr17:46800233-46800263
  misc_feature 1..30: note = hyper
  source 1..30: mol_type = genomic DNA
tccccccaggctgggcgccagcattattct

SEQ ID NO: 36599 - DNA, 559 bp, Homo sapiens
  misc_feature 1..559: note = chr17:46800489-46801048
  misc_feature 1..559: note = hyper
  source 1..559: mol_type = genomic DNA
gcctggggggaggggcggggtgtcctgcttttgggctagaggcccggggccgctcccgagctttctcccctcttccctggagagcgactgttcgggagggtgagaatggtataaatttcaaaaacaacgaaaccttcttttgccccctccgcagcagtcgcctccgggctttattgcaagtttacggtaacgagttcatctatttaattcgcggttgcagctcggggatttctattagacaggacgggttggggccggggggcacagggtctcccctgaaggaaacccaattagagtgcagcacttagcaccttcaatataactttaatgaagggggggaggggagctgcagggaagagaagtttgctctaggttggggaaggaaagctggagctgctcccgagaactggggggcctggatgaggctttttcctgcttcgagggctttccagcttccggcccgggaactactatttggagtagggatcgcctgcagggaaggcggggcggattctcggctggcggcggcctcgcagggttcccggaagcgctagccagc

SEQ ID NO: 36600 - DNA, 188 bp, Homo sapiens
  misc_feature 1..188: note = chr17:46801108-46801296
  misc_feature 1..188: note = hyper
  source 1..188: mol_type = genomic DNA
cgagattcaaaaagagcttccggaggtagtttctacgcattgcgccactactcccttattcggcttctggaggcctaataaaatccacttgctttggagttagaaattatttcgggcctggagcccgcgtagacgcgaccctgtgatcccatttcgtagcttgctgagagattcgctgcgggagtttg

SEQ ID NO: 36601 - DNA, 30 bp, Homo sapiens
  misc_feature 1..30: note = chr17:46801636-46801666
  misc_feature 1..30: note = hyper
  source 1..30: mol_type = genomic DNA
gattcccaatgaaagcgtttaatacaaaac

SEQ ID NO: 36602 - DNA, 655 bp, Homo sapiens
  misc_feature 1..655: note = chr17:46802257-46802912
  misc_feature 1..655: note = hyper
  source 1..655: mol_type = genomic DNA
catctccgttagtggcggtggcagcccctcttgtggcctttttcctctctccaaggggtcaccccgcaccatgccgctccccctcatctatcttgccccctccccacaggcccatctgcgctgaactctcgccagttccgaagtcggcgagggagggggtttacttgcccgatcgttggtgggtttgagcttatagaggcagaggagtaagaacctgcgatattgaaagctacccacatggggcttccttgaaggaggacgtggaaggcagaaagtgacctgctctgagcggcgcatgtaaccgaggaccttaagctggaccacggggcttggacgattttttaaatcaggaaatcgacctcatcttcctcctcctcgtcctcttcccctgaacccccagtccgcatgcactcacactctttggccttttccctcagtcccgggctcctctttggtaaatagatttgtaggtgtctaagtcacgtcccaccctcactccttcccaggagaggagacagggctaggatcccacccgaccgcgggccataaacacttggctgcggcggccgccgcggggtttctaggagagctggctccgggagggaaatgtcctcgaggtagtggcggccgcggcccaccaccaactgctcgccac

SEQ ID NO: 36603 - DNA, 192 bp, Homo sapiens
  misc_feature 1..192: note = chr17:46802993-46803185
  misc_feature 1..192: note = hyper
  source 1..192: mol_type = genomic DNA
cgtggagaatgcgccggcaggccccccacccccagcctaaggtgcaggaaggaccagcacgaacccgctggctttgctgcgcggccaggagatgagtcccaccgggcactgagcccaggtacaggacatcagagaatgaacacagaggcagaggccctcatgtccctctcagagtcccggctctgcaaagag

SEQ ID NO: 36604 - DNA, 30 bp, Homo sapiens
  misc_feature 1..30: note = chr17:46803786-46803816
  misc_feature 1..30: note = hyper
  source 1..30: mol_type = genomic DNA
ctcaattcatgaaagcggtttctaaagtgc

SEQ ID NO: 36605 - DNA, 321 bp, Homo sapiens
  misc_feature 1..321: note = chr17:46804107-46804428
  misc_feature 1..321: note = hyper
  source 1..321: mol_type = genomic DNA
ggacacccccactttcgctcctcccacccaggcaaggagatctcttaaggggtagcgctgttcttcaccttggcgagaaccttcttctctttgacccggcggttctgaaaccagatggtaatctggcgctccgagaggctggtggctgccgagatcttgcgcctcttgtccttggtgatgaacttgttagccgcatactcccgctccagctcccgcaactgccccttgctgtacggaatgcgtttcttgcggccgcgacgaaaggcgcaggcgtcaggagggtgctgcccgctggagtctgcgcggcgtgaaagggaggga

SEQ ID NO: 36606 - DNA, 352 bp, Homo sapiens
  misc_feature 1..352: note = chr17:46805572-46805924
  misc_feature 1..352: note = hyper
  source 1..352: mol_type = genomic DNA
gcaaactcagtggggcggctggggtactcttccccggccgtgggagtctccgcggggtacgcggccagggtggctgcctgggcacagggtttcagcgagctccgggacactcggcaggagtagtacccgcctccaaagtaaccataaggcacgggagctggggacgtcccctggggcaccccagggcatgggtggcattgctttggcggctccgccgagcctggcagatccaagggggcatagttgacagcaggcatcagcgtaggcgccgctgggtggctggtcagaggggagtgggcgaccagattccgcccccctcccgctcccagcaagccttcgatatccttggctc

SEQ ID NO: 36607 - DNA, 107 bp, Homo sapiens
  misc_feature 1..107: note = chr17:46806788-46806895
  misc_feature 1..107: note = hyper
  source 1..107: mol_type = genomic DNA
tggaatgagctgctccgggccccagggaggtgccctggacgccccttacccagggactcgctactgcccagaatgctctggaggccctgattcgggtgaggctgagg

SEQ ID NO: 36608 - DNA, 823 bp, Homo sapiens
  misc_feature 1..823: note = chr17:46810273-46811096
  misc_feature 1..823: note = hyper
  source 1..823: mol_type = genomic DNA
cctgcacaacccaggcgtcctgatcttccagactgactgggctgagcctggccttcccctaaccccacagatgcctttgtgtcctgctgggagcctcctggcagaccctccgggagcccggagcctcccccagctttctttactgacccagccaaaagcgctgaaagcctcagcgtgctcctttacatacccgccagacacctccaggaaggtaaaggccaagttgaaagttaagagtctgtttacctccaggagcccattcagctcggccccacagacagcctgtgacctttacagcccggcctttgagcgcggccgccgcgcccccgggggttccggcaacggggacttggcacctcggtgtcagctcccgcccccacccaggctagggacccgccaacgaggggtgggggcgggaggcgcccacccgtcgcactagtgggcatttgctaaactacgttttatttttttgtaaagtgagcgcccgctgccttcgttctcccaactggagcaaactctgtggcggcgacgatggcggccgtcaggtcggtggtgatgaatagagaggatttctctgcagcgcgacgctcccctctcccgaaaggttggctccacggtcccgccggccgcgcaggtctggctgaactgcttggggtcgcccggctcctctcgattttatgaaaatggcctaattgaggtgtgctcttttctttccttcctcttttcatcttttccttccgtctgcattttctctcctctgtcttaggcttggtatcttcttttctttttatatttgtgtttttctcaccgcctttgcttcctt

SEQ ID NO: 36609 - DNA, 146 bp, Homo sapiens; identical to SEQ ID NO: 12785
  misc_feature 1..146: note = chr17:46811354-46811500
  misc_feature 1..146: note = hyper
  source 1..146: mol_type = genomic DNA

SEQ ID NO: 36610 - DNA, 30 bp, Homo sapiens
  misc_feature 1..30: note = chr17:46812585-46812615
  misc_feature 1..30: note = hyper
  source 1..30: mol_type = genomic DNA
tgtctagtgcaggcacggttattagtgctt

SEQ ID NO: 36611 - DNA, 71 bp, Homo sapiens
  misc_feature 1..71: note = chr17:46815930-46816001
  misc_feature 1..71: note = hyper
  source 1..71: mol_type = genomic DNA
aggccaagctttggacgagggaaagcacagactgacgccgaccagcccatcctccccggccttgcactgcc

SEQ ID NO: 36612 - DNA, 454 bp, Homo sapiens
  misc_feature 1..454: note = chr17:46816270-46816724
  misc_feature 1..454: note = hyper
  source 1..454: mol_type = genomic DNA
gggtcaggtctttaacggtccagccagcgcagcaagagagctggggagtcttcttgcagtcccttcctcctactcacgcaaagatctcctctatgctggtaggtgcacctgccctccaccgatcctcaccctgagcgcaggtcgtacctcaaggcgaaaacccgcttagtgcgttggcgggtggagagctgccgccttcttgatccgggactgagaagctgcactccctgacgccactgtggccagcacctcgggccgcgcagacccctacatctctaatcccatagccctccaggggtccttggggcagtccctttggaaagtcttcgaagtgcagggtactttaagtaccctgtagacgccttttatttaatccgcacaacaaaagaacggggcaggagtggggggaaattgttacttccgttttgtagataagagaactgagccgggacgg

SEQ ID NO: 36613 - DNA, 417 bp, Homo sapiens
  misc_feature 1..417: note = chr17:46824498-46824915
  misc_feature 1..417: note = hyper
  source 1..417: mol_type = genomic DNA
gcctgttccccatcacgattgatcctccagggtcgccaaggctcctgctgactacaaaaacatccccaagattcccttcttgacccggttcaggcatatctctttatacttccatgtctccgtttctctatatttttactgtggaggactcagaagagagctgaggctattgtccggggaggaaaggaattcgggcaaatttgtgggtaggggcccagacccaagacccgtgtttctcctgcgtgggttggagtctgtctcaggtcgctccagggacatcaagagcccgcgccgccgagagcccgcgccgccgtccagcgggaagcagcggacccacaggggcctccagccgcctccccgctcccgccccgtgtttctcctgggcctccagctccgtggagagagctgagagttctc

SEQ ID NO: 36614 - DNA, 469 bp, Homo sapiens; identical to SEQ ID NO: 1307
  misc_feature 1..469: note = chr17:46824916-46825385
  misc_feature 1..469: note = hyper
  source 1..469: mol_type = genomic DNA

SEQ ID NO: 36615 - DNA, 63 bp, Homo sapiens; identical to SEQ ID NO: 4456
  misc_feature 1..63: note = chr17:46826997-46827060
  misc_feature 1..63: note = hyper
  source 1..63: mol_type = genomic DNA

SEQ ID NO: 36616 - DNA, 172 bp, Homo sapiens
  misc_feature 1..172: note = chr17:46827330-46827502
  misc_feature 1..172: note = hyper
  source 1..172: mol_type = genomic DNA
tccttggaggacaggcggctgcttaggagtgggacagtaaggactaggctgggtctggagggctggcggggcaggagttgggggccaggtaggaaagccaggggtcgaagggatcgattctaggggccgcagaggctactctcgtgctctggagaagcaccgcatctttctc

SEQ ID NO: 36617 - DNA, 68 bp, Homo sapiens
  misc_feature 1..68: note = chr17:46827625-46827693
  misc_feature 1..68: note = hyper
  source 1..68: mol_type = genomic DNA
cgccagcattttgccggggtttatgcctcaatcccgcattccagccacttccacgaattacttggaag

SEQ ID NO: 36618 - DNA, 157 bp, Homo sapiens; identical to SEQ ID NO: 4459
  misc_feature 1..157: note = chr17:46829979-46830136
  misc_feature 1..157: note = hyper
  source 1..157: mol_type = genomic DNA

SEQ ID NO: 36619 - DNA, 64 bp, Homo sapiens
  misc_feature 1..64: note = chr17:46830189-46830253
  misc_feature 1..64: note = hyper
  source 1..64: mol_type = genomic DNA
cggtagggatgcctgggagtctagggagtggcgggggtgtttcttggcccggcagggtggggtt

SEQ ID NO: 36620 - DNA, 40 bp, Homo sapiens
  misc_feature 1..40: note = chr17:46830483-46830523
  misc_feature 1..40: note = hyper
  source 1..40: mol_type = genomic DNA
gggcggtcttccaagcgggcagccacgttgcctacttgag

SEQ ID NO: 36621 - DNA, 547 bp, Homo sapiens
  misc_feature 1..547: note = chr17:46831779-46832326
  misc_feature 1..547: note = hyper
  source 1..547: mol_type = genomic DNA
taatgggaacagtgacggaatgaaagtgaccacgctggaacccgaagcgctgttcccctccgtggcttcacactgatctccacactagaattccgtgtctgcagttcaagttcaaactactgtggtcggggaagggctacagagatctcgcttggccgtggagtcaccggccccgtccagtcttgcttgggacacatactggtttacactctctcgggttcagtttcctcatctgtaaatggggctcgtatccccctcataaagtggtttgggggataataaagcttgtaaaagcgctttgccccagtgcttggcacataatacgcgctacgttaacaatgtcgcgtacacgcccgaaccggaggaaccccattccacgctccttctggaaccgaattcacctctgaggctttggggcttcagagccggagccgcttgggcaaaaccagcagaacagcgagagggaacgggctggtctagccctgccctgagcatttctactgagacccccggtcctgcttcttccagcctctgctggatttctctc

SEQ ID NO: 36622 - DNA, 304 bp, Homo sapiens
  misc_feature 1..304: note = chr17:46832489-46832793
  misc_feature 1..304: note = hyper
  source 1..304: mol_type = genomic DNA
cgtcgacccggggtctttttccgccaaggagctcggggctcaagaactcgggactgggctgtgggcggggcatggttttcctctctgggcgtcctaatctccaatttcaggcaaattcgctaggaagaaccttcccgagcgcgccttctccaacaggacctccaagccagcctcacgcacgcaggcctggctctctcctgcagaatccccacctgccctataactacccacttcagatatgggggaatggaggagatattccaatcacgccatctacctacagtttccacggccccttctgttg

SEQ ID NO: 36623 - DNA, 61 bp, Homo sapiens
  misc_feature 1..61: note = chr17:46918852-46918913
  misc_feature 1..61: note = hyper
  source 1..61: mol_type = genomic DNA
ttgtcagaaaattctcgtagcataggaagttgtgactgagatggctcgaagtgaaacagaa

SEQ ID NO: 36624 - DNA, 353 bp, Homo sapiens
  misc_feature 1..353: note = chr17:47072676-47073029
  misc_feature 1..353: note = hyper
  source 1..353: mol_type = genomic DNA
acaaaaacaaaaatccgacaaacacgtggctgggtagaacaaaacgctcattggggagggtgggctctaaggtggtggaggatatagagaaaccgagttggaagccctcccccgcccctaagtcccagccccatttcttttcagcgcgccgggaaaacggggagggggacaaaggtgctgcgtgctgtctttcaactcccgactttttgaatggcatacaatcgtccggccgcagagcggtgagccaaagtcggagtcagctcagactctgcaaacgaaaaataataacaataaaaaaaattcaaggcattcatatcggtgtagtcaacacgtgttgcggagtcggcccgggc

SEQ ID NO: 36625 - DNA, 225 bp, Homo sapiens; identical to SEQ ID NO: 12797
  misc_feature 1..225: note = chr17:47073103-47073328
  misc_feature 1..225: note = hyper
  source 1..225: mol_type = genomic DNA

SEQ ID NO: 36626 - DNA, 172 bp, Homo sapiens
  misc_feature 1..172: note = chr17:47073388-47073560
  misc_feature 1..172: note = hyper
  source 1..172: mol_type = genomic DNA
cgaaacgcgcggcgagcagccccctcccccaccgcccagacggggtgcgaccgcccacgtgtcgccccttgcccagtcgggtccttccctcgggctccgggagccggaggatccggaatgagttggtcaaagccgagggaagggacccaggcggatccgcttccccctcccc

SEQ ID NO: 36627 - DNA, 456 bp, Homo sapiens
  misc_feature 1..456: note = chr17:47073953-47074409
  misc_feature 1..456: note = hyper
  source 1..456: mol_type = genomic DNA
ttccttgtctcccaccgttcctgtctcctggagtcatctccggccagttccgcgtgttcccctcaggaccccgaaacgttatcatttaacagccggaccccgggtgcgaaccaccctttctcccgtggggatctcaaaacattatttcctgcggcttcctcgttctccactgggataccccgttcccagctttccagtcccgcgctcgcagggtcccccggtcctgcatccccggaggcgggggagtttcgtggggctggcgtggggaaggcggagaccccccccatttaaacatctagggaaaaggttcctttctttttaaatcaccagctcgtgcgaccctctcctgaagaccccagagtcttcggcttctctttgtctgtctcggccgtcccccgcctgtcagtcgctagcagttaaccggggaggggtgagcaaccccgccccccaaaacga

SEQ ID NO: 36628 - DNA, 685 bp, Homo sapiens
  misc_feature 1..685: note = chr17:47074731-47075416
  misc_feature 1..685: note = hyper
  source 1..685: mol_type = genomic DNA
ttttttttttttttccgctccattttttttcaagtcgattttatttagaggcggcgccagggcggccgcggagaaacgtgacacaccagccctctcggaggggtttcggaccgaagggaagaagctgcgccgtgtcgtccgtctccctgcgcgccgcgggcacttctcctgggctctccccgaactctcccgcgacctctgcgcgccctcaggccgccttccccgccctgggctcgggacaacttctggggtggggtgcaaagaaagtttgcggctcctgccgccggcctctccgcctcttggcctaggaggctcgccgcccgcgcccgctcgttcggccttgcccgggaccgcgtcctgccccgagaccgccaccatgaacaagctttacatcggcaacctcaacgagagcgtgacccccgcggacttggagaaagtgtttgcggagcacaagatctcctacagcggccagttcttggtcaaatccggctacgccttcgtggactgcccggacgagcactgggcgatgaaggccatcgaaactttctccggtaagaacacagccacctcccggaaaagccacaacgagagccccgaacaacggagacccgcaccttccggttcctctcccgccaactcctctcttcccgggcctgcggggtttggcctccgtacccaccctcga

SEQ ID NO: 36629 - DNA, 101 bp, Homo sapiens
  misc_feature 1..101: note = chr17:47075634-47075735
  misc_feature 1..101: note = hyper
  source 1..101: mol_type = genomic DNA
cagcccctccctatccgccggtggacgcccccccagctggaaaaccccggctcccgttcctcagtcttaggcctttccaggcgtggaaggggtacccggac

SEQ ID NO: 36630 - DNA, 254 bp, Homo sapiens
  misc_feature 1..254: note = chr17:47075879-47076133
  misc_feature 1..254: note = hyper
  source 1..254: mol_type = genomic DNA
cggcgccgggtcgccatgctgcttcccgagacgccgaggctgggccgagaggcgcgcgcggtggcagtgagggaccctccccgccaggccccgctccgctcccccaggtccaccccttcccaaaccagccccgacaggtgaccgctccgtggcccaaagcccgtcttcctggccaacagagaaaaataaagtttcattctgcacactgcctcccgccccgcgccccactttctgaggaacggggagccctttct

SEQ ID NO: 36631 - DNA, 262 bp, Homo sapiens
  misc_feature 1..262: note = chr17:47081179-47081441
  misc_feature 1..262: note = hyper
  source 1..262: mol_type = genomic DNA
gttgggtggatttcccgcttcccttttaaaggggagcggctggagtctcacagtgttacccacgggagaggggtcggagacgggtggtagactcagctcagggcaaggctatatttgcttttggagttgccggccttcccttcccctttcaaaaaagagagagagtagagagagagaaagtggcggcggcgctgcaggctcttcctggagcgctcgccccggcccggcggccctaaccttccccgcccgcccccgcgccagt

SEQ ID NO: 36632 - DNA, 442 bp, Homo sapiens
  misc_feature 1..442: note = chr17:47210040-47210482
  misc_feature 1..442: note = hyper
  source 1..442: mol_type = genomic DNA
tgcacctgccctactcgccgagaatttgcccgggtcggtgccagggcggggcagtcggcggcctggctgctaggctccgtgacatccggcagtctgagggcggcgggattcgggatgacttcgggcgggtgagtgtccccggggcagagcagagcgagaggtgaaacttcgggagcagggagcgccgcgggtcctttctggcgtctgcagagcgggcaggtgctggggacgcagacgccggagccagggagcgggcggttggagtcttaagtccaaccggttccccgcataggtggctgcagaggcgaggtgacggcgcgtgcggaacgaactctgcacccccaggaatggggagcgctggcttttccgtgggaaaattccacgtggaagtggcctctcgcggccgggaatgtgtctcggggacgcccgagtgtgggaatcg

SEQ ID NO: 36633 - DNA, 36 bp, Homo sapiens
  misc_feature 1..36: note = chr17:47307637-47307673
  misc_feature 1..36: note = hyper
  source 1..36: mol_type = genomic DNA
tggctttgtcagagtcggggacggagggatacccca

SEQ ID NO: 36634 - DNA, 142 bp, Homo sapiens
  misc_feature 1..142: note = chr17:47308577-47308719
  misc_feature 1..142: note = hyper
  source 1..142: mol_type = genomic DNA
ggttactgaggattgcgggggttggcgggaggaatgactccctacccccacccccgcccgtaaagttggtggagcgggtggtgacagacagtttgccccttttgcagatggccctataaataaaaaacgcactttctcccct

SEQ ID NO: 36635 - DNA, 95 bp, Homo sapiens
  misc_feature 1..95: note = chr17:47547802-47547897
  misc_feature 1..95: note = hyper
  source 1..95: mol_type = genomic DNA
tgggggaggggacgccgacacggagctgccatcggatgcgacggaccccaccgagcaccccagccacggagcggcttccgcgggcagcctggggc

SEQ ID NO: 36636 - DNA, 1560 bp, Homo sapiens
  misc_feature 1..1560: note = chr17:47573694-47575254
  misc_feature 1..1560: note = hyper
  source 1..1560: mol_type = genomic DNA
ggggagtgcccacttcgccggggcgaacccgctcccggggttcccccacggccggcgggctcctccgacgcgcgtgttctcacggcttgaagcagcgcagcggatcgcgagggacggagcgggtgtgcccctacccgggctggcggtggctacgtctcggggtgcagagcgccggggcgcactaggcggggacccttcctggccgcgcgcagctctggctacgcaggcgggaggcggcaggcagggggcgctgcggggcgaggcaagtgcagtccgccgctgcctgcctgcgagtctggggctgcgcgccgctccccacctagctgcgcgacccgagcgccgcgcccaccgcgctccgtgggctcccgcgcctcgaagggtcgggatccggtctgagcctctcctggctctcggtgcaagccgctgggcacctaacgagacgggggcgcccggacgcctcggattctgtagcgcggtatcccgggccaccgactcggcaaaggtcggcgggtcctccgggtggtccgacgagattgtcagatgtggcctgctttatggccatgaaccgaatgccctggaaggtctggcaacggaggaggcgtcttcactctccccgccagcatctttcatcagagcactgcgccccaaattccggctttacagatacggagactgaggctctgagagtttaaacgacttggccaagatctcacagcaagttgggccagagtcgtggctagactccccgacctgattcccagctcggtactcccccaccttttcagggggcagccgctgtcccagctcggggtcacggctgcgtttcccagcagggcggggggggttgacactgtccccagagtccgtcggcggtagagcctgcgggtgaggtgggcagagattctgtccgggtgcgggccccagcccgaaagctcagccccagttccctggagctgtcaggacctgtggctgcgtccggggatttgggagcgaccgcgggcacgtctgctgactaacgccgctggttagagacgctgctcagacgcgggtgggcgagcgtagaccaggagagcggggaggagggaccggatcccagaggggcaacgacttgggctccgggtctgggcaagagcgagggtccccgcgcgaagacccaaggaaggaggggagctgggcgtggaggacctgggcgcttgggaaggtgtaccccgacaggaacctgccgtctgcagcccctgcggctcccgcctccgcctcggcgcgcggctgctcggtctgggatggctgtgcgcggtccgagtttcttcctgggccgcggtgagagagagagggctgaaaccagagcgcgtcccggcgggtcggctggcgggccgcgccggtaatggaggcactttgtcattcagacgtctgtaaccagagccgccgggctggctaatgcgcctaatagggatggaacgagggcagcaaatgggcgtgcgtgagcggccgggctgagctgggtggatggtggatggggaggcagctccgcgggggacgggcccctaccgcactgttccagcc

SEQ ID NO: 36637 - DNA, 295 bp, Homo sapiens
  misc_feature 1..295: note = chr17:47928151-47928446
  misc_feature 1..295: note = hyper
  source 1..295: mol_type = genomic DNA
ccctgacacacagcacgcgctcagttaaccctaacttaattgttgtgatgatgaggaggatgatgattttattccttcgaaggagcgctggtctcctggccccctctcagtctcccgacctcgccagcgccagagccatcctgcatggtcccgacctcgtcagcgccagagccgtcctgcatgaggcaggatgtggtgggcgcacagcagggacgaggcggggggcacggggcagaaaggagagggcgacgggaagaaggcagagaaaacccaaaaggtccggaaggctgggagg

SEQ ID NO: 36638 - DNA, 103 bp, Homo sapiens
  misc_feature 1..103: note = chr17:47967958-47968061
  misc_feature 1..103: note = hyper
  source 1..103: mol_type = genomic DNA
ctccgggcccgacgccggcccagcccagcagtgccgggcgccgggcccaagccgaccccctgttttggctctgccgcctgatttctaccgcaggcagatatct

SEQ ID NO: 36639 - DNA, 589 bp, Homo sapiens; identical to SEQ ID NO: 4464
  misc_feature 1..589: note = chr17:47987525-47988114
  misc_feature 1..589: note = hyper
  source 1..589: mol_type = genomic DNA

SEQ ID NO: 36640 - DNA, 85 bp, Homo sapiens
  misc_feature 1..85: note = chr17:48040403-48040488
  misc_feature 1..85: note = hyper
  source 1..85: mol_type = genomic DNA
atgcaccaccccctccgtaaaccgctgagagtgggtccacgaccctcctctcggccaaccactcccgccccgcccccatagctga

SEQ ID NO: 36641 - DNA, 625 bp, Homo sapiens
  misc_feature 1..625: note = chr17:48041152-48041777
  misc_feature 1..625: note = hyper
  source 1..625: mol_type = genomic DNA
gtgtgtctgtgtgtgcgcgcgcgcgctctgtgttgtattgtgtgcgctagtgcacgcattgtcttcgatgttgccgctagaggaaccttccaactcccactactcccacctccggctttcaccctgcacccggcgatgaagacgtcggcgaaacgcctactttccatgcctaggtctgggaaggtctgaagatcccggcggagctgccttcgttcggggccgggcaaattcgttgcagccgggttggcctcagggcctctcgccggctcgctatgtttccccggggcgccctggcaggccagccggcggtctgtcagtccagctcctggtgcgggcgcctcgttttggtccaccgggtccggggctgggacaccgagggaaaacttcagagctccgggccaccgagcctggaagttacgcgtcccccagcccacgcgtccccaatcccggggtatttcctgctccctcatccagcgaagttcagcgtcgcgtgtctccccagcggcgcagcctgcctccaagacaccctcaaaaccgcctcattttttgttaaccgttttctctctctctctctctctgtctctctctctcttcctccgtccccccaccccgtgtcccaagaatt

SEQ ID NO: 36642 - DNA, 102 bp, Homo sapiens; identical to SEQ ID NO: 12812
  misc_feature 1..102: note = chr17:48042039-48042141
  misc_feature 1..102: note = hyper
  source 1..102: mol_type = genomic DNA

SEQ ID NO: 36643 - DNA, 239 bp, Homo sapiens; identical to SEQ ID NO: 1311
  misc_feature 1..239: note = chr17:48042409-48042648
  misc_feature 1..239: note = hyper
  source 1..239: mol_type = genomic DNA

SEQ ID NO: 36644 - DNA, 206 bp, Homo sapiens; identical to SEQ ID NO: 1312
  misc_feature 1..206: note = chr17:48042750-48042956
  misc_feature 1..206: note = hyper
  source 1..206: mol_type = genomic DNA

SEQ ID NO: 36645 - DNA, 1762 bp, Homo sapiens
  misc_feature 1..1762: note = chr17:48048808-48050570
  misc_feature 1..1762: note = hyper
  source 1..1762: mol_type = genomic DNA
agccgtagggagcagcgggcctggagggaggccttggggctccatgatcgcgacccgggcagatctcgtaacttgctggaactggggtagggaaaggcagctgtccgggaaggaacttggagggggtctgctgggagagttggggcgcggagggctatgcgaattcagcaaccgggtcggcctcagagactctgcgtccccgctcgaattgcgcagtccacgcagccagagaggcgcgggtgggctctgggctgccagcccagagctgccagcagtggggtcgaggcaggggaggcaggacaggcgcgggcgggagcggaaacccaacggtttttctgggaattggttgaggcagggtcgaggagggaggatctcagaagcccgcagcgcccgaggccacgggtgagggatgcgggggaggtgacggcagctggtgaccgcggctggccgagggcgggtacactgacgtgtggagggtgagcccgactaggggaagaaggtggggggacgcgggcggacagaagccgctctctctcggctcaggtcggctggacagacccgcagggaatgcggcgaacgctgccctaagcgcccgggcattgcggctgctccatccgccctactcctcccattgcctgggacctctgcagcgtccccgtagagccgcgcaggttagggtggctggcttggaagaacagaaacccctcggcccaaccctcccctgtccctcagcattctagggctgggctgtcccgcggccgagattcctggagagctaggcgggccagagctgaccagatcccccgcggcggcaccgcagcgcgatccaggagtggccccgccgggctacgctgcgcgctcttggaacccgggtcaccttccctgccgccggaaccgctctgtgcgcgctgcccaacgaaggaaggggctgccccacgcagacccggcttctgggggtccctggaaacccaggcggccacggtgtggcgggggagacatggtcacttttcctgcagggtgcgcctgagcagaggggcagcccgttacagtaggcgaggccagggcaaacccggggtcactatcagcgctgcgagactggtattcaaggtcctctcagccgggcctctcacccaccccgctggccgcagccggaggctgccacgcggacaccgtctcaagcctctgagcattgctctgagcctctgcctgcaatgtccttcctctgtcatctctaggcctcggctcagccctggacctagcctttctgccccgccctaccccaagctggcgccaccgcccgtggctgaactccgacctcccaccgcaggcgccgcggtaccctggctgtggccctcggcgctttcttcctagggtcacaggacccatacgagtgggagctccctgggagcagaactgcgtcttgtatcacctggcgcggtgaacgtgggggttgaaacgctccacgcggaaggtagagggcaggggccaagggggcgatcctggtggctgcgctttttgctatttgctgccgacggcatgcagacgagatgcaaataagcttatgaaactgtccgtcctaccccctcgctccctcctcgccccctacaccgtgttgtgctgcccaccagactcggagaagccgcggctgtccccggaaccctccgagcggcgccctcaggcccccgccaaaaagctccgcaagccgaggaccatctactccagcctgcagctgcagcacctaaaccagcgtttccagcacacg

SEQ ID NO: 36646 - DNA, 222 bp, Homo sapiens; identical to SEQ ID NO: 12817
  misc_feature 1..222: note = chr17:48070683-48070905
  misc_feature 1..222: note = hyper
  source 1..222: mol_type = genomic DNA

SEQ ID NO: 36647 - DNA, 72 bp, Homo sapiens
  misc_feature 1..72: note = chr17:48071121-48071193
  misc_feature 1..72: note = hyper
  source 1..72: mol_type = genomic DNA
agagccagaactggccgcggcccacaacgcggcgctcccagctccgcgcccggccgccgcagcactgtcccc

SEQ ID NO: 36648 - DNA, 122 bp, Homo sapiens
  misc_feature 1..122: note = chr17:48071583-48071705
  misc_feature 1..122: note = hyper
  source 1..122: mol_type = genomic DNA
ctttcccgcaacttccgtgggtccttctcattgccccctcacgactcctagtctccccatcccttatccaaaggagggcccctagagtttccagcccctgccgcctacccccaagccctctg

SEQ ID NO: 36649 - DNA, 53 bp, Homo sapiens; identical to SEQ ID NO: 4468
  misc_feature 1..53: note = chr17:48071806-48071859
  misc_feature 1..53: note = hyper
  source 1..53: mol_type = genomic DNA

SEQ ID NO: 36650 - DNA, 70 bp, Homo sapiens
  misc_feature 1..70: note = chr17:48585866-48585936
  misc_feature 1..70: note = hyper
  source 1..70: mol_type = genomic DNA
aggaggtttccaagccgtctccgcccaagttgatcggtggatgcgcgcccccgcgcggggcaccggttgc

SEQ ID NO: 36651 - DNA, 75 bp, Homo sapiens
  misc_feature 1..75: note = chr17:48619216-48619291
  misc_feature 1..75: note = hyper
  source 1..75: mol_type = genomic DNA
cgtcccccaccaacccgttcggcgcgggcgagccgggcaggccgacgctaaaccagatgcgcaccggctcgccgg

SEQ ID NO: 36652 - DNA, 390 bp, Homo sapiens
  misc_feature 1..390: note = chr17:48619346-48619736
  misc_feature 1..390: note = hyper
  source 1..390: mol_type = genomic DNA
cgcctctctgcccctcccgctcagcagcgtgccagctggcttgaccctccccgcctcggttagcgtcttcccgcaggccggagccttcgcaccgcagccgctgctgcccacgccgagctcagccgggccgcggcccccgcccccgcagaccggcaccaaccccttcctctgagccccgccccgtcccataccggcctgcgcctgcgccggacgctccgcggccccgcctccggacccggggctgggcggggcgccggtgctagtggaacgccgagccagtggcggctggtatcccgcggcggctctggaagctggacgcggaccacggcccgggagctagaaactgaacgcccgcataataaagactggaaccctcgttctcagctctca

SEQ ID NO: 36653 - DNA, 812 bp, Homo sapiens
  misc_feature 1..812: note = chr17:48636435-48637247
  misc_feature 1..812: note = hyper
  source 1..812: mol_type = genomic DNA
atcccctccccccatcggccggggcgggaactgagacgaccccaaccctctgcggtggcgggaggtgcgcgggggctgcgtgggtggtgcagccttaggagagtgaacaacgcccaggggtgatggcctcagcaaagtgaggggtggtgatggaggtcatccgacccatcccgccgcctctccgcagtggcgcaagcgccccaaaatctccggagagggaactgactgacccactaggttccgccgtgtctacctctcgcagatgttggggaagtgcttcccggcgtctaatcctcgctgttcccccctccaccggcgcccagcacacccgcggcgctccgctcccgggtacccacagctttctggagtggcgccggcggcaggagagagctagagccgactgagccccagaactcggggaggtaggcggggcaagggccggggtctgcgcgtgcgtgtgcacgcgtggaaagcacaaacccacgagggcccgctgccggtagggttaaggtgagtgagtgaaggcggcagacccgcgaagttccagttccgcggacactctttccctaagccacatagggacttaagagaaactgaggcacgaagttggggggtggcggtggtggggactttgaaggtcgagtcgataaagcccagctctgtgcttccgccccctcccacacactcgagacccccacaggttccttcttaggggtcctcgctctgctccgcagcccctcctggggatccgggctctgcggtccagcgcgacctgcctggggccacgtgttcaagcacgaagcccctgcgtg

SEQ ID NO: 36654 - DNA, 54 bp, Homo sapiens
  misc_feature 1..54: note = chr17:48637706-48637760
  misc_feature 1..54: note = hyper
  source 1..54: mol_type = genomic DNA
gatgcctggggcctgcggccctacgccaggaccccgcgccgaatactctgattc

SEQ ID NO: 36655 - DNA, 30 bp, Homo sapiens
  misc_feature 1..30: note = chr17:48712444-48712474
  misc_feature 1..30: note = hyper
  source 1..30: mol_type = genomic DNA
acggagcccctgagacggcctgggcgcccg

SEQ ID NO: 36656 - DNA, 611 bp, Homo sapiens
  misc_feature 1..611: note = chr17:50235868-50236479
  misc_feature 1..611: note = hyper
  source 1..611: mol_type = genomic DNA
ctctcagccgggttccggcagtgcgtccagggcgccgaggggaagggctgggccccggggactggggcgcggtgggggcacacagactctccaggtcgcgcgcgcccttcctgctcctctgctattttcctgaactccccagaacccccagttgcctggcttccatcgcccgcaactagcgccgctgtcgagattttccgcaatacaactgcaggggtcgttatttcctcgcctacggatccctacgcttcccaactcagagaggaggaggacaggtgggggcgggagggggaggaggagaaggaggcttggccaggtgagcgtcctcgccgccgccgggcgtcccagcgtcagctccgcagcccggcacccgggggcggaggcaggaggcccgggcggggaggtgaggctgagcgcggccatgaggaggaggaggaggaggctgggtgtcacagcttcaggccaccttggccgccgcctcggccccagtccctggcagccgcctccgcactccgccccgccctggctgcctctgttaccctccaggattttcgagtttctcttcttaaaaagaacttcgtgctgcgggttcggcgcgggagacccaggca

SEQ ID NO: 36657 - DNA, 60 bp, Homo sapiens
  misc_feature 1..60: note = chr17:50236690-50236750
  misc_feature 1..60: note = hyper
  source 1..60: mol_type = genomic DNA
ctgcctccctcctcccgaaaagggggaacaccgcctttccaagtccgggtgccagcagcg

SEQ ID NO: 36658 - DNA, 30 bp, Homo sapiens
  misc_feature 1..30: note = chr17:50237251-50237281
  misc_feature 1..30: note = hyper
  source 1..30: mol_type = genomic DNA
tgcagtggtggtttgcgaaagctcaaacct

SEQ ID NO: 36659 - DNA, 255 bp, Homo sapiens
  misc_feature 1..255: note = chr17:53341227-53341482
  misc_feature 1..255: note = hyper
  source 1..255: mol_type = genomic DNA
cgtcccactgaaaaacggttttctttcatttgtgcccattcgttcttgcagccccttccccagatcgaagactagggtcttagtaaggagaggtaaggagggaggggaagaacctgcctggccccccgcggagctctgcagggggcgtcgcggctgcacgccagcgcccgcaccaccccaggcgggaagggagttatcacacagggggtcgcacgcagatctcggggaccgtgggtgccacgaggtcaaactggc

SEQ ID NO: 36660 - DNA, 87 bp, Homo sapiens
  misc_feature 1..87: note = chr17:53342183-53342270
  misc_feature 1..87: note = hyper
  source 1..87: mol_type = genomic DNA
gtgctgcaaggtccccgaaaatcggcgcgagcggcgacgctaaacacgcggcggcggggcgagcgggccaggcgggcggtgccgcgc

SEQ ID NO: 36661 - DNA, 201 bp, Homo sapiens
  misc_feature 1..201: note = chr17:53342828-53343029
  misc_feature 1..201: note = hyper
  source 1..201: mol_type = genomic DNA
aatttgagtgcatcgcgatggagaaaatgtcccgaccgctccccctgaatcccacctttatcccgcctccctacggcgtgctcaggtccctgctggagaacccgctgaagctcccccttcaccacgaagacggtgagcgctgccgcggccccgctccgggaagggacgacgctccgggggtccccctccgcggccgggcac

SEQ ID NO: 36662 - DNA, 617 bp, Homo sapiens
  misc_feature 1..617: note = chr17:53343030-53343647
  misc_feature 1..617: note = hyper
  source 1..617: mol_type = genomic DNA
cccgctggagcatcccccaaccccgctcccgccctgtcccgcggcgccccggccccgcgctgatgaaattgaggagctcacccagcacccttcctccccttcctcctcctccatgaaaggggagggacccctcctgagctacatttaaaagagcttcgggcacccggcctccctgggtcccgctcctgcggcgcgggtgggaggtgtaacttgacaggtcaggatcgttccctagaacgaggcacacccgcacgcagagcgagcccgcctgcggagggcagagcctcccgggctggggaggagaaaccctggggcctggttctgtgcggggcagggggcgggggtcggcttgagggagggggtttcactgcgtagcctgggttttggggttgtgttacagcttctgttactggttagtatttggaactcacgaggtgtgagagaagactcgttttcttctggtgaagggtagctgagaaagcggggtgggggctggggccggtggggggagtggtctctcggcgggaagccgtgcacgcctccagcgttgacactttcccggtgcactttttctggtgggaggggagagcggagcaggctcacgtgtaaccgcgcag

SEQ ID NO: 36663 - DNA, 357 bp, Homo sapiens
  misc_feature 1..357: note = chr17:53922649-53923006
  misc_feature 1..357: note = hyper
  source 1..357: mol_type = genomic DNA
gtctttcaagataaacggaacgtccctaataattaatgttttggttatgtgcccacttgagaagagataccacttcagcctcttccgtctccgtggtgcagccaggccctagcgtctctccatccccgttccccgcgggctcccaggacggcgtccgcgggcctcagcgactctgcggagggtttccgcgggatgctcaagggggcagtgtggtcctgccgaagagggccgcctcgcctcgaggaacgccttggccattttcacaggaaaatgtttaccctggaaattaaattatatttgggattttgggtttcccctcccccaccccgccgtgggaggtttcggaaagttactgtg

SEQ ID NO: 36664 - DNA, 30 bp, Homo sapiens
  misc_feature 1..30: note = chr17:54671575-54671605
  misc_feature 1..30: note = hyper
  source 1..30: mol_type = genomic DNA
gccagaggcatggagcgctgccccagccta

SEQ ID NO: 36665 - DNA, 343 bp, Homo sapiens
  misc_feature 1..343: note = chr17:54671992-54672335
  misc_feature 1..343: note = hyper
  source 1..343: mol_type = genomic DNA
ctaagcaagaagctgcggaggaagttacagatgtggctgtggtcgcagacattctgccccgtgctgtacgcgtggaacgacctgggcagccgcttttggccgcgctacgtgaaggtgggcagctgcttcagtaagcgctcgtgctccgtgcccgagggcatggtgtgcaagccgtccaagtccgtgcacctcacggtgctgcggtggcgctgtcagcggcgcgggggccagcgctgcggctggattcccatccagtaccccatcatttccgagtgcaagtgctcgtgctagaactcgggggccccctgcccgcacccggacacttgatcgatccccaccgacg

SEQ ID NO: 36666 - DNA, 155 bp, Homo sapiens
  misc_feature 1..155: note = chr17:54673918-54674073
  misc_feature 1..155: note = hyper
  source 1..155: mol_type = genomic DNA
ccaactccttgggaccgacgcctgactctcgcatgcgtccctccgcctcagtccccagtggcgcccgtcctcacagctccacgtgggccagcctcctgacactgctcagcgctctctttatttatcttggactccaaagtcgctctcctttgctc

SEQ ID NO: 36667 - DNA, 399 bp, Homo sapiens
  misc_feature 1..399: note = chr17:54674738-54675137
  misc_feature 1..399: note = hyper
  source 1..399: mol_type = genomic DNA
aaactttctgtgccccgggccaatatttttttagacagagtttcacttgcgaggggcggaggtggtggggagtggggaagaggaggggtcttatgcgaggggggcgaaagcaagaattttcatgcctggtaaacacgcgaattatgcgaagagagttattcccagctgggcgggcagccaaaactcggagagcgcgccgaggccagcgcccccacccccacgttggcaatgtcattggattacaatgcgaggtcttcccctccgcgacgccccctcctccctccgcgggcccgcccgcccgcgcccctcctccccacccctgcccacttggaaaacccgcccgcagccggcgagcttctcggctttcagagcaggagccggtgtgagctgggaggacgc

SEQ ID NO: 36668 - DNA, 171 bp, Homo sapiens
  misc_feature 1..171: note = chr17:54675138-54675309
  misc_feature 1..171: note = hyper
  source 1..171: mol_type = genomic DNA
ggttgcagacgtgaccggcgacagacagaccaccggatgcacagaaccagagagcaggcccgaagccgctgcggccgcgggagaggacccagcgggacccaggcagtcccagaagctaacgaaggaagtgctggtcctggaacattgtgcctaatgcgcagctggttacct

SEQ ID NO: 36669 - DNA, 37 bp, Homo sapiens
  misc_feature 1..37: note = chr17:54755949-54755986
  misc_feature 1..37: note = hyper
  source 1..37: mol_type = genomic DNA
taaccccccaggaagcgctccacgtgctgctggtgcg

SEQ ID NO: 36670 - DNA, 33 bp, Homo sapiens
  misc_feature 1..33: note = chr17:54756362-54756395
  misc_feature 1..33: note = hyper
  source 1..33: mol_type = genomic DNA
cgctcaccccgtttacgacggagccctttgttt

SEQ ID NO: 36671 - DNA, 569 bp, Homo sapiens
  misc_feature 1..569: note = chr17:56234271-56234840
  misc_feature 1..569: note = hyper
  source 1..569: mol_type = genomic DNA
tttagaaagttatctcgccctccctcctcccccacaaaaaaagtttgagtcgccgctgcgggttgctagcggagtcgcgcgtcgggagctacgtagggcagggaaggcatggcttctgttttcgtccaatgagaaggggccagcggtggcggtcgggccaggtccggggcctggggacgccgaggcggccgcggaggagcgccgcgtcaaggtctccagcctgccctacagtgtggatgcgctcgtgtcggacaagaagccgcccaaggaggcatccccagtgccggccaaaagcgcctcttccggggccaccctgcggctactgctgctgccggggcacggcgctcgggaagcgcacagccccgggccgctgatcaagcccttcgagaccgcctcggtcaagtgggaaaactccctaagacggagcggcgtggatgcaggaaccctgctgataattcgccgccgccaagacacgtgagccctaccacctgcaccctgagaaaacacaagaccaatccgaagccgcgcacagcctttaccacgtcccagctcctcgctctggagggcaa

SEQ ID NO: 36672 - DNA, 141 bp, Homo sapiens
  misc_feature 1..141: note = chr17:56326821-56326962
  misc_feature 1..141: note = hyper
  source 1..141: mol_type = genomic DNA
gcgtcccctccgcctcgagcagaggctccttcccccatggggtcctgggctttggagccccggagccggcctgccgaagctcagcgaggatcgtgctggtttcaggaggaagcctgcgctgggcgccgccaacagggctct

SEQ ID NO: 36673 - DNA, 53 bp, Homo sapiens
  misc_feature 1..53: note = chr17:56327222-56327275
  misc_feature 1..53: note = hyper
  source 1..53: mol_type = genomic DNA
cccggagcccggccacgtggcggtcacgttctggccgccgcaggccagatacc

SEQ ID NO: 36674 - DNA, 611 bp, Homo sapiens
  misc_feature 1..611: note = chr17:56832946-56833557
  misc_feature 1..611: note = hyper
  source 1..611: mol_type = genomic DNA
ttcagagttggagagcgggcgagtggagtgtcctttagactccgcggactcgacgggagggaccctgcaatgcttaattagaaccggttgccatggcgacagtctctaggcagcgtgggctgagctctccgtaggaataaagggtgggccgccgctggaccctgcgcgcgcccgccaccaactttccctccagatccgagaggggcggcgcgctccgcccccgggccgcgcacgtcggtgctcggcggcgcgcacgcctgcgggagccctctccaggcaacctagtgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagctattcctgggcgagtttcgcggaccgtgcggcggcggcgagccggagccggaacccgaacccgaacccgaacccgaacccgagtccgagcccgagcccgaacctgaactggtagaagctgaggcggccgaggcttcggtagaggaacccg

SEQ ID NO: 36675 - DNA, 76 bp, Homo sapiens
  misc_feature 1..76: note = chr17:56833915-56833991
  misc_feature 1..76: note = hyper
  source 1..76: mol_type = genomic DNA
tctgctcctctcccccgcacccgcgcctgccgccgctgaaagcgcccccgctgctcggacccgggcggtcggctga

SEQ ID NO: 36676 - DNA, 65 bp, Homo sapiens
  misc_feature 1..65: note = chr17:56834247-56834312
  misc_feature 1..65: note = hyper
  source 1..65: mol_type = genomic DNA
cagtctgtcttttcccgggctgagtgccttgttgtttggcggcagagacgcgactcctttctaga

SEQ ID NO: 36677 - DNA, 718 bp, Homo sapiens
  misc_feature 1..718: note = chr17:58212587-58213305
  misc_feature 1..718: note = hyper
  source 1..718: mol_type = genomic DNA
tctctaagcacagggcggtggcgaaagggaagggctgcagggtggagtccggcaccaagacctcccggcccggcttctagcagcacacggacgcttgagatgatttcttctgaaaacgggcagtggttgaaaaccactgcttcaaaacacagactggaggagtggtaaatactaacgaggagttttagcaatggactctgttaacagagtctggtcgcctgagaagggcctcggaggactggccaggttggagaacgatttcaactgcgtactggacgacacacagaagactgcggggagccttagcccctacccggcctgcagtgctctctggggcacacggcagccccacgacgcctttgggtttcttcgagcgctactcgcacgcaccagcgcccacacagctgcaacgccaaacgcccgccagcaccttagggccgcgggagtcccttccccaggcccgccccacacgccggccttttctgccgcttcccaagccggagccaatcagcgctcagcagcgaccggcagggacgaccaatcgacttatcctgcgttgtgctaaagacctagaaatcgagcgtggtacattcgatcgacggaacgtctgggccctagtgctaagttgggtgactgttcggtggttgtctcggggggttgcaggaagatcctgtttccttggcgtagaaggagaggttgaccccgaagagttaagatt

SEQ ID NO: 36678 - DNA, 272 bp, Homo sapiens
  misc_feature 1..272: note = chr17:58216565-58216837
  misc_feature 1..272: note = hyper
  source 1..272: mol_type = genomic DNA
cgaggactagcagcagatctggtgtgcagaaccctggattcgagtcccggcttcagagaccctcggctgtgtgacgtggaggcgtcggccgccctctgagagccttcgtggatgacagctgatgcttgggcctaccttcctcggctgctgagaggctcagaagggaccgcgtgtaaaacgccttggaatcttaaatctacttaattccatttacctgcttcccagaaacggtccatggcttccgtcccggtcatagcgctgcgcagcgggac

SEQ ID NO: 36679 - DNA, 434 bp, Homo sapiens
  misc_feature 1..434: note = chr17:58216865-58217299
  misc_feature 1..434: note = hyper
  source 1..434: mol_type = genomic DNA
cgtccgcgctccattgcccctccaggtgccgttattttgccttttaacctggggcgggaggttttagacgaggctgcaagtctgggccagcggggacctgagggtcccttgcaaccagcacccgcgacggtgtctacactggaattccaaggaaaagagggctccaggggcgcgaccaaggtttggtcttctgctgagcgctgctggatgaatcgccagccttcgcccgcggccccctcctcctcatccctgaccccaactcgacaagatcccccgagcgcaggcccaaactccgcacagcttgtgggccgtgaggtccgggtctcgaagctcggtcccgctggggctgtccctccgcctctacttccagggtaaagaccgcggaaccaggcgggggtctggggagcctggctgcgacctcggctgcaggcttc

SEQ ID NO: 36680 - DNA, 268 bp, Homo sapiens
  misc_feature 1..268: note = chr17:58217356-58217624
  misc_feature 1..268: note = hyper
  source 1..268: mol_type = genomic DNA
cgccacctaccggaagccgcgtccgcgctacagcctccactcaggattcgacccgaactccaagacgcgtccgcactggtccaacaaccctcatggatcgtcgcctgcctcaactgtttagaccaccgcgggtttcacccggaagcaccggggaggtcggagcttgcctgagaggctcagcgaaggtccatgccttgttcagtcccaggcagtgcgggacaggtgggcgaagctcgaaccccatgctctgtcccggcactggcaggaa

SEQ ID NO: 36681 - DNA, 409 bp, Homo sapiens
  misc_feature 1..409: note = chr17:58218648-58219057
  misc_feature 1..409: note = hyper
  source 1..409: mol_type = genomic DNA
aggccaaggctggcccgcttagggaccgcgctcgggctggacgtcgcgctcagcgcgcagggcccccatggacgtcgcgccgctgacctagctgtcagacatcgccacgaggagttggcaggctcgggaggccgaaacgctgtgctcacctcgagcactgccaggctgctggagaggctttccggggcacagaagctgcagcggcgcggggcggtgggctgtgagcgagcatatgtaggggagcgtttcccgcgagaaagcagaacctgcgccagccgagggccctagggctgctggtaggaggactgttctctatcgtccagctgctcccgacctcttctctgaactggccctgctctggggaacagcgccctgcttctttgtgcgacgatcacgcttgactcattgg

SEQ ID NO: 36682 - DNA, 294 bp, Homo sapiens; identical to SEQ ID NO: 12837
  misc_feature 1..294: note = chr17:58227104-58227398
  misc_feature 1..294: note = hyper
  source 1..294: mol_type = genomic DNA

SEQ ID NO: 36683 - DNA, 210 bp, Homo sapiens
  misc_feature 1..210: note = chr17:58228164-58228374
  misc_feature 1..210: note = hyper
  source 1..210: mol_type = genomic DNA
cggccagagcaagggcggtctggcagggtcctggaagccgcgcttcccacacgggttccttgcccctgagggtcgcaagctcccctggcctccctaacctccagcgctgaattgggagcctggcgggggcggggggtgggggacccggagccccaaggcctctgcggagccggtctttccggacagggtgattttcgtttaaagattaat

SEQ ID NO: 36684 - DNA, 221 bp, Homo sapiens
  misc_feature 1..221: note = chr17:58498756-58498977
  misc_feature 1..221: note = hyper
  source 1..221: mol_type = genomic DNA
tgtgcccgaggtggccgctgggtggcaggggaggcccgggccgacggcggtcccaccgcactgtcgcgaaggcaggcgaagaacagggccacactgagtggggacaactgggcccgggcccagaggacacgaaggaaggtccgggagaaggaattcctagtttcagggaagaaaaggtggctcgagtgaggaaactgcgggggcaacggtctctcgtcgcc

SEQ ID NO: 36685 - DNA, 367 bp, Homo sapiens
  misc_feature 1..367: note = chr17:58498978-58499345
  misc_feature 1..367: note = hyper
  source 1..367: mol_type = genomic DNA
ggaccccgccgtgtgccgcccagggacgcgagggggcgctgctgccgcgccaggggcgagggtcccggggcctcctgagcacctcccggccctgcccggccaactcagactacacccggactctgcccaccgcgtttccgccctcggcctcgggtccctggagggctcgcgggtaggaagagtcggggtggcgggactttcgccgacacccggctccccgcctggtggctgcgcacacgaggccggcgacgggacttgcccgcgtctcagcgcctcctgtgtgaagcgggaccgctgcggtacctgccccagggaaggccgcggggagggttacagagcccgtaggcactggcggggatctttatac

SEQ ID NO: 36686 - DNA, 91 bp, Homo sapiens
  misc_feature 1..91: note = chr17:59467463-59467554
  misc_feature 1..91: note = hyper
  source 1..91: mol_type = genomic DNA
tggccctgctgtcagcgccccctagtgccgggccggccgcgcatgagggcggtgggacagatcgcccacaactcctcggcttgcttttggg

SEQ ID NO: 36687 - DNA, 90 bp, Homo sapiens
  misc_feature 1..90: note = chr17:59474157-59474247
  misc_feature 1..90: note = hyper
  source 1..90: mol_type = genomic DNA
ctgcagcccgcgccccgtcactcggacgcaagtccgtcgtccgctctgccacgcggccgcacagcccgagcttcctgctgcccactgccc

SEQ ID NO: 36688 - DNA, 403 bp, Homo sapiens; identical to SEQ ID NO: 4476
  misc_feature 1..403: note = chr17:59474741-59475144
  misc_feature 1..403: note = hyper
  source 1..403: mol_type = genomic DNA

SEQ ID NO: 36689 - DNA, 53 bp, Homo sapiens
  misc_feature 1..53: note = chr17:59475357-59475410
  misc_feature 1..53: note = hyper
  source 1..53: mol_type = genomic DNA
atctggtcacctcaccggctgcgcaaacgtgtccacaacgggtccctccccga

SEQ ID NO: 36690 - DNA, 330 bp, Homo sapiens
  misc_feature 1..330: note = chr17:59475678-59476008
  misc_feature 1..330: note = hyper
  source 1..330: mol_type = genomic DNA
tgcttccgccggtcccgaatccgcactgccaggagagatccggccttcaaacgctgctcccaacgttcaacaacgaagtgccctgcgaccggtgtgcgcagtgggcgggcgcctgcatgggtcaatgttggatgtacgcgcccaccacgcggttgtacgggtgggaatgtcacccgtggctagtgcatgctctgtcttttccttcagaaaacgaccttcaggaatcagcctgagtgttcgcgcccgagcccgattggaagcaggtgcgtggtcgcttcactctccccgtgcacaccttgagttatagctctcgctgcgcacagagggcac

SEQ ID NO: 36691 - DNA, 2610 bp, Homo sapiens
  misc_feature 1..2610: note = chr17:59476068-59478678
  misc_feature 1..2610: note = hyper
  source 1..2610: mol_type = genomic DNA
atcacttcatgggggggaaactgaggctgccggaagacagaaaacgaagactgatcacagaagagggggcttcaatcacaggtgctcgcagacaccccaactccctcacgcgttactcagcactccttaacttaggagacgtgcgcttccgagagatgagaagaaactaaaaaagtggttggcagggcgaagagaggaagccggtatttcggaagaaggagactttcgtctccggtaccggatagggcgaaaattcgttgggtcgcgggtggagaatccggggtccgcccgcgcggtgccgccctgtgctcagcgaaaggtgcgctcaccttcctggccccgaggatccgctcctcccggccgctggaaagctcagggcggggcccgggcctgcggagaactccaggttccttccgagtcttccggtgaaggcgggcgcgggtagggggtccccgcgtttccccagcgcaaggccgcgtcccgctcccgcccgcgccggccccagcagggctcggccatggctccactcaccagctcccgccacctgggatccgctcccggacctcggccgcccgagcctcccgactcgcccgcccaccggcctcgctttccagtgcctgctgtctctttccggggcgcagggacccccaggcggcgccacgacccggagctgggtcggaggccaggctggggctcgggccagagcggccgggcctctgggcgcgggagaaggagggcgccccctctccgctcggggtcgtgtcaatgctttgcacttggggccggcgtgcggctgcgggtccttccccaaggccccgggacccgggctcccctcgcctcaggccctttcggcgggtcaggtcggccctccgcgctctccagtccggcgcaggcagccgcaggcgcgggcgggcggtgggggccggggcaggaggaggggtctcggggcccggcggcccgtcattggttaatattttattctgttgacatgttttcttactgctgaggcttccgacaccttctcccaggccccccctcccggccggagcttggcctgagctgtcaaaaccccgcccccggagacccacaattggtccaaaaagcgtaaaatcagcaatcaaggggggcctggctcgttagcgcaggggatccgagctgggcaggacatgtgagatagtcacagttttccagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggtagggctgccggccggctggaaggcgcgcgggcgggcgggcgggctggggcacgggactgcacggatcagagcagagctggggactcccggctcccggctcccggctccaggttctggccctgacgccacgcttcgctcccacggacaaccaagttgacttttctcgtttggcaccggagcgatttttttttaaaacaaaaacgctaaaatcctccgaatgaaataaaacgaaaacatactgctaaagaatagccccaaccgttctgagtcccagcgcagaggaggccccgcggcttggccctggcggtctcctccgccccgcgctctcgctcttctgcgtccgggtccgtctccgagctcgggggaaattcagcctctctcagactctgctccgaccccgaagcccctagtgggacctgggcccagctaaccccacgctggttgctcggttcctggcagcgagccccgggtcagccgagccctccgcctcaccgggctgggagccctttctccaccgcgggcatccgagccctggacgcatccgccgccccaggccttaaagcctgaagaaagccacagccccggcccctccacccttcgactcagccaccgagaatccaggcctcgggttcaccctcttcccccgaactgcacggccaggatgtcttatcaggctctgtagcccagttcccaatacaaacaccctccagatttatttctgggagcttccgtcccaagtgggta

SEQ ID NO: 36692 - DNA, 200 bp, Homo sapiens
  misc_feature 1..200: note = chr17:59488224-59488424
  misc_feature 1..200: note = hyper
  source 1..200: mol_type = genomic DNA
atactcctagaggagcggcgcgtttgcgtcccgcggcttctcactttcagcaggacattaggagggagacgagagtcggctgcgcgcccgcggcggcctacgtacagggctgcggacaccagggggcagcaccgacttagggtcgcgggaggggtgcgggtgcgggcatgggcgcgggggaggcgggtgcctgcgaaggc

SEQ ID NO: 36693 - DNA, 368 bp, Homo sapiens
  misc_feature 1..368: note = chr17:59488634-59489002
  misc_feature 1..368: note = hyper
  source 1..368: mol_type = genomic DNA
cggctgggccttgtcccagacaaaggctaggccactcccatgtccaattaagccaccctcctccccggcctcccagccctcattgtccccggggtcgccaattagcctaggcgcccggcgtacccgccgctccggtgccgcaaggcctccttaacccttcagggcctggcccggggtccttggacggcagagccgccggcacacgcgtggcaggagggccagtgctgggacgatggcgatacctgctggcggcctagcctgtcgcctcgggctctcgcgtgtggggcgtgtgaggtctaagagggaattgtgcgtgtcggtgtggggtggcgcgtgcgattcccggaggaactcggagatggagggtg

SEQ ID NO: 36694 - DNA, 72 bp, Homo sapiens
  misc_feature 1..72: note = chr17:59490147-59490219
  misc_feature 1..72: note = hyper
  source 1..72: mol_type = genomic DNA
gcagcgccagctcggcgaccttccaggctgctgcagaccccagcttgtcctcttctgcgcgcccgcggggct

SEQ ID NO: 36695 - DNA, 275 bp, Homo sapiens; identical to SEQ ID NO: 1315
  misc_feature 1..275: note = chr17:59528876-59529151
  misc_feature 1..275: note = hyper
  source 1..275: mol_type = genomic DNA

SEQ ID NO: 36696 - DNA, 12 bp, Homo sapiens
  misc_feature 1..12: note = chr17:59529253-59529265
  misc_feature 1..12: note = hyper
  source 1..12: mol_type = genomic DNA
cgacctcgggac

SEQ ID NO: 36697 - DNA, 509 bp, Homo sapiens
  misc_feature 1..509: note = chr17:59529843-59530352
  misc_feature 1..509: note = hyper
  source 1..509: mol_type = genomic DNA
cggagtcggagccccggccgtcccgcgctcctcggacccgaacctgcaggggacctcgggccgctggcgcctccgcatgcggcaccgcaattagggtgagtgtgggttccagccgagtggggacgagctgggcgtgcggggctggggccacaggggctcagggttaggctgcggggacggacaggaggatgagctggaaaggggtgagtcacgcgacccggggaagaacttcaggggcggtcaaagttgcaggaaggcggcgcgaagtgccttgggtcgggccgccgcctcggcccgacacccagtagttggggcacgagccctcctctctgagtaacgcgatgaattgggtctagagatccaagagcatagaaatatcgacagcgccagcaccctaagaacaaggccgtgacaggcggagcggtggcctggaaattggtgtttgcagaatatgcaaggccaaggaagagggccccggtactggagcgaaaatccgtgtagatatgtga

SEQ ID NO: 36698 - DNA, 351 bp, Homo sapiens
  misc_feature 1..351: note = chr17:59531667-59532018
  misc_feature 1..351: note = hyper
  source 1..351: mol_type = genomic DNA
aaagagaaatgctgtcgtctttggaaaacgaggcagctgaaagcaacagaccccatcgcaaaggcagcggaggttgcgggccgcacccgcggaggagtggatgtgaaggacgagagcggaccgctatgcggtgctgagtgcgggaccccgcggtgctggcggcggccgagcgcgcccaagctcgaggtccgagaggaccgcgaggacggccgccccgggccagccgggcgtggaaaaaaggaaattgctgggaagggggcaagctgtcccgaggtctggatgtggcttcgtggcggagagaaaaggaagaggcaaaccctgagcccgggagggagagcactgagcaggcct

SEQ ID NO: 36699 - DNA, 170 bp, Homo sapiens; identical to SEQ ID NO: 1318
  misc_feature 1..170: note = chr17:59533874-59534044
  misc_feature 1..170: note = hyper
  source 1..170: mol_type = genomic DNA

SEQ ID NO: 36700 - DNA, 66 bp, Homo sapiens; identical to SEQ ID NO: 1319
  misc_feature 1..66: note = chr17:59534340-59534406
  misc_feature 1..66: note = hyper
  source 1..66: mol_type = genomic DNA

SEQ ID NO: 36701 - DNA, 225 bp, Homo sapiens; identical to SEQ ID NO: 1320
  misc_feature 1..225: note = chr17:59534556-59534781
  misc_feature 1..225: note = hyper
  source 1..225: mol_type = genomic DNA

SEQ ID NO: 36702 - DNA, 171 bp, Homo sapiens
  misc_feature 1..171: note = chr17:59535096-59535267
  misc_feature 1..171: note = hyper
  source 1..171: mol_type = genomic DNA
gcctctctgcctcctcgggcgtcagtgccacctcccttcgcagcttgggactgggccgccaaagcccgcagggggccaccgcagccgcgcgggccttgcgggaaagaccgaggggaggggcagcgctatgcaaatgaatccaaacagggatcgcgacgctcaaaagtccca

SEQ ID NO: 36703 - DNA, 496 bp, Homo sapiens
  misc_feature 1..496: note = chr17:59539215-59539711
  misc_feature 1..496: note = hyper
  source 1..496: mol_type = genomic DNA
gtccccagggacctccgagaaagtcggggctgcagcggggttggggcttgggggaccctccaggtggagagaatctaggggtatcccctagtctctgtccctttccccaggaaaggggctgagagtaagcgccttgaatttggccaccgctttggccggggagctcccgcggctctcgcagcgcagctagaacttgcgtgttccctcagcagtgagttcgcagttacgggtttgttgccagaattaaaaaagccccaaacccttgccccgcgccccgcgcgcctccaacaccgagaaacgtccgaggaagcttatcttagcagttcattctaaagccatttccgagtatgaatagataaaggctccagctccgcaccctttcagagcctgtttcatgatcagaggagaagccccgggctttcatctcctcccgggccggcgagcaggcggcttgtttattcccctggcggagccgtttccgcgtgtgccgtgggga

SEQ ID NO: 36704 - DNA, 301 bp, Homo sapiens
  misc_feature 1..301: note = chr17:60705635-60705936
  misc_feature 1..301: note = hyper
  source 1..301: mol_type = genomic DNA
cctgcagggcgcgcccggggagccagggctctctgtccgggagttcccgggcccagtctcctcgctctgccccaggactgatgcgttaggacggctttccaactatccgcgagggttcgtttcccccaccttccccccgccccctgcatctcgtgggcgttgatattttcttttccacacttagtcttcaaggaggcttgtggcgcgcggcatccgccccgcgtgagctcggcagccctgtgaggaggctcctgccactgggacgcagcaacaggctgggcgccgccgtgctgtgatgttg

SEQ ID NO: 36705 - DNA, 90 bp, Homo sapiens
  misc_feature 1..90: note = chr17:61600708-61600798
  misc_feature 1..90: note = hyper
  source 1..90: mol_type = genomic DNA
gaggacagacggagacgccgggagccagtggcgcctgtggctccgggcaggggccgcggccgaaagatgccggtccgcaggggccacgtc

SEQ ID NO: 36706 - DNA, 165 bp, Homo sapiens
  misc_feature 1..165: note = chr17:61777909-61778074
  misc_feature 1..165: note = hyper
  source 1..165: mol_type = genomic DNA
ggccattcactgcctcggtttcccccggttggcctcgcgcgtaggcgccggcgcccccatccccgcccagagctgtggggccgcagagacccagccggggcgaccccggagcctggcccggggtccctcgggcggccgagtcctcccgccgccaggggccgcccc

SEQ ID NO: 36707 - DNA, 15 bp, Homo sapiens
  misc_feature 1..15: note = chr17:61778234-61778249
  misc_feature 1..15: note = hyper
  source 1..15: mol_type = genomic DNA
ggtatgcgtggttcc

SEQ ID NO: 36708 - DNA, 180 bp, Homo sapiens
  misc_feature 1..180: note = chr17:61926145-61926325
  misc_feature 1..180: note = hyper
  source 1..180: mol_type = genomic DNA
aaaaaaacaagactttttgcaaattatccattgtcaaaactccgccaaatacatctcccagcccgccagggagcagccagcagaggccgcaagctcggccaagcgagccgggatgtccaaggcgggaacgtggcttcgcgcgcaactctctgagacgcgggccggctcacgtgtccgggc

SEQ ID NO: 36709 - DNA, 118 bp, Homo sapiens
  misc_feature 1..118: note = chr17:61926507-61926625
  misc_feature 1..118: note = hyper
  source 1..118: mol_type = genomic DNA
cgcgctcccctcccgtcgttgtagcttcctgctcgcccctctcatctcagccaaccctgctgagctttcgcgtgggcgtcacgagtttctaggcagatcaggaaaaccgctctccggc

SEQ ID NO: 36710 - DNA, 54 bp, Homo sapiens
  misc_feature 1..54: note = chr17:62776217-62776271
  misc_feature 1..54: note = hyper
  source 1..54: mol_type = genomic DNA
caagggccaggagaccgcggcttgccgaggctgagggaccgaaggagcagggtc

SEQ ID NO: 36711 - DNA, 275 bp, Homo sapiens
  misc_feature 1..275: note = chr17:62776523-62776798
  misc_feature 1..275: note = hyper
  source 1..275: mol_type = genomic DNA
gaccatcgccctgggcggggcttccgaggtggtgccggagaggtttcgcggaatcggagctggcaacggcagcgaatagggacagcgacgctcaggagtgctgtcacccatacccaaagaagctgcgtctgggcggggcgaggaggaacctgaatgcctctgctggggaccttggggggcattgggacgaggaccggagcagaaagccggggtccggagccaggaaggctgcgtctgaaggggcgctggctggtcgctagcggagcccaaggagg

SEQ ID NO: 36712 - DNA, 270 bp, Homo sapiens
  misc_feature 1..270: note = chr17:62777021-62777291
  misc_feature 1..270: note = hyper
  source 1..270: mol_type = genomic DNA
caacagggcctttcccggagcaacccggccgggcctggaaaaactccgagagggattcccagcgcagggacgcccaccggagcgcagtgtctcgggctggataagaaggggacccggccacagctccttcgccaacctgcgggaacacagagaaggggagggattggtgggggccgagaggatccctggagcgcgagagcgcacccgtcgccaggaggtcccctgcgtccactgcccaggcgacgcaagctacagcggcgtcaacgcctg

SEQ ID NO: 36713 - DNA, 141 bp, Homo sapiens
  misc_feature 1..141: note = chr17:64825634-64825775
  misc_feature 1..141: note = hyper
  source 1..141: mol_type = genomic DNA
tagcccatgtgaatccgtgctgacatccgcacagatgaacggatcagatgagatttaatctccctgaggcccatgggcacgagtcactggagttttatggggtccagtaaagagcaaggaaaagtccgggtcttacaaggc

SEQ ID NO: 36714 - DNA, 229 bp, Homo sapiens
  misc_feature 1..229: note = chr17:64831214-64831443
  misc_feature 1..229: note = hyper
  source 1..229: mol_type = genomic DNA
cggcggcggcggccacggtcattggcgccgagcggttccggctgactggacggggcgggcgtcccgggcagcctagcgcggtacctcccgccccgcgcgcccagccggcgagggacattggaccagggtcgggggtcgcggccgctccagcgaggtaagagccgggaagaccgggagagaccacctcttccatcctgggggggtccctgggggacggtctcccaccggt

SEQ ID NO: 36715 - DNA, 60 bp, Homo sapiens
  misc_feature 1..60: note = chr17:64961565-64961625
  misc_feature 1..60: note = hyper
  source 1..60: mol_type = genomic DNA
cacgcgcgcgtagcccgggacccgagcgatccccaggggccgcgccggcacccccggggg

SEQ ID NO: 36716 - DNA, 45 bp, Homo sapiens; identical to SEQ ID NO: 12865
  misc_feature 1..45: note = chr17:64961987-64962032
  misc_feature 1..45: note = hyper
  source 1..45: mol_type = genomic DNA

SEQ ID NO: 36717 - DNA, 1213 bp, Homo sapiens
  misc_feature 1..1213: note = chr17:66596302-66597515
  misc_feature 1..1213: note = hyper
  source 1..1213: mol_type = genomic DNA
gctgcagccctgggccgggggcgtcaggaaactcgagactggggcgcggggaggccccggccagagcgcccgctctcccgcgtcccgggcggggtcctcacctgttccagcgggccaccttcctccggtaataccgcagcgcctcctggctggccaggagcgagtcctcggctcccaggagaggcggctcctccgggacgttgtacagcgggtgggcgaagagggcctgcaacttggagctcgacccgctgtggctgccgccagccggttcagtccggggctcggttcgggaaaagttgtgcacgatcgtgccggggtccgaggcagctgcggccgagtcccgcgccagggaggaggcgcggccggtgcacgggcacccccgcgggcgctcccgaggccgcagctggcgctgtacttggggccagaggtggaagtagaggtcggcggagagcagcgcgcccagcagcagcagagtcagtaggcggtcccggcgcagccccggcatggcgtgctggccaagggggacgccgggggcaggccggctgtctccggggtcccgggaggggtcgcggggtgcgggcagaagaggtgcctggagtcccgcgggtgggccggggtcagtgagaccggaatgctccccgcgcgggctagtcccctgtggaggggtgtcgctcctcaacttggggaccaggtgcacggagcaccggggctctcggagtcagcgggcgtcgcttctccgcgccgagtgagccgagggaatggggttcccggggtgcccgcttcttgcgccttttctcccgtgcgcccgcccgcccggacgctcgcggcaggtgaagggccccggggcgccggcgccggctgccaccgcgggcggacgggcgacggggcggggggcgaccgcggagggcggacggaggccgccggctgcaaagcccggggcgtctctcctgaggatgctgtcgctcggcggcggctgctagtgctcccgcgactcctcctgcgggcggcggagacgccagtgccggcggctggcacgggcggcgcgagtggggagttggcgaagcaggagcggctccggggagcttgtctgtgcgcctggactcctagaggcagaggtagcgcggggcctccccgagcctggcctggcgccggcacccccacccactctccgctggcacctgcctctggcgcagctgacggccaactcccgatc

SEQ ID NO: 36718 - DNA, 749 bp, Homo sapiens
  misc_feature 1..749: note = chr17:68165237-68165986
  misc_feature 1..749: note = hyper
  source 1..749: mol_type = genomic DNA
gcaaaggtctctacccggcgctggcacctcgcaggcccctcgaggagcacgcagggcaagcggcccaagagcgggggaaccgggaagtgtgtggggctccagacggagtaggaagctttgcccaaggccaggctgcaatcaggcagccgcaacagccgggcgcggagcttcccacctgctgctgtcccagctgggccgcaacttcctcctccccggcccgggcccgactccccggccgggctccgagggtggagggggacgaggcggcggcaggttccctccgctggcaacgcctcgcagcatcctcccctccccgccgcggttcccggggccggccgcgcggccaggcgcgctgcgattggccggcagcggccgggggcggggccaggagagccggtgtcgcacggaccgcctcaaaagagcccaggatattgcagagcgcactggagccctggccagcgcgcagccttcccggcgccggcgggctgggtcttgggaattctggtttgctttggctcactcgctttttacaaaccactggatcttacatgcctctgtaccccccacttccactccatgtccccatgctcctgcgccagcaacaggtaagggctgctgtgttttcttccttttcgctcgctgccggtgtgtcctggggaatggactctggccgccgtcccctaccctaccctgccccgctgctccagaggtgcccagctgtcacactgctgtagcgctcacccacactc

SEQ ID NO: 36719 - DNA, 78 bp, Homo sapiens
  misc_feature 1..78: note = chr17:70026589-70026667
  misc_feature 1..78: note = hyper
  source 1..78: mol_type = genomic DNA
tgttaatctgcaacacgccacagcctctagatcgctgccgttcagagtcggatgtcatgggggcgactggcaggggtt

SEQ ID NO: 36720 - DNA, 30 bp, Homo sapiens
  misc_feature 1..30: note = chr17:70026970-70027000
  misc_feature 1..30: note = hyper
  source 1..30: mol_type = genomic DNA
aaggagttggagctccgtgatggtgagctt

SEQ ID NO: 36721 - DNA, 751 bp, Homo sapiens
  misc_feature 1..751: note = chr17:70112816-70113567
  misc_feature 1..751: note = hyper
  source 1..751: mol_type = genomic DNA
aaattttccgcagggcgttctagggatgagttgagggaagccgcatgacgcgcggctccccggtgccacagctaaggacagatattttcgcaaaacccagaatgaaaaaagagcacgctccctttgggagcgctgtccctttgggactggggccttccactcccacccctcctttttccctgatcggctccgcagctccacgacaagccagctggtctggtctctgacttgggctccggtccgtacccccggggcgccctgctgtgttacagccgcccgacgcccccagacccggccaggtcaccagggcagattggaggttcgcgccccctcacccgacacctcccgtccacctcatctttctttttttcgaaaacaggaaagggaagaaaactgaaacgggcctcttggtctgcagttttagcggagtcgggattccacagccctgagtggcacatgccggtcaacttcccaaagtcgggctcccgtgtggggagaaatacacacgcaggaatgcacaagcatcgcgtgttcgcaactgtcgctgggaggtctggcggctgtgatgggacatgcactcactcgggcaacacgtccacaggtgacatctattcgatcagtcaacagatatttattgcgcacctacgacgctatctggtactttccttttccccttagctgttgctgtccagcccagcgccagtccagagacgggcttaccggccgctcccttccacaagaaactcgtgtc

SEQ ID NO: 36722 - DNA, 372 bp, Homo sapiens; identical to SEQ ID NO: 1322
  misc_feature 1..372: note = chr17:70113647-70114019
  misc_feature 1..372: note = hyper
  source 1..372: mol_type = genomic DNA

SEQ ID NO: 36723 - DNA, 365 bp, Homo sapiens; identical to SEQ ID NO: 1323
  misc_feature 1..365: note = chr17:70114152-70114517
  misc_feature 1..365: note = hyper
  source 1..365: mol_type = genomic DNA

SEQ ID NO: 36724 - DNA, 30 bp, Homo sapiens
  misc_feature 1..30: note = chr17:70115315-70115345
  misc_feature 1..30: note = hyper
  source 1..30: mol_type = genomic DNA
caatgcccttctacccgggacacagaaata

SEQ ID NO: 36725 - DNA, 640 bp, Homo sapiens; identical to SEQ ID NO: 1324
  misc_feature 1..640: note = chr17:70215667-70216307
  misc_feature 1..640: note = hyper
  source 1..640: mol_type = genomic DNA

SEQ ID NO: 36726 - DNA, 76 bp, Homo sapiens
  misc_feature 1..76: note = chr17:70216392-70216468
  misc_feature 1..76: note = hyper
  source 1..76: mol_type = genomic DNA
cgtcaaagccgggtccagggaaggggggcatgccatgggcgtattgttggcctgcgagttccgtcaatgggaaaag

SEQ ID NO: 36727 - DNA, 59 bp, Homo sapiens
  misc_feature 1..59: note = chr17:70588893-70588952
  misc_feature 1..59: note = hyper
  source 1..59: mol_type = genomic DNA
tcctctggataccagcgccgcaccgcgcacccgcgccgcctgcgcgccctgcagtcggc

SEQ ID NO: 36728 - DNA, 30 bp, Homo sapiens
  misc_feature 1..30: note = chr17:71160848-71160878
  misc_feature 1..30: note = hyper
  source 1..30: mol_type = genomic DNA
tgggtggaagggaatcgactctgtgaaatc

SEQ ID NO: 36729 - DNA, 256 bp, Homo sapiens
  misc_feature 1..256: note = chr17:71161183-71161439
  misc_feature 1..256: note = hyper
  source 1..256: mol_type = genomic DNA
cgcaagaccaccagcgcccagagccccagtctgaggcttggcgccgggggtctgcgggcgaggggagctctctacgtgcgaggggctagcgggagccggcacaagagggtcgaggagccaggaaccccaaacgtccggcgccaggcgctagccaagctgctgcgcgccccggcgcccagctggctcggggacagccgctgggtgtcggagaccggagctagcggattgcagcggaaaagcaaaggtgaggggtgtg

SEQ ID NO: 36730 - DNA, 917 bp, Homo sapiens
  misc_feature 1..917: note = chr17:71161499-71162416
  misc_feature 1..917: note = hyper
  source 1..917: mol_type = genomic DNA
agcgcacttgggcacctgtgtgcatctgcgctgatggtggtgtgcccatccgagtgcctgagcttaggtcccggtgcgtgattctccgctcttgtgccttttggggtgattgtagtaggaatgaacgacaacgggtacccttgcctgagtaagggggctgtgggtagagtgtgctggaacggacgtgtcctcgcagcctcatgcccgtgtgcgtggcgtgtgccctttagcccgagatttcaggtagctgcgacgggtgacaacttctctcccagccccctacaaaagagacctggcgcgaggggagcgaggccgtgagatgccagctggggctcctgcgggagcgcacccggagatccgagcctgccagaggcaggcggcgggcgcagagcggagaaagaggggcttctctccctagacgctgaacgatctaggatccgtccccgtcccccacctcgggacagaaaggacagtttgtctaggtttggagagaaaaaaccactgcataggccgtgcccaaaagccgctggccaagtcccccaagcgactgtcttctgcgccccgatgtctctgtcctcagcgccccccccccacacccggcacccctgctgtgcgtttcgatactgggcgtgctggcgccacaatctccgctcttgcctcgtcttcctggaaatggcacagagttctttgggaaacccttgctctgaggatcagcgagttggatggccaggaggaggactttctgtgccagccgggagcaaccggctccgcggtcctgacactcgcccctccatttctcaaccccgtaggccagcaccgccccggcttttcccaggcgctcacgcgccgcggtggccctcaggggcttttgtcaccctgccagtgggggctctcgctctagccgcacagagaccaag

SEQ ID NO: 36731 - DNA, 61 bp, Homo sapiens
  misc_feature 1..61: note = chr17:71639405-71639466
  misc_feature 1..61: note = hyper
  source 1..61: mol_type = genomic DNA
cacaggtcacagcagcgagcggctgcacagactatcgagcgaacagcggaggctggaggca

SEQ ID NO: 36732 - DNA, 62 bp, Homo sapiens
  misc_feature 1..62: note = chr17:71639789-71639851
  misc_feature 1..62: note = hyper
  source 1..62: mol_type = genomic DNA
gtctgggaagctcagcgtagccgagcgtggagcccggcacggaatgtcgctcccctcccaag

SEQ ID NO: 36733 - DNA, 30 bp, Homo sapiens
  misc_feature 1..30: note = chr17:71640237-71640267
  misc_feature 1..30: note = hyper
  source 1..30: mol_type = genomic DNA
ctggagaggggtcctcggggtctcccttcc

SEQ ID NO: 36734 - DNA, 265 bp, Homo sapiens
  misc_feature 1..265: note = chr17:71640832-71641097
  misc_feature 1..265: note = hyper
  source 1..265: mol_type = genomic DNA
gcaggcagcatctggcggggccgaaccaccccctctgggctccaccgccctcgcgccgaatcgggagacgccgggtctcctccgggggcgctggggccgggcgcgccctcggctccgcgcccagccggctagcaaactttgcgggtcccggagccgggcgcgcagccctgagcgcccatgtccgcgccagccgcggggcggcgggggagggtgctgggcttcgcgacgcgggctgtcgccggcgcccgggcgcagagcctcctgc

SEQ ID NO: 36735 - DNA, 318 bp, Homo sapiens
  misc_feature 1..318: note = chr17:71641365-71641683
  misc_feature 1..318: note = hyper
  source 1..318: mol_type = genomic DNA
gggggcagcgtgagccggggacgagcgcggcggaggcggagacgcggagaggggggccgagcgctaccccgtggccgcgactggagagcagcctgcgcgccgggaggggcggcggcggcggcggcggccccgagccaggcccgggagcgagccccgcagaaatacaatccgactgcgcggccgcgggcgcccagcggctctgggacccgcaggggggcagcagtgccaaccttctgccgcgccgggagagatgcgcgcgagcccctccgctctctgcccagcctttccttccagcctcgctcgcgcccctgtctcaaa

SEQ ID NO: 36736 - DNA, 62 bp, Homo sapiens
  misc_feature 1..62: note = chr17:71897979-71898041
  misc_feature 1..62: note = hyper
  source 1..62: mol_type = genomic DNA
attcgcacctgattacgctgcgcggacacaacagaggcgcccggacccgcagccctgccttc

SEQ ID NO: 36737 - DNA, 70 bp, Homo sapiens
  misc_feature 1..70: note = chr17:71898345-71898415
  misc_feature 1..70: note = hyper
  source 1..70: mol_type = genomic DNA
cctccctccccgccccgctccgccctgctggtcccgcctgccgtccgcaattaggcggcagatgcttgcc

SEQ ID NO: 36738 - DNA, 597 bp, Homo sapiens
  misc_feature 1..597: note = chr17:71948390-71948987
  misc_feature 1..597: note = hyper
  source 1..597: mol_type = genomic DNA
actccattcatctcccggttcctcgcattcatcccccaccgaacccacccacaaaatgctgaatcggtgggtgagatccccatagcaacggctccgatgccagaacccaggattacgacaccggatcagccagagacgcgctggaggggcccaggaggggctgcagcgcgccgcaaatcccccggggcttacgggagccgctctttaggagacagcgctggacgaaccgggcggggtggggatggataatcttcaggcgccaacgcaaaacggccgcaagacgtggccaggccaggaggctcctgggtcccgggcccgcgatgtggcccttgcgcggggacaaagacgaggccatcgccctcacgtgttcccaaagacgcccaacctcatcaggaggccgccccatccgccacctgggagcgtcccacacgcccgggcccttgaggatgtcccctcggcgatgtgcctgaccgggcgctccccgcccgccaacctccaacctccaacctccgccctccaccctccaccctccttgctctgtccgcgtggacgcagcccccggttcagacactagcgggtgcgcggggccgcccagga

SEQ ID NO: 36739 - DNA, 109 bp, Homo sapiens
  misc_feature 1..109: note = chr17:71949194-71949303
  misc_feature 1..109: note = hyper
  source 1..109: mol_type = genomic DNA
tcctgtcacccaccacgggagttcacacgctccagtccatcggcctcccccggcccgaccgccctggctcaggcaaatcccagcctgcacttcccgaaggaagtcccct

SEQ ID NO: 36740 - DNA, 251 bp, Homo sapiens
  misc_feature 1..251: note = chr17:72208417-72208668
  misc_feature 1..251: note = hyper
  source 1..251: mol_type = genomic DNA
agggcctttgagcaccgggtgactggggccccactccccagcagccatatgtgtttgcgagcgttttcagtcggtccgcatccacccggtcccttcagccagaaccctaggagccccgccccgtcctcccggggctcctttctcacccgcgtccctgccgcggtggatacgcacccctcaggctggctgcccagcgcggtttccacgcccaatctgccgcgaccccatcactccaccgcacctacccctga

SEQ ID NO: 36741 - DNA, 97 bp, Homo sapiens
  misc_feature 1..97: note = chr17:72209140-72209237
  misc_feature 1..97: note = hyper
  source 1..97: mol_type = genomic DNA
ttgtcctcactcaggcgtcctgcaggcggcttcagcgagttgttggggcagatgcgccgggagctcccgagggcagggacggcgtcttatttctctt

SEQ ID NO: 36742 - DNA, 284 bp, Homo sapiens
  misc_feature 1..284: note = chr17:72270174-72270458
  misc_feature 1..284: note = hyper
  source 1..284: mol_type = genomic DNA
gtaggcttggataagcgccttggcaacgcccctacaaatattcatgatcattattagtatgttaccaacctattggttaattcttctcctaactcaggagacctccaaaaagaagagggatggcctgcgcttccgacgtggcaggaaaggagtcacgtgctccggggtccttccgcgtcgccccgcgcgtccggagccaggccggggttgccaagcaaccggtaaacgccgccgtttgaggagcaccggagccgcgaccgtggattgaacgcttccccagagac

SEQ ID NO: 36743 - DNA, 42 bp, Homo sapiens
  misc_feature 1..42: note = chr17:72321933-72321975
  misc_feature 1..42: note = hyper
  source 1..42: mol_type = genomic DNA
cacaggcacctgctgcgatgcacgcggcgcccacggaaaccc

SEQ ID NO: 36744 - DNA, 248 bp, Homo sapiens
  misc_feature 1..248: note = chr17:72322310-72322558
  misc_feature 1..248: note = hyper
  source 1..248: mol_type = genomic DNA
ccccctgccccgcctcgggtcggcgtccttagccgctggcgcgttgttggtttcgggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtgagacccttttagaccctcctccccaccc

SEQ ID NO: 36745 - DNA, 15 bp, Homo sapiens
  misc_feature 1..15: note = chr17:72322611-72322626
  misc_feature 1..15: note = hyper
  source 1..15: mol_type = genomic DNA
cgccaccccactgag

SEQ ID NO: 36746 - DNA, 96 bp, Homo sapiens
  misc_feature 1..96: note = chr17:72427312-72427408
  misc_feature 1..96: note = hyper
  source 1..96: mol_type = genomic DNA
agccccgggggaaggcggccggaaaatctcttgtttatcgggctggataagtaccagcctggattcgcttcccaatttctgcggtccagcttcagc

SEQ ID NO: 36747 - DNA, 64 bp, Homo sapiens
  misc_feature 1..64: note = chr17:72428340-72428404
  misc_feature 1..64: note = hyper
  source 1..64: mol_type = genomic DNA
ctggagcgcggcgggcgcccgattagcgccctgaatggaggtgatgtaacggtgatgcaggctc

SEQ ID NO: 36748 - DNA, 182 bp, Homo sapiens
  misc_feature 1..182: note = chr17:72667300-72667482
  misc_feature 1..182: note = hyper
  source 1..182: mol_type = genomic DNA
gtgagctcctgggaccgcaatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccggg

SEQ ID NO: 36749 - DNA, 181 bp, Homo sapiens
  misc_feature 1..181: note = chr17:72838924-72839105
  misc_feature 1..181: note = hyper
  source 1..181: mol_type = genomic DNA
caagcgcctgcaggccgagtggccgtcggggcgggcgcaggcggggccggtgcacccagcgggcagcgagctgggccgagcgaaggcctcggccacggagctgggcagggaagcgtgacgcgggcgcgagccccgggcccaggccgcgtgcagcagggcctcccgccgggccagctgctcc

SEQ ID NO: 36750 - DNA, 30 bp, Homo sapiens
  misc_feature 1..30: note = chr17:72848653-72848683
  misc_feature 1..30: note = hyper
  source 1..30: mol_type = genomic DNA
cgaaggcgctccagtcgtactcttccagca

SEQ ID NO: 36751 - DNA, 190 bp, Homo sapiens
  misc_feature 1..190: note = chr17:72856276-72856466
  misc_feature 1..190: note = hyper
  source 1..190: mol_type = genomic DNA
tacctgcccctggcacgctcttattcttcgggagtttagaaacaggctcaaagtcactagcaccgccaagacctggacgggctctgaaatacagccagcggaatggtaccctccccaaataagtgtctttcctcgattttcctgtggcccggggtcagggactgaactaagataacgccaccatccgagg

SEQ ID NO: 36752 - DNA, 743 bp, Homo sapiens
  misc_feature 1..743: note = chr17:72856941-72857684
  misc_feature 1..743: note = hyper
  source 1..743: mol_type = genomic DNA
tggaaggggaagaagcgggactcgcggcgggggaaggggtctgggcgccgaggcgagtgcgcagcaggtgcccagcagacctagggaaactggggcactgggctggggagccgcacagccccctttcaccttctcgactcctttccaacccctcgctctggtggatcccagccccggcccccactcccggccctgttccccgctctccgccccggcggcttccagcagcaacagtttgggtccgcggcagcccagactcccctggtcccgcggtgctgccgcgccaagcgaaggaggaggagggctcggcgaccctggggacgaacgtcttggacgcttcgcccgcgtccttctctcgcgtccgccgcgcgcctgtctgctcggcctcttcttcgccttctctccggccgcccgggtcaaaacccaaggccaggttcttgagggtccgggtcctccagccgccccctccttgagccccgagagtcctgcgtgggtccaaccccccgggtgtcccgcctctgtctccgccgtccttgctcgcgcgccgcgggaacccagccccaagttggcggcgaagttggtgcccctcgcccgccgctcgccacttaccgaggggaaggggcgctgcgcccgcgacgagagcccgcgccggccgcctccctcgcggtgtctgtcccagagcctcggccccggagggctggcgcgctcagtctcagctccgcgggcgccggagcccgggcgcg

SEQ ID NO: 36753 - DNA, 67 bp, Homo sapiens
  misc_feature 1..67: note = chr17:72857958-72858025
  misc_feature 1..67: note = hyper
  source 1..67: mol_type = genomic DNA
tcccctctccggaaccgcgtccccagacctgacactcggggcaagtgcgcctcggaggacacaccag

SEQ ID NO: 36754 - DNA, 23 bp, Homo sapiens
  misc_feature 1..23: note = chr17:72889334-72889357
  misc_feature 1..23: note = hyper
  source 1..23: mol_type = genomic DNA
ctccatccttgggtgcggggccc

SEQ ID NO: 36755 - DNA, 380 bp, Homo sapiens
  misc_feature 1..380: note = chr17:72889430-72889810
  misc_feature 1..380: note = hyper
  source 1..380: mol_type = genomic DNA
cgcgccgccacctccgccgcaccccgcccccacccgcagcccggccgggacgccgggtccccgcgttcctcacctgccggcaaggcgaagaggctgagcgcgaggatggcgcagtccacgccgtggcgctcccaccaggagctcgtcctcaccacgtcctgcaccagcacctccagctcccgcagcagcgcctcgcccccacggtgcgcgctccgcgccggttccatgggctccgtaggttccatgggctccgtgggttccatggactctgtgggctcgggcccgacgcgcacggaggactggaggactggggcgtgtgtctgcggtgcaggcgaggcggggcgggccggggcggagtcacgcgccgcctggggacaccc

SEQ ID NO: 36756 - DNA, 40 bp, Homo sapiens
  misc_feature 1..40: note = chr17:72890033-72890073
  misc_feature 1..40: note = hyper
  source 1..40: mol_type = genomic DNA
gacaccccccacccccgccccgccccgagggccttccctg

SEQ ID NO: 36757 - DNA, 30 bp, Homo sapiens
  misc_feature 1..30: note = chr17:72920550-72920580
  misc_feature 1..30: note = hyper
  source 1..30: mol_type = genomic DNA
cttcccctttcccagcgcttcctccagcac

SEQ ID NO: 36758 - DNA, 219 bp, Homo sapiens
  misc_feature 1..219: note = chr17:72920855-72921074
  misc_feature 1..219: note = hyper
  source 1..219: mol_type = genomic DNA
ctgcacgctcatcagcggcggagccttcaacaaggtggccgtgtacgacaccgacgtgttcgcgctgctcactgcgatgatgctgctggcaacgctctggatcctcttctacctcctccgaaccgtgcgctgcccctgcgcggtaccctaccgggacgcgcacgctggccccatctggctccgaggtgccaggggaggtgggggcgaggtagggtgggc

SEQ ID NO: 36759 - DNA, 75 bp, Homo sapiens
  misc_feature 1..75: note = chr17:72932011-72932086
  misc_feature 1..75: note = hyper
  source 1..75: mol_type = genomic DNA
cggcgatgcctctcccggcctcaggtaagcccggagcgccggcggaactttcccagcttgcgcaccccagacact

SEQ ID NO: 36760 - DNA, 258 bp, Homo sapiens
  misc_feature 1..258: note = chr17:72932356-72932614
  misc_feature 1..258: note = hyper
  source 1..258: mol_type = genomic DNA
gcccggtctggggcacgcaggaagcggctgccccggccccgcagtccctaaaatggctcggaaggaaatcccgagggcgcccgcactcagcagcctcctcggagccggccctgcgctgctgggccgggcgccgggcccgacggctccgcggctttcatcgccaatccagccgagacccacaaaccagtccagtgtcccggccctcccttggactggcgtcgcgcccaggggcgtgccagggggcggcagagtactgct

SEQ ID NO: 36761 - DNA, 235 bp, Homo sapiens
  misc_feature 1..235: note = chr17:73073449-73073684
  misc_feature 1..235: note = hyper
  source 1..235: mol_type = genomic DNA
ggcctgtccgagggccgccactaggacgggaggtggaggtgtccaactcgtgggtgtgcctgggcgtcacctacccccgcagctccccgctcggcggccgcccgagccgcagcgtggtctacctgctgggccgcaaccccttctcgtggtgcctggagtgggacgacaacgcgcagaccgtgctgcacggcgcctaccaccgcacgctgggcgtggcgctcgactgcgacgccgg

SEQ ID NO: 36762 - skipped

SEQ ID NO: 36763 - DNA, 100 bp, Homo sapiens
  misc_feature 1..100: note = chr17:74070380-74070480
  misc_feature 1..100: note = hyper
  source 1..100: mol_type = genomic DNA
agccagactccggggcccctcatccgcctccgccccgcgtttcctccccccgatctcccaggggtcctcttttgagggcaccccagcccctcgacggtcc

SEQ ID NO: 36764 - DNA, 712 bp, Homo sapiens
  misc_feature 1..712: note = chr17:74071017-74071729
  misc_feature 1..712: note = hyper
  source 1..712: mol_type = genomic DNA
gggaggctggcaccccgaggcggtcatcgtgcccctgctcttcgcgctcatcttcctcgtgggcaccgtgggcaacacgctggtgctggcggtgctgctgcgcggcggccaggcggtcagcactaccaacctgttcatccttaacctgggcgtggccgacctgtgtttcatcctgtgctgcgtgcccttccaggccaccatctacaccctggacggctgggtgttcggctcgctgctgtgcaaggcggtgcacttcctcatcttcctcaccatgcacgccagcagcttcacgctggccgccgtctccctggacaggtgagccagcgccttggcctccctgggagatgggcatccacgcgggggatggagcgggaggcgggactggggaccaagaagggacgcgcagagtgggacaggacactaagaaggcagtggaagacaagcgggcgcggaggaggaaaaagaggaataagaatgggggaccgtggtgtccctcggttagatgcgtcctggggcctggaagcctggagaatgtggctctccagcgccgcccgtgcctgacaacgcgcagcgtttcccagtacgacgcgtttgtgcgcgttcatctcgcttgagcttaatgccctccgtgagggtgggataggacaaagtgcccaatatacagaagagttgagttcctaagtaactcgctcagagtcgccagccagggatc

SEQ ID NO: 36765 - DNA, 103 bp, Homo sapiens
  misc_feature 1..103: note = chr17:74072477-74072580
  misc_feature 1..103: note = hyper
  source 1..103: mol_type = genomic DNA
cacctttcctgctgccgggcccgccccatttccaggctccgctgagtgtctgggacacgctgggaggcccccacctccgccctcacgccgagcctcaccccca

SEQ ID NO: 36766 - DNA, 456 bp, Homo sapiens
  misc_feature 1..456: note = chr17:74072998-74073454
  misc_feature 1..456: note = hyper
  source 1..456: mol_type = genomic DNA
cgtcgacccggtggccgcgggctcgggtgcccggcgcgccaagcgcaaggtgacacgcatgatcctcatcgtggccgcgctcttctgcctctgctggatgccccaccacgcgctcatcctctgcgtgtggttcggccagttcccgctcacgcgcgccacttatgcgcttcgcatcctctcgcacctggtctcctacgccaactcctgcgtcaaccccatcgtttacgcgctggtctccaagcacttccgcaaaggcttccgcacgatctgcgcgggcctgctgggccgtgccccaggccgagcctcgggccgtgtgtgcgctgccgcgcggggcacccacagtggcagcgtgttggagcgcgagtccagcgacctgttgcacatgagcgaggcggcgggggcccttcgtccctgccccggcgcttcccagccatgcatcctcgagccctgtcctgg

SEQ ID NO: 36767 - DNA, 63 bp, Homo sapiens
  misc_feature 1..63: note = chr17:74117965-74118028
  misc_feature 1..63: note = hyper
  source 1..63: mol_type = genomic DNA
tcctctgaaccagtccggaaggggggttcggctggcaagccgcggtggcgtcagcctctggca

SEQ ID NO: 36768 - DNA, 146 bp, Homo sapiens
  misc_feature 1..146: note = chr17:74136296-74136442
  misc_feature 1..146: note = hyper
  source 1..146: mol_type = genomic DNA
gtgggggtcggtgccccccgggggcagggcgggggccttggcgttgagaatggagaattcctgcagccactgcaggctggtcaggctgtcatccagggcgtcgggctcctccaggccgccctccggcccggcctcctccgccggcc

SEQ ID NO: 36769 - DNA, 149 bp, Homo sapiens
  misc_feature 1..149: note = chr17:74136570-74136719
  misc_feature 1..149: note = hyper
  source 1..149: mol_type = genomic DNA
cgttacacggcctcccggacgcgcgcttccatctcgcgaccccgggggcgcctcctccgaataagtatgtggtgcctgcgaggaccacggtgggagctgagcactaccccacccccgaggggacagtgtgtgtacggggacgccctctc

SEQ ID NO: 36770 - DNA, 30 bp, Homo sapiens
  misc_feature 1..30: note = chr17:74378928-74378958
  misc_feature 1..30: note = hyper
  source 1..30: mol_type = genomic DNA
acagcctccgattcgcgttttctaggcacc

SEQ ID NO: 36771 - DNA, 15 bp, Homo sapiens
  misc_feature 1..15: note = chr17:74533543-74533558
  misc_feature 1..15: note = hyper
  source 1..15: mol_type = genomic DNA
caccgccttcctctc

SEQ ID NO: 36772 - DNA, 143 bp, Homo sapiens
  misc_feature 1..143: note = chr17:74533674-74533817
  misc_feature 1..143: note = hyper
  source 1..143: mol_type = genomic DNA
cgcggggcgcggggcgcggggcgccgggagccggggccggctgcgtgcgcggcgggcgggcgaggggtagagcgcggagggagggagcgtgtgtctgtgcgcgccgggtgtgtgtgtgtgtgtgcgtgcgtgtgtgcagggta

SEQ ID NO: 36773 - DNA, 144 bp, Homo sapiens; identical to SEQ ID NO: 4498
  misc_feature 1..144: note = chr17:74534219-74534363
  misc_feature 1..144: note = hyper
  source 1..144: mol_type = genomic DNA

SEQ ID NO: 36774 - DNA, 46 bp, Homo sapiens
  misc_feature 1..46: note = chr17:74534387-74534433
  misc_feature 1..46: note = hyper
  source 1..46: mol_type = genomic DNA
cgcccaggctctggggggttagcacgggggtcgtccccctgcccgc

SEQ ID NO: 36775 - DNA, 327 bp, Homo sapiens
  misc_feature 1..327: note = chr17:74581216-74581543
  misc_feature 1..327: note = hyper
  source 1..327: mol_type = genomic DNA
gggcttatccagacacggcgagcggaagccggggagaagggagcgggcgcggggcggacagagaccgcagcgggcgggaaaggcgactggccgcggcccgacggagggtccccgcgaagttggaaaccggagacttgggcccctgcccaaaaagcagaatctgacgttaccgagggagagttcccgacaaaaaaggaagtttttatctgcttcggggacccagccagatttcgacaatagaaagtgtacttatcaggccggggaggacttcaccaacaaggggcaccggggcgggtcgccagtgcacaggggcgaggtcttccttgg

SEQ ID NO: 36776 - DNA, 399 bp, Homo sapiens
  misc_feature 1..399: note = chr17:74864669-74865068
  misc_feature 1..399: note = hyper
  source 1..399: mol_type = genomic DNA
ggaggcgctggggaccggggcgcgggcccggggccgcctttagccggcaccgagggcgcggggccggggatgagggcgcccgccgcggggagcccgtctgcgcgccgcggcaccttcccgcccagcgagcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgc

SEQ ID NO: 36777 - DNA, 186 bp, Homo sapiens
  misc_feature 1..186: note = chr17:74865069-74865255
  misc_feature 1..186: note = hyper
  source 1..186: mol_type = genomic DNA
tccggcctcgcccgcggctgctcgcaccaacaagtttgaacaatgatcaccgtcaaccccgatgggaagataatggtcagaagatgcctggtcaccctgagaccctttcggtaaagttccctcctggttggttttttccccaggggggcgccgggtggaggtgggcgaggtcggttcctgcgaacg

SEQ ID NO: 36778 - DNA, 748 bp, Homo sapiens
  misc_feature 1..748: note = chr17:74865553-74866301
  misc_feature 1..748: note = hyper
  source 1..748: mol_type = genomic DNA
aaagttagtgtgcggcgccttggagctccccctccggtccctcccgtcccgcccgtctgcccctaggtcggctaccccccaacccctccgcctgtgccaccctctccccagcctttggtggcactgctctcctccccgcggggctcgggcctggctccgacgagagggtcccgagattagagcgaggactcgctcatcccaggattcgcccccgatcgcaggcgtcggagaggcgggggcaggggcggcgctgcagggctacggggcggctggagccgaggctgcggcggagcgtggtgggcgggcggtggcgaaggcgacacgcttcgggcggccaacacctgggggcccaggccaggcagggctggggccgcgcgggactcactggacccagccaggggcccccagggcccagcggtgccggggcagccccctctcctcccaggcatccgcggaaccggcccgcagcggggtggggagggggcgctgcccagtggacgcccggcggggcccgagtgtcaccccgtgggtagctgggcagcgaggaagctgggggagtgaccgccccggcgcgggggccggactcgggacgtggccacaggtgggctccgggcgcgggaaggagcccgagaaggcggagcttgcaggggccctgaactcttgccctccaggtctcggcccagccccactgtggtccccctgccggctccagacggggatgggggcggggagacggtggctcacctgg

SEQ ID NO: 36779 - DNA, 30 bp, Homo sapiens
  misc_feature 1..30: note = chr17:74965579-74965609
  misc_feature 1..30: note = hyper
  source 1..30: mol_type = genomic DNA
tgcagtgagactcatcggtgaggggggcac

SEQ ID NO: 36780 - DNA, 187 bp, Homo sapiens
  misc_feature 1..187: note = chr17:75368715-75368902
  misc_feature 1..187: note = hyper
  source 1..187: mol_type = genomic DNA
gccgtgttccatccccgccctgtgccccttctcccggacagtgccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgc

SEQ ID NO: 36781 - DNA, 188 bp, Homo sapiens; identical to SEQ ID NO: 12903
  misc_feature 1..188: note = chr17:75368903-75369091
  misc_feature 1..188: note = hyper
  source 1..188: mol_type = genomic DNA

SEQ ID NO: 36782 - DNA, 366 bp, Homo sapiens
  misc_feature 1..366: note = chr17:75369092-75369458
  misc_feature 1..366: note = hyper
  source 1..366: mol_type = genomic DNA
ccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccgg

SEQ ID NO: 36783 - DNA, 368 bp, Homo sapiens
  misc_feature 1..368: note = chr17:75369492-75369860
  misc_feature 1..368: note = hyper
  source 1..368: mol_type = genomic DNA
cgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcg

SEQ ID NO: 36784 - DNA, 74 bp, Homo sapiens
  misc_feature 1..74: note = chr17:75370268-75370342
  misc_feature 1..74: note = hyper
  source 1..74: mol_type = genomic DNA
ggggatatcctcatccgcctcccagaatcgggccgtgggggacagaaggggcctgcgtgcgggcagggagagta

SEQ ID NO: 36785 - DNA, 30 bp, Homo sapiens
  misc_feature 1..30: note = chr17:75370646-75370676
  misc_feature 1..30: note = hyper
  source 1..30: mol_type = genomic DNA
agccctctggtgggccgggagggggaaagg

SEQ ID NO: 36786 - DNA, 88 bp, Homo sapiens
  misc_feature 1..88: note = chr17:75447639-75447727
  misc_feature 1..88: note = hyper
  source 1..88: mol_type = genomic DNA
cttgcaccactggctcgggggctctcaggtggcgcggccgcgaggcggaccctgatggccatggtggcggtgccgggagccacgctgt

SEQ ID NO: 36787 - DNA, 413 bp, Homo sapiens
  misc_feature 1..413: note = chr17:75524591-75525004
  misc_feature 1..413: note = hyper
  source 1..413: mol_type = genomic DNA
accccctctcgtggtcgccagggtaggggtgggaggaatctggaagccacgtgcgatgctcggagctgcgtcctctgtcctggggcgtgggtccgcgagcgccgcgcagcctcccggaccgccctgagctgctgcgcccggcgctgctcctccttccccagctccgcgccttcccctcgcgatccccctcctgcctcttcggtcctggaagcgtcccaagatggggtgggggcatggagggagagaggggaggagggagctgcccgggggcagtgccgccaggaagtgggacggggactctggcgcccctccaggctgctgcgcgcgggctggggaccgtgcaccgctttgcgcgccagacgatgcatcttctggaacggcagctgaggcaatgcggggtgtgaagtggcggc

SEQ ID NO: 36788 - DNA, 103 bp, Homo sapiens
  misc_feature 1..103: note = chr17:75525005-75525108
  misc_feature 1..103: note = hyper
  source 1..103: mol_type = genomic DNA
ggcagaggggctcgcaggggctgggatccgcgtgcccctctctgcctcggtgcggagcacgatgtgcccgggcgggggcgaggacgtccgggaggggctgggc

SEQ ID NO: 36789 - DNA, 98 bp, Homo sapiens
  misc_feature 1..98: note = chr17:75953838-75953936
  misc_feature 1..98: note = hyper
  source 1..98: mol_type = genomic DNA
tcgaattgcacattgcgcctgaccttacctaccactaatgaataatggatatcgaggagccgtggaatggaggatcacggcggcgtacggagcaccgg

SEQ ID NO: 36790 - DNA, 389 bp, Homo sapiens; identical to SEQ ID NO: 4503
  misc_feature 1..389: note = chr17:76227773-76228162
  misc_feature 1..389: note = hyper
  source 1..389: mol_type = genomic DNA

SEQ ID NO: 36791 - DNA, 144 bp, Homo sapiens
  misc_feature 1..144: note = chr17:76228213-76228357
  misc_feature 1..144: note = hyper
  source 1..144: mol_type = genomic DNA
cggacgccggcaatggcagcgcctggcccgggcgcgcagagctgctctcctcgcactcggggctctggcgcatctgcgaaggtaaccggccaccgcgccggccctcctccctccgcgacctcgtccctccgacacccccttaac

SEQ ID NO: 36792 - DNA, 18 bp, Homo sapiens
  misc_feature 1..18: note = chr17:76254836-76254854
  misc_feature 1..18: note = hyper
  source 1..18: mol_type = genomic DNA
cgccggggaggctgctgc

SEQ ID NO: 36793 - DNA, 146 bp, Homo sapiens
  misc_feature 1..146: note = chr17:77178726-77178872
  misc_feature 1..146: note = hyper
  source 1..146: mol_type = genomic DNA
cacccaaccccaactcgccagccggagcttcctgcgcagcccccaagattgcaaaagtctggccccagccccctccccggccagagctcctggggcctccctcgccaggcgggtggcccacctcccccgcctccccggaggcccgg

SEQ ID NO: 36794 - DNA, 102 bp, Homo sapiens; identical to SEQ ID NO: 4505
  misc_feature 1..102: note = chr17:77178962-77179064
  misc_feature 1..102: note = hyper
  source 1..102: mol_type = genomic DNA

SEQ ID NO: 36795 - DNA, 249 bp, Homo sapiens; identical to SEQ ID NO: 4506
  misc_feature 1..249: note = chr17:77179081-77179330
  misc_feature 1..249: note = hyper
  source 1..249: mol_type = genomic DNA

SEQ ID NO: 36796 - DNA, 75 bp, Homo sapiens; identical to SEQ ID NO: 4507
  misc_feature 1..75: note = chr17:77179380-77179455
  misc_feature 1..75: note = hyper
  source 1..75: mol_type = genomic DNA

SEQ ID NO: 36797 - DNA, 27 bp, Homo sapiens
  misc_feature 1..27: note = chr17:77179456-77179483
  misc_feature 1..27: note = hyper
  source 1..27: mol_type = genomic DNA
gcaggggggcgcccggcggcggctctg

SEQ ID NO: 36798 - DNA, 92 bp, Homo sapiens; identical to SEQ ID NO: 4509
  misc_feature 1..92: note = chr17:77179617-77179709
  misc_feature 1..92: note = hyper
  source 1..92: mol_type = genomic DNA

SEQ ID NO: 36799 - DNA, 67 bp, Homo sapiens
  misc_feature 1..67: note = chr17:77179710-77179777
  misc_feature 1..67: note = hyper
  source 1..67: mol_type = genomic DNA
ggcgagcgggcgagagcaggagtcagtcactttggagcctccggagccctgtctgcaaagagtggtg

SEQ ID NO: 36800 - DNA, 429 bp, Homo sapiens
  misc_feature 1..429: note = chr17:77179799-77180228
  misc_feature 1..429: note = hyper
  source 1..429: mol_type = genomic DNA
cgtgtgcgcgcgtgtgtagcggtgggagggggagtccctggcgtactccaacatcaaacggagccccgcgcggagggaagagaatccggagcgacggcacaacagctgatcccacacttaacccctcgcccgccggcaccggggcagccctccctcgcgccctcccacgctcgggcccctgcgcgcccctcctcccccccgttgccagcacttgctcctggcctggggggtctggaatctccctttgcccccgctccgttctccggccgctgcggagaggaggagccgctccgccggctctgcggccgaccgaccggaaggcgcctcgtcctgtttcgcgttcagagaagcgcctttcctaagggaggccggctcagtggcggggatgtcggtgatgtaatccgagggcatctacgcagaggcttccgc

SEQ ID NO: 36801 - DNA, 114 bp, Homo sapiens
  misc_feature 1..114: note = chr17:77188779-77188893
  misc_feature 1..114: note = hyper
  source 1..114: mol_type = genomic DNA
gccagaccctggagccgccgtggctgcctacacctctgtctccctgggcccaaacaagcacgggtgtcagtgaactctctgttttgcaggggtggccagcggctagccctgctg

SEQ ID NO: 36802 - DNA, 34 bp, Homo sapiens
  misc_feature 1..34: note = chr17:77216439-77216473
  misc_feature 1..34: note = hyper
  source 1..34: mol_type = genomic DNA
ctcctctctgcctcccgctcgctcctgctcactc

SEQ ID NO: 36803 - DNA, 129 bp, Homo sapiens
  misc_feature 1..129: note = chr17:77290796-77290925
  misc_feature 1..129: note = hyper
  source 1..129: mol_type = genomic DNA
ccggactgggggccacgtggaggaggccttggttcagctctgccccatgcctcacgggacacacatttatcacctggaaacagcggccagtgctcaggaaggctcatgccattgcggatctgccttcat

SEQ ID NO: 36804 - DNA, 233 bp, Homo sapiens
  misc_feature 1..233: note = chr17:77772557-77772790
  misc_feature 1..233: note = hyper
  source 1..233: mol_type = genomic DNA
ctgtccaaagtgaggcgcgcgcaggcggcggcagccgcgaggtcctcgacccgccgggcaagcggggcgcttcgcccatcttccctcccagtcgtgccccagcctctggaaacacgggtttcaggttttggccttgttcctaaacttcacaaggtggccgcttgtcgaacagtcccatctctccggccgttctgtctgaacgaacagcgcgtcgaggacgctcagatctccca

SEQ ID NO: 36805 - DNA, 16 bp, Homo sapiens
  misc_feature 1..16: note = chr17:77776550-77776566
  misc_feature 1..16: note = hyper
  source 1..16: mol_type = genomic DNA
ggaccggttgggccac

SEQ ID NO: 36806 - DNA, 317 bp, Homo sapiens
  misc_feature 1..317: note = chr17:77776679-77776996
  misc_feature 1..317: note = hyper
  source 1..317: mol_type = genomic DNA
gccgcgggccggccccatttccgccccccccccacgcgcccccccatcacacgcacacccaatccccggactgctcgctggtgctgcttgtgagacccattcctaggagccccaggcgcccttggggagcagaaagaggcggtccagagttgggccggacaaccgcaacctggaaggagtccgggagtccttgggtctgggcgctcagttctcacggtctggggagaaggggctcagacgggacggactaggcacagccaggggcggggactgcgagaggcgaggggaggccggcagggtgtggcggcagagcagcc

SEQ ID NO: 36807 - DNA, 223 bp, Homo sapiens
  misc_feature 1..223: note = chr17:77777052-77777275
  misc_feature 1..223: note = hyper
  source 1..223: mol_type = genomic DNA
cgttatcagaaacctccagccccaacccctgcctggagatgcccggggcgcgctgactctgttctcgcatcaccccgggccctggctcaacgcgtgagcagcctgtggttccagataccccgagtggagagtttgaccccagattctgcctgcactgacaggcttggcctggcggttacgagccacggttgatgagcgcccctcctcccgtgacccagctcat

SEQ ID NO: 36808 - DNA, 147 bp, Homo sapiens
  misc_feature 1..147: note = chr17:77777502-77777649
  misc_feature 1..147: note = hyper
  source 1..147: mol_type = genomic DNA
gctccagggactcctcggactccgcctggcgcttcccgttttttcatttcctaccccacccccatgcagaaggaattgaagtgacttttttgctgggacgtcgggacctcaagtcagttccaaagtgggagtctctcagccggtgcc

SEQ ID NO: 36809 - DNA, 254 bp, Homo sapiens; identical to SEQ ID NO: 4512
  misc_feature 1..254: note = chr17:77777650-77777904
  misc_feature 1..254: note = hyper
  source 1..254: mol_type = genomic DNA

SEQ ID NO: 36810 - DNA, 52 bp, Homo sapiens
  misc_feature 1..52: note = chr17:77777943-77777995
  misc_feature 1..52: note = hyper
  source 1..52: mol_type = genomic DNA
cgacgcctttcctcgcagccccggtacagggcttcctcggtgcacccctagc

SEQ ID NO: 36811 - DNA, 373 bp, Homo sapiens
  misc_feature 1..373: note = chr17:77778673-77779046
  misc_feature 1..373: note = hyper
  source 1..373: mol_type = genomic DNA
gaaatgtgatgttcacgctgagtttctgtatttttctagtttcaacctcagagcttactttttggccaaacggatgaaggggtaagccaccgtggaagtcccagcagatacccccaccatcgccccatccatcctgggaggttcggtggccctcgaggcagagacatggactgtggctggggtattgggggcagatgttcaatgtgttggggtgtggagagggtagattggcagcctactgaggattaaaggggtgtcctgcaaaccagctccggggtctgggtccggaccttccagggactcagttccgcaccctttgaacagatcaagacagagcacttccttgctctgggatggtcgcctcagccaccga

SEQ ID NO: 36812 - DNA, 304 bp, Homo sapiens
  misc_feature 1..304: note = chr17:77786467-77786771
  misc_feature 1..304: note = hyper
  source 1..304: mol_type = genomic DNA
tcccctgccctggtgcgcccccgggccctgccctgagcccatgccccaggccgggtgtccagttcaccctgagctccccttggcgcccggagaagggtgctcgggcccgggtgctggggagcggcggggtggccgccggcgcctcttcggcgcggatggctctcggcggggccgaggagggggtcgcagagcggctccccgccgagaggagggtgggcgctcggcacctgctgagctacggtggtggctgcggtttatggcgcccgaggatccacccggatcttctccgcggagttccgggctt

SEQ ID NO: 36813 - skipped

SEQ ID NO: 36814 - DNA, 112 bp, Homo sapiens
  misc_feature 1..112: note = chr17:77814794-77814906
  misc_feature 1..112: note = hyper
  source 1..112: mol_type = genomic DNA
ggagaagctcgaagacggtctggtgttgaacgcacacgtggactccatttcattaccaccttgcagctcttgcgccacggaggctgctgctgcccggcggctgctacccacc

SEQ ID NO: 36815 - DNA, 30 bp, Homo sapiens
  misc_feature 1..30: note = chr17:77815150-77815180
  misc_feature 1..30: note = hyper
  source 1..30: mol_type = genomic DNA
atatttttctcctgccgtgtttggcttttt

SEQ ID NO: 36816 - DNA, 133 bp, Homo sapiens
  misc_feature 1..133: note = chr17:77815455-77815588
  misc_feature 1..133: note = hyper
  source 1..133: mol_type = genomic DNA
ccaggtctgggctgccgggggaggccgagcggctgctgcagcctccctgctgccaggggcgtcggactccgcttcgctcactacgcccaggcccctcaggggcccacgctcaggacttcggggccacacagca

SEQ ID NO: 36817 - DNA, 30 bp, Homo sapiens
  misc_feature 1..30: note = chr17:77815905-77815935
  misc_feature 1..30: note = hyper
  source 1..30: mol_type = genomic DNA
gcccctacctaacctcggtggctggtccct

SEQ ID NO: 36818 - DNA, 176 bp, Homo sapiens
  misc_feature 1..176: note = chr17:77904151-77904327
  misc_feature 1..176: note = hyper
  source 1..176: mol_type = genomic DNA
cggctcggtggggttcgcggcgcacggaccccgcccccaaggcctcaggtgggccgggggctccgggaggcctccgccgccctccgtcccaggagagcagttcccggtgagaagcccgggctctgcagacaccccacagcagttctgcgtctcggaaaacgcggcgccttcatcag

SEQ ID NO: 36819 - DNA, 159 bp, Homo sapiens
  misc_feature 1..159: note = chr17:78045491-78045650
  misc_feature 1..159: note = hyper
  source 1..159: mol_type = genomic DNA
ttatcaaacaggcttcgtgtgagatgattttgcccacctgtaggctcatgggagtgtcctgagcacgtttgagggaggctgggctgagccggggtgcctggcaggaaatctgcaggaagtgcattttgggtttttcagctttttttttttttttttttt

SEQ ID NO: 36820 - DNA, 30 bp, Homo sapiens
  misc_feature 1..30: note = chr17:78449436-78449466
  misc_feature 1..30: note = hyper
  source 1..30: mol_type = genomic DNA
gcctctccagctcatcgatcttgctctgca

SEQ ID NO: 36821 - DNA, 30 bp, Homo sapiens
  misc_feature 1..30: note = chr17:78449720-78449750
  misc_feature 1..30: note = hyper
  source 1..30: mol_type = genomic DNA
tggccgggtagggaacggggtgggggaggg

SEQ ID NO: 36822 - DNA, 880 bp, Homo sapiens
  misc_feature 1..880: note = chr17:78449963-78450843
  misc_feature 1..880: note = hyper
  source 1..880: mol_type = genomic DNA
gcgtgctctggctctcgcagcggcccagcttggcggtcagctcgcggatggtctccttctggctcaggatggtctccttctgctgcagcaccgtctcgcggagctgcagcacgctgctccggagctcctcggcgccgccggcggccacggacgcggcgcacatgtcggcgtccacgggcaccgaggtgcagatgaagcgcgtcggcccgaaatcctgggccccggcgcccaggaggcagagggcgagcagcgcacaggtgcgcgcggcgcggccggccggcatggctgcgggcaccgggcgctccgggcccggctcggctcggctggggctcggctccggctgggacccggctcgggctgtggctccgcgagcggcccgcgctctgggcgccgcgctcttcggccgcgcggtccacaccgccgcgctatcaggcccccactgccgcctgcgctgcggagcccgcgccttttatgccgccgcgggaggggcctcgagccgccgacgtcagcgggggaggaatcccgctttaattgtccgcggcccgggcccgcggcgcggcgggggtctcacgagcgcgccaccggggctgcctccgctcgcgtcccccccgcccttctgggagctgccgcggccccctcctcccccgcccccgcctgggccggcgctgctgccccgaaggctccgagagctcagggggaaggaagtcgggctccggccccggactcgaggatggaccacctgcgtggtgtccccgaacctccgacggggctccaggcgggcgggaaaccaccgcgtccgggagatagaattcggttcggccctcctggctgcactgaacacccttgggccggggtcgtttggagccgggctgggtgccca

SEQ ID NO: 36823 - DNA, 477 bp, Homo sapiens
  misc_feature 1..477: note = chr17:78451477-78451954
  misc_feature 1..477: note = hyper
  source 1..477: mol_type = genomic DNA
gcggggctcggctcccgagatcgcggtccgggttccggcgccgggctgggggctcaggaccagggctggcgcagccgccccgccccgccccgccccggggctatcagagcggtcaaagcctcggaaatccctccgtccacgctcccgtggtacagagaaggaaactgaggctccgagactgcggggccgggctacagccgtggccccccgacccctccccgccgcccccggcttctctggtctctgcgttctgcagcctttccctgcgcgcagccgggggctgggggtccccagccagcagggacccacgggcagtcccgggtgccgggatcgggcgtccgcccctcgggcgggagcagaggccggctcgatggagacctttttgagaaatggcggcctctacccgccccccagcccccgagcgcccgccgtctgcgttcagcatctcagcttttaagcctccctgagccggggctg

SEQ ID NO: 36824 - DNA, 232 bp, Homo sapiens; identical to SEQ ID NO: 12930
  misc_feature 1..232: note = chr17:78452108-78452340
  misc_feature 1..232: note = hyper
  source 1..232: mol_type = genomic DNA

SEQ ID NO: 36825 - DNA, 397 bp, Homo sapiens
  misc_feature 1..397: note = chr17:78452549-78452946
  misc_feature 1..397: note = hyper
  source 1..397: mol_type = genomic DNA
agcggcctggcacctcggcacagaggagcgtgtcccccttccgcagaggaagggagtggacggcgtcagaaagggaggggagcctggggcggtgtctggggctagcgggacctctgggcactgtggggccccaggagaggagaccctcgggtccagcctgcaactgttgtgcaggaggcgctgggcgggacacctgcaggcgctgcacacacacgcgagggccaccatgccgcgtttctccttcacaagaccctgggcaagcggagggtcgtatttaggattccctcggcctccccagtgttctgaaagtatctgagagggagggagcaggaaaacgaagggccgccctgcccaaactcatcggggtgtctggttactaggtcggaagaggggggat

SEQ ID NO: 36826 - DNA, 45 bp, Homo sapiens
  misc_feature 1..45: note = chr17:78978134-78978179
  misc_feature 1..45: note = hyper
  source 1..45: mol_type = genomic DNA
ggctgcggctggacccggctgcgcggggcgcgaggctgcctttcc

SEQ ID NO: 36827 - DNA, 81 bp, Homo sapiens
  misc_feature 1..81: note = chr17:78978379-78978460
  misc_feature 1..81: note = hyper
  source 1..81: mol_type = genomic DNA
cgccccaggatggggcgcggggagcgcgctgagctgtcctttcccgcagcggccccgcggttgaagcgtgggcttgggttt

SEQ ID NO: 36828 - DNA, 66 bp, Homo sapiens
  misc_feature 1..66: note = chr17:79316947-79317013
  misc_feature 1..66: note = hyper
  source 1..66: mol_type = genomic DNA
tcaccagggactctccgttctcgctcccgaagaggggacttgcgcggacggcgaggaggatcgatg

SEQ ID NO: 36829 - DNA, 57 bp, Homo sapiens
  misc_feature 1..57: note = chr17:79317833-79317890
  misc_feature 1..57: note = hyper
  source 1..57: mol_type = genomic DNA
tggctttggtgcaggcgggtgtgcgctccgagcgtctttcggcgggggggagggggg

SEQ ID NO: 36830 - DNA, 15 bp, Homo sapiens
  misc_feature 1..15: note = chr17:79615121-79615136
  misc_feature 1..15: note = hyper
  source 1..15: mol_type = genomic DNA
cgaacctggctgcct

SEQ ID NO: 36831 - DNA, 121 bp, Homo sapiens; identical to SEQ ID NO: 12933
  misc_feature 1..121: note = chr17:79761692-79761813
  misc_feature 1..121: note = hyper
  source 1..121: mol_type = genomic DNA

SEQ ID NO: 36832 - DNA, 376 bp, Homo sapiens
  misc_feature 1..376: note = chr17:79761833-79762209
  misc_feature 1..376: note = hyper
  source 1..376: mol_type = genomic DNA
cgagtctgcgtatggccggggtacgaggcgctccctgcgcagggtgggcaggaccgaagctcgccgggaggctgcgcggagggcgggcggggaccctcggctgccgctcccacccccgcggggccgcccccgagcccgccctccgccgccgccctcgccctgcgtcgccgccggaaagtttgcaccgaccccgatctggcagcgccgcgaagacgagcggtcaccggcgcccgacccgagcgcgcccagaggacggcggggagccaagccgacccccgagcagcgccgcgcggtgagcacctgggccgcggccccgaggggacgttggggagtcgacccggtggggacagagaccgcggggcgggcgcggcggggc

SEQ ID NO: 36833 - DNA, 164 bp, Homo sapiens
  misc_feature 1..164: note = chr17:79762474-79762638
  misc_feature 1..164: note = hyper
  source 1..164: mol_type = genomic DNA
cgccgccctggggagcgcacaaagcgccgcggacgcgtccccgaggcgcggggtctcaccagcgctgtctcccctcggtgggctcctgccccgaggactgcccggtggcaccggcgcggcccaggatggggtgaggggtgtctgcgccccgcctggccgctcct

SEQ ID NO: 36834 - DNA, 86 bp, Homo sapiens
  misc_feature 1..86: note = chr17:79859940-79860026
  misc_feature 1..86: note = hyper
  source 1..86: mol_type = genomic DNA
cttgcgcgcctccagcgctcgcccgcgcggctggttcctttgggatgcggaggtgcgacggctcctccgcgcgcgcccgctgcacc

SEQ ID NO: 36835 - DNA, 185 bp, Homo sapiens
  misc_feature 1..185: note = chr17:79860488-79860673
  misc_feature 1..185: note = hyper
  source 1..185: mol_type = genomic DNA
cccccaggctgtgtgcgtccaggacgtcgccccaaacctgcagaggtgcgagcggctccccgacggccgcgggacctaccagtgcaaggcgaacgtcttcctgtccctgcgcgcagccgactgcctcgccgcctgagcccggacctctcctggcaccgctgggggccccccgcccccaccgtccc

SEQ ID NO: 36836 - DNA, 34 bp, Homo sapiens
  misc_feature 1..34: note = chr17:79918595-79918629
  misc_feature 1..34: note = hyper
  source 1..34: mol_type = genomic DNA
ccatgttaccctccacggccgtgaagtccagcgg

SEQ ID NO: 36837 - DNA, 41 bp, Homo sapiens
  misc_feature 1..41: note = chr17:79988475-79988516
  misc_feature 1..41: note = hyper
  source 1..41: mol_type = genomic DNA
gccctgcagtgatggcgagcgaccaccgagaggcgctgctg

SEQ ID NO: 36838 - DNA, 82 bp, Homo sapiens
  misc_feature 1..82: note = chr17:80188720-80188802
  misc_feature 1..82: note = hyper
  source 1..82: mol_type = genomic DNA
gccacgccgggcagccgcacgcaacggaaccgaaccgccgggctcctgctccgagacccgcagttcacgagtcgacgccccc

SEQ ID NO: 36839 - DNA, 718 bp, Homo sapiens
  misc_feature 1..718: note = chr17:80329283-80330001
  misc_feature 1..718: note = hyper
  source 1..718: mol_type = genomic DNA
cctgccccccacctgcgcgcgggcgggtccagggcttggtggacacggagaatcccaggctccgtgccctgcaaacacgggcgtgaggggcgcaggggtgaacgctggaggcggagaacccaagaggggctgcggggtcagccttggggcagccgggctggaggcagcttcgctccgcagacgcagacgcgagacccgcctgggaccctccgccgaccccgctgcggccccgcgacccccgcgtcttcccggcgccgcgcggtcagcgccgccccctagacacccggcgccgtcccctccgcgcgcctgctgcccgctggggttattttaataccgggccctggcgcggggcgcggcgcattcccagctggcggcgggcaggtggcggcggcgcagagacccggcgcggggcggggggcgcggctttggtggcgggactggcgggcgcccctgccgtgtgctctggaagccgaggccaccgcggagcccctcgcgccccctctgcgctgggacaggggagcgcgcctcggaaagttccccgcggccccgctgcgcgaggagtttggagccgcgagcggctgcccccacgcgcgaccccaggctcggcgggcaggtctggccgctcagtgaccggaggcaggtgggtcctcggtgggtgaccgggagcgcgcggggactgccgggtctgtgcccttcggggccctccgcagggctgggc

SEQ ID NO: 36840 - DNA, 45 bp, Homo sapiens
  misc_feature 1..45: note = chr17:80330164-80330209
  misc_feature 1..45: note = hyper
  source 1..45: mol_type = genomic DNA
cgcgcacaactggggagcccggtgcaccctcggcttctgcgccgt

SEQ ID NO: 36841 - DNA, 177 bp, Homo sapiens
  misc_feature 1..177: note = chr17:80333064-80333241
  misc_feature 1..177: note = hyper
  source 1..177: mol_type = genomic DNA
gcgccgcggacggcgcgcatcgtcaactacctgaccacctgcctcacctacggcaacagctgcgccaaccccttcctctacacgctgctcaccaggaactaccgcgaccacctgcgcggccgcgtgcggggcccgggcagcgggggaggccgggggcccgttccctccctgcagccc

SEQ ID NO: 36842 - DNA, 1221 bp, Homo sapiens
  misc_feature 1..1221: note = chr18:500042-501263
  misc_feature 1..1221: note = hyper
  source 1..1221: mol_type = genomic DNA
cccggagaaaacacccggccgccagcgcggggaccgctcgggccgggaaacggctagaggcgggaggagagaggactgggcgagcgtggggagcgctgcggcgtggaaaagcgaccgggagggatggcgatgcctccactctcctcggcaggttttttcaattaaaaagttggaaacgggaatccgtaaacaacgacttagggcttcaaactacttgcaaagacgcgatggggaggggaatacttgcgcgcttcaaaaccccaacctcgaggtctccagccgcgcctgacccgggagccgggtgcgcccccagtgtccgcgcacgaacccggcgccctggcagccccgactccccgggcccgcagcccaagggaaggttcgcgcgggaggcacctccgtggcctcccgcgcgccccgaagcccgttccccccgcccagagccccgcggagctgccgccgccctacctttcatggtgaccgtggggacgcaccgccggccggggagctccgcgcgagcgccgcgcagccgaggaagtcgtcccgagcggctgctcaccgcacgcccatggtagccgcgccgcgcgccggccgtctgcgcccccgtcctccctcgccgccgccggcccgcgctccccgcgctcccggctccgcgctctgctgcctcggggctgccgcgcgcgccgctctcgctctcccagcgcccctccccctggcccgacccggccgagcgagcggccgcgcccacgcccctctcgcgccctcccgcgcccgccccgccctcggcccgcgcctgccctcgccgggcactttctcgcccgccctctcctgcgcgccctggccccactcgcgcgggctctctctttttcccgttgcaccagcgtcgggatgaagtcgggagcaaagcccttcccggggcggtccagcgttcaccttcggcgagcacctaaggtgccgctgctgctggggtcgcttctacaccccaaactacctagcaagtgttgggcgagaggatggggagctgctgtgccccgggggtggcggggggtaaggtgggcccttccccaaacggctctggggcatggagaggtacagaacgtcctccgggttcagagtttccaagtgcgtgcgctggttgacgcctgaaggagaccaagcagcagggaacactctctctgtcacccagggagagcccgagtggccagaatccgaagtcaccattag

SEQ ID NO: 36843 - DNA, 96 bp, Homo sapiens
  misc_feature 1..96: note = chr18:903748-903844
  misc_feature 1..96: note = hyper
  source 1..96: mol_type = genomic DNA
ggtggcaattttcaacgtttgtagcatctgttaccctacacttcagcacccggagtctggacagctccgcaggccgcgctccggaggcagcatgag

SEQ ID NO: 36844 - DNA, 358 bp, Homo sapiens
  misc_feature 1..358: note = chr18:904374-904732
  misc_feature 1..358: note = hyper
  source 1..358: mol_type = genomic DNA
ttcatgaataaaaatcggagcgcaacagtgcaacaaaatattctgtacttaaaggcaacaggcaggcagatgttgacaaagagggctctccaaaaaccatgttcggatagatttttgcgaactgcacagataaataggagcagaaggccggtcacctctgtaaccagcggtagcagcagcagaagccgcagcttcagaggcagccggagagacctcggagcagagaaggcgccgccgaccctcgcggctgcctggcccgcggctcctacaaaggcgggctagccgcccgccctctcccttgccttcctccccttcttttctgactttccctctttcccttaatcgcctgcttcttcct

SEQ ID NO: 36845 - DNA, 115 bp, Homo sapiens
  misc_feature 1..115: note = chr18:904991-905106
  misc_feature 1..115: note = hyper
  source 1..115: mol_type = genomic DNA
aggaacttgaagaagcgctttgcccgccgtcctacctggcagctctcctggcagcgggaggagttgaagggtaagggagggaaaatcttaccaaagcgaccggctcactcgactg

SEQ ID NO: 36846 - DNA, 177 bp, Homo sapiens
  misc_feature 1..177: note = chr18:905713-905890
  misc_feature 1..177: note = hyper
  source 1..177: mol_type = genomic DNA
ggcagctcagggtcccgggtagagccagtgagcttctggccgctggagaaccccccctcccccaacccggcccacaggatgggggcagggcacggcccctagcttggtttcttttacctattcttgggacgagttaggagaacttcagctctggagcctggccgggggttgagcgtg

SEQ ID NO: 36847 - DNA, 699 bp, Homo sapiens
  misc_feature 1..699: note = chr18:906208-906907
  misc_feature 1..699: note = hyper
  source 1..699: mol_type = genomic DNA
cagccctgcctggcccgggatggaggaaccttggcttttttcttaaccccgggtttctaaccggcaggcgcggcccaggttcccggaggcagccccagagtcgcggaccgatgtgccaggctgtggatgagccctgggtaggggagggttcgtaccagcggcgcctggggcagcgaggagcgcgcgttctgcctgcgaagctgccttctccgagccccgcccaggaacattagctctggggggccgctgatcattgatttggacggagagatgggttctgggttctgtattaggattccagcatctgggctcgaggcagggcaatatccagaaagaccccagggttcggggtacccgggccagggctgaggcgcatcgccgagcaaaggctgggtgcgaggcgtgcggaatgatgcgcttgccttgcccgggcctctccaaggatggagaaaaggcgagtgaagcagcgaagtacgactccaaccccgcccagagagtgctactagcgctggctgcacgccaagtctctccaggggtccaaagcgagagggatttgttttaacccatctctacccgtcctgtgtcaagaacggaggctgtagagggcgactgcgaagtcgccaggcactcgctggatctcggtccccctcctcgtgctctggggttgagatggggcaccgccatcgataacagatcagc

SEQ ID NO: 36848 - DNA, 380 bp, Homo sapiens
  misc_feature 1..380: note = chr18:907314-907694
  misc_feature 1..380: note = hyper
  source 1..380: mol_type = genomic DNA
ggctcgggagccaggcggggaggggggcggtccttttccgtagacaggtgtgcgcgatcggcggagacgcctcggtttcccagcgcttgttgaggccgtggcccgcaggacgaccctttacccgcgaagggggggtgggcgggccgcccggcggggtaggagtggttgggtgtcgttgcctcctccttacctctgctcccacccccagtcctgggagaagagacaattctcagcggaggacttttatcacctgtgaaaatccgcgcgagccccttactttggatcctcgccgagctggggaggaacttgcactgaccacaccttctgtccccggccaccccgcaggccagaggaagaggcgtacggcgaggacggaaacc

SEQ ID NO: 36849 - DNA, 256 bp, Homo sapiens
  misc_feature 1..256: note = chr18:907721-907977
  misc_feature 1..256: note = hyper
  source 1..256: mol_type = genomic DNA
cgccgggcgcagggagccccgcctccgcgccgcgcgccgccgccgcctggtaccgcccggccgggagaaggtgagattcgcgcggcctcgcgcacacccgcggctgggagctcgggactgcggtgacgggaggggcagtgtggtgacccacccaggatttttttttttttcccgtgaaagtcctcaagcctgtcctctccctggcccgatcctattgcagcgacagaaaatcagcagcgggcgggtctgtgtggac

SEQ ID NO: 36850 - DNA, 87 bp, Homo sapiens; identical to SEQ ID NO: 12948
  misc_feature 1..87: note = chr18:908432-908519
  misc_feature 1..87: note = hyper
  source 1..87: mol_type = genomic DNA

SEQ ID NO: 36851 - DNA, 15 bp, Homo sapiens
  misc_feature 1..15: note = chr18:909070-909085
  misc_feature 1..15: note = hyper
  source 1..15: mol_type = genomic DNA
actttctctgtatgt

SEQ ID NO: 36852 - DNA, 106 bp, Homo sapiens; identical to SEQ ID NO: 12949
  misc_feature 1..106: note = chr18:909183-909289
  misc_feature 1..106: note = hyper
  source 1..106: mol_type = genomic DNA

SEQ ID NO: 36853 - DNA, 414 bp, Homo sapiens; identical to SEQ ID NO: 12950
  misc_feature 1..414: note = chr18:909318-909732
  misc_feature 1..414: note = hyper
  source 1..414: mol_type = genomic DNA

SEQ ID NO: 36854 - DNA, 221 bp, Homo sapiens
  misc_feature 1..221: note = chr18:961763-961984
  misc_feature 1..221: note = hyper
  source 1..221: mol_type = genomic DNA
catcggaactgtcaccggcataatttcgttgtttttaacttttcagttaaaaaacttttaacttttcagttaaaaaagaaagcaagcgttctttggctgtctctgtgccggatgcagagggcacaactgctctgtggcacagccctctgtgatcggccgcgtgagggtcctgtcatcttgtctttcccttgtttcttccttcagggcgctagggacaccac

SEQ ID NO: 36855 - DNA, 372 bp, Homo sapiens
  misc_feature 1..372: note = chr18:2846451-2846823
  misc_feature 1..372: note = hyper
  source 1..372: mol_type = genomic DNA
ccccccgcgtggcctcggaaactgtcagatggtgcctaaggcagagttgggcaaagaaagaaccagcgttcgtttcctcctggactctctaggtccatggagctggtgggggaacggccctgtcttgcccgaggaggaaattcgagtcgagcccccactcctctccccgcgggactgataaacatgtccctcattcgccccgggaggctggcacccaggcacgacgcgaggacggccagactcgccgacggcggccgcgtcccggggggccgggagcgagcctgtcggaaggtgggaggcggagtcgctcggcatctgggaagagaccaaaggaatgagtcattggaaatgctgtaacgtagacccttatcc

SEQ ID NO: 36856 - DNA, 190 bp, Homo sapiens
  misc_feature 1..190: note = chr18:2847026-2847216
  misc_feature 1..190: note = hyper
  source 1..190: mol_type = genomic DNA
gccggagggggcggccgcggagcactggttggagcgccgcgaagcgcccgagcctcttgccttcgcgggcggcgccctggccgccggcagccttgtggccggtgccccgatccgccgcgctccggacccgggcaggcggggcgcgcccgctgcgcgcgggatgtggcagcccagacggccctggccccgc

SEQ ID NO: 36857 - DNA, 601 bp, Homo sapiens
  misc_feature 1..601: note = chr18:2847537-2848138
  misc_feature 1..601: note = hyper
  source 1..601: mol_type = genomic DNA
cgggcgatccgaaaacgactcccaggaattccatgagcccctgggaccatgggtgcttttctttcccgtcttggtcgggtccaggcgcgcgctctccagaggcgcacccgggcaccctccggcgtctgctcggtgaagctcccgcctccgcagagggcgacgggcccccccgaccctcgctcggtctggtgccgcagtcccctctcccctggcctcattgttctccgggtttaccccgtgcccctctccctctctctcctgcaccccaggaactggtgcgcctacatcgtgaacaagaatgtgagctgctccgtgctggagggaagtgagagttttattcaggctcagtacaactgtgcctggaaccagatgccctgtccgtcggcgctggtgtaagtcctggagccggggagcgggcggggcgcgcccgggccggggcggtgggggtggggtggggttgctgcgctgggctccagtccctccggtaaatcccttccagatccggtgaaaagcccgcagcggaaaagcgctccgagcgctcgcggggcaccggccacgctgggctatttagggagtgggtgctgcccgagtgagtggggag

SEQ ID NO: 36858 - DNA, 89 bp, Homo sapiens
  misc_feature 1..89: note = chr18:2906054-2906143
  misc_feature 1..89: note = hyper
  source 1..89: mol_type = genomic DNA
cggcggggatggcgtttcttggcgagcgggtccctcagccaggcccgggtattgtcaggcgtcccgtggacggtcgggaggggcttcct

SEQ ID NO: 36859 - DNA, 30 bp, Homo sapiens
  misc_feature 1..30: note = chr18:2906366-2906396
  misc_feature 1..30: note = hyper
  source 1..30: mol_type = genomic DNA
gaggccgtggggccccggcaggagtgtggt

SEQ ID NO: 36860 - DNA, 310 bp, Homo sapiens
  misc_feature 1..310: note = chr18:3499061-3499371
  misc_feature 1..310: note = hyper
  source 1..310: mol_type = genomic DNA
gacagtggaagtcaccgagctcgggagcggacgggctcggagggggagaggcagccggcagaggagcggccgggggaggaggggacagatgcttggcggcggcggccgggctgcggggcgctcagagccgggtctgcgcctcggggatgtagatctcgatgctctcggcgctctcggtggccgagttctggcggacggacgcggcgcgcttggcggccatcaggcgcttgcgggcctcctggcgctgcgagctctccagcgagcgctcccggatcagcggcgcggggcccttcgccggcttctttggcac

SEQ ID NO: 36861 - DNA, 42 bp, Homo sapiens
  misc_feature 1..42: note = chr18:4453666-4453708
  misc_feature 1..42: note = hyper
  source 1..42: mol_type = genomic DNA
tatcctcaccttctacgaagccattcacgaagaccacaaaag

SEQ ID NO: 36862 - DNA, 306 bp, Homo sapiens
  misc_feature 1..306: note = chr18:4453922-4454228
  misc_feature 1..306: note = hyper
  source 1..306: mol_type = genomic DNA
taaccccttgccctccgcacatcctccccttctctagcagaaaattccgcagcgctacggtcgggctggaggcaagccctgcagccgggggcgagcgcggcactcggacacaggcactcagtgtctccggcgccggcagccgagccacgggccaccccttcccacggcctcccggtgccacccagcgaggccgggacagcgcgccttccgcaaaaagcgcagcagccgaagtcctgaaagcagggtcttcatcgccgcgggccctccgaaggtgcctctcccagctgcagccgcccctcaatgaaa

SEQ ID NO: 36863 - DNA, 24 bp, Homo sapiens
  misc_feature 1..24: note = chr18:5196235-5196259
  misc_feature 1..24: note = hyper
  source 1..24: mol_type = genomic DNA
agagacagcgtcggacgttcacaa

SEQ ID NO: 36864 - DNA, 373 bp, Homo sapiens
  misc_feature 1..373: note = chr18:5196575-5196948
  misc_feature 1..373: note = hyper
  source 1..373: mol_type = genomic DNA
cgcctccttctcctcgggaggccaggaggacccgggtcactttgccaattctgcggagggggaagtagcagtgagggagattcccacgcaagtagcccgaagcccactactctttgccccacctctccactctcttgcccgtgtaggtgccggtgctgctggcgaaagtcccagttcttaaggctcctgagctcggaaggggtgtggaggagccagatgggaagagaagcagcgggacgagggcgaggaagggctggagattgttagaggacagatggggcgggactggggagaggggcgaaggcgacgcgccgaggcactcctccgccccatgagcacagacagtaactccgaaacgcgcagatgggccgta

SEQ ID NO: 36865 - DNA, 70 bp, Homo sapiens; identical to SEQ ID NO: 12958
  misc_feature 1..70: note = chr18:5197202-5197272
  misc_feature 1..70: note = hyper
  source 1..70: mol_type = genomic DNA

SEQ ID NO: 36866 - DNA, 430 bp, Homo sapiens; identical to SEQ ID NO: 12959
  misc_feature 1..430: note = chr18:5197329-5197759
  misc_feature 1..430: note = hyper
  source 1..430: mol_type = genomic DNA

SEQ ID NO: 36867 - DNA, 175 bp, Homo sapiens
  misc_feature 1..175: note = chr18:5542983-5543158
  misc_feature 1..175: note = hyper
  source 1..175: mol_type = genomic DNA
cctccccacccccaccgcggcagagccgccttcgcagacacctcccgaggagaatcgcggccccgagggcgccaggtgagtcgcgccgccccgagcccccgggccacggcaggccgacccaggcgcccccggcccgcccgtgctcccgcgcccgggtgccagaggcgaggggccc

SEQ ID NO: 36868 - DNA, 270 bp, Homo sapiens
  misc_feature 1..270: note = chr18:5543899-5544169
  misc_feature 1..270: note = hyper
  source 1..270: mol_type = genomic DNA
cggaaaagttacctgggatcagcagggagcccgggcgcgccgcggcgtggggactaggctcgggcgcgcgtcctcggcggcggtgcgcaggagactcgggcgtggggaggaagccgcagcccagggctgctcgccgctgttccccccgccccctgttgcaggagacaccgaggctccgcggagctgcggcgggggcccacgcccagagaccgtgcgaggaaagccaacctcgtcctgcctgccctcccagccgcgggggagggggccacc

SEQ ID NO: 36869 - DNA, 77 bp, Homo sapiens
  misc_feature 1..77: note = chr18:5544170-5544247
  misc_feature 1..77: note = hyper
  source 1..77: mol_type = genomic DNA
cagtacttcaggacagttacatgggcacagcctcctccgtcctggcgcagggtcaggctccgcggacgacgcctgga

SEQ ID NO: 36870 - DNA, 259 bp, Homo sapiens
  misc_feature 1..259: note = chr18:5628082-5628341
  misc_feature 1..259: note = hyper
  source 1..259: mol_type = genomic DNA
cactggagcccaccccgctcctacgccgcaaagcagcacaattacagcctgggaggggcaagtcttgcggggcccgtcggtaactgccattatttgaatgcgatataggagatcccacatagaccctgctctaccgggttagaatctgtttctaatcacgtggaatttagatttaaaccacagttagatttgggatttaccatcgtttctactttcattcatttagtggcttccagccctctcgcggcccagtcttaat

SEQ ID NO: 36871 - DNA, 579 bp, Homo sapiens
  misc_feature 1..579: note = chr18:5628792-5629371
  misc_feature 1..579: note = hyper
  source 1..579: mol_type = genomic DNA
cggctcaacttccagcgccactcgggtgccccgagcccgccgcagctcccggcgcgccctccagccgcggcacgcagcccctgacgcgcccggggcgccctcccgcagcaccagccaggccaccccacctcccgcgccgcgcttccccgccagccgccggccaggagctccccggcttctgagcaggacgcgccaaagggagttgggaggctcagcagcccccagcgtcgccttctcgggtgacgtgacgctctctctggagcgcgggcccgcctccgccaagcctccaccgcaggtccttacagccgagccacgggaagatgcaacgccgggcgaggggcgcctcccggattttgaaaaacagcctcattcgcctcgggaacgcctcgatcccccacccgcaccctttggccagatgattttaatcctgggattccgcgttggtcgtgggggtaccgggagctggagctggaggagaggagccggcagcgcggagttgccggggtgcagctgcgcgcagctggcggcgaggggaggcggtccctgcggctccgccgggctgggggaactggctcctgc

SEQ ID NO: 36872 - DNA, 112 bp, Homo sapiens
  misc_feature 1..112: note = chr18:5629372-5629484
  misc_feature 1..112: note = hyper
  source 1..112: mol_type = genomic DNA
cctctgcctcccggaggatcgcactcgctcatccttacacaccacacacacacacacacacacacacacacacacactgccgctagcgccccccacgccacaagccggaatg

SEQ ID NO: 36873 - DNA, 257 bp, Homo sapiens
  misc_feature 1..257: note = chr18:5629569-5629826
  misc_feature 1..257: note = hyper
  source 1..257: mol_type = genomic DNA
cgaggttcgcaccttcccggaaggcccccccctcccccgcgtttccccagggcgagcaaggtctagcttctgagactccgctctctgggctagcggttcgagctgcaggggggcggggacggattcggagggagcactagagagagagcccgcgctcactcctgccctcctcgcaaagaactggccagccccactcgcgtccagcccacaactaggctgccgggaccggggagccagaccccaggtcgctccaactc

SEQ ID NO: 36874 - DNA, 399 bp, Homo sapiens
  misc_feature 1..399: note = chr18:5630256-5630655
  misc_feature 1..399: note = hyper
  source 1..399: mol_type = genomic DNA
cgctttctcccccatcgacctcgagccaagggcaggcggcccgcacccgcgcccctgcccacggggctaggcggcgctcccggcctacgcccggctgccaagaagagaaaggcgctcacctgagtcaccgaagccttcctttggggcccctcccggagcttgttcgcagcccgcaggcacaaccttccttggagaaaaaaagtagcgcaagggcagagagaggtagggctgctcacaggtccctccgcaggggctctttccttcgaattctccggggtccagtctcgggctcggcggcgggaaagagctcctggaggctggaaggggccgccagacccgggctcctcccgcagctgcggtggcggcacctccaagttgccacctgcagcgcgcttcggg

SEQ ID NO: 36875 - DNA, 105 bp, Homo sapiens
  misc_feature 1..105: note = chr18:5630693-5630798
  misc_feature 1..105: note = hyper
  source 1..105: mol_type = genomic DNA
cgccctccccgtccgctcgttggctgcgcccggtgcccgggcggtccccgcgctctgccccgccctgagcccgcctcccagccgcgcgctcgcaaagtatgggtc

SEQ ID NO: 36876 - DNA, 85 bp, Homo sapiens
  misc_feature 1..85: note = chr18:5891336-5891421
  misc_feature 1..85: note = hyper
  source 1..85: mol_type = genomic DNA
ggggggcgccgcggcgggggcagacgacgacgaagaggcggcggcggccgcggcggcggccgcggcggccgccaggtctttggcg

SEQ ID NO: 36877 - DNA, 32 bp, Homo sapiens
  misc_feature 1..32: note = chr18:5891443-5891475
  misc_feature 1..32: note = hyper
  source 1..32: mol_type = genomic DNA
cggtggagtagaggtcccgcaggttgatgatt

SEQ ID NO: 36878 - DNA, 88 bp, Homo sapiens
  misc_feature 1..88: note = chr18:5894858-5894946
  misc_feature 1..88: note = hyper
  source 1..88: mol_type = genomic DNA
ctgggcagcgcatcccgtgtagccagcccgggaaaaagcctctcaccgaacaccagcccggggcgcggggactcggggacccgagggg

SEQ ID NO: 36879 - DNA, 510 bp, Homo sapiens
  misc_feature 1..510: note = chr18:5895017-5895527
  misc_feature 1..510: note = hyper
  source 1..510: mol_type = genomic DNA
cgctcacttacccagggagaccgagggaggtcggggccggcgaacgggcgctcgggcgacacaaaggaaccatggagaaactttttcagcccgagccgacggcggagcgcagggacagcgccccggggccccgcatccgagcgcgactcagcagccccgcgggggcgagcgcccgccccaggctcgcagtccccgccggcgctgtggcgggagccatttccaagagtttccaagaagtgtcaggtcctccgcatcccgcatcccgcatcccgcctcggagccctcctctccgccgctcatcctccagctcccggcgtcccctagcgcggcgctcccgggcgggcccctgcggccgcgccgccggccctcgcgcctcttttgtgtggctgcggcgcgccgggctccgccgggtggagttgagcccgcggcggcggctcggggcggccggactggcggctgttgctaagagaccggagccatgacacagggaaattgcggcagggtggcggt

SEQ ID NO: 36880 - DNA, 297 bp, Homo sapiens
  misc_feature 1..297: note = chr18:5895739-5896036
  misc_feature 1..297: note = hyper
  source 1..297: mol_type = genomic DNA
ccgcggggcagggggcgcggggtgcctcctcggcctcggctctccccgccccggggcgccccgagaccgccgcctgcctccgcgggcagctttgttcttctttcctccaactacctgtctgagccgcgggccccagaggccccaaagagaggcccggagggtctccccagcagcatccgaggggcgctctcggggagctaggggccagagtccgcggtccctccgtgcctgcctccctcccctcgtgcctcggtcttttgttgcctctactcctcggcacggcgcagcctgggctct

SEQ ID NO: 36881 - DNA, 173 bp, Homo sapiens
  misc_feature 1..173: note = chr18:6414507-6414680
  misc_feature 1..173: note = hyper
  source 1..173: mol_type = genomic DNA
cgaggcgccgggctctgcggcggccgcgcccgtccaaagtaggcgacaagtgaggcagcgcctctcgcggggagcccggcgcgcgccccggcggcgaaagagaaagagaaagagcctgggccgggaccggggctatccccaaccgccaccgcccccaccggcccggccctcgc

SEQ ID NO: 36882 - DNA, 130 bp, Homo sapiens
  misc_feature 1..130: note = chr18:6730009-6730139
  misc_feature 1..130: note = hyper
  source 1..130: mol_type = genomic DNA
cgccttgtgcctgagcgcacgaccgccgtcactggatgttgtttcaagttttggtggactagatgagtgagcctggggttctttgcattgtctttgactggaggtgggaaacgctcgaaggctccaccag

SEQ ID NO: 36883 - DNA, 32 bp, Homo sapiens
  misc_feature 1..32: note = chr18:7116490-7116522
  misc_feature 1..32: note = hyper
  source 1..32: mol_type = genomic DNA
aatgaatgagatggtcgcgtttctgcagagct

SEQ ID NO: 36884 - DNA, 170 bp, Homo sapiens
  misc_feature 1..170: note = chr18:7117059-7117229
  misc_feature 1..170: note = hyper
  source 1..170: mol_type = genomic DNA
cgcctgcgggtccccctgcccgggacggctggctaggggcgcccttctcgccgcgtctctccccactagcccgcttggctgccaggggccccgaggaatccgccctttcccggccgccgcgacccagcttgcgcagccggacaatgagggcgactcgggagagctctttc

SEQ ID NO: 36885 - DNA, 21 bp, Homo sapiens
  misc_feature 1..21: note = chr18:7117615-7117636
  misc_feature 1..21: note = hyper
  source 1..21: mol_type = genomic DNA
cgcctgcgggggacagggacc

SEQ ID NO: 36886 - DNA, 224 bp, Homo sapiens
  misc_feature 1..224: note = chr18:7117867-7118091
  misc_feature 1..224: note = hyper
  source 1..224: mol_type = genomic DNA
ggctgcgccccgccccgccccgtcccgccccggcttggccccgccacccagacccctcccccgggggcgcccagcttggcctctgggtcccggcgcacgcggaccccaagtcggggaggccgggctgaccgcggccgcctccccggctccgggtaggaggtgggcagagaaggtgggctgaggggaggagaaactgggctgcgggggtccgggagggtggattc

SEQ ID NO: 36887 - DNA, 46 bp, Homo sapiens; identical to SEQ ID NO: 12973
  misc_feature 1..46: note = chr18:7118131-7118177
  misc_feature 1..46: note = hyper
  source 1..46: mol_type = genomic DNA

SEQ ID NO: 36888 - DNA, 174 bp, Homo sapiens
  misc_feature 1..174: note = chr18:7566582-7566756
  misc_feature 1..174: note = hyper
  source 1..174: mol_type = genomic DNA
cgcttcgggcccacacgggacaccgaggcatgatgaggacgcagaacagcagaagcgcgccctgcttcccgggcgccagtgctcggggccagcggcgtgtacccggcgggcccggccgggagcgggctggcgatcgcggggctcggcgctcccggctcccgcgccatctcccgg

SEQ ID NO: 36889 - DNA, 263 bp, Homo sapiens
  misc_feature 1..263: note = chr18:7567072-7567335
  misc_feature 1..263: note = hyper
  source 1..263: mol_type = genomic DNA
aagacgcggccggggcgaggaggtgggcggggggagcccggtggccgctcctccccgcgcggctgacgcccgcttcggcggcggtagtggctgtggccgcggggccgcccccagccgagctcccggaggcgctcgggcgcgggccggcggggcacgggcgctcacgccctctagcgggccgcggcggcgccgggcggccgtgacgtgagcgctcccttcagccggcctgcggggcaccgccagtcagtcggggagcaagagcc

SEQ ID NO: 36890 - DNA, 446 bp, Homo sapiens
  misc_feature 1..446: note = chr18:7567754-7568200
  misc_feature 1..446: note = hyper
  source 1..446: mol_type = genomic DNA
ccctccgccctcgcgcgcccacccaccgccgccggggagcggcccggcccgcactcagcaccatgaggggacttgggacttgcctggcgactttggccggacttttgctaactgcggcgggcgagacgttctcaggtaagcgggaccgcctctgccgcccccgaggcgcgcgggccggcgcgggacgcccgggacgccgacagctccctggtggtagagccctaaggctggcgtcggggccgggcggggggcgcggcgggccggacaccgcttctgcctgtgagccgggcgctgggcgaggggccgtggggctggcaggcacccagtcctcgggcgggcggagcggacggaccccgagggcgagctccccagccgggactgccagctcggccgccgtccttccgcggcctgggctagtgctcaaggttgggcggcttgcactcttg

SEQ ID NO: 36891 - DNA, 139 bp, Homo sapiens
  misc_feature 1..139: note = chr18:7568400-7568539
  misc_feature 1..139: note = hyper
  source 1..139: mol_type = genomic DNA
ccctgccctccctgtcgccccctgcccggcgcggctggcgaccccgggaggtccccgcggtcgtgcagcgtctgcggagaggctggggggagttcctcgccggtcccagcggtagggcttggcggccgcggagggaagc

SEQ ID NO: 36892 - DNA, 96 bp, Homo sapiens
  misc_feature 1..96: note = chr18:7568540-7568636
  misc_feature 1..96: note = hyper
  source 1..96: mol_type = genomic DNA
ggcaggtccccaggccctggccacggccctgcgccccgctgggctccccctccccaccctcgtccccctagcggagcgccgcggccagctgcaact

SEQ ID NO: 36893 - DNA, 90 bp, Homo sapiens
  misc_feature 1..90: note = chr18:8608748-8608838
  misc_feature 1..90: note = hyper
  source 1..90: mol_type = genomic DNA
aaaaataactgatttcgcgcgtttccgtgcaaaatgggagacagacgtgacggagagagaccgagcagtgccacggcccggtagagggtg

SEQ ID NO: 36894 - DNA, 81 bp, Homo sapiens
  misc_feature 1..81: note = chr18:8608901-8608982
  misc_feature 1..81: note = hyper
  source 1..81: mol_type = genomic DNA
cggcccggcggcgcggcctcaggtcggggcctttccagcgttccagctacaccgagcgcgcgggggcgaaaacatgtgcat

SEQ ID NO: 36895 - DNA, 101 bp, Homo sapiens
  misc_feature 1..101: note = chr18:9708380-9708481
  misc_feature 1..101: note = hyper
  source 1..101: mol_type = genomic DNA
ggcactgcctggctgcgagcacatgatggcgatacgggagctcaaagtgtgccttctcggggtgagtcctggccgccacccgccggcggaccccggcccgc

SEQ ID NO: 36896 - DNA, 549 bp, Homo sapiens
  misc_feature 1..549: note = chr18:9708821-9709370
  misc_feature 1..549: note = hyper
  source 1..549: mol_type = genomic DNA
gggacggggcagtggcggcgagtctggggccccgagggctttctcctccgcttttgatagtttccttccggcagaaagtttaagttgctcagccaagtcgctgagtgctcttttgcctcctgggggcaattgatttactcacgtaaaacagaaaaataaaaccaaaagcgaacccagccaagggggtgaaagccgagggcgcggccggggtggaaggtgaggcagtgacctgtgcggagcgcgccctgcaaacttccctgctgcgggtgaaagaagctgcctgggaaagtcctccccaccatcactcccctaaagtggggttttctccgcccgaagaagccttaaagcagccagaaacaaaaaagcagtcaatccgtgcggcccggggactgcagacaggggacccggcgaggacgcagggagccgctggcgaaccgcccctgggaattcagataaacgtagggtcgcttcctttcgggggcccactccgcattccagaattccttcttctaaaagaagagccggttctaagggcgttttcagcagcca

SEQ ID NO: 36897 - DNA, 30 bp, Homo sapiens; identical to SEQ ID NO: 12980
  misc_feature 1..30: note = chr18:9771739-9771769
  misc_feature 1..30: note = hyper
  source 1..30: mol_type = genomic DNA

SEQ ID NO: 36898 - DNA, 456 bp, Homo sapiens
  misc_feature 1..456: note = chr18:10454714-10455170
  misc_feature 1..456: note = hyper
  source 1..456: mol_type = genomic DNA
cgggcgcggagaagtcggggcgggcggcagagaggccgggacgcggaccgggccggggcgcccacagccgcccgacggcgcccagagagcgcgcgccccgcagccccgcgcctagcccgccgggcatggggcgcgcggcagccgcctgaagccccggcctggcccggccgcacccggccggaggcggagggcagagcgcgcgcccagttgcccgggcaccaaatcggagcgcggcgtgcgggaggccccagagcaggactggaaatgtcctggccgcgccgcctcctgctcagatacctgttcccggccctcctgcttcacggtgagttcccgagggccactcgagcgctcccagccggcggaggcagcccgggcgccgcggagcccgcggaggcgtcgggtctggatcgcggcacggcctacactgtccccttggcggggcgggtccgaggggag

SEQ ID NO: 36899 - DNA, 353 bp, Homo sapiens
  misc_feature 1..353: note = chr18:11148741-11149094
  misc_feature 1..353: note = hyper
  source 1..353: mol_type = genomic DNA
cgagggcacgctcccggggctcttggccgcccctcgcccaccgggctctgggtagcccctcaccaggctcttggcggccacctagcccggcgcccggccccctgcggccggcccatttagtgtgaatcctggatccggcagcggcggcggcttcttcaggggtagctgatgccggggccttggagagggacgctttgggagggtcctgggaggcggcgcggcgagcaaagggggcaagaagggcgtgctgtgctcccgcctggctcccggggcgtcgtttgggggcggccggggagttttctacttggaagcccctctgaagccaccgcgtctcctttgcccggcctcgtctc

SEQ ID NO: 36900 - DNA, 141 bp, Homo sapiens
  misc_feature 1..141: note = chr18:11149115-11149256
  misc_feature 1..141: note = hyper
  source 1..141: mol_type = genomic DNA
cgctctggcctcggccccggctctcggagctgcccggcgggctccgggtctcgccctccagcccccaggcggcccgcggcggatccccgagaggcagcgcagctcagcccctgcgccccccagcttcgggccggagagacc

SEQ ID NO: 36901 - DNA, 199 bp, Homo sapiens; identical to SEQ ID NO: 4519
  misc_feature 1..199: note = chr18:11149561-11149760
  misc_feature 1..199: note = hyper
  source 1..199: mol_type = genomic DNA

SEQ ID NO: 36902 - DNA, 213 bp, Homo sapiens
  misc_feature 1..213: note = chr18:11149779-11149992
  misc_feature 1..213: note = hyper
  source 1..213: mol_type = genomic DNA
cgcgggcactcctgccccactggctcccgcagccccgcggctctgcgtggttctgtcattccggtggtgcaccctggcatccagtccacccggccgggccctgagcttgcccaaacccagggaaccgtttaaggtccgagggaaacgcacaggcccggcaggagagaagccaggggcttggagagtcctgtgcgaccccgacttctgctgggt

SEQ ID NO: 36903 - DNA, 63 bp, Homo sapiens; identical to SEQ ID NO: 12986
  misc_feature 1..63: note = chr18:11751569-11751632
  misc_feature 1..63: note = hyper
  source 1..63: mol_type = genomic DNA

SEQ ID NO: 36904 - DNA, 478 bp, Homo sapiens
  misc_feature 1..478: note = chr18:11752127-11752605
  misc_feature 1..478: note = hyper
  source 1..478: mol_type = genomic DNA
ggcgccctcgccccccgtctccgttcattgtgctgtattcatccagcagattttgaaacaattctcgtgtaaaaaggcattttactccgcgcgtcttccttacagccatttagttgggagtttgcggtgggcagggggagggagaagaaacgcctgctctgaatcggaaaacaccgaagagaccagaccatctctttcagcagcaggaaagagaggagccgtcgcaggagccgcacacgtctccaactctctattgctttttgcgcacattcctaacttcctgacgtccatcccagcgggcaggcatggggtgtttgggcggcaacagcaagacgacggaagaccagggcgtcgatgaaaaagaacgacgcgaggccaacaaaaagatcgagaagcagttgcagaaagagcgcctggcttacaaggctacccaccgcctgctgctcctgggtaaggccgaggggcgcgcggcggctcc

SEQ ID NO: 36905 - DNA, 129 bp, Homo sapiens
  misc_feature 1..129: note = chr18:11752640-11752769
  misc_feature 1..129: note = hyper
  source 1..129: mol_type = genomic DNA
cgccaggctgggcgggcagggccgggcgagggtcgcgcgcacctctgggccgcggagcccagacggcggccggggcgagctcctccagccaggaacccgcgtgtaggaaatccccgtgctgggggagga

SEQ ID NO: 36906 - DNA, 142 bp, Homo sapiens
  misc_feature 1..142: note = chr18:11947249-11947391
  misc_feature 1..142: note = hyper
  source 1..142: mol_type = genomic DNA
ggaggaaccacaaaccgcgtagactcaggccagccgctgggcctgggcctgtgtgtccctcaggcggcgacctttggcccacttcaggccggccgtatttaccagcttagaggcgccgcggcgttggcgagtcctttttcac

SEQ ID NO: 36907 - DNA, 35 bp, Homo sapiens; identical to SEQ ID NO: 12991
  misc_feature 1..35: note = chr18:12253812-12253847
  misc_feature 1..35: note = hyper
  source 1..35: mol_type = genomic DNA

SEQ ID NO: 36908 - DNA, 43 bp, Homo sapiens; identical to SEQ ID NO: 12992
  misc_feature 1..43: note = chr18:12254104-12254147
  misc_feature 1..43: note = hyper
  source 1..43: mol_type = genomic DNA

SEQ ID NO: 36909 - DNA, 290 bp, Homo sapiens
  misc_feature 1..290: note = chr18:12254304-12254594
  misc_feature 1..290: note = hyper
  source 1..290: mol_type = genomic DNA
cgggcgggggcggggccgccgcactttaagaggctgtgcaggcagacagacctccaggcccgctaggggatccgcgccatggaggccgcccgggactatgcaggagccctcatcaggcgagtgccccgcgtccccctgattgccgtgcgcttccaatcgccttgcgttcggtggcctcatattcccctgtgcgcctctagtaccgtaccccgctcccttcagccccctgctccccgcattctcttgcgctccgcgaccccgcgcacacacccatccgccccactggtgcc

SEQ ID NO: 36910 - DNA, 159 bp, Homo sapiens
  misc_feature 1..159: note = chr18:12287804-12287963
  misc_feature 1..159: note = hyper
  source 1..159: mol_type = genomic DNA
caacgtggttcctcccgttgaatcaggttctgaccgagtccgctgcagctgcaggcgggggcgccctgccgagcagatacccagcggagctccggggccccgtttctactgtaagcagctgggggccaaatgtgcgcccgggcacgtctcttggcctct

SEQ ID NO: 36911 - DNA, 486 bp, Homo sapiens
  misc_feature 1..486: note = chr18:12307602-12308088
  misc_feature 1..486: note = hyper
  source 1..486: mol_type = genomic DNA
cgcgaggagtaggctgcatagacccggcgcaggaggtgttcattttcggatccagccctgtagtcactttagctaaacccggttccaaaggggtgggagtcgtcggagaggaatggcctctgtatctccggagacggaaacaccaggacgaagaggccctaagaacgtgtgcccggggtgcgaccggggggtggggggcagggggcagagaccctgaaaagctccaccgccgaaccccagggcagtgtcccggcttggctggactgggcgcgggcggctgcaatgctcccgggcgcggcgctgggaccccgcgggccacgtcggctccgctgccccgacgccagggcccgactcgcgtctccctctggcggggcaccacaaggggcagcgaaacggtggtgggggcgggcgccgcgctccttcccgtctcctccccgccagctccgggcccgtccttttccgcccggctcccggcaagggtccccc

SEQ ID NO: 36912 - DNA, 30 bp, Homo sapiens
  misc_feature 1..30: note = chr18:12308897-12308927
  misc_feature 1..30: note = hyper
  source 1..30: mol_type = genomic DNA
gtgtagcaggatgcccggccactcccttcg

SEQ ID NO: 36913 - DNA, 105 bp, Homo sapiens
  misc_feature 1..105: note = chr18:12911116-12911221
  misc_feature 1..105: note = hyper
  source 1..105: mol_type = genomic DNA
gggcgcgagcgggagcggaagcgggcccgggccgcactgctgccgcgtctagccgcctcccaggctgcctgcgccgcgtggctcgcccccgggacttgccagcag

SEQ ID NO: 36914 - DNA, 350 bp, Homo sapiens; identical to SEQ ID NO: 1330
  misc_feature 1..350: note = chr18:13868570-13868920
  misc_feature 1..350: note = hyper
  source 1..350: mol_type = genomic DNA

SEQ ID NO: 36915 - DNA, 307 bp, Homo sapiens
  misc_feature 1..307: note = chr18:13868946-13869253
  misc_feature 1..307: note = hyper
  source 1..307: mol_type = genomic DNA
cgagcgcagggcacccggcccatcagctcttccttcacctgaactgccccggcctcgctgagacgcggattttaaaaccgccctgcacctatgtgctggcagccaggccctgggaacttcctccaaacactcccatgagttcgggatgactagcatcagttttcagctggagagcagacggcaactgaacgctgcgaagtcccacgatggggatgagaggaccagagccccgaggccagtcgcccccctcccgcccatccgcccgcccgcccgccacgcagggctgctctagcgcctgcctcttcct

SEQ ID NO: 36916 - DNA, 58 bp, Homo sapiens
  misc_feature 1..58: note = chr18:14450734-14450792
  misc_feature 1..58: note = hyper
  source 1..58: mol_type = genomic DNA
cgggccagcatggagcggaagagcccgactgctttctggtactcgctcgcgcggaagg

SEQ ID NO: 36917 - DNA, 91 bp, Homo sapiens
  misc_feature 1..91: note = chr18:15198009-15198100
  misc_feature 1..91: note = hyper
  source 1..91: mol_type = genomic DNA
agaagccgcggcggccgtggaaaaagtcgcggcggcaaaaagccgcagagtagggggcgaaaagacgcaaaaagccgcggcggcaaaaagc

SEQ ID NO: 36918 - DNA, 30 bp, Homo sapiens
  misc_feature 1..30: note = chr18:15198160-15198190
  misc_feature 1..30: note = hyper
  source 1..30: mol_type = genomic DNA
aaaaagcagcggtggcgctgacaaaaagcc

SEQ ID NO: 36919 - DNA, 100 bp, Homo sapiens
  misc_feature 1..100: note = chr18:18821813-18821913
  misc_feature 1..100: note = hyper
  source 1..100: mol_type = genomic DNA
agaagaccccccccccgcacgaccccctgtacacccccgcggggctgcgcgttcgtctgtgcggcggggtttgggaatggaggcgtgaggaccgcgcatc

SEQ ID NO: 36920 - DNA, 1030 bp, Homo sapiens
  misc_feature 1..1030: note = chr18:18821914-18822944
  misc_feature 1..1030: note = hyper
  source 1..1030: mol_type = genomic DNA
agggctccacaggctgggcggggggcgtcgttggaggggggtaggggagaaatgcgcgcccaccaccctcacagagggcgagggacccccaaaagccactcgcggacgccgaggcagcgggaaggcgcgaggcggggcggggggagggggcgcgggggtccccgctgcggaggccagggcgggcgggaggggcagcacctgaggaatccgcctccggctgcggcggccgccgcctcgctccgccccggggaactgagcgcgcggaccgcgcgcctgccagagagacgccagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgagcggccgcggggactccggggcgcgggcaggaggtgagaggtcgcgaaccgggcgcgggagctcgcctgtgaccggcaggagctgccctttggcgggctggacgccctggccgcgcggggaagcgccgcagcggacttttccggagggatgggaagctcagcgggggtgtgagcggagcgcgtgcgggtggcgagggagcgccagtgccaacctgggagccgtgcctgccttccctgccgcctcgcgtcgcccaccgaagggacccggccgtgctgtccgcgcccagaggccgaaggcctgtcaccgggctctactcgctgcctttgtggcgggagcgagacggcccgggggtgggacgagggagctgcggcgcgccgagtagcgcggggtcccccggcggaggcggcgagggggcacctggttcgtctccccgagcccaggggcagtgagggggtgccgggcaggcgggcgggcgacaggtagggcgccgcggaggtggcggggagaggatggatggagttcagcctgggaaagttgagaacgtccagaggtggctgggcgctcgctcggcgtctgtgggttttt

SEQ ID NO: 36921 - DNA, 259 bp, Homo sapiens
  misc_feature 1..259: note = chr18:18823227-18823486
  misc_feature 1..259: note = hyper
  source 1..259: mol_type = genomic DNA
catgagtccaaggaacgtccccgaacgcgactcgtttgcccggaactgccgctgcctctaaccgaggctgcgggtcctggagaaactcctcagtcttgcccctttctccggtgaacgtgacggttccaaggtccttatcctccccacccactcctctggccccggctgagaggatagaaaccacattttaatttctgcttttcacaccgtaaggtgtttttttccgcctccccccgcctcgaggcgggaatccctgctt

SEQ ID NO: 36922 - DNA, 88 bp, Homo sapiens
  misc_feature 1..88: note = chr18:19748288-19748376
  misc_feature 1..88: note = hyper
  source 1..88: mol_type = genomic DNA
tcctaaagtctccctcggcagccttctggggtcacgtctgtcggaagaaatcctttctgtaagcgaaagggagcgagacatatatcac

SEQ ID NO: 36923 - DNA, 60 bp, Homo sapiens
  misc_feature 1..60: note = chr18:19749864-19749924
  misc_feature 1..60: note = hyper
  source 1..60: mol_type = genomic DNA
gcgcagccttatctccgagttatctcggcgcaaaggggcgggagccggtagttaggcagg

SEQ ID NO: 36924 - DNA, 78 bp, Homo sapiens
  misc_feature 1..78: note = chr18:20716572-20716650
  misc_feature 1..78: note = hyper
  source 1..78: mol_type = genomic DNA
tgagtatccgggatgcgacgcgcacccaaccctgcgtcccgcccggcgctcccagcctccccgcggtctctgggctac

SEQ ID NO: 36925 - DNA, 88 bp, Homo sapiens
  misc_feature 1..88: note = chr18:21977137-21977225
  misc_feature 1..88: note = hyper
  source 1..88: mol_type = genomic DNA
tctcccttggatattcgttcatgcttgtagaaccgaccacgcggtacattgggaaacggtcacatgaacaatgcgtgacttccattgt

SEQ ID NO: 36926 - DNA, 131 bp, Homo sapiens
  misc_feature 1..131: note = chr18:22928965-22929096
  misc_feature 1..131: note = hyper
  source 1..131: mol_type = genomic DNA
aatgctcagaagctgcgagtgaacaaaactgccaatcgtgcaaactttaataaacttttttttttttgaaaagaaaaatccctcccaaattccttcacggggtttcagaagcttcttggagccctttccac

SEQ ID NO: 36927 - DNA, 533 bp, Homo sapiens
  misc_feature 1..533: note = chr18:22929186-22929719
  misc_feature 1..533: note = hyper
  source 1..533: mol_type = genomic DNA
cgttactttcaagaaagccggggtctcgggcaagtctcgccggcgcgagcctggtccaccgttaccctgacacccgcgcacgcccgtggcgtttcttttttcactgtcgacacttggatctttcaggccctgggtctaggtttcccccagaaaaatgaggggcccatgtgacggaaaccaccagacacactgtgtggagacacatgccaatgattcacctcgttcccgaactaaaacttctgcgctttaggaaaaaagcaagcgttccaatctgcgaggccctcccccaccccgtcccttcccaggagaagaaagaaagggctttgtgtgtgcggtgagggctccgttcatcgagttcaaaaatgcacagcggccgggggccgggaggcgtggggcgccgggccctgcccaccccttttccccgggccggcggcgagtcgggaagctggtgcgggaaccggggccacggggcgccgcggcccggcagccaggaggaagaggatgctgcgccgccggggaccagagggcggggc

SEQ ID NO: 36928 - DNA, 357 bp, Homo sapiens; identical to SEQ ID NO: 4528
  misc_feature 1..357: note = chr18:22929926-22930283
  misc_feature 1..357: note = hyper
  source 1..357: mol_type = genomic DNA

SEQ ID NO: 36929 - DNA, 894 bp, Homo sapiens
  misc_feature 1..894: note = chr18:22930284-22931178
  misc_feature 1..894: note = hyper
  source 1..894: mol_type = genomic DNA
gtgcccgcggccggcggccggggtctgtttactccggcgacgtgcggagaggacccaagcaggacgcgggcgggcgggaggcggcggccgggaccccgggccacgtttgtcacgagcgggggctgctccccacctccgagatgacttttttcttcttccaaagaaaaggaaaaaagaagcaccgcacggttttgcatatttattctttgcgaaaacacacaacagaaactttttcctccagcccagatgtagatctcagacgggatatttttttttcctccctctccggataatttcgtttctttctctctctctctctttttttttttcggttgttgttgtcttttctcgcccactttctaccgccgccccattcggggatcctcctcccgtcttcgtctccccccaccccgacacctcaccctcactccacctaggggctcagcggggaggggagcgcgcgcgcccccgcactcacactcacactcacgcgcgcacacgcctcgcagccacgcagccctcgctccgctacccacagtgacactcgcggatgggggaaagcggggagcagggggttcctccttacctttgagggatctcggtttcgcttgcttgcggcgagacatcctaaaagcaaacagctgaagttgtttcaattcagccctgaaagaaactatacttcctcgtggccgcgcgcccctcgggccgcggcgcctcgcgccctccgctcggcctccctcgcgccctcgctccgcgctccgctcctcgctccggctccggctcgcgctcgcgcgcggggctcgcggctgcccgagctccgcgctctgcacgacggcggcggcggcggcggcggctgctgcaccaaactttcccagccttcgacccccaccccca

SEQ ID NO: 36930 - DNA, 187 bp, Homo sapiens
  misc_feature 1..187: note = chr18:24127943-24128130
  misc_feature 1..187: note = hyper
  source 1..187: mol_type = genomic DNA
tactcccggaagatgcgcacggcgtagcgggtggccagccgggtgttctcgctcagccgggcccgctcggggcgctgcagcacgtcggggtccagctcggagccgtccccgggcggcccaccgcgggcccggggcgccagcagtcgcggcggcgcctcgggctccagcgcggcgctctggtccatat

SEQ ID NO: 36931 - DNA, 138 bp, Homo sapiens; identical to SEQ ID NO: 13008
  misc_feature 1..138: note = chr18:24130809-24130947
  misc_feature 1..138: note = hyper
  source 1..138: mol_type = genomic DNA

SEQ ID NO: 36932 - DNA, 89 bp, Homo sapiens
  misc_feature 1..89: note = chr18:24131098-24131187
  misc_feature 1..89: note = hyper
  source 1..89: mol_type = genomic DNA
cgcagtttgccggaggcggtgtgctgggttggacgctccgggaaacaaagcaacccaaaacagctcccagttgacgtcaacttatttcc

SEQ ID NO: 36933 - DNA, 479 bp, Homo sapiens
  misc_feature 1..479: note = chr18:24764644-24765123
  misc_feature 1..479: note = hyper
  source 1..479: mol_type = genomic DNA
acaccctggaggacccgacagactggcagcagaaactaaagactgttcctgccgtcctctttccaacctctgcatgccccaagaggggtctgaccccggaatcctggagtccagggtgccccgccggggcgcaggaaggaaactcaggtagctgacaagttcaggcggccgtccttctccagcgccccctcaaagtcaggatcccctcctgctcccgccccccacctcccgccatgcgtccactgaagtgaagggaagtgggttggaatactggaggtaggggagatagaaaaaggaagaagcctcccgcatctccagcggcgaagcacctggaaaggtgagggcgcacgtccccgcccaccagagcccgctcccggcgcgggtacccagcagcgcgccatcatctctgcccctccagtgccccccagccccaaccccagccccagcgcggttacctcgcgggccgctgccgggcgctt

SEQ ID NO: 36934 - DNA, 37 bp, Homo sapiens
  misc_feature 1..37: note = chr18:24765383-24765420
  misc_feature 1..37: note = hyper
  source 1..37: mol_type = genomic DNA
tctctccctcgcccccgctgcccgccctgccttctcc

SEQ ID NO: 36935 - DNA, 53 bp, Homo sapiens; identical to SEQ ID NO: 13011
  misc_feature 1..53: note = chr18:25755399-25755452
  misc_feature 1..53: note = hyper
  source 1..53: mol_type = genomic DNA

SEQ ID NO: 36936 - DNA, 345 bp, Homo sapiens
  misc_feature 1..345: note = chr18:25756641-25756986
  misc_feature 1..345: note = hyper
  source 1..345: mol_type = genomic DNA
gagcttgctcggccccgaagaaggagcagaggggacccgcaatccagcccctagagccccgccaggaaaggcgcgagagacctactggccccggcaaccctgccccggcgcccggacggagcccgatgcctgcgcagctaccggccgcgcggcgcggcgcggcgcggcgtggcacctcccttcccgggtgcgcagcccggccccgcagcggcgcggggaacaaagggacccggcgccgcccgccccaccccgcccgtggcccggcccgcggggaccgccgcgtacctgaagcagggccgccagcagcggcagcagggtccgcagcgctcccgctatccggcacat

SEQ ID NO: 36937 - DNA, 185 bp, Homo sapiens
  misc_feature 1..185: note = chr18:25757253-25757438
  misc_feature 1..185: note = hyper
  source 1..185: mol_type = genomic DNA
gagctggggagggggcgggggaacagggagggagagcgtgtgagcgtctgcgagtgtgtggaggcggctgctgtggcagcgcaggcggctcggctccggcccggagcgcagcggaagccgcgagggatgcagcggcggggaccttggccggtggaggatgtggaggtggaagtggagcggatggc

SEQ ID NO: 36938 - DNA, 533 bp, Homo sapiens; identical to SEQ ID NO: 13014
  misc_feature 1..533: note = chr18:25757439-25757972
  misc_feature 1..533: note = hyper
  source 1..533: mol_type = genomic DNA

SEQ ID NO: 36939 - DNA, 359 bp, Homo sapiens
  misc_feature 1..359: note = chr18:25758128-25758487
  misc_feature 1..359: note = hyper
  source 1..359: mol_type = genomic DNA
cggggggtcgccggagggaagcctagagtgcgccgagcaccgccccggcaggtggaggggctgcgggaaataaaataacttgggcaggaacttgattggtagcaggttcatctttggtccgcggtagggaatctaatggagatgaagaatggtggggaagggggggcggtgtctccttgggagcctaacgtacgcttctttattttgtcattctttggagatgggtaatctttcctggcaggggcagacacagcaaactaaggacgcaggccaagctcatcctagctattgttgtctgaggcgctcgccgggagccacctgcgggcgggggagggcggaggccgcggctcctctctgga

SEQ ID NO: 36940 - DNA, 125 bp, Homo sapiens; identical to SEQ ID NO: 4530
  misc_feature 1..125: note = chr18:28620831-28620956
  misc_feature 1..125: note = hyper
  source 1..125: mol_type = genomic DNA

SEQ ID NO: 36941 - DNA, 135 bp, Homo sapiens; identical to SEQ ID NO: 4531
  misc_feature 1..135: note = chr18:28621033-28621168
  misc_feature 1..135: note = hyper
  source 1..135: mol_type = genomic DNA

SEQ ID NO: 36942 - DNA, 550 bp, Homo sapiens
  misc_feature 1..550: note = chr18:28621474-28622024
  misc_feature 1..550: note = hyper
  source 1..550: mol_type = genomic DNA
gaagcagtaagaatccgcgagaccagactcggctcactgccgacgcgggtatagacctcgctcccatcggaccccatgcgcatccatggatgcgggtaagtcgcgggtccgcggctcctttctgggcgtgcggaatgaaactctgttgaagcctgaagcttcgcgtgtaaccgcgccgccagagttccgaacacttcaagtctcccgtgttctcagagcatcgtctctaacttcctctcctagaggatttcgtcctgggcggcaggtttccgtagactcgaaaccccaggctgtgctccggccgcgcagtcctccccggagccggagtaagtacgacgcaaccccaccgcatccatcatcccccaccactgtcaccctctacccgcctccacacctcggcagcatccccaaaacacaacacgaccccaacccccattctggcccggtcttcccacactttcgcgcccccggcacatcccgcccccagctgggtggctggcgggggtggaccgcttgggtgagcttctgaataccctttaggggagatacc

SEQ ID NO: 36943 - DNA, 93 bp, Homo sapiens
  misc_feature 1..93: note = chr18:28622025-28622118
  misc_feature 1..93: note = hyper
  source 1..93: mol_type = genomic DNA
agaaacccacttctcaggggcagccccaccaagggacccagggacacagccccggctccactcactaacgaaccaatccgggtcaactgcgac

SEQ ID NO: 36944 - DNA, 364 bp, Homo sapiens
  misc_feature 1..364: note = chr18:28622419-28622783
  misc_feature 1..364: note = hyper
  source 1..364: mol_type = genomic DNA
ggctgctaccagacccgcagcattgatctgagccgcggttgtcacgtttcggcccgctttgtccccagctccgtgcagcgtccagggcggatccacccccgtccccaccccagccctatccggcgagatctggcttaccacgagggtcagcagcagatgcaggcagacggctccgcgcacggagcgccggggcccagcggcggccatcgggatgccgggcagggccaggagaacgcgggcgccgggagggtgccgagagcgagacctgccgaggtgcagggcgcgggaggtgcttttctcgccgctgcttgtttttaagtgtatttggcctctctcaggcttgcctgcccgggagcaacttcac

SEQ ID NO: 36945 - DNA, 66 bp, Homo sapiens
  misc_feature 1..66: note = chr18:29078189-29078255
  misc_feature 1..66: note = hyper
  source 1..66: mol_type = genomic DNA
ggcgggaggcggaggcgagggtgcgatggcgcggagcccgggacgcgcgtacgccctgctgcttct

SEQ ID NO: 36946 - DNA, 81 bp, Homo sapiens
  misc_feature 1..81: note = chr18:29599743-29599824
  misc_feature 1..81: note = hyper
  source 1..81: mol_type = genomic DNA
tacctgctttacgcacggtctctccaaaccggcggaaattacagagtaaaataactttctcaaaaccgcatagtacttagc

SEQ ID NO: 36947 - DNA, 30 bp, Homo sapiens; identical to SEQ ID NO: 13021
  misc_feature 1..30: note = chr18:30349740-30349770
  misc_feature 1..30: note = hyper
  source 1..30: mol_type = genomic DNA

SEQ ID NO: 36948 - DNA, 324 bp, Homo sapiens
  misc_feature 1..324: note = chr18:30350080-30350404
  misc_feature 1..324: note = hyper
  source 1..324: mol_type = genomic DNA
cagcacctcctccaccgtgtccagggacagggtcacgttggccgtgtagaggtactcgagcaccaggcgcagcccgatggacgagcagccctgcagcaccaggttgttgatggcccgggggctggtcagcagcttgtcgtcgggggaggaagaaggagtcccgggctcctcctgcggcggcggctgctgctgctgtgacggctgctgctgcggcggctgctgctggtccttgggggcccccaggccgtcctggccgccgacccctcccccgagaggggggtggctggagaagagcgatcggaagtactgcgagcaggaggccag

SEQ ID NO: 36949 - DNA, 319 bp, Homo sapiens
  misc_feature 1..319: note = chr18:30350720-30351039
  misc_feature 1..319: note = hyper
  source 1..319: mol_type = genomic DNA
ttgactccctcctggcgcgctccggaccccgaccctaggaggaaagtccgaagacgctggatccgtgagcgccaccagaagggccctgtctggggtcccggcgccggttctgcgccctgcggctcctctcgccacctcccacacacttcgtccctcactttcctaaaaccaaccacctcagctcggctgttggcagcaacagcagtggcagcagcgacggcaaagtggcggctgaggccgaggcacctcgtgggctcgtgtccatgccgggccagatgaagggaaaggccgggaagtggggagccgggggtgccctgaa

SEQ ID NO: 36950 - DNA, 30 bp, Homo sapiens
  misc_feature 1..30: note = chr18:30352193-30352223
  misc_feature 1..30: note = hyper
  source 1..30: mol_type = genomic DNA
gcttcctatttataccggactgggctcctt

SEQ ID NO: 36951 - DNA, 113 bp, Homo sapiens
  misc_feature 1..113: note = chr18:31020398-31020511
  misc_feature 1..113: note = hyper
  source 1..113: mol_type = genomic DNA
ggaattgttttcaaacgcgcggggcaaggactccccaccgcctctggaaggggtgaagaactagtcgactctaactccctcagggtggccagggaattgcatttggttctccc

SEQ ID NO: 36952 - DNA, 36 bp, Homo sapiens
  misc_feature 1..36: note = chr18:31158511-31158547
  misc_feature 1..36: note = hyper
  source 1..36: mol_type = genomic DNA
ctgggtcattgtctccgcgcccgaaccccgagcacc

SEQ ID NO: 36953 - DNA, 568 bp, Homo sapiens
  misc_feature 1..568: note = chr18:31739074-31739642
  misc_feature 1..568: note = hyper
  source 1..568: mol_type = genomic DNA
gtgaggttgccctggcggtgtccatagcaacgctggagggggtggcagggagaaaggcgccctccaccctgtcagcctcctcctcgcctcccccgacctgcaggcgcgctaagcgctccgggcgccgcgctccgcgagggggagcagtgctcccaacccgcgaccctccgcctcagacatcacagttgccgcggcaacggccggaggaggaaggccaaggcttttctcccgctgacgtcccccgccaccagtacccagagtgctggggcctggatgagatctgcgtccgcttcacccgagcatgagcttgggtctctcggaggagcaggagacgcgggctcgaagccgcgggcctgaccctgatccgtggatgccgccgccgccttctcctcccctgggtggtgggggacagggcctgggaggcacggtcacgccgagtttgagcacgtgaccttccaagagcttgagagtcccctagagagcaggccccaccccaatccatcccgcctcgccggaggggtccctctggctttagtccttctcttctaattccctgtatgtcccgacc

SEQ ID NO: 36954 - DNA, 329 bp, Homo sapiens
  misc_feature 1..329: note = chr18:31802052-31802381
  misc_feature 1..329: note = hyper
  source 1..329: mol_type = genomic DNA
tcttgtgaagaaaatcgacgctgctgcggctccccagccccactggcttctgcagcgtgaggctgagatgcattgggctctcaatgccagtgcctcgcggcgcctgggctagagctttgtggccatgagactagagccaccccagaaaaaggaacaaatacacacaccattcgatagcgcctaaacccatctttctttgttgttcatcttctagctgcggctttatttgtggaagagggaagtgaggaagggaatgggggggcggggaggaggaatctccaggaccttatctacaatctcaacagtcgcggcaacgatctctgggagtg

SEQ ID NO: 36955 - DNA, 413 bp, Homo sapiens
  misc_feature 1..413: note = chr18:31802675-31803088
  misc_feature 1..413: note = hyper
  source 1..413: mol_type = genomic DNA
ggaagctcctgcagccggtccgggaacccgaggcggggagggaggccagctctggaggtgcgctgccgctttaaaataaaggaccacaaagactgtacagtggggaaaacgcgcctggctaatgcgagtggggacgacttggggagggggttgaggaaggtagggggcacacgagccaacggcggctcacggctccccctctctcccgcctctctccttcctccctccccgccgggctgctccggcagacaaataacagaggaaggcgagtcactcaccgtggtcttgacaggcacgtagagcacttgcttggcgccgccgcctcccccgcggacctcgtccggctggcccagctggaagcccttcgatttgacccagaatttaaatttggcgttgtccgtggagctcgactc

SEQ ID NO: 36956 - DNA, 186 bp, Homo sapiens
  misc_feature 1..186: note = chr18:31803310-31803496
  misc_feature 1..186: note = hyper
  source 1..186: mol_type = genomic DNA
agggatgcgaggtcccggccgcagcgggagcctgctttgggtgggggaagggatgggaagaggggaggagggtccggttgggcaccagcaatcaatgccccgtgctaccaagtctggtccattcgtaattgcaacggctgtctcggacgtttttcctgttcccttagcggtcggtctctttaatat

SEQ ID NO: 36957 - DNA, 35 bp, Homo sapiens
  misc_feature 1..35: note = chr18:31804992-31805027
  misc_feature 1..35: note = hyper
  source 1..35: mol_type = genomic DNA
acggctgggcgctgacgtcacgggcagaattgtcc

SEQ ID NO: 36958 - DNA, 30 bp, Homo sapiens
  misc_feature 1..30: note = chr18:31902793-31902823
  misc_feature 1..30: note = hyper
  source 1..30: mol_type = genomic DNA
ttcttgaaaagaaaacgctagcgatttcac

SEQ ID NO: 36959 - DNA, 381 bp, Homo sapiens
  misc_feature 1..381: note = chr18:32073450-32073831
  misc_feature 1..381: note = hyper
  source 1..381: mol_type = genomic DNA
agtgactgaagcgcccgtccattccaaggtgtgtgcacggcgttttcttctttgacagctccggagtgggggagggcgcgggggtggagggggtccgtgtgccgggcgaggagtgggcgcgaggccgggctgccgcgctgcccccggccgcccggtgcagaggagcccgccgcggggcgggaggtgcacatgacgcgcagccccggctgcgcagggaccgcagccgcccacggcgccggggcgcggacacaggcggctcggcgctggagcaagggcaggcgccgcgcaccgagcaaagtcaagagtggaagcgggcggagagcgccggcgggggcagggattcgcctcaacgcccactcacggggttcccacctgtgcgcc

SEQ ID NO: 36960 - DNA, 159 bp, Homo sapiens
  misc_feature 1..159: note = chr18:32073907-32074066
  misc_feature 1..159: note = hyper
  source 1..159: mol_type = genomic DNA
cgggcggcgcctcaggcccgcggggcggcggtagcggctgctgcaggatgtccggcccgggggcgcggggccgcgcaggtaaatctcccccgccctcgaaggccttcgcagcgccgcagcccctgctgctgccgcggcgccgctcggggggtggctatg

SEQ ID NO: 36961 - DNA, 132 bp, Homo sapiens
  misc_feature 1..132: note = chr18:33878418-33878550
  misc_feature 1..132: note = hyper
  source 1..132: mol_type = genomic DNA
tcaggcctctggggccgctgcgggcggccacgcgaccctcgcgacaaagcacgcttcccggcgacaccgcctcctccttcccccgggggcgccgccggggacgccggccgcacactgcgatagcgctcaggg

SEQ ID NO: 36962 - DNA, 15 bp, Homo sapiens
  misc_feature 1..15: note = chr18:34833539-34833554
  misc_feature 1..15: note = hyper
  source 1..15: mol_type = genomic DNA
caggcccatttctgc

SEQ ID NO: 36963 - DNA, 572 bp, Homo sapiens
  misc_feature 1..572: note = chr18:34833958-34834530
  misc_feature 1..572: note = hyper
  source 1..572: mol_type = genomic DNA
cggcggggaggggtcgggggacaggggggcggggcgggcctgaggctctccccctcgggccccgcccccggccccgccccggtgcccgcccctctccagcccgcgcgcgcgtgctaggcccctccgggggcaggcgctggcggggacccggctcgctgacctgcgcctagtctctggccgcgtcactcgcccggcgcccgctccccaagtggggcccgcggccgggcggcgctgggagaggcgcccgccccccacccccgccggccccggcacctcagccctcgcctcggcgggagagggcggacacacctgcgggtggaggagtttattggacactgtcctccctgacaggagggggcctggcagcgcgcgggcacagggtgccggcctggggagagagacgagtgcgaggggccgggagggaggcgccgccgagaaacttctccaccgccggcccggccgcccccctcgccaccgcaggtgcccggctgtcggaggaggcccagaggctgagccctcgcgggccctccgcccccactcccggcctctgcccgccccgccaggctccgggt

SEQ ID NO: 36964 - DNA, 30 bp, Homo sapiens
  misc_feature 1..30: note = chr18:34973974-34974004
  misc_feature 1..30: note = hyper
  source 1..30: mol_type = genomic DNA
aaattgccagcttgtcgggggccgcagggc

SEQ ID NO: 36965 - DNA, 264 bp, Homo sapiens
  misc_feature 1..264: note = chr18:35064882-35065146
  misc_feature 1..264: note = hyper
  source 1..264: mol_type = genomic DNA
acccacaggagagaccgcgcagacccttgacccgaagaatacttcttattttatggtgatgaactagcctcgataatagccatggctgatatcacacccagttaggggggccataaataattctcttctcccccgcacagaagctataaaccagggccgaggcgcgatagtttatcaaagacgagggctggctccttaaataaaccgcggtgatctcacttgcggcgccccctcccacgccggccccctcctcccccactagag

SEQ ID NO: 36966 - DNA, 171 bp, Homo sapiens
  misc_feature 1..171: note = chr18:35065516-35065687
  misc_feature 1..171: note = hyper
  source 1..171: mol_type = genomic DNA
cgctctgggccttcagcgctgactcacgctcgcagtaggtgaggaaggcgcagcctggggaggaaagcaagcgccaagaagggtcagtggggcgcccccgggcccgccgacgcgccctgccgcccgccctccaggctcccgcccctccctgccgctcggtccctgtcccca

SEQ ID NO: 36967 - DNA, 61 bp, Homo sapiens
  misc_feature 1..61: note = chr18:35067550-35067611
  misc_feature 1..61: note = hyper
  source 1..61: mol_type = genomic DNA
cgtccctcgtgctgccgcctgcttctcccgggggcgtctttcctcccgtccccttgttggc

SEQ ID NO: 36968 - DNA, 29 bp, Homo sapiens
  misc_feature 1..29: note = chr18:35104522-35104551
  misc_feature 1..29: note = hyper
  source 1..29: mol_type = genomic DNA
aggtaaattttcggccggcggggcagccc

SEQ ID NO: 36969 - DNA, 44 bp, Homo sapiens; identical to SEQ ID NO: 13033
  misc_feature 1..44: note = chr18:35104934-35104978
  misc_feature 1..44: note = hyper
  source 1..44: mol_type = genomic DNA

SEQ ID NO: 36970 - DNA, 117 bp, Homo sapiens; identical to SEQ ID NO: 13034
  misc_feature 1..117: note = chr18:35144820-35144937
  misc_feature 1..117: note = hyper
  source 1..117: mol_type = genomic DNA

SEQ ID NO: 36971 - DNA, 630 bp, Homo sapiens
  misc_feature 1..630: note = chr18:35144968-35145598
  misc_feature 1..630: note = hyper
  source 1..630: mol_type = genomic DNA
cgtcctgggctcgaccggtgcagccttccccatccccatctttcaggtcgctgtacccaaaaatccaagccccgtctcctcgatcccctctctctttctcttcatcggcgcccgctgctctctccatggcatcgttcctatcagcacctcgcccaaaacccagtcttgccccagcgaacagctccccacgcaccccagctctggtctccgctgcccgagcgcctccctccaccgcgcccgcccgaggcttcctctcgcttagtccgccgctcgtcagtcgccggccggccggtcggcccgccagcccgctcctgctccccggcaaagttgggagggaaaggtgtactcacctttgtgcatgcctgtgaacctgtccttcagaaccgtaagctcgtagattttgccaaactcctcgaagaggggcttgaggtccttctcatccaggttgcgggggatctgcccaatgaacagcttgatggcatcgtggtccttcatgggaatggtcgacgggttccccgggctgtggcttaatccgttcatgtgcccggcactgcccgggctgctgccgagcccgttggtactgaggcttgcgttgtcagcctgtccgtttgctaacgtggccatctttat

SEQ ID NO: 36972 - DNA, 89 bp, Homo sapiens
  misc_feature 1..89: note = chr18:35146102-35146191
  misc_feature 1..89: note = hyper
  source 1..89: mol_type = genomic DNA
acggcgggcggcggccgggggcagggcggcgtggggcggcggccaccgcgcctcccccgtcggcggccccgcgccgtggcgatggtaca

SEQ ID NO: 36973 - DNA, 55 bp, Homo sapiens; identical to SEQ ID NO: 13038
  misc_feature 1..55: note = chr18:35146710-35146765
  misc_feature 1..55: note = hyper
  source 1..55: mol_type = genomic DNA

SEQ ID NO: 36974 - DNA, 195 bp, Homo sapiens
  misc_feature 1..195: note = chr18:35146895-35147090
  misc_feature 1..195: note = hyper
  source 1..195: mol_type = genomic DNA
cggaaggtgggggtccccgtcccgggcggcctcccccgccccggagagcgcggctggtcccccggtggctggcgggaggaaggtaggagtcgggcgcccctgcccgctcgcccgccggagggggaggaaggcgctgggcgcggtggccggtgagccagcgcgggggatggcttgatttgccctcgtctgctttac

SEQ ID NO: 36975 - DNA, 78 bp, Homo sapiens
  misc_feature 1..78: note = chr18:35147091-35147169
  misc_feature 1..78: note = hyper
  source 1..78: mol_type = genomic DNA
ggttcaaatagaatatatttttttaatcaccatcaaaagaataaagcccctgaatcgctatctgggttgccgccggac

SEQ ID NO: 36976 - DNA, 317 bp, Homo sapiens
  misc_feature 1..317: note = chr18:35147487-35147804
  misc_feature 1..317: note = hyper
  source 1..317: mol_type = genomic DNA
tcagggcagcctcttcgcttcagaagcctggcaaattgaaataacgcgcccgctcccccgcgggctgcggggctggggagctggggcggcggggctgagcggctggcctaacccccgccggccctcggctagccactttcgggtttcagggtttctcttttcttgccctcggattacattacgttactagaggatatgtctgcaattttaattaaagaaatgagaccccagctgcctgcaaacccaggccaaccccatttggtacaagcacaatacggagctctccagcgccggaggaggcccggaggcccgaggtt

SEQ ID NO: 36977 - DNA, 15 bp, Homo sapiens
  misc_feature 1..15: note = chr18:35147834-35147849
  misc_feature 1..15: note = hyper
  source 1..15: mol_type = genomic DNA
cgcctctctctgagg

SEQ ID NO: 36978 - DNA, 30 bp, Homo sapiens
  misc_feature 1..30: note = chr18:40857392-40857422
  misc_feature 1..30: note = hyper
  source 1..30: mol_type = genomic DNA
agagggaggtccactcgccctcgcacagtg

SEQ ID NO: 36979 - DNA, 189 bp, Homo sapiens
  misc_feature 1..189: note = chr18:43913431-43913620
  misc_feature 1..189: note = hyper
  source 1..189: mol_type = genomic DNA
aatgcgttcttggcacgcgtcctgcgttaacaaggcgtttggtgtgtgcatgtctgtgtgacagtgcctgggtcctgtttgcggctgcttgttcgcattccagcttcccttgtgcccgcagtcaggctctacacgtgcgccagcctccgagcgcacgtccccgagtgacccgtgcgcggtgtgcaggga

SEQ ID NO: 36980 - DNA, 71 bp, Homo sapiens
  misc_feature 1..71: note = chr18:43914155-43914226
  misc_feature 1..71: note = hyper
  source 1..71: mol_type = genomic DNA
gccgcccgcgcccgcgccccggagccgcgccacaaagggcccgcgcgcagccgccgccgccgccgccgcgc

SEQ ID NO: 36981 - DNA, 399 bp, Homo sapiens
  misc_feature 1..399: note = chr18:43914227-43914626
  misc_feature 1..399: note = hyper
  source 1..399: mol_type = genomic DNA
aggagccaggatggtcctggtccacgtcggctatctcgtgcttccagtgtttggctctgtgcgaaacagaggtatcgctttttcctttcggggtctgcttcggagcgtggatcgccgcaggcaccggggcgggggcgggcgccgcgggcggccgggggctcagggcacacccgcgaggacgcagggcgagcggtggcttccccccaccccattttagggggacccccgagggtgggggcggccgccctcgtgggagcttttgtagtgaagttagggtttggcgaatttgggtcccttcctccccagccccattttttattttttgcggcggacgtggttcccccaaatcacagccccttcccctaatacctagccctgtatgatcgaaaggagaaagat

SEQ ID NO: 36982 - DNA, 140 bp, Homo sapiens
  misc_feature 1..140: note = chr18:43914882-43915022
  misc_feature 1..140: note = hyper
  source 1..140: mol_type = genomic DNA
atcccatccttttttcgtctttaaccctttttgtgcatcgcccttgtgctattgccctgctcaccccgccccccgcaactgtctttgtatgacagttgcatacacgggttcaagatgcttgggcgcgtgtgtgtgtgtgt

SEQ ID NO: 36983 - DNA, 282 bp, Homo sapiens
  misc_feature 1..282: note = chr18:44336168-44336450
  misc_feature 1..282: note = hyper
  source 1..282: mol_type = genomic DNA
ggatgctcttggaaacgcggtggcccaagcctaagcggccatgctcggggctaggagcggaccccacggccactcaccccggggcgctgcgaccgaagctgccgcggccactgccacccgggggctcgccggccggctccgcgcatcccgccctctcaatggactttcttacctcttaatgtagttcctgccatacaggatctgttgcagcaaggtcaccaaggcaaaggcgcagatgaagatgaagagcaaagttcggctccccaacaaatcccggttggc

SEQ ID NO: 36984 - DNA, 139 bp, Homo sapiens
  misc_feature 1..139: note = chr18:44337012-44337151
  misc_feature 1..139: note = hyper
  source 1..139: mol_type = genomic DNA
cgatagggacggggggagggggcgtacaaaacacccgcgcagtctggctaatgataggcgggccgtggggagggggaggggcggagcgcaaaacgccgggtttgaatcttggaattaaaaagagggcaggggctgggcg

SEQ ID NO: 36985 - DNA, 167 bp, Homo sapiens
  misc_feature 1..167: note = chr18:44337451-44337618
  misc_feature 1..167: note = hyper
  source 1..167: mol_type = genomic DNA
agagggcaggaagaggaaacaacagttgcggagctggacttgatggaagggagcatttgcgtgcggcgcgcagggcactgagtcaccatcgtggccgcgtcctcgcgctctcctagcgatttctccggagaaagcggagcaaggtcagccgggcagcccttcaagga

SEQ ID NO: 36986 - DNA, 193 bp, Homo sapiens; identical to SEQ ID NO: 1335
  misc_feature 1..193: note = chr18:44337649-44337842
  misc_feature 1..193: note = hyper
  source 1..193: mol_type = genomic DNA

SEQ ID NO: 36987 - DNA, 140 bp, Homo sapiens; identical to SEQ ID NO: 1336
  misc_feature 1..140: note = chr18:44772977-44773117
  misc_feature 1..140: note = hyper
  source 1..140: mol_type = genomic DNA

SEQ ID NO: 36988 - DNA, 501 bp, Homo sapiens; identical to SEQ ID NO: 1337
  misc_feature 1..501: note = chr18:44773466-44773967
  misc_feature 1..501: note = hyper
  source 1..501: mol_type = genomic DNA

SEQ ID NO: 36989 - DNA, 315 bp, Homo sapiens
  misc_feature 1..315: note = chr18:44774387-44774702
  misc_feature 1..315: note = hyper
  source 1..315: mol_type = genomic DNA
gcccttgctgggcaccgggatgactgggtagctgcgcgggcctttggcccctgccccggcacccgcccccgcgcccgcgcccacgcccacgccggccacacagccacccccagcgccgcccccaccagtccccgcgccgcccgaagcagcagccacagagaggctggcggctgcggccgagaggctggcggcggccactacggcggcctcctgcaaggagtcgtcgtcgtcgtcgaagcgcggccgcttgtgatgggcgtgcggggcaccagccagctctgccaagggcggcggtggcggcggcggcggcggggg

SEQ ID NO: 36990 - DNA, 151 bp, Homo sapiens
  misc_feature 1..151: note = chr18:44775439-44775590
  misc_feature 1..151: note = hyper
  source 1..151: mol_type = genomic DNA
tgggtttgaggttggcgtgccctggccgcggctggctcagcgtgtcgggctggaaggcgctcgacggcgacgccagcaggatgtcgttgggccctggcagcggactggaagccatctccgccgcagaaccccgggccgagccctacaggtc

SEQ ID NO: 36991 - DNA, 30 bp, Homo sapiens
  misc_feature 1..30: note = chr18:44776834-44776864
  misc_feature 1..30: note = hyper
  source 1..30: mol_type = genomic DNA
cagctacatctcaagcgcattggccaaggc

SEQ ID NO: 36992 - DNA, 49 bp, Homo sapiens
  misc_feature 1..49: note = chr18:44777301-44777350
  misc_feature 1..49: note = hyper
  source 1..49: mol_type = genomic DNA
gataattccaactctcgctccccagcaaggcgcgcggctggccagccgg

SEQ ID NO: 36993 - DNA, 196 bp, Homo sapiens
  misc_feature 1..196: note = chr18:44777596-44777792
  misc_feature 1..196: note = hyper
  source 1..196: mol_type = genomic DNA
ccaacttagttctcccgactcccaaaccagtcaccacggaagcccaccgctgcccctcaacctaacgcggaaaatcctaccgctggggatctcaaataggtgcccagcaagctgtgtgccggattggggcggccggttccggcaatacctggtaacctctgggtgtctttaggcgtgtggctgccggcccatcttc

SEQ ID NO: 36994 - DNA, 464 bp, Homo sapiens
  misc_feature 1..464: note = chr18:44777862-44778326
  misc_feature 1..464: note = hyper
  source 1..464: mol_type = genomic DNA
cgcgaagatccgggctctggcccgagcgaatggcgctcaaaccccggcctggggagaatgacggcctgaattgcggcggggcgtcccctccaccgcagaaagtgtgggtacgcagaaacccgcggcaggagagccccaagtggagcgcagtctgacagcgtctgtctctgaactcgtgtcggaccgaggggacgccacccagcgggcagggtgacgtcaccgtctccctgacactccacattaaagggctggcatgttacagggagggagggggagagcgaaagccagcgcgagcaacagagagatcctttctcagcaggcacgaaagctaccaacctaaccaactcgcaattgacaacaacctcctcagccccggagtaaactgcagcaatggtgctggagccgcagatctgatttaggagtggaaagcgaacagtctgcctgcatcccgggacctagatcct

SEQ ID NO: 36995 - DNA, 529 bp, Homo sapiens
  misc_feature 1..529: note = chr18:44780673-44781202
  misc_feature 1..529: note = hyper
  source 1..529: mol_type = genomic DNA
caatgctttcctcttcgagctgacatgcattttacacgtcaggactctcctcagccggctaattgattcaaattgttttattggttaaactggtgtcacccattttcatgatctatcaccacatggaggagagcatttccactcccatctccgttccgggcggctgcggttcacccaggccaaggacaggtaaaggagcccagacgcgggacccagaggaaaaccacaaaccgagctggcctcctcataactggagaggcgacgtctggaagtaagaggaggaggccggcacagcagcgcatatgggcttccagctacaaatttaaactggttgaagagaacccacgctcagccgggcctgggcccagtttcctccacctgggacacagtcggtttccgagccggcgttgaactccgcggtataggaggccacaacaaaacccgggtgggaactgtccgcggtgctgacgagatgcatcgttccaaagcacagcgaatcctactgtgttcaagtcgggaagaagcctcc

SEQ ID NO: 36996 - DNA, 264 bp, Homo sapiens
  misc_feature 1..264: note = chr18:44786883-44787147
  misc_feature 1..264: note = hyper
  source 1..264: mol_type = genomic DNA
ctcgcccgcgggagtcgctgtccgagcttggcagtgctgaaaccgccggcgtgagctagggagctgcgggctgcggaggttcaggggcaaaaatctggatgctgtcctaagctagggagccgctttccacagcgtctccaaaaagtctagtttgccttctctccctagctctcttcatatcccccccaaccccccgcccacaagtgacaccagaacgttgtaaccaaaaattaattgccttaatcaaatcgacccaccttctgc

SEQ ID NO: 36997 - DNA, 150 bp, Homo sapiens
  misc_feature 1..150: note = chr18:44787701-44787851
  misc_feature 1..150: note = hyper
  source 1..150: mol_type = genomic DNA
gtttagggtgagggtcggtctctcctcgcgccctgcttctcggcttagcttgctcagatccgcacccccccactccccacctcagacctctctgacgccgcctgttggtcaggcagggcagggcgaggagcgcagcgccagccccagccc

SEQ ID NO: 36998 - DNA, 30 bp, Homo sapiens
  misc_feature 1..30: note = chr18:44788251-44788281
  misc_feature 1..30: note = hyper
  source 1..30: mol_type = genomic DNA
aaaaaaaaagttagtcgaatccgtctcata

SEQ ID NO: 36999 - DNA, 177 bp, Homo sapiens
  misc_feature 1..177: note = chr18:44789786-44789963
  misc_feature 1..177: note = hyper
  source 1..177: mol_type = genomic DNA
ggaggatgaatggggcgctcgccgcggctcatggcgccccctaggagcggcaggaaacttctcctgcagggcagcgcgggccgggctccgcctccggaaggcgggcggggagggtagttgctgggggtccctaggccgggccccaggacatctaggacatgccgggggctgtttgct

SEQ ID NO: 37000 - DNA, 30 bp, Homo sapiens
  misc_feature 1..30: note = chr18:44790732-44790762
  misc_feature 1..30: note = hyper
  source 1..30: mol_type = genomic DNA
aaatgaagggggcagcgatggggtcggaaa

SEQ ID NO: 37001 - DNA, 217 bp, Homo sapiens
  misc_feature 1..217: note = chr18:45058076-45058293
  misc_feature 1..217: note = hyper
  source 1..217: mol_type = genomic DNA
aatgactccggtctccgcgccgctggtgttgcacaacttgtctgtgctggcttgagaccccggtgatccccttctaattgaaatcactttcccctgacctcccccgtaagcctgggagcttgttgctctctgcgccaacactcgggctgcggaggtcgggggaaatcctggctgggcaccagagctgcacgcacgccgcatccatcttccggccgcc

SEQ ID NO: 37002 - DNA, 140 bp, Homo sapiens
  misc_feature 1..140: note = chr18:45058307-45058447
  misc_feature 1..140: note = hyper
  source 1..140: mol_type = genomic DNA
cgccaggtgcccagccagggtgggcgtcggggcagccccctggaaggcggccctgctggatcaccggctgcttggaagctcgcagcggggctgacactgccccctaaggggcattttggacatttcgtgggggggcttgt

SEQ ID NO: 37003 - DNA, 123 bp, Homo sapiens
  misc_feature 1..123: note = chr18:45275551-45275674
  misc_feature 1..123: note = hyper
  source 1..123: mol_type = genomic DNA
cctcctaacagagaacggcgctcggagccgggaacgcagctgccgccgcccagccctgagccccgcgcttcgcgcccgcggccctgagctctgctgacccctggcggccgccgcgcgccgcgc

SEQ ID NO: 37004 - DNA, 90 bp, Homo sapiens
  misc_feature 1..90: note = chr18:45662989-45663079
  misc_feature 1..90: note = hyper
  source 1..90: mol_type = genomic DNA
gcccttacgttccttcggctggcccctcgccccaaaggagcccgctggcgtgggccggcggcaatggggcagtggcgagagttgctctct

SEQ ID NO: 37005 - DNA, 110 bp, Homo sapiens
  misc_feature 1..110: note = chr18:45663423-45663533
  misc_feature 1..110: note = hyper
  source 1..110: mol_type = genomic DNA
gcgccgccagggtcccgggctgggaatccacgcggccgcgctgctcgcgggagcctgccgcagccggcgggaggttgtcattgattcgtgctgggcgagttaagccattc

SEQ ID NO: 37006 - DNA, 30 bp, Homo sapiens
  misc_feature 1..30: note = chr18:45935031-45935061
  misc_feature 1..30: note = hyper
  source 1..30: mol_type = genomic DNA
aaagtcccaggaaaacgtcactcaccaaaa

SEQ ID NO: 37007 - DNA, 202 bp, Homo sapiens
  misc_feature 1..202: note = chr18:47087502-47087704
  misc_feature 1..202: note = hyper
  source 1..202: mol_type = genomic DNA
atgcttgatttcactcgccaaggagtgagtgctcatcggcagacactgggctctggccacgcgtcttagactccaaatctcggctcactggtccctttgaggaggtcgcctggtgttcccgtagccctccaccccaccgtaggagagcgcctgccacgagctccgcgcctcgctaagtgctttgctacgtgaactcttagtt

SEQ ID NO: 37008 - DNA, 67 bp, Homo sapiens
  misc_feature 1..67: note = chr18:47088061-47088128
  misc_feature 1..67: note = hyper
  source 1..67: mol_type = genomic DNA
tccttctccagggatcgcctccccagcggacgcagagtttcagggaaatgtccgcctccgccacttg

SEQ ID NO: 37009 - DNA, 125 bp, Homo sapiens
  misc_feature 1..125: note = chr18:47339606-47339731
  misc_feature 1..125: note = hyper
  source 1..125: mol_type = genomic DNA
aacaggaaattgcaccgaaatcgctgtcgctagcgccttacaagtaagggttttctccttaacccaaacaagcctttcgggctgggtttttatcacgtccgctccaaaaccgaggaggttgagtg

SEQ ID NO: 37010 - DNA, 339 bp, Homo sapiens
  misc_feature 1..339: note = chr18:47792640-47792979
  misc_feature 1..339: note = hyper
  source 1..339: mol_type = genomic DNA
gccaggcctggagtgcggagagatggagaaagctgtagggtctggcagacatatcctgtgcttaccacgatcaccactttgggggtggggcccttaacctcccgctgtacggtgccaaaccgctggctgtacattttcgagtccccttcgggacgggggcggcgtccgccgcgtttcccccaaccgtggcgacctgcgggacccgcttccgcgacgcagaagtctggttgccatggtgcgcctcgcgggattaggggccggtagaggtgggcgggtcgggcggaagtcggtctggtcaccatgggggccgcagacgcctgcactcgggacttcctcttc

SEQ ID NO: 37011 - DNA, 30 bp, Homo sapiens
  misc_feature 1..30: note = chr18:49866847-49866877
  misc_feature 1..30: note = hyper
  source 1..30: mol_type = genomic DNA
tcctctggctccctccgtttccttgagtta

SEQ ID NO: 37012 - DNA, 127 bp, Homo sapiens
  misc_feature 1..127: note = chr18:49867272-49867399
  misc_feature 1..127: note = hyper
  source 1..127: mol_type = genomic DNA
cgtcgcacccccttccgtaccccacttcccttctcatttcatttggcgagtagtagaattggggtgggggatagcaagagatttggcgcttgcgctgcccccatttgcgcaccgatgataaaagata

SEQ ID NO: 37013 - DNA, 95 bp, Homo sapiens
  misc_feature 1..95: note = chr18:52989060-52989155
  misc_feature 1..95: note = hyper
  source 1..95: mol_type = genomic DNA
attttcccatatggccgggccaagcgtggtgaatatgcaaagcaggaagagaccattcctggcgggcgggggaggccgcggcgctgctgtcagac

SEQ ID NO: 37014 - DNA, 125 bp, Homo sapiens
  misc_feature 1..125: note = chr18:52989156-52989281
  misc_feature 1..125: note = hyper
  source 1..125: mol_type = genomic DNA
ctcaactttgcgcagcggagctggaaggcagcccggccctgatggagctcgaaatcctaatgcatacgcgagatcgattcaacttttccgaggggtttttattagttcctcgaataatgccgatt

SEQ ID NO: 37015 - DNA, 181 bp, Homo sapiens
  misc_feature 1..181: note = chr18:52989772-52989953
  misc_feature 1..181: note = hyper
  source 1..181: mol_type = genomic DNA
aacagagtagcagtgcggcccgccccgggctccgcgggccccggcctccccggagctggtgggaagcgcggccgcccatgaacttcacctcgccccgccgcagacagccgcatgggcccagagcctacggaggggctggggcgctgctcccctcgctggcgctgggcgccccaagggcgca

SEQ ID NO: 37016 - DNA, 1404 bp, Homo sapiens
  misc_feature 1..1404: note = chr18:53254613-53256017
  misc_feature 1..1404: note = hyper
  source 1..1404: mol_type = genomic DNA
gtatttccaaagagacgatcaaactggtaacatccactataaaaccaaatcagggaaagaaaaaaaaaaagccgctcttcagcgcatcattttatgcaacaggaggtagagcgagaaatgaatggatcacagagaaaagagaaactactgagaacgatccgatctcaactttccccccaccctgcaccccacccccctcgcacactcacactcgcacacgcacacacactcgcacacaccactcccctccgcttttcaaagtagctatcaagaaattaaagatgagcgtctctggagtgaaaacacgtccaaagggggaggggtggggtgacagggttggggggagcggagtggagggtcgggtcctctaattgtccagcaccctaatttgtgaaagaaaggggttataaaaattaaagtcaggcccctggcaaagtcctcggtccctccgagggggcatcaaggggaggggcgggggggctggcggcgagggggagggaagcggcgggaggggaaggggtgtctcttctgggagcgccgggcgccgggagcccgcggcgcgggaggcgcggagccgcgtgcggggccgccgagcccgaaccccgcgccgccgggcgcctccgccccgccgagccccgcaggcgccggtacctaccgcccgcgcgcgagaaggggctctccgtgcaccgccggcgccgaggcggcgttcatgtctaaccgccgccgccaccgccgccgcctgctcctgcgcccgctcccgcgcctgctgcctccccgccgccgccgccgccgccgccactacagatccgcagacacacagccaagatccctgactcttaacaccaactctcttctccggggaggggaggggacggagggaaggggggagggggaaacacgccgaggcgcacggaattgcaagttcagcaaagaaatgggtgggggggctccggcggggagacgcgacttgctccgggtcgggcaggctaggatgcatccccctcgcacccaccccgaggggaaaaaaaaaaaatctcaacacctcccccgcctcgccaaaaaatacaaacgaaaattcatcgagcacctcatttttcctcagatcgtcagttacaatctgaagcctgaacagttcagtttttgcccgttgcatccctcggaggcactttgaaatttattcgagtttacatcccctcacttctttctttctcttactctcgttccctctcactcacacatccacacacggcaaagcaagtttatactaggctgcaaatacacgtgatgcaaaaagactttgccaagaggaacaatatttttctttttcgtctataaatcaagccacattttcctggggagattttcgtttcggtagttttgcgttgggggcgaaatctgaattgc

SEQ ID NO: 37017 - DNA, 380 bp, Homo sapiens
  misc_feature 1..380: note = chr18:53256942-53257322
  misc_feature 1..380: note = hyper
  source 1..380: mol_type = genomic DNA
caccatggactcccccgtggagtcacattgataataataggtttccctgaaagatacattgtaatccattcacatccgggaactgcgggcttataaagagaaggagctgcggccgcggctgctcctccagacaatgactgggaaggggcggggcgggagcaggcgaccatagagtggtaaacagagcgcctagagaggcggccaagatggcggtgctggtcgaccacgcctcctccgggagcggaggcgggtggctgttctcgggtaggcgtcgcgcgtggggcggcactgtgggagttcccgaggccgaggtcgttcgcaggccccatttccctgcgctcttattcgtgttgccgcttcttggccgtccttgctctttg

SEQ ID NO: 37018 - DNA, 609 bp, Homo sapiens; identical to SEQ ID NO: 1338
  misc_feature 1..609: note = chr18:53446866-53447475
  misc_feature 1..609: note = hyper
  source 1..609: mol_type = genomic DNA

SEQ ID NO: 37019 - DNA, 57 bp, Homo sapiens; identical to SEQ ID NO: 1339
  misc_feature 1..57: note = chr18:53447798-53447855
  misc_feature 1..57: note = hyper
  source 1..57: mol_type = genomic DNA

SEQ ID NO: 37020 - DNA, 255 bp, Homo sapiens
  misc_feature 1..255: note = chr18:54789032-54789287
  misc_feature 1..255: note = hyper
  source 1..255: mol_type = genomic DNA
ctgggagtgcatgtgcgttgctgagcgtggcctgagcccggtcagcggccgggcgccggtggcagcccccggtcccgcggcgaccccggcccaggaaggagcccggtagggggtgcgctttccctggcctcccgaggcgggatcggggccgggctccactcggtgagaggatcctgccagccagctgggtgaaagacccacagaaatcccgaactggctgcaagatgcattggtagctggcgcctttagtcgggt

SEQ ID NO: 37021 - DNA, 123 bp, Homo sapiens
  misc_feature 1..123: note = chr18:55019653-55019776
  misc_feature 1..123: note = hyper
  source 1..123: mol_type = genomic DNA
atcctgtgcttagatcgaactgtaacattattccaatcacatttatcttgcaggcggcggaggagatggcagcctcgctggaaacgcgcgggggagcctgagccggcggccggggacgcacgg

SEQ ID NO: 37022 - DNA, 260 bp, Homo sapiens
  misc_feature 1..260: note = chr18:55020439-55020699
  misc_feature 1..260: note = hyper
  source 1..260: mol_type = genomic DNA
aaagcccctagaagccgctgtccaaatcgatgtgattgcatttctcgtattcttcctcagcatcccttccctcatttcagaaatgggggttgggggaggctttcaggagggtgagggtggagggaaagacggtgtgtttgttcgggagggggcggcgagcagagatggacaggcgtgaggggagcgccctccccgcgccctgtccgcagactccgcgggccgggcccggggcggtgctggcggtttaatggcgcaggcgc

SEQ ID NO: 37023 - DNA, 141 bp, Homo sapiens; identical to SEQ ID NO: 4552
  misc_feature 1..141: note = chr18:55020804-55020945
  misc_feature 1..141: note = hyper
  source 1..141: mol_type = genomic DNA

SEQ ID NO: 37024 - DNA, 431 bp, Homo sapiens
  misc_feature 1..431: note = chr18:55020965-55021396
  misc_feature 1..431: note = hyper
  source 1..431: mol_type = genomic DNA
cgagagcccccgccccgctctgtgaccccgggaactctcccagcagggcctcctgacgggcaggtggcaactacaaagtgccacctgtggtccaagctgggaccgaggcgaggaacccagaggagcctcgcctggaccgaggagcggagtaggccggcggcccccgggggtccccagccaagttataggaagtgaaatcggacgtgggtttgggaaggaagaggttaaggcaggaaccacccccagactttccctgggtctccggtttcctctgccctttctccaaaaacaattctatggggctgcaaaggcgtagcgggtcaggctggcggggcggccgctgtccgcggtgctgattccctggtcctcgcagcgccgcgggctccagccctgcgcccggcgtgcgccctgctctccgcatgacggccatt

SEQ ID NO: 37025 - DNA, 33 bp, Homo sapiens
  misc_feature 1..33: note = chr18:55103381-55103414
  misc_feature 1..33: note = hyper
  source 1..33: mol_type = genomic DNA
gcaacacctacaccacgctgacaccgctccagc

SEQ ID NO: 37026 - DNA, 303 bp, Homo sapiens
  misc_feature 1..303: note = chr18:55104869-55105172
  misc_feature 1..303: note = hyper
  source 1..303: mol_type = genomic DNA
tgtcactacctacagcgagggcagggtgtaaggttgagaaggtcacattcaccgctttgggaggacgtgggagaagagactgaggtggaaagcgctttgccttgctcaccggccgtccttgccccggtcccagcgtttgctgggatttgccaggatttgccggggctccgggagaccctgagcactcgcaggaagaggtgctgagaaattaaaaattcaggttagttaatgcatccctgccgccggctgcaggctccgcctttgcattaagcgggcgctgattgtgcgcgcctggcgaccgcg

SEQ ID NO: 37027 - DNA, 597 bp, Homo sapiens
  misc_feature 1..597: note = chr18:55105464-55106061
  misc_feature 1..597: note = hyper
  source 1..597: mol_type = genomic DNA
aatgtccaggtcccccgctgggaaggacacactataccctatggcaagccagggtgggcgacttcccatggatcgggtggaggggggtatctttcaggatcggcgggcggtctaggggaacaattcgtggtggcgatgatttgcatagcgcgggtcttgggatgcgcgcggttccgagccagcctcgcacagctcgcttccggagctgcgagctcaggtttccacccccgatcccccgggctttcctcgcaccgctgagcccagcttgtggggtgcactcgaccaacgcccgacagggctggggaatgtgacaggcagcaggttcacccgggcttggggagggggagtttccgctttgacagcattttcctttgccgtctgctggtggattcctattcccagtcggtaatcgccccgcagtgttgatctaagaaggtaaagaaaactaggtttccctgcaaagagcctcccccaaatcggcggactccggatactttgagtggatttagaaatttatgtaatctttctcctttagtttatttttcatcctctcctacagttttctctgatttgctgttggttcggggcaagataaag

SEQ ID NO: 37028 - DNA, 342 bp, Homo sapiens
  misc_feature 1..342: note = chr18:56887076-56887418
  misc_feature 1..342: note = hyper
  source 1..342: mol_type = genomic DNA
agctaaggctggaggcgccggcgagcctggagagggaggagttcactaaattgtgttggatggaaggcgtcgaggaccggaggaattaatccgatgtggggaaggcggacggggctacgaggaaaaaagagggggcaatgtacactcagccttttcatcactcggcggggagatggatggttttccggaccgggcgtcccagcgccccggttagctatagggagacgtcagagcgctctggtccgcgatagaagagccccccagcccccccgcccgggcttccatataaagtaggggccctagtggaggccgcagcagtagcaccagcggctgcggcggcgg

SEQ ID NO: 37029 - DNA, 46 bp, Homo sapiens; identical to SEQ ID NO: 13078
  misc_feature 1..46: note = chr18:56887753-56887799
  misc_feature 1..46: note = hyper
  source 1..46: mol_type = genomic DNA

SEQ ID NO: 37030 - DNA, 170 bp, Homo sapiens
  misc_feature 1..170: note = chr18:56888013-56888183
  misc_feature 1..170: note = hyper
  source 1..170: mol_type = genomic DNA
aataatcttggggagcgttgtcccttgaaagcatctcagaaccctggtccagctcggtggcctcaacagcgactggcatgggctgaaatctaagctgcgcctatgctccccgcaaagccacaggtgtggggacctagggtgcagcgctcccgccccgggtttcacatctg

SEQ ID NO: 37031 - DNA, 232 bp, Homo sapiens
  misc_feature 1..232: note = chr18:56888404-56888636
  misc_feature 1..232: note = hyper
  source 1..232: mol_type = genomic DNA
ttcgccctttcccctcgctcctttcccattccctctgcaacaggtcctgctctctaggcaccggcttggaggctccctcgccatggcccctagaacccaggcggagaggacggccgcgctgcgggtgcggagggcgcctgcgggtggggtcaggattccgccctgcgcgcactcgctgctttcgctcagctgggaggcaggaagcgcctggcagcctcggctcacccagcat

SEQ ID NO: 37032 - DNA, 177 bp, Homo sapiens
  misc_feature 1..177: note = chr18:56931541-56931718
  misc_feature 1..177: note = hyper
  source 1..177: mol_type = genomic DNA
atcaaatgctgaagccgccaaggctctcgggtccgcacccagggtgccctcaccgtacgccgaccgtgtggggaacacgctctctggaagctgagttgggggtcctggtctctcttgccgccccctgcccccagcttcctgcgcgtgggctccagcggtctccgcaaagactttcag

SEQ ID NO: 37033 - DNA, 83 bp, Homo sapiens
  misc_feature 1..83: note = chr18:56932322-56932405
  misc_feature 1..83: note = hyper
  source 1..83: mol_type = genomic DNA
gacacgccgccctcgcgcgcagagactgctccagaaagggaaaaacgcaaaacttaaaacgcggtggctcacgcctgtaatcc

SEQ ID NO: 37034 - DNA, 22 bp, Homo sapiens
  misc_feature 1..22: note = chr18:56932645-56932667
  misc_feature 1..22: note = hyper
  source 1..22: mol_type = genomic DNA
gccagagcgacaccctgtctct

SEQ ID NO: 37035 - DNA, 136 bp, Homo sapiens
  misc_feature 1..136: note = chr18:56932957-56933093
  misc_feature 1..136: note = hyper
  source 1..136: mol_type = genomic DNA
gctttcctcctagggcgggtcagagcagacgtcgtcggggtttgggaaggaagcatctccagacctcttgaattgactgaagccaatagaggcttgccctaggtctgtgcttggagcagcacggtgccttttcttc

SEQ ID NO: 37036 - DNA, 483 bp, Homo sapiens
  misc_feature 1..483: note = chr18:56934924-56935407
  misc_feature 1..483: note = hyper
  source 1..483: mol_type = genomic DNA
agcttccagtgtcaacggtggatatcgagcacgctcaggcgggagtccgggactctccttcttcagagagtctcaggagattgtgaagcgggctgagatttcgagattccttcctcgccctagagccggcgccaaagaactgcagatactgtccagggcacgcccgcaagaactagctctcggggcggtggcgtagggcgctccaggacactctccgagcgcggcacctcaccagacgcgccttttaccgaactctgggttggcgagtgtggagcgagttggggaggttagagagtctcgcggctccgaaaaggaaaagcatctctttgcctcagttcttgtaccgctggtgatcaaccttgggtgttagggactggcaccgaaccggagatctgcttggtgaactgagaggagtccttaggagagcggggacgccaggggccgggggacacttcgctctcgccctagggaaggtggtcttga

SEQ ID NO: 37037 - DNA, 140 bp, Homo sapiens
  misc_feature 1..140: note = chr18:56935479-56935619
  misc_feature 1..140: note = hyper
  source 1..140: mol_type = genomic DNA
cgcgctagcatctgagccttagccccatccactccggaccccaagcgcgcacgccggctccagggaagggcgcctctggtctaggccgccgaagcgttcggaatggggacgattctctgctgcagcgaagtgtccctaga

SEQ ID NO: 37038 - DNA, 147 bp, Homo sapiens
  misc_feature 1..147: note = chr18:56935927-56936074
  misc_feature 1..147: note = hyper
  source 1..147: mol_type = genomic DNA
aggctccagcgcctgcggtgatgggagcggcgtggccagcggggcccggcagcctgttgccctccagctgcagggctgaggtccgcgaagtgcgttgaggcggccagagggcctctcctcaggcctgaaagtcgcccttctccccgt

SEQ ID NO: 37039 - DNA, 383 bp, Homo sapiens
  misc_feature 1..383: note = chr18:56936333-56936716
  misc_feature 1..383: note = hyper
  source 1..383: mol_type = genomic DNA
gcgggaacttgtccccgaagccgggcccgcacgggtaggagggcggcggcggcgcgagaggttgcaggccggggcccaacggcggggagttcaggaagggcggaggcggcggcggtggcgtgtagctggcaggcaggctctgcgccggcggcccgaagcccggcaggctctgcagcgccgtggcgcccccgcccggcagcggcggcccgagccaggactccagcggcagcgcgcccccagccggcccgccaccgctgcccgggcccgccccgaggggcgacagcgtcgcggagggcggggagcggctgaaggagaggaggggcgagtcctgcagcttcatggaggacacttccagcttctcctgccgccgccacttagcccgt

SEQ ID NO: 37040 - DNA, 279 bp, Homo sapiens
  misc_feature 1..279: note = chr18:56939373-56939652
  misc_feature 1..279: note = hyper
  source 1..279: mol_type = genomic DNA
ccccaaaggggagctcgtactacaaactggaacagactgcttgaagggcgatgcacagggaacatcgaagatctgtgcctctcccttgagactctgggcatgccaagtcgaggaaggacagtaataaatgcatggacacccgtgaattccgagaagcattggctgcaatttgggcctcgggccctcccagatcccagttcctcaacctgggcgctttacctggacccggacctctggtaggttgaccttgccggccagctcctcgcggctgtacacgtc

SEQ ID NO: 37041 - DNA, 408 bp, Homo sapiens; identical to SEQ ID NO: 1341
  misc_feature 1..408: note = chr18:56939763-56940171
  misc_feature 1..408: note = hyper
  source 1..408: mol_type = genomic DNA

SEQ ID NO: 37042 - DNA, 680 bp, Homo sapiens; identical to SEQ ID NO: 1342
  misc_feature 1..680: note = chr18:56940565-56941245
  misc_feature 1..680: note = hyper
  source 1..680: mol_type = genomic DNA

SEQ ID NO: 37043 - DNA, 632 bp, Homo sapiens
  misc_feature 1..632: note = chr18:56941557-56942189
  misc_feature 1..632: note = hyper
  source 1..632: mol_type = genomic DNA
gggccaaggagatggcccagagctggctggggaaggaccttctcccggggaagaggcctctcgcctccccgagggttcaggagtaattggcttgcagttctttctcctttggaccccctcgaggcttccgtggcccacagtgactgatcggccacttggaaagatgattggatagggtgagtgtgtttcacctccagcagcgcggatggacaatggcgctgtgaacgtctcacccctcaaatctgaggcgagacccgaggcgagcgcttggccttccctgaactggtggcctgaaccgtgaattaaaatgctttcctataaaagctcaaggacctagaggacaatatccctaaaatctccttttcagtaggcgctctgatctccacagcaggggtgtcttctttatcccgcttgcgttcagacaagcgtttgctgcgtccctttagagggcaaggcaaccgtcgagggccacgtcgtgggcatcaaacaaattgggaaaggccagggccgttggcctggtggagtttaacgtccagtctggaagacaagacaaaggaagagggaaaacacacatcctcagatccccaacctttaaattggtgttagaaggatgtttgcggaggacaagtcaa

SEQ ID NO: 37044 - DNA, 30 bp, Homo sapiens
  misc_feature 1..30: note = chr18:57069866-57069896
  misc_feature 1..30: note = hyper
  source 1..30: mol_type = genomic DNA
agaggtgactgaggccgctgtgctgaggct

SEQ ID NO: 37045 - DNA, 37 bp, Homo sapiens; identical to SEQ ID NO: 13089
  misc_feature 1..37: note = chr18:57363706-57363743
  misc_feature 1..37: note = hyper
  source 1..37: mol_type = genomic DNA

SEQ ID NO: 37046 - DNA, 532 bp, Homo sapiens
  misc_feature 1..532: note = chr18:57364448-57364980
  misc_feature 1..532: note = hyper
  source 1..532: mol_type = genomic DNA
gccgtcctccggctcctctctgtaggtccacgtgtgtcccaacgccaggagcagcagcagcggacccaggctcctgcccagctggcccctggcagctcctccccggctcggaggcggcggcaccatcagggaagctcccggcttcttcccagcgccgagctccgtccggaccaagcgtcctgctcctccgcggccgccgccgccttccctcttcccggcagggggcgccggagagcaggggcgtttgcaccacctgcacggggagcaggggtccggaatattatggggctggggggaaaatgaggctaggagttggggtatcggatgcaaacccagcagagaagcaggtaaagggggtacctgcggtgtccggctggcgcgagggccctgaggttcaagttgtctcgtcgggacgttcacgtccgattgacagacttgctggactcggcttggggctgcgccctcgcctcttccctctccctcctctgggagaagcgcgcagggtggggaaagcgggcggttgtttgcattt

SEQ ID NO: 37047 - DNA, 515 bp, Homo sapiens; identical to SEQ ID NO: 4560
  misc_feature 1..515: note = chr18:59000829-59001344
  misc_feature 1..515: note = hyper
  source 1..515: mol_type = genomic DNA

SEQ ID NO: 37048 - DNA, 208 bp, Homo sapiens; identical to SEQ ID NO: 4561
  misc_feature 1..208: note = chr18:59001497-59001705
  misc_feature 1..208: note = hyper
  source 1..208: mol_type = genomic DNA

SEQ ID NO: 37049 - DNA, 263 bp, Homo sapiens
  misc_feature 1..263: note = chr18:60263660-60263923
  misc_feature 1..263: note = hyper
  source 1..263: mol_type = genomic DNA
cgctcccgcgcgggtcagcaattcgaagtccgccccagacccctgggccttcgggcgcccccggaagccgcagggactgtcggactgagcggcccccttgcttgggtgggagctggggtgcagagaggggctgttctcgcacccttccgctgcatcggtccccgggccagtgcggagactcctctttgcgtttccaaatcacttttacgaacaaaagaggcgcccagaggatatcaccccgggcgcaccgccctccaggggtg

SEQ ID NO: 37050 - DNA, 135 bp, Homo sapiens
  misc_feature 1..135: note = chr18:60264219-60264354
  misc_feature 1..135: note = hyper
  source 1..135: mol_type = genomic DNA
agtgcgtccagcatacgtgggtgtggacgaaggtgagaaagggttctttccaaaggttcaagacagagcttccagtaccttctaaatccccagaaagtagtggtctagaagttgcttctccgcttcccaacgcca

SEQ ID NO: 37051 - DNA, 140 bp, Homo sapiens; identical to SEQ ID NO: 13094
  misc_feature 1..140: note = chr18:60985592-60985732
  misc_feature 1..140: note = hyper
  source 1..140: mol_type = genomic DNA

SEQ ID NO: 37052 - DNA, 21 bp, Homo sapiens
  misc_feature 1..21: note = chr18:60985733-60985754
  misc_feature 1..21: note = hyper
  source 1..21: mol_type = genomic DNA
tgtgcccgggctgggaggaga

SEQ ID NO: 37053 - DNA, 137 bp, Homo sapiens
  misc_feature 1..137: note = chr18:63417736-63417873
  misc_feature 1..137: note = hyper
  source 1..137: mol_type = genomic DNA
ttctttattttcctgcgaaggaatccatctgtacagatccgccaggcgggaggtggaggagggtgcgcgagggtgcgcgcgtgtgtgtgtgcgcgcgtggcggccgagcggctccgtcttcgcgttcttttccagta

SEQ ID NO: 37054 - DNA, 399 bp, Homo sapiens
  misc_feature 1..399: note = chr18:67067494-67067893
  misc_feature 1..399: note = hyper
  source 1..399: mol_type = genomic DNA
ttcagtcctagttaacgaaaacgcatgcataaatcaaccactcgggtcggtcggtcttctccactccttcagcagaggacgtcggcgcccggctgcctcgcccgcctgcctgtctctaggctgcgggaggattagacacatgcgcacgattggtctctttgtgtgcaccaggaagggtctggcgtcgatttacacttcctaacggggcagagacctggaacggccgcgagtgcttgggaataaaaatgtactgtaaacaaggccaatgaaataagtgtctcgctcccgctggccttccgcgttggaagtgtccccactgccctttccccgctgcacagcttgcgagtggagatttagagcccgggaatgaggcgccgtgtccttaggaatctcgcgccc

SEQ ID NO: 37055 - DNA, 57 bp, Homo sapiens
  misc_feature 1..57: note = chr18:67067894-67067951
  misc_feature 1..57: note = hyper
  source 1..57: mol_type = genomic DNA
gggagcgctgagggaccggggagccgggtggggagcgggcctcggggcgcccggcgg

SEQ ID NO: 37056 - DNA, 113 bp, Homo sapiens
  misc_feature 1..113: note = chr18:67068698-67068811
  misc_feature 1..113: note = hyper
  source 1..113: mol_type = genomic DNA
ggggcccacacctgccggggggctccgcagacggacctggggactccaggagcgcctgagtccccatcctcgagtgcaccgggctgtcttcgaccgtgcggggaagtcagtag

SEQ ID NO: 37057 - DNA, 214 bp, Homo sapiens
  misc_feature 1..214: note = chr18:67069032-67069246
  misc_feature 1..214: note = hyper
  source 1..214: mol_type = genomic DNA
ggctgtagtttagggcgccttcgccgtggccgagggcggctcccgcgccccgcaagtgctcccctacccggggacccgcgcccgcgtgcaggcaggtgtgtgccccgcgcccgcccgcggtcactgctccgtgacggcaaagttgatggagacctttccctattcttgagagatgcgctgcctggcttgggagggaaaccgtgtagaacccaag

SEQ ID NO: 37058 - DNA, 238 bp, Homo sapiens; identical to SEQ ID NO: 13098
  misc_feature 1..238: note = chr18:70209148-70209386
  misc_feature 1..238: note = hyper
  source 1..238: mol_type = genomic DNA

SEQ ID NO: 37059 - DNA, 440 bp, Homo sapiens
  misc_feature 1..440: note = chr18:70209493-70209933
  misc_feature 1..440: note = hyper
  source 1..440: mol_type = genomic DNA
gggggccttcgtccccggctctgacgttcaaggccagggtcgttctcagaagaaaggcgcctgtgaacctgtcagggcacagaacccaaagccttacaccgggaggtggagccaccgggaagaagggggactgggagcaggtgcctgcggctcgggggttctccccgaaggccacccccttggtcccgcgcacagccaacccgctttccgatctggcacaacaggtccggagaaacgcccgggcgcagctggcagcgcatccctgaaggctcccgagcagcgcgcggggctgcgacgagggagggggccgcgcttctgcaggtcctcgtcgctaagacgggccccgagaccctcagaaggcgtcaccgccaccccgcccattcaccagcgcggagggggctaagacgcaggcaaagaaaaacctacgaatgcttgccttc

SEQ ID NO: 37060 - DNA, 89 bp, Homo sapiens
  misc_feature 1..89: note = chr18:70210724-70210813
  misc_feature 1..89: note = hyper
  source 1..89: mol_type = genomic DNA
aacatccatgctgggcgagctccgctgtccgcgaagttgctctgcttagagaaaatgaggcgagtgggagctgtcgggaggaggacacg

SEQ ID NO: 37061 - DNA, 258 bp, Homo sapiens
  misc_feature 1..258: note = chr18:70211036-70211294
  misc_feature 1..258: note = hyper
  source 1..258: mol_type = genomic DNA
cccctcgagctcccgcgctcagcgcgtccgcagcgcggctccctcgcgggtcccctcggccccgcagccccgccagtctccagagggcatagccgagcgctgccgcctccctaggactcggaaccttccctgctcccaagcccgccgcaccctccaacgccccggtcctgctcacccaaacgcccagagcaaaatactcccagacgtctcttttgaaaattagacacccttaaaagcaccggtcgcttctcttctttt

SEQ ID NO: 37062 - DNA, 185 bp, Homo sapiens
  misc_feature 1..185: note = chr18:70211499-70211684
  misc_feature 1..185: note = hyper
  source 1..185: mol_type = genomic DNA
gaactgtccggttcccgcagggctagaagaggggcctccggcccgggtctgtgtgtctgctcctctggacctcggactggtggagcggctggcgcttgcgcttatttattaaattgcggtgtccgcgctcgctcaaaggacccggggagacgcgctgggtttcccagctgcgcctggagctcggc

SEQ ID NO: 37063 - DNA, 100 bp, Homo sapiens
  misc_feature 1..100: note = chr18:70534216-70534316
  misc_feature 1..100: note = hyper
  source 1..100: mol_type = genomic DNA
catccctgaactgcacgctatcctccacccccggggggttcctgcgcactgaaagaccgttctccggcaggttttgggatccggcgacggctgaccgcgc

SEQ ID NO: 37064 - DNA, 36 bp, Homo sapiens
  misc_feature 1..36: note = chr18:70534427-70534463
  misc_feature 1..36: note = hyper
  source 1..36: mol_type = genomic DNA
cgttcggccccgggaaaggggcgggagggctggctc

SEQ ID NO: 37065 - DNA, 335 bp, Homo sapiens
  misc_feature 1..335: note = chr18:70535220-70535555
  misc_feature 1..335: note = hyper
  source 1..335: mol_type = genomic DNA
cggaaagaggagcgggtgggtgggcgtctgggaggcgggctggagggcggtgcaggggagcggggcggccggggggggggccggggggcggggaagggagggaggagaaaggagccggaagagggcagagttaccaaatgggctccttagtcatggcttggggctccacgaccctcctggaagcccggagcctgggtgggatagcgaggctgcgcgcggccggcgccccggggctggtgcgcggcagaatggggccgcggcggcggcagcaaggacatcccagccgcgcggatctgggggaggggcggggagggggtgaggacccggctgggatc

SEQ ID NO: 37066 - DNA, 93 bp, Homo sapiens
  misc_feature 1..93: note = chr18:70535575-70535668
  misc_feature 1..93: note = hyper
  source 1..93: mol_type = genomic DNA
cgcagagagaggatgcagccgcaaatcccgagccggatcctcgtgccggacggaaggcgtggaagcgggaggggccttcgtgtgaaaatccct

SEQ ID NO: 37067 - DNA, 175 bp, Homo sapiens
  misc_feature 1..175: note = chr18:70535909-70536084
  misc_feature 1..175: note = hyper
  source 1..175: mol_type = genomic DNA
ttactcctgcaaagacgcgggcttcttgcaattgagccccccacctcgaggtatttaaaaccaccccaaggcacacacggacccccgttcccccgcgccacttcctcctacaggctcgcgcggcgcgttaaagtctgggagacacgagttgcggggaaacagcaccggaagagcc

SEQ ID NO: 37068 - DNA, 838 bp, Homo sapiens; identical to SEQ ID NO: 13106
  misc_feature 1..838: note = chr18:70536187-70537025
  misc_feature 1..838: note = hyper
  source 1..838: mol_type = genomic DNA

SEQ ID NO: 37069 - DNA, 33 bp, Homo sapiens; identical to SEQ ID NO: 13107
  misc_feature 1..33: note = chr18:70537332-70537365
  misc_feature 1..33: note = hyper
  source 1..33: mol_type = genomic DNA

SEQ ID NO: 37070 - DNA, 378 bp, Homo sapiens
  misc_feature 1..378: note = chr18:72123440-72123818
  misc_feature 1..378: note = hyper
  source 1..378: mol_type = genomic DNA
ctgaagtctcctttgcgcctgaaagaacggctagccaagtttccaatcaactaaaggtgggcgtttcattcatatgatgtgagcccagcgtacgcagcagtctgcaaaatgcgaaatgtttctttctctccctaattctctggctcagctgaggagctgctgggtgcgagctttcgggccctcccaggttaggaggcgcctgtcgaggaccgggacccgggatcctcccggtcccagccgcctccgcagcgctctctgctcgcccgagcgcacactgcgtcggttcccacagaccgcgaccgcggagagcctgggctctggagcgcaggggggccggggtcagaccagccctccgcatgggctcggtgagataggggg

SEQ ID NO: 37071 - DNA, 15 bp, Homo sapiens
  misc_feature 1..15: note = chr18:72124175-72124190
  misc_feature 1..15: note = hyper
  source 1..15: mol_type = genomic DNA
aacccatgtccccgg

SEQ ID NO: 37072 - DNA, 48 bp, Homo sapiens; identical to SEQ ID NO: 13109
  misc_feature 1..48: note = chr18:72124237-72124285
  misc_feature 1..48: note = hyper
  source 1..48: mol_type = genomic DNA

SEQ ID NO: 37073 - DNA, 143 bp, Homo sapiens
  misc_feature 1..143: note = chr18:73167786-73167929
  misc_feature 1..143: note = hyper
  source 1..143: mol_type = genomic DNA
gtcccgcccgggttgcgcgcagcgggggccgcgtgatggatgggccgggccgggcacccgggaacccgcgagcgcggggctgggctctgggctgcgtccgggggccccgacttggttattgatcggcccaagcgcaggagaac

SEQ ID NO: 37074 - DNA, 32 bp, Homo sapiens
  misc_feature 1..32: note = chr18:73628017-73628049
  misc_feature 1..32: note = hyper
  source 1..32: mol_type = genomic DNA
aaaggccagttaggccgcgaagctttgccaaa

SEQ ID NO: 37075 - DNA, 114 bp, Homo sapiens
  misc_feature 1..114: note = chr18:73628494-73628608
  misc_feature 1..114: note = hyper
  source 1..114: mol_type = genomic DNA
ggaggagcctgagggccaagagggccggcgcgcggtgggcgcggcctgcggggatgccgggctctacggagcagcgcggggtcccgaagccccctaccgcgaggcctcagaagg

SEQ ID NO: 37076 - DNA, 273 bp, Homo sapiens
  misc_feature 1..273: note = chr18:74961385-74961658
  misc_feature 1..273: note = hyper
  source 1..273: mol_type = genomic DNA
tcctctgtagcaggccgcggggtgagggtgggattaggcggccaattttacaaaactccagggagcgtcgccagcctcgatttcctggggttattcctgggagagaggcgttctcacggacagccaccctggggaggaggaggaggaaaggcactaatggatgaggaggcccgcgcacccctccgcctcccaccccggcgcgccctggaacgccctggagcgcgcccggcttccctcgcccgcctggcccgcggcatccggcagccccgcctt

SEQ ID NO: 37077 - DNA, 88 bp, Homo sapiens
  misc_feature 1..88: note = chr18:74961868-74961956
  misc_feature 1..88: note = hyper
  source 1..88: mol_type = genomic DNA
tcccaaaagagctctcgccctgtggacgactcggaatccctggaaaagccgggagggagtcggaggcgccagcccactggggaggtgg

SEQ ID NO: 37078 - DNA, 153 bp, Homo sapiens
  misc_feature 1..153: note = chr18:74962018-74962171
  misc_feature 1..153: note = hyper
  source 1..153: mol_type = genomic DNA
cgctgggcagtgcggggaagcgccgcgggaaggagcggctccgagcaacaggtgcagcacgcagcccctccgggagccagggaaaaccgccggcgaagatctggagcggtaaggcggagagaagggtctttccacctgcgcggctgcagccgg

SEQ ID NO: 37079 - skipped

SEQ ID NO: 37080 - DNA, 250 bp, Homo sapiens
  misc_feature 1..250: note = chr18:74962692-74962942
  misc_feature 1..250: note = hyper
  source 1..250: mol_type = genomic DNA
gggcaagccgcggagcaccaccaacctgttcatcctcaacctgagcatcgccgacctggcctacctgctcttctgcatccccttccaggccaccgtgtacgcgctgcccacctgggtgctgggcgccttcatctgcaagttcatccactacttcttcaccgtgtccatgctggtgagcatcttcaccctggccgcgatgtccgtggaccgctacgtggccatcgtgcactcgcggcgctcctcctccctc

SEQ ID NO: 37081 - DNA, 316 bp, Homo sapiens
  misc_feature 1..316: note = chr18:74963230-74963546
  misc_feature 1..316: note = hyper
  source 1..316: mol_type = genomic DNA
ggggtctcagtgtcccgcggccctgccggagccttggcggcagcctggccccggtggtccccactctggcggcgctggtacggatctgtgcagagaggcttcctggccgctgctggagcgtgccattggcttgcgcaagaaagttacttggagtctgagagatgctggggaaagtttgcagttcacttcgcatggtccagtagaaccagtttctcctcccctccccttcctcggccctgcggcccttcaacgcccccaggttgcctgggcggtaggtaggcgggcgctgccgcatccttcccggtacagcaaaccc

SEQ ID NO: 37082 - DNA, 70 bp, Homo sapiens
  misc_feature 1..70: note = chr18:74963720-74963790
  misc_feature 1..70: note = hyper
  source 1..70: mol_type = genomic DNA
cggggcggcccctctcccccggggtgcgcagtttgccctcgctccgaaggctttgcgcacaccgggctct

SEQ ID NO: 37083 - DNA, 246 bp, Homo sapiens
  misc_feature 1..246: note = chr18:75362850-75363096
  misc_feature 1..246: note = hyper
  source 1..246: mol_type = genomic DNA
caggaccctgcaggacgcgggccgaggctcccagctgccggccatgccctcggctcctctcccgacacgcgccagcactgccccctgctggcctcccgggagcactgcccgctgccgcggcgggaggagacccgggaagaagccgggaccgcgagcagctggacgctttctccctggggctcagccacacattttagtcacagttacagactacgggggatttgaagccttcgctttagtttttat

SEQ ID NO: 37084 - DNA, 462 bp, Homo sapiens
  misc_feature 1..462: note = chr18:75611969-75612431
  misc_feature 1..462: note = hyper
  source 1..462: mol_type = genomic DNA
tctccagctgagccccgaggaggccgctgctccgtgtcctggactctgagcaaagccgcgggccttagaccctccccagcctcaggcgagccccagtgccgacacctgctaagagacggtgcattgcgggctaaacccgcagacactgagcggggacgccacttccgacggcgtaaggcacctaaagtagccacagaggaaactgggggtgcaggagctgcaggagccccggcggcctgcaggggcggtggcgcggcgctgggcgcgcggccgctagatggcagcgcagccccggcccggcccgcgggaggcggccacgcgcgggggacgcggggcgcggcgcgctgagcgcgggtgccgaggctggagggcgcggccgggctcccgagtcctccctccgcggcatccttgtctccaccctcaaatgtcctgcaagccaggagcctccgtaggaaccgctgc

SEQ ID NO: 37085 - DNA, 332 bp, Homo sapiens
  misc_feature 1..332: note = chr18:77153184-77153516
  misc_feature 1..332: note = hyper
  source 1..332: mol_type = genomic DNA
attaagtgattttcccgagcaggaagtggcatctggcctgcggttcagtagggggaggaaagggtgggcgcacctgcccctggctggcgcacctgccaggtagccccacgcggcaccgcgtgtgccgagcgcccctgaggatggaaagccccacgcggggcaggtggcacccaccctccgaagacgggacgggatggagcgttgagcttcggggcagctccggcccggcccgcgctggagacgcccgcatctgccaggatggcgtctcatagccctggtgctcacacatgacgccaggaagccccagcaacagtgaccgcccaggctctaga

SEQ ID NO: 37086 - DNA, 166 bp, Homo sapiens
  misc_feature 1..166: note = chr18:77159847-77160013
  misc_feature 1..166: note = hyper
  source 1..166: mol_type = genomic DNA
tagcgttggcggcctcgggctgggacctccccactcccggggctccgcagggcgcgcacgtggcgctcgggggtcaccgttgcagccgctttcccgaggaggcccggattgaaaacttctttaaaaaaaaaacttaaaaaaaaaattccgtcgccctgggcgcagc

SEQ ID NO: 37087 - DNA, 132 bp, Homo sapiens
  misc_feature 1..132: note = chr18:77547916-77548048
  misc_feature 1..132: note = hyper
  source 1..132: mol_type = genomic DNA
cagccagggaggagacgccggggtccgcgccgcggggcgggcgcttccccggacccgggggaggcgggacgcaggcgaaggccgccccgggagagcggggtcccgggagagcggggtcccggctgtggggga

SEQ ID NO: 37088 - DNA, 258 bp, Homo sapiens; identical to SEQ ID NO: 1347
  misc_feature 1..258: note = chr18:77548351-77548609
  misc_feature 1..258: note = hyper
  source 1..258: mol_type = genomic DNA

SEQ ID NO: 37089 - skipped

SEQ ID NO: 37090 - DNA, 485 bp, Homo sapiens
  misc_feature 1..485: note = chr18:77557912-77558397
  misc_feature 1..485: note = hyper
  source 1..485: mol_type = genomic DNA
cgccggagtccgggatgccggctccagagacgccgcgctccgccccgaggaggccgccggccgggtaagcggagcccggagctcgcggagtctggaccgcaggtaaagttgagcgcgccgtggggccgggggtggggggtccgcggcgaaggagccggggccgcagtgggcggtggggcggggggcgcgggctcctgtctgatggttccgcgcgcagcttcttctccgggtgcgcggtgcgcgcgggcgcgggagggtcgaaggggaccttggaatccccctgttcgggccaagggggcgggggcggctcggggccgggcggggctggtgcctccccctcccgctcagcgcccagagtccgggagtcgaggggggcgtcgggccggaggcgctcgccggtctggccgcgccgcgcgcgtggatggaggtctcggccgcggatcgccccgtctattcgcgctggtcctgcgggagcccgggtgagc

SEQ ID NO: 37091 - DNA, 726 bp, Homo sapiens; identical to SEQ ID NO: 1349
  misc_feature 1..726: note = chr18:77558416-77559142
  misc_feature 1..726: note = hyper
  source 1..726: mol_type = genomic DNA

SEQ ID NO: 37092 - DNA, 74 bp, Homo sapiens
  misc_feature 1..74: note = chr18:78005084-78005158
  misc_feature 1..74: note = hyper
  source 1..74: mol_type = genomic DNA
tccccctccgcggggcgccccattcattagccaggagactgggcgcagggccgccggggcgggcggggggctta

SEQ ID NO: 37093 - DNA, 78 bp, Homo sapiens
  misc_feature 1..78: note = chr19:496464-496542
  misc_feature 1..78: note = hyper
  source 1..78: mol_type = genomic DNA
gcttccccgcggcctcgggacagaggggactgagcatggatttcggactggccctcctgctggcggggcttctggggc

SEQ ID NO: 37094 - DNA, 268 bp, Homo sapiens
  misc_feature 1..268: note = chr19:591263-591531
  misc_feature 1..268: note = hyper
  source 1..268: mol_type = genomic DNA
agagcgagaccggcgcgtgtccccgtgggctgtgtgtgaacaggggcccgtgaccgcggcggggttcccggggcgcgagcctgtggccggagaggtgtgtctccaggagtgtgtttgcgtggtggtcgcgggcgtgtgcgcctccggtgggtttattttggtgggacgtgtggtttgtgtgtgttgggaccaggtggcgggcgtgcgcgtgtacgcccggggccggtgtgcaccggtgggcagtagtgtgagccgcaggcaggtctca

SEQ ID NO: 37095 - DNA, 89 bp, Homo sapiens
  misc_feature 1..89: note = chr19:639980-640069
  misc_feature 1..89: note = hyper
  source 1..89: mol_type = genomic DNA
acgccgcgggaaccccgagcgcgtcgcggggaccgcgcagctacccgcacctggagggcgacgtgcgctggcggcgcctcttctcctcc

SEQ ID NO: 37096 - DNA, 103 bp, Homo sapiens
  misc_feature 1..103: note = chr19:661158-661261
  misc_feature 1..103: note = hyper
  source 1..103: mol_type = genomic DNA
ccgtgtccaaggccacggggcgaggaagtggctccaccacaccaggatccagtcctgtgcgggctctaggagcagctaaatgtgcagccgagtcaaggcagtg

SEQ ID NO: 37097 - DNA, 61 bp, Homo sapiens
  misc_feature 1..61: note = chr19:822595-822656
  misc_feature 1..61: note = hyper
  source 1..61: mol_type = genomic DNA
ggcgggattgcggggcgcggggctgggggctgggggctgcgggatgcgggcagggccctcg

SEQ ID NO: 37098 - DNA, 87 bp, Homo sapiens
  misc_feature 1..87: note = chr19:1401710-1401797
  misc_feature 1..87: note = hyper
  source 1..87: mol_type = genomic DNA
ggcaccgcagccccgcgcccggggacgcgaacctgcaggctggggactggaatccccgccttgccgcttacgcgccatagattcctc

SEQ ID NO: 37099 - DNA, 197 bp, Homo sapiens
  misc_feature 1..197: note = chr19:1446633-1446830
  misc_feature 1..197: note = hyper
  source 1..197: mol_type = genomic DNA
gacccctcctcactgcgccgacgcggaggctgcgccagctggggcggcgggggcggctgcgggggcatcctgcggaggctcggccctgcgcagggtgggggcctgggccacgccctgcgcttctttgggcctcagtttccccttctgggcgcgagcgtatggcctgctttgacgttcgccgccgctgctgttcgtat

SEQ ID NO: 37100 - DNA, 359 bp, Homo sapiens
  misc_feature 1..359: note = chr19:1450073-1450432
  misc_feature 1..359: note = hyper
  source 1..359: mol_type = genomic DNA
attggctgtctcacccgcatccctcatcccgcatcctcccccgctcgcggtggtctcgcccagcgctaggagcggcagcgccgcctgcccaggcccggaccgggctttgtccgccccggagcccctgcccgcgccgcggagaccccggagcccgcgcgctccgaggccaccccgggccgggatttccggtggggcccgcggagccgcgcagagggaggaggccccagacccaggcgccccgccagcccagctgcacgtaagcgggtgtgtgtcctcggggaggagggcaggggcgcgacctccgcctcgcgtcgaggtttccatccctggctctcagcattgcccgtcagcacagactc

SEQ ID NO: 37101 - DNA, 77 bp, Homo sapiens
  misc_feature 1..77: note = chr19:1523753-1523830
  misc_feature 1..77: note = hyper
  source 1..77: mol_type = genomic DNA
gcccccaaccccccacgcgcgagagagcctcagtttcccgctcggtaaagcgggcgtatcagcggttcccagccagc

SEQ ID NO: 37102 - DNA, 107 bp, Homo sapiens
  misc_feature 1..107: note = chr19:1524442-1524549
  misc_feature 1..107: note = hyper
  source 1..107: mol_type = genomic DNA
cgtgtccgtgggttgcgtgtccggggtgtgggcgtgcggctcggcctcgggatgcgacgctgtgttgcccctgggtgtgtgtgcgagcctggcgagggtctgagtgt

SEQ ID NO: 37103 - DNA, 49 bp, Homo sapiens
  misc_feature 1..49: note = chr19:1718861-1718910
  misc_feature 1..49: note = hyper
  source 1..49: mol_type = genomic DNA
cgtgctgcggggtgccggggcgcagagcccgcggcgggagctgtcagcg

SEQ ID NO: 37104 - DNA, 30 bp, Homo sapiens; identical to SEQ ID NO: 13129
  misc_feature 1..30: note = chr19:1719137-1719167
  misc_feature 1..30: note = hyper
  source 1..30: mol_type = genomic DNA

SEQ ID NO: 37105 - DNA, 180 bp, Homo sapiens
  misc_feature 1..180: note = chr19:1725554-1725734
  misc_feature 1..180: note = hyper
  source 1..180: mol_type = genomic DNA
gggaggcgatgctgccgacgctattgctgccattactattacggagagatggggcggggcgggagcaccgggcccttcccggaagcccttcctgagcttattcagtgcctggggccgcggcgatcgatgacagctgggcgccggccgagccccctccgggccgcgcgggggcgcatgcgc

SEQ ID NO: 37106 - DNA, 61 bp, Homo sapiens
  misc_feature 1..61: note = chr19:1726021-1726082
  misc_feature 1..61: note = hyper
  source 1..61: mol_type = genomic DNA
ctcttatcttggggacgcacggttccagcggcggggggcgagggtacggctgggtgggggc

SEQ ID NO: 37107 - DNA, 415 bp, Homo sapiens
  misc_feature 1..415: note = chr19:1749776-1750191
  misc_feature 1..415: note = hyper
  source 1..415: mol_type = genomic DNA
ccagagctgcccgggcgccccgcaactgcgggcaggaaatccgggacgtcgggcccgccaggggcgaaaccccaaagtcgcgacacccggggtggggaggtcaggacgtccccacggccaacgtggaaccttcgggagccgcgcgctcagcctcgccgggacccccgccaggccgtaaaagcccagagtctccccccaaatctaaataaaatccccagaccccgcccgaacgaaggcggctggagtccagagggagaactcctgccacacactaggcaccggcggccgggatttggggcgcccgcaggtttcgggggccgggagtgggagcagagcggatctagggctgcggctgggcttgggtggggcgcgcattcattgccatcgtttagtaaaacctcgctttaataaaagc

SEQ ID NO: 37108 - DNA, 36 bp, Homo sapiens
  misc_feature 1..36: note = chr19:1752836-1752872
  misc_feature 1..36: note = hyper
  source 1..36: mol_type = genomic DNA
ggcctttggcaaccccgaggccgggcagcccattgt

SEQ ID NO: 37109 - DNA, 692 bp, Homo sapiens
  misc_feature 1..692: note = chr19:1753502-1754194
  misc_feature 1..692: note = hyper
  source 1..692: mol_type = genomic DNA
ccacatcctggtggccgcgctcgcagccgggccgggccgtgcgccgcgcagcctggcagcctcgcgcgcagccaccggggagcgggcgggagtcatgcagcggccttgagcactaggggccggcgctgaggagcgcgcgcggcgggagggcagccgagcatggagctgagcctggagagcctggggggcctgcacagcgtggcccacgcgcaggcgggcgagctgctgagcccgggccacgcgcgctcggcggcggcgcagcaccgcggcctggtggcgcccgggcgcccgggcctggtggccggcatggcgagcctgctggacggcggcggcggcggcggcggtgggggcgccgggggcgcgggcggcgcgggcagcgcgggcggcggcgcggacttccgcggggaactggcgggcccgctgcacccggcaatgggcatggcctgcgaggcgccgggcctgggcggcacctacacgacgctcacgcccctgcagcacctgccgccgctcgcggccgtggccgacaagttccaccagcacgcggcggccgcggccgtggccggggcgcacggcggccatccccacgcgcacccgcacccggcggccgcgccgcccccgccacccccgccgcagcgtctggcggccagcgtgagcggcagcttcaccctcatgcgcgacgagcgggcggcgct

SEQ ID NO: 37110 - DNA, 658 bp, Homo sapiens
  misc_feature 1..658: note = chr19:1754224-1754882
  misc_feature 1..658: note = hyper
  source 1..658: mol_type = genomic DNA
cggcaaggagctgcccgccatggggtcgccgctgtcgccgctgcccaacgcgctgccgcccgcgctgcacggcgccccgcagcccccgccgccgccaccacccccgccgctggccgcctacggcccgccaggccacctggctggggacaagctgctgccgcccgccgccttcgagccgcacgccgcgctgctgggacgcgcggaggacgcactggcccgcgggctgcccggaggcggcggcggcacaggcagcggcggagcgggcagcgggagcgccgcggggctgctggcgccgctgggcgggctggcggcggccggggcgcacgggccgcacgggggaggcggcggccccggcgggagcggcggcggccccagcgcgggcgcagcggccgaggagatcaacaccaaggaggtggcgcagcgcatcacggcggagctgaagcgctacagcatcccgcaggcaatcttcgcgcagcggatcctgtgtcgctctcagggcacgctctccgacctgctgcgcaaccccaagccgtggagcaagctcaaatccggccgcgagaccttccgcaggatgtggaagtggctgcaggagccagagttccagcgcatgtcggcgctgcgcttggcaggtaggagcgtggcgcgcagggccagaccc

SEQ ID NO: 37111 - DNA, 757 bp, Homo sapiens
  misc_feature 1..757: note = chr19:1757305-1758062
  misc_feature 1..757: note = hyper
  source 1..757: mol_type = genomic DNA
tggggaaacaggctccgtttgtgcctcgccttcctgacttgtgacaatgacaaacagtctcagctctgggagtctgggtttcctgtcgaggaagggagagttagaacagtcgccgtctcaggggtgcgtgggggaaccggaggggtgagcgcagctcctggcaccccgagcctcccgcagggcgctggggcgttgaggatgataaacccggaccacgctgcccgcctgctctctgccgggtccgctgcccacgccgtggccccgccgcgcggccccgcggccgcggggttcacgccgtcaaccttgcgcacctgtcgcgtctcaggtgccctgggggccgcgtctacaccaccggactccgcctggggcgtaagaggtggcgggggcgagggccgcggggtcactaggctccggcccaggcctttagttccggtcgctgcgcaaatgaaaagcggttaagtggcggcaaatcgcggcggttagggggagacggccggatgcgtccccatctccacctaacacggcgacgccccaacgctggtgctcggaaagggaactctgcccccgccccgcccccgcaccatttcaaccccgcagcagaggactcgccgccctttctactccggcatccccattccccgctccgcgagcaccgcgggcctccccaggcctcctccaaggagaactttgcgccccgggtctcccgtcgcgcttgcccggctcggggcgggccacgcgtttccgcaggtgccgagtg

SEQ ID NO: 37112 - DNA, 33 bp, Homo sapiens
  misc_feature 1..33: note = chr19:1758771-1758804
  misc_feature 1..33: note = hyper
  source 1..33: mol_type = genomic DNA
ggcgggcgggctcctcggcgggggtgggggcgg

SEQ ID NO: 37113 - DNA, 334 bp, Homo sapiens
  misc_feature 1..334: note = chr19:1762172-1762506
  misc_feature 1..334: note = hyper
  source 1..334: mol_type = genomic DNA
ccatctggagaccctcgtgctggctgctgggggtcctgcgtgccttccgcgcgcccccagctgcgcccgccagccctccaaccctcctgccctcctgccctcctgccctcctctctgggagtcgggacagaagctgctgggctctcctccctggagctggggctttgggaaggtcgagtagaccctcagtgagtgggatgcgcgagttggggacgctagttgcggggcagcaggggtccacgcatttccaagcgccctttcccgtccaaggacctgctggggggatgactgtgcctcagtttccatcacccagcaaacgccgtcccgcagcacc

SEQ ID NO: 37114 - DNA, 169 bp, Homo sapiens; identical to SEQ ID NO: 13138
  misc_feature 1..169: note = chr19:1762627-1762796
  misc_feature 1..169: note = hyper
  source 1..169: mol_type = genomic DNA

SEQ ID NO: 37115 - DNA, 30 bp, Homo sapiens
  misc_feature 1..30: note = chr19:1764269-1764299
  misc_feature 1..30: note = hyper
  source 1..30: mol_type = genomic DNA
gcccccaccccatggcggcccagcctccag

SEQ ID NO: 37116 - DNA, 300 bp, Homo sapiens
  misc_feature 1..300: note = chr19:1765665-1765965
  misc_feature 1..300: note = hyper
  source 1..300: mol_type = genomic DNA
tgactctcgggactgcggcccggtggggacacagggctctgggtcactgcgtccacttgataaaccaggaacctgatgtccagagaggccagggtgcgcgttcaaggccactcggcccgcagagcccacccgcgtccccatggctgcagtggtgaggggagcagggggaggcagagaggagcccaccctggggctgggcggacatggatgcgtaacccacaccgcaggcttctgcggggtgacacccagactcaccccaagaccctgcacaccctacagctctcacgtctcacgtccaca

SEQ ID NO: 37117 - DNA, 30 bp, Homo sapiens
  misc_feature 1..30: note = chr19:1768342-1768372
  misc_feature 1..30: note = hyper
  source 1..30: mol_type = genomic DNA
agtgagtgaggccagcgggggaggccagac

SEQ ID NO: 37118 - DNA, 230 bp, Homo sapiens
  misc_feature 1..230: note = chr19:1769737-1769967
  misc_feature 1..230: note = hyper
  source 1..230: mol_type = genomic DNA
cgcggtaaacagctccgactggatcgatctgggctgtgaggagctgtaattagattgaacgccgggaaggggggcagcagagcctctttttgctgcaatcgacaaaacgggaagttttttcagactctgcctggcccggcccctcccccagcctctgcctctggggtccccattaggcaccagattggagcctgggaggtggggtgggaaagggacgatatgcatcctac

SEQ ID NO: 37119 - DNA, 41 bp, Homo sapiens
  misc_feature 1..41: note = chr19:1775395-1775436
  misc_feature 1..41: note = hyper
  source 1..41: mol_type = genomic DNA
ggcccccgggggccccgccggcgccacggccactttctcca

SEQ ID NO: 37120 - DNA, 444 bp, Homo sapiens
  misc_feature 1..444: note = chr19:1776259-1776703
  misc_feature 1..444: note = hyper
  source 1..444: mol_type = genomic DNA
acctttaggcaccttcgtggagcgcaaggaaggacgcagctccggacacgggagaccacgcccaggctcccaggagaaggggacccggccggagaaggcgccgctggggccgcccggaggagcccctctgcacgggcccgtggagacgcttcctgcgtggaaccttctggaatccaccgcccccctttccgcccgcgtcagggtctgaactgggcttgcaggggggcagcggggttgaacgtggtgttggtttccactctcgccaaagagagaagacgccgaggaaggtggattccgcttgctccattttttgccaaaaatatttacaaatgggaagggtcggaaatgaagatgagcgcccccctcccaccccgcgctctcccccgctcctctcatctggtctgggtgacctccgagactggccggccgcgggatcccaggagc

SEQ ID NO: 37121 - DNA, 21 bp, Homo sapiens
  misc_feature 1..21: note = chr19:1776990-1777011
  misc_feature 1..21: note = hyper
  source 1..21: mol_type = genomic DNA
agtgccaccccttcccgaacc

SEQ ID NO: 37122 - DNA, 391 bp, Homo sapiens
  misc_feature 1..391: note = chr19:1856988-1857379
  misc_feature 1..391: note = hyper
  source 1..391: mol_type = genomic DNA
tgggaacacagctgccgcacgtagctcggcggcggcggcggggacatccgcagccccagccggccccgctcacgtggtcccactcccgccggggccagggggcccgggccagggtcgcctctccggcctgggtgcctgccagccccgccccgcgcttggagactgaggcgcgcacatgcgcacgtgggtggcggggcagggggtgcacgggctacccacccacgctgcgctgggcgaagcgcctctgcgaaatgccaggccctgcctcgcacacaatccactcgcagggaggagggtggggtgaacttgtgggggcccagagcgcgctgctcctagccagccgggcccccaggtgcacagccacccagctgctccgcgctacctggccgag

SEQ ID NO: 37123 - DNA, 100 bp, Homo sapiens
  misc_feature 1..100: note = chr19:2251135-2251235
  misc_feature 1..100: note = hyper
  source 1..100: mol_type = genomic DNA
accccttcctggagacgctcacgcgcctggtgcgggcgctgcgggtccccccggcccgggcctccgcgccgcgcctggccctggatccggacgcgctggc

SEQ ID NO: 37124 - DNA, 186 bp, Homo sapiens
  misc_feature 1..186: note = chr19:2251610-2251796
  misc_feature 1..186: note = hyper
  source 1..186: mol_type = genomic DNA
gggtcgggcacagcgcagcgcgggggccaccgccgccgacgggccgtgcgcgctgcgcgagctcagcgtagacctccgcgccgagcgctccgtactcatccccgagacctaccaggccaacaattgccagggcgtgtgcggctggcctcagtccgaccgcaacccgcgctacggcaaccacgtggt

SEQ ID NO: 37125 - DNA, 856 bp, Homo sapiens; identical to SEQ ID NO: 4572
  misc_feature 1..856: note = chr19:2252588-2253444
  misc_feature 1..856: note = hyper
  source 1..856: mol_type = genomic DNA

SEQ ID NO: 37126 - DNA, 40 bp, Homo sapiens
  misc_feature 1..40: note = chr19:2253696-2253736
  misc_feature 1..40: note = hyper
  source 1..40: mol_type = genomic DNA
cccagggcagctcctcgctcagggccgggggcggcggcgg

SEQ ID NO: 37127 - DNA, 435 bp, Homo sapiens
  misc_feature 1..435: note = chr19:2289837-2290272
  misc_feature 1..435: note = hyper
  source 1..435: mol_type = genomic DNA
tgaaaaacagtcctgcggttgggcgtctacaaaaaaaggggaagttctgcctggggagcgccgtgcagccgtccccttcccctccgggaaatgcataggtggacacgcgagcggccggcccgcgggggaggggaggggagggtccgccctggggacccctcagatcatcttcatgttgaacttgcgcgcgcctccctggcccgccgcggcggccggcccatccaccttgcggaaggagtactccaccgagaagttgtttttgtgctgcccgcggccgcggctccacacgaacagcagcacgaagcagaagaggaccacgcccaggaaggtgatgcagcccatggcggtggacaccaggatggtggtgaggtcgagcggcgcgcgcagggccgccagcgtctcgttgtgggcctcgcccggggtccggttggcggc

SEQ ID NO: 37128 - DNA, 238 bp, Homo sapiens; identical to SEQ ID NO: 4574
  misc_feature 1..238: note = chr19:2290630-2290868
  misc_feature 1..238: note = hyper
  source 1..238: mol_type = genomic DNA

SEQ ID NO: 37129 - DNA, 392 bp, Homo sapiens
  misc_feature 1..392: note = chr19:2302559-2302951
  misc_feature 1..392: note = hyper
  source 1..392: mol_type = genomic DNA
ccccagcaaggggcacgtcccaccaggcccggactgcccgtctgcccctgcagggcccctcgctctggtggcgggctcggtgagctctgctgcccggtctcgggagtctgggggagcgcggcgtcgacccctgtggagggaggactcgtgtttcaaggacagagcctcattaccatgcacgaccagccgcagctgaggccgcagaggcctttggcaggggggccgggccggcggcagggacggcgttggcggtggtggacgggagtgggggtctgtcctgaacaggtgggggtggtccctgtgctggcccccgccatgcgatcgcaccccaggactctcctcctcttcctaagccccagcatgtgcctggtgccgcgcgggtgctggaggca

SEQ ID NO: 37130 - DNA, 33 bp, Homo sapiens
  misc_feature 1..33: note = chr19:2308140-2308173
  misc_feature 1..33: note = hyper
  source 1..33: mol_type = genomic DNA
agccgccgccgccgccgccgccgccgccgccgc

SEQ ID NO: 37131 - DNA, 106 bp, Homo sapiens
  misc_feature 1..106: note = chr19:2478809-2478915
  misc_feature 1..106: note = hyper
  source 1..106: mol_type = genomic DNA
aactttttttatttccgcaaactaaaatcaacaagcagaaaaataccccaggaagtcggcctccgggccagccgggcttggcgcagtgctgcgttttgcctgtaaa

SEQ ID NO: 37132 - DNA, 30 bp, Homo sapiens
  misc_feature 1..30: note = chr19:2703070-2703100
  misc_feature 1..30: note = hyper
  source 1..30: mol_type = genomic DNA
ttataggctccctctcgtgggaccctccgc

SEQ ID NO: 37133 - DNA, 30 bp, Homo sapiens
  misc_feature 1..30: note = chr19:3244155-3244185
  misc_feature 1..30: note = hyper
  source 1..30: mol_type = genomic DNA
tgggccaagagatcacggaagccataagga

SEQ ID NO: 37134 - DNA, 30 bp, Homo sapiens
  misc_feature 1..30: note = chr19:3270512-3270542
  misc_feature 1..30: note = hyper
  source 1..30: mol_type = genomic DNA
agcgcgggcagggcccgcctgggcgtcggg

SEQ ID NO: 37135 - DNA, 205 bp, Homo sapiens
  misc_feature 1..205: note = chr19:3361138-3361343
  misc_feature 1..205: note = hyper
  source 1..205: mol_type = genomic DNA
ggctggaggttcgggcgcgaggtggcgccgggacgcgatcactcggcacgcagacgtcgctcgccaggggttgcgcttgcgcggggacctgccccgagaggggcggggcggcaggggttccccctccctgagaggccgtggaagtcccgaggggtgggtggttacagcagcacaggggttaggacgggcccgggaggtggctaag

SEQ ID NO: 37136 - DNA, 15 bp, Homo sapiens
  misc_feature 1..15: note = chr19:3585992-3586007
  misc_feature 1..15: note = hyper
  source 1..15: mol_type = genomic DNA
ggggccccctttgca

SEQ ID NO: 37137 - DNA, 240 bp, Homo sapiens
  misc_feature 1..240: note = chr19:3785596-3785836
  misc_feature 1..240: note = hyper
  source 1..240: mol_type = genomic DNA
ccacgtgtactcacacgcatacggatgcatgcacacgcacagaaacacacagggctcggacacagctgcgcgcagacaagcaaaggaccacgtccacgtggaaacaggtgtgcgcacacgtccccgcgcatccgcgcgcacaagcgctccacacctgggaacgtgcgcacctgtcccccgcccccggcacacacacagccgccccacactggaacacctgggcgccagcgccgggccact

SEQ ID NO: 37138 - DNA, 357 bp, Homo sapiens; identical to SEQ ID NO: 1351
  misc_feature 1..357: note = chr19:3785864-3786221
  misc_feature 1..357: note = hyper
  source 1..357: mol_type = genomic DNA

SEQ ID NO: 37139 - DNA, 103 bp, Homo sapiens
  misc_feature 1..103: note = chr19:3786583-3786686
  misc_feature 1..103: note = hyper
  source 1..103: mol_type = genomic DNA
gcgcggcggggaccgggggtgagggagagtgagctgcccgtccggggagataagcaaggcgccaagcccggactcccagaggacacttcgtactctgcaattc

SEQ ID NO: 37140 - DNA, 139 bp, Homo sapiens
  misc_feature 1..139: note = chr19:3821971-3822110
  misc_feature 1..139: note = hyper
  source 1..139: mol_type = genomic DNA
gttcgtcggatcacacgcgcggaagaggcccgaccacaggcctcccagcgcccgccgggccctagcacagcccggacgggtgtcggagctccccctgctggacgcacccggtactgcagccggtgccgccgccccctca

SEQ ID NO: 37141 - DNA, 157 bp, Homo sapiens
  misc_feature 1..157: note = chr19:3822134-3822291
  misc_feature 1..157: note = hyper
  source 1..157: mol_type = genomic DNA
cgttgaaactgcactcgcacagcttgcagtggaagcgaagcactcgcccttcgtcgctgaacacctgagacacagaacagccgcacgcgcaccaggcacgaggcggggtgggatgtgagatgctaccgctgccaggtcgcggcggagccttcctcct

SEQ ID NO: 37142 - DNA, 210 bp, Homo sapiens
  misc_feature 1..210: note = chr19:3868851-3869061
  misc_feature 1..210: note = hyper
  source 1..210: mol_type = genomic DNA
ggctgggactggggccgggccgggcgcacgcggcgggagaaggggtaggcggggtcccggccaggctgcaggggccgggactggcgggggctggcgcggcggggcagttacctgtactgcgggccgccgccctgcgcgaagtcgaaatactgactcgtcgccatcttggcgtcttccccgagcctggcggacccgcgacgtcacccgccc

SEQ ID NO: 37143 - DNA, 85 bp, Homo sapiens
  misc_feature 1..85: note = chr19:3869118-3869203
  misc_feature 1..85: note = hyper
  source 1..85: mol_type = genomic DNA
cgcgaagccctcaccttctcgcttccttctcttaggctagggagacaccgccccgcgaccacacctgccccgaggccccgcctcc

SEQ ID NO: 37144 - DNA, 304 bp, Homo sapiens
  misc_feature 1..304: note = chr19:3880484-3880788
  misc_feature 1..304: note = hyper
  source 1..304: mol_type = genomic DNA
tttaaatctctgatgcgccatcagaaaattatttctgcctctgcccctggcgtggctttcggagatgcttgtctgtcagccaatggggaggatcggattctggcagggggctgtgcttttccgtcaggccgccaccccccaccccctcctccctgcacacaaaagcagcataaattaaccgtcttcgggaagccgagcctctgccagccctgagctgggaagaagcagctacctcggaggcagggcgcgcaggcgggcggcgatgagagggggcgcagccgcagccccgcgctggggagcccac

SEQ ID NO: 37145 - DNA, 59 bp, Homo sapiens
  misc_feature 1..59: note = chr19:3881573-3881632
  misc_feature 1..59: note = hyper
  source 1..59: mol_type = genomic DNA
ggccgtccccaaatgcgaagccaggatctgagtgcaggagtgtccggggcccactgagg

SEQ ID NO: 37146 - DNA, 106 bp, Homo sapiens
  misc_feature 1..106: note = chr19:3933108-3933214
  misc_feature 1..106: note = hyper
  source 1..106: mol_type = genomic DNA
gacctcgttggaaaacgaagctccccgcagggtcccggcctctagggctgctgtgcgggcgggggtgggtgagttcgcttccttgacgccacgagaaccagtctta

SEQ ID NO: 37147 - DNA, 257 bp, Homo sapiens
  misc_feature 1..257: note = chr19:3933461-3933718
  misc_feature 1..257: note = hyper
  source 1..257: mol_type = genomic DNA
gctatttccattcggcggcgggaacaggtgccggcgcctccgccccatccccaggggccgcctcccccggggcggcctccaggctgccgagacctataaaggcgccaggttttctcaatgaagccgggacgcactccggagcgcactgcgtggtcgcaccctacccgggctgccttggaagtcgtccccgccgcccctccgcaccggcatgaagctcatcgtgggcatcggagggtgagcgccgggggacctggtgg

SEQ ID NO: 37148 - DNA, 81 bp, Homo sapiens
  misc_feature 1..81: note = chr19:4077899-4077980
  misc_feature 1..81: note = hyper
  source 1..81: mol_type = genomic DNA
gggagatcatggctgcggttctggtccagccagacctcctgggtttgttctttttttaagaaccaccgcaatttaaagagc

SEQ ID NO: 37149 - DNA, 197 bp, Homo sapiens
  misc_feature 1..197: note = chr19:4198002-4198199
  misc_feature 1..197: note = hyper
  source 1..197: mol_type = genomic DNA
tgaaagtgtgagtggcgagagccctgccggccgcgtggaggtgcgaggctgcggacgtcgcgggcccggaggcacctgcgcgcccttggccgactcggaggaggtggagatggacgcccgcgggtcccctggagatgcagccggcggcctgcgctggtgagggagccgggcccccggcgccgcgtcctcctcatcct

SEQ ID NO: 37150 - DNA, 92 bp, Homo sapiens
  misc_feature 1..92: note = chr19:4279567-4279659
  misc_feature 1..92: note = hyper
  source 1..92: mol_type = genomic DNA
cgctgcgctgagaacccaggcgtccgggctgggagaggggccgggagcgtccgcaggtggcgctggcccggatctcccgaccccaggaaggg

SEQ ID NO: 37151 - DNA, 70 bp, Homo sapiens; identical to SEQ ID NO: 13159
  misc_feature 1..70: note = chr19:4304487-4304557
  misc_feature 1..70: note = hyper
  source 1..70: mol_type = genomic DNA

SEQ ID NO: 37152 - DNA, 35 bp, Homo sapiens
  misc_feature 1..35: note = chr19:4380549-4380584
  misc_feature 1..35: note = hyper
  source 1..35: mol_type = genomic DNA
gaagatgtgggagggcgtcacgggtgggtatctgg

SEQ ID NO: 37153 - DNA, 32 bp, Homo sapiens
  misc_feature 1..32: note = chr19:4597471-4597503
  misc_feature 1..32: note = hyper
  source 1..32: mol_type = genomic DNA
agaatttctgcccatcgcgcacttccatgctg

SEQ ID NO: 37154 - DNA, 189 bp, Homo sapiens
  misc_feature 1..189: note = chr19:5292630-5292819
  misc_feature 1..189: note = hyper
  source 1..189: mol_type = genomic DNA
tggggtccacaggcccgagaggagcggaaacaaatggatggaggtaaacttcctgcgattttcgggggtggctaagagcagggattcctgccatgcaccccccaccgctacctgccccctctgcggtcctgttgcctcctccgccttctgcgaagtccccagtcacagctcccccgggctggcagcgaa

SEQ ID NO: 37155 - DNA, 71 bp, Homo sapiens; identical to SEQ ID NO: 13161
  misc_feature 1..71: note = chr19:5293067-5293138
  misc_feature 1..71: note = hyper
  source 1..71: mol_type = genomic DNA

SEQ ID NO: 37156 - DNA, 27 bp, Homo sapiens
  misc_feature 1..27: note = chr19:5293155-5293182
  misc_feature 1..27: note = hyper
  source 1..27: mol_type = genomic DNA
cggctcggagatcgggcccaggccccg

SEQ ID NO: 37157 - DNA, 175 bp, Homo sapiens
  misc_feature 1..175: note = chr19:5293462-5293637
  misc_feature 1..175: note = hyper
  source 1..175: mol_type = genomic DNA
ccatgaaacactgagcgaaggggcgccccagggagggcacgacccaagacccctccctcccgaagacgtctcacggggagcctctacactgctcctcgcttccccagctctgatcgtagccatggcaacgcatgaggaggctggatgccggacagggcggcggagggctccccaa

SEQ ID NO: 37158 - DNA, 122 bp, Homo sapiens
  misc_feature 1..122: note = chr19:5294020-5294142
  misc_feature 1..122: note = hyper
  source 1..122: mol_type = genomic DNA
tccaccggaggggcccggaatgtagaagcccagcgggacctgggggtctggggacgggacaggggcagaggccgggatggagacccaagggctcccgcgtctgctcccatccctggaaaaaa

SEQ ID NO: 37159 - DNA, 30 bp, Homo sapiens; identical to SEQ ID NO: 13164
  misc_feature 1..30: note = chr19:5338746-5338776
  misc_feature 1..30: note = hyper
  source 1..30: mol_type = genomic DNA

SEQ ID NO: 37160 - DNA, 106 bp, Homo sapiens
  misc_feature 1..106: note = chr19:5339037-5339143
  misc_feature 1..106: note = hyper
  source 1..106: mol_type = genomic DNA
tcttcctgcctcctccggcttctaggtatcatccctgctgctcagccgggactccgacacctcggacacccgcttcactagccgcggctgccgggatgtgttttta

SEQ ID NO: 37161 - DNA, 30 bp, Homo sapiens
  misc_feature 1..30: note = chr19:5339394-5339424
  misc_feature 1..30: note = hyper
  source 1..30: mol_type = genomic DNA
ggaaagagggtcaaccgaagaaggaggtcc

SEQ ID NO: 37162 - DNA, 352 bp, Homo sapiens
  misc_feature 1..352: note = chr19:5340451-5340803
  misc_feature 1..352: note = hyper
  source 1..352: mol_type = genomic DNA
cccggccctgtccctcggggcattgtccgggcgcagctaccggggcgcagcggctgggcgtgcaactggctgcagccgagcatcctccgagcacaatggccgtgcaggcttccccggcacaaagccggcgcgctgcccactcggctgcctccgagaccccccttggagcgcctgcatttttttttcctctaatccatgattttatttttttttttggctttacctggaggctggctgggctgggctcccccggctctgccccgcttcacatcgtggctgttgcatgggatccgagcggagcccgagcgccagcggctcgcggcgtgcgcgcgccggccgggctgccgggcgg

SEQ ID NO: 37163 - DNA, 38 bp, Homo sapiens
  misc_feature 1..38: note = chr19:5436741-5436779
  misc_feature 1..38: note = hyper
  source 1..38: mol_type = genomic DNA
acccctcccgggtcccgggagctcgcgccctgctcccg

SEQ ID NO: 37164 - DNA, 214 bp, Homo sapiens; identical to SEQ ID NO: 13167
  misc_feature 1..214: note = chr19:5437029-5437243
  misc_feature 1..214: note = hyper
  source 1..214: mol_type = genomic DNA

SEQ ID NO: 37165 - DNA, 63 bp, Homo sapiens
  misc_feature 1..63: note = chr19:5567596-5567659
  misc_feature 1..63: note = hyper
  source 1..63: mol_type = genomic DNA
ggcgcccgcctcccccgccgctctccaggggtccccggccgccgcccccgccccaccccaccc

SEQ ID NO: 37166 - DNA, 432 bp, Homo sapiens
  misc_feature 1..432: note = chr19:5827883-5828315
  misc_feature 1..432: note = hyper
  source 1..432: mol_type = genomic DNA
gggggcgcggccttgcgggctgcgcgagctggaggtgcgcgtgagcgagctgggcctgggctacgcgtccgacgagacggtgctgttccgctactgcgcaggcgcctgcgaggctgccgcgcgcgtctacgacctcgggctgcgacgactgcgccagcggcggcgcctgcggcgggagcgggtgcgcgcgcagccctgctgccgcccgacggcctacgaggacgaggtgtccttcctggacgcgcacagccgctaccacacggtgcacgagctgtcggcgcgcgagtgcgcctgcgtgtgaccctacctcactcggccggcgcggcggccactccccccgcctcgacggcaccactggccggccccgcgaaagactgcgcgtgcgtagagcacgccggcgcggccccgggactctcgcgataactgtactga

SEQ ID NO: 37167 - DNA, 30 bp, Homo sapiens
  misc_feature 1..30: note = chr19:5962276-5962306
  misc_feature 1..30: note = hyper
  source 1..30: mol_type = genomic DNA
gaagctgagggcagacgcttcaggagaaaa

SEQ ID NO: 37168 - DNA, 56 bp, Homo sapiens
  misc_feature 1..56: note = chr19:6393996-6394052
  misc_feature 1..56: note = hyper
  source 1..56: mol_type = genomic DNA
aactgcgcatgctcacggcgcaaccattcattgctccacttcgcaaatactccagc

SEQ ID NO: 37169 - DNA, 44 bp, Homo sapiens
  misc_feature 1..44: note = chr19:6501870-6501914
  misc_feature 1..44: note = hyper
  source 1..44: mol_type = genomic DNA
gcccgggggaggcaccggggctctttgtgcgtgaggaggggaca

SEQ ID NO: 37170 - DNA, 53 bp, Homo sapiens
  misc_feature 1..53: note = chr19:6502724-6502777
  misc_feature 1..53: note = hyper
  source 1..53: mol_type = genomic DNA
tatttagacctcattcgccagaatccttgcagtaaccgcgagccctcccagtg

SEQ ID NO: 37171 - DNA, 45 bp, Homo sapiens
  misc_feature 1..45: note = chr19:6531154-6531199
  misc_feature 1..45: note = hyper
  source 1..45: mol_type = genomic DNA
gctgctgctgctgctcgctgccgcctgcgccgtcttcctcgcctg

SEQ ID NO: 37172 - DNA, 498 bp, Homo sapiens
  misc_feature 1..498: note = chr19:6590325-6590823
  misc_feature 1..498: note = hyper
  source 1..498: mol_type = genomic DNA
gcaggtctgaaccagcggggaacgtgaagtcgagaccttcaaaagaacttcttcgtttcccgaatcgttttcctggatgtcactgggcgcgagagcaccgcgcgcagcggactctctacgctgcaaaggcgcccggcgcggtccccaaagggacccctcccccacccggagcgagtggctggggccatcccgtcctaggaggccccaggaagcccccacgcccagccttgtgaagcccccagcagcctctgagtcagcctgccgggggaacaccagagccgagtcatcttccatttccatgtgtgcctacctttcccatcccgggatctccctgtacctcctggcagggctgcctgtctcgtagcccctacaccgggcagcctggtccccgcctcgcctccctgttctggtctctgtctctgccctaccagatcttcctctctggcctctttgtacccatctcattctgtcttttcggtcacgcgcctctctatgttt

SEQ ID NO: 37173 - DNA, 123 bp, Homo sapiens
  misc_feature 1..123: note = chr19:7197100-7197223
  misc_feature 1..123: note = hyper
  source 1..123: mol_type = genomic DNA
aacttttgacagcttcgtggtcagcagcgacgaccgcaggagcgcgtgtccttgaagcggggaagcgccccttttccttgcctgacaataccgccccacacgcgatgacgcctttggaataga

SEQ ID NO: 37174 - DNA, 270 bp, Homo sapiens
  misc_feature 1..270: note = chr19:7565964-7566234
  misc_feature 1..270: note = hyper
  source 1..270: mol_type = genomic DNA
tcccgccgccatccacgccgccgtgggagctgctgcaagcgcaggcgcgggaacgcacgctcgccatgcaggccggcaacctgcacctgcacgaggacgcgcacgccgggatcggcctctccaacgcgcacgccgcctacggctggcccgagctgccggcgcgcacccgagagcggatccgcggcgcgcgcctcatcttcgaccgcgactccctgcctcctggcgaccgcgacaagttgcgcatcccgcccaccacgcaccaggcgctct

SEQ ID NO: 37175 - DNA, 335 bp, Homo sapiens; identical to SEQ ID NO: 13172
  misc_feature 1..335: note = chr19:7794909-7795244
  misc_feature 1..335: note = hyper
  source 1..335: mol_type = genomic DNA

SEQ ID NO: 37176 - DNA, 152 bp, Homo sapiens
  misc_feature 1..152: note = chr19:7795540-7795692
  misc_feature 1..152: note = hyper
  source 1..152: mol_type = genomic DNA
gacggggtgcatgatcggggtcgggggtcagcactcaggacggggtcggggtcgggggacgcggccagggctcagggccggggtcgcgtcgggccctcaccgcgctcacgcagttcccgcagggcgctctcctgctccatcagcttcgcctg

SEQ ID NO: 37177 - DNA, 50 bp, Homo sapiens
  misc_feature 1..50: note = chr19:7795734-7795784
  misc_feature 1..50: note = hyper
  source 1..50: mol_type = genomic DNA
cgtccccgagcctgggagccgcagggtgagaggggcgagggcggcgagga

SEQ ID NO: 37178 - DNA, 486 bp, Homo sapiens
  misc_feature 1..486: note = chr19:7852985-7853471
  misc_feature 1..486: note = hyper
  source 1..486: mol_type = genomic DNA
tgtacatctttgggccgtttgcagtcacgcgtgtgcacatggcgtgcacgtatgtgtgcgagtccccacgcgtttgtctcccatcggcgtgtgtgcacatagtgtgcgctatatgcctgcctgcccgcccgctctgtggtcccgagtcgggggaccccgcaccccccgggcaagggaaggatttccgagtccctggccttgcctgcaggagcctctctccgcagcctccacggagcgcgcggcgctgctcggctgccaggacctgctgaggacaaacggtgtgtgcagagccgggcgcctgggcgcccggggcgtgtgcggcgggagcgtctgagaccccagagatggagtcctgggtgcgtgggggccctgtggtccctgagtctggccacggggtgtggaagggagtcccctgagtcctcccaagtgacccggcgggcatgcgttttgggatgggggtcgttccagcctcgaagcagacggcgg

SEQ ID NO: 37179 - DNA, 60 bp, Homo sapiens; identical to SEQ ID NO: 13177
  misc_feature 1..60: note = chr19:7853543-7853603
  misc_feature 1..60: note = hyper
  source 1..60: mol_type = genomic DNA

SEQ ID NO: 37180 - DNA, 110 bp, Homo sapiens
  misc_feature 1..110: note = chr19:7853873-7853983
  misc_feature 1..110: note = hyper
  source 1..110: mol_type = genomic DNA
actgatcatgcaccccgtcctgaccctgacgctgcactctgaccttgactgccactcctagcgccggccacacccggaccctgcccaggtgtaaccgtccttgaccctgt

SEQ ID NO: 37181 - DNA, 30 bp, Homo sapiens
  misc_feature 1..30: note = chr19:7926920-7926950
  misc_feature 1..30: note = hyper
  source 1..30: mol_type = genomic DNA
cgccggcgggcagagcgccccctagggcca

SEQ ID NO: 37182 - DNA, 95 bp, Homo sapiens
  misc_feature 1..95: note = chr19:7927441-7927536
  misc_feature 1..95: note = hyper
  source 1..95: mol_type = genomic DNA
ccctgcccgtggcaccgcccccggacgcgcccctacatgaggccccgcccccaatccgcctctgccggcgtcctgcctcccgatctgcccctgcc

SEQ ID NO: 37183 - DNA, 302 bp, Homo sapiens
  misc_feature 1..302: note = chr19:8115235-8115537
  misc_feature 1..302: note = hyper
  source 1..302: mol_type = genomic DNA
aagtctgggtaacaccgtcttggccgcggcccgcgggttgggaaggtagggggcagtgagccgtagcggagaggctggccccagcccgccacgccgcttccccacgctcgcagccacgcggagccgcgtcctggtccagcctcacccacccagagcaagaggcggaggaactggaacagcgccccggcccgtgggctgccactggccgcagcaacgggacgggtgagagcacctgcccccgacgcgtcttaactgctctggtggggcggggctgaccgtgcaagccccgccccagtctaagc

SEQ ID NO: 37184 - DNA, 96 bp, Homo sapiens
  misc_feature 1..96: note = chr19:8428705-8428801
  misc_feature 1..96: note = hyper
  source 1..96: mol_type = genomic DNA
cctcaagcgtgcgccctctccgccactgggtaaggcgggggcggaatagggggcttgcaatttcacactagaggcgggcaccgtgggggaaagaag

SEQ ID NO: 37185 - DNA, 126 bp, Homo sapiens
  misc_feature 1..126: note = chr19:8429231-8429357
  misc_feature 1..126: note = hyper
  source 1..126: mol_type = genomic DNA
agccctgatgctctgcgccgccaccgccgtgctactgagcgctcagggcggacccgtgcagtccaagtcgccgcgctttgcgtcctgggacgagatgaatgtcctggcgcacggactcctgcagct

SEQ ID NO: 37186 - DNA, 145 bp, Homo sapiens
  misc_feature 1..145: note = chr19:9434811-9434956
  misc_feature 1..145: note = hyper
  source 1..145: mol_type = genomic DNA
tggtcctagcctttgcgcgtgcgcggcgtgtctgcgtgggcgcatgcgcataacggccgccatcttaacagcgcgttcccgttggcgtctgaggtaagtttttgtttctgggcggcgttcggtggtgtcccggtgcagccacgcg

SEQ ID NO: 37187 - DNA, 118 bp, Homo sapiens; identical to SEQ ID NO: 1354
  misc_feature 1..118: note = chr19:9473938-9474056
  misc_feature 1..118: note = hyper
  source 1..118: mol_type = genomic DNA

SEQ ID NO: 37188 - DNA, 56 bp, Homo sapiens
  misc_feature 1..56: note = chr19:9517735-9517791
  misc_feature 1..56: note = hyper
  source 1..56: mol_type = genomic DNA
tacggcattcacttccgtttccgggagcgcacttccgtttccaggcatgagggcaa

SEQ ID NO: 37189 - DNA, 106 bp, Homo sapiens
  misc_feature 1..106: note = chr19:9517879-9517985
  misc_feature 1..106: note = hyper
  source 1..106: mol_type = genomic DNA
cgactttccaaagctagtagagagatcccagcgtcccccgggaaaggcagaaggggcggggcgataccaagacggagacaatggggcggggcgatgccctggaggc

SEQ ID NO: 37190 - DNA, 122 bp, Homo sapiens
  misc_feature 1..122: note = chr19:9608931-9609053
  misc_feature 1..122: note = hyper
  source 1..122: mol_type = genomic DNA
tttaaggcctcagaacgcttggacacttttgaagacgggaacacacggctgaaaacagccctcggacgcgcccatactgcacttcccacccggctcctctaggggaccgaaggtcccaatgg

SEQ ID NO: 37191 - DNA, 57 bp, Homo sapiens
  misc_feature 1..57: note = chr19:9609379-9609436
  misc_feature 1..57: note = hyper
  source 1..57: mol_type = genomic DNA
attctagtttccctccgcgtgggtgcggaggtatcaaggggtcggctcagtgcctgg

SEQ ID NO: 37192 - DNA, 405 bp, Homo sapiens
  misc_feature 1..405: note = chr19:9903623-9904028
  misc_feature 1..405: note = hyper
  source 1..405: mol_type = genomic DNA
tggtgcaggggaaaccgttggttcagctgcggttcctgggaagggggtgccgctctgatcacgcgcacttctgattcccctctcggggctcggaagcggctgagggctctggacccggtctccgaggcgtgaggcggtgggagggtcggcggccgcgtcctccacgaccctggggagaagtcccagtttccgcgcagccgacaacggttggaccccgtccctccggcttcactgggcaccgtgggggcagaacccggcggcggcttggggtgggggcgggaccacgatggagggagtctgttgggcgggacctcgaaatgcctctgctcgctttcctctgcattcatgcggcttgtacgaggatgcgctgtttcctggtggtttgttatacggcagtagataact

SEQ ID NO: 37193 - DNA, 191 bp, Homo sapiens
  misc_feature 1..191: note = chr19:10024331-10024522
  misc_feature 1..191: note = hyper
  source 1..191: mol_type = genomic DNA
gtcccttctctggcccgccgcggggcgctcggtccctcgacacccaggcgccccgggggggcgtgggggagggggcacgagcgcgagctgcggggcagggggtccgggacggggtgagggggggctcggggacgcgggctgcggctcggcgcgcctggcgggctcctcttataaagcgccggctcgggccc

SEQ ID NO: 37194 - DNA, 55 bp, Homo sapiens
  misc_feature 1..55: note = chr19:10121131-10121186
  misc_feature 1..55: note = hyper
  source 1..55: mol_type = genomic DNA
cggtgcagtcactcgcggcggccgctcctctcagggtccgcgggaaactgcccga

SEQ ID NO: 37195 - DNA, 64 bp, Homo sapiens
  misc_feature 1..64: note = chr19:10197697-10197761
  misc_feature 1..64: note = hyper
  source 1..64: mol_type = genomic DNA
cacacgggagtggggcgctccatcgtgtacggtgaggctgcaggggtcccgggcctggtgcggg

SEQ ID NO: 37196 - DNA, 118 bp, Homo sapiens
  misc_feature 1..118: note = chr19:10347133-10347251
  misc_feature 1..118: note = hyper
  source 1..118: mol_type = genomic DNA
ggtcagccaagggagcgctacagaggactggaaaacgctggaggcctggacttcctgatggtcttggtgggggtcaggaggagagcttggcctaccccggtggcggggggcggggggc

SEQ ID NO: 37197 - DNA, 30 bp, Homo sapiens
  misc_feature 1..30: note = chr19:10397660-10397690
  misc_feature 1..30: note = hyper
  source 1..30: mol_type = genomic DNA
cggggccccttagtccgggctttttgccat

SEQ ID NO: 37198 - DNA, 392 bp, Homo sapiens
  misc_feature 1..392: note = chr19:10398074-10398466
  misc_feature 1..392: note = hyper
  source 1..392: mol_type = genomic DNA
cgcctacagtgagggacaggggctcggtcccggctggggtgaggggagggggctggaagaggtgggggaagggtagttgacagtcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcg

SEQ ID NO: 37199 - DNA, 313 bp, Homo sapiens
  misc_feature 1..313: note = chr19:10400448-10400761
  misc_feature 1..313: note = hyper
  source 1..313: mol_type = genomic DNA
tcatgccggcctccacgtagaccccaggggtcgctcactcctgccagctcgccttcaccaaggccaggagcttagcgcacgctcgcctcccgcccccccgccgcctctgccgccgccccctccttggaaaccaagttaccaacgttaaaccaatccccaagcgcaactctgcctcccccacaccccacccgccgcgccgcgcggagccgtcctctagcccagctcctcggctcgcgctctcctcgcctcctgtgctttccccgccgcggcgatgccagggccttcgccagggctgcgccgggcgctactcggc

SEQ ID NO: 37200 - DNA, 173 bp, Homo sapiens
  misc_feature 1..173: note = chr19:10400989-10401162
  misc_feature 1..173: note = hyper
  source 1..173: mol_type = genomic DNA
tcgatagcccctacccgcttcgagatcctaggtgttcttccgcacccaacccttcgccctggagacccagtgtctctcctgtccgctccccgggtacctccttacgctgtgctgtgcaccatggtccacggactggcatcttccccactcgcggtccgcgaagactccatctc

SEQ ID NO: 37201 - DNA, 30 bp, Homo sapiens
  misc_feature 1..30: note = chr19:10402001-10402031
  misc_feature 1..30: note = hyper
  source 1..30: mol_type = genomic DNA
ctcattcgcactttccgtgagttctgggtg

SEQ ID NO: 37202 - DNA, 81 bp, Homo sapiens
  misc_feature 1..81: note = chr19:10402409-10402490
  misc_feature 1..81: note = hyper
  source 1..81: mol_type = genomic DNA
gccgagctggacctgcggccgcacggactgggactgtttgaaaacagctcggcccccagagagctccgaaccttctgtgag

SEQ ID NO: 37203 - DNA, 41 bp, Homo sapiens
  misc_feature 1..41: note = chr19:10406119-10406160
  misc_feature 1..41: note = hyper
  source 1..41: mol_type = genomic DNA
gcccagatcagctggcgcgcgcccccgggggccctcaacat

SEQ ID NO: 37204 - DNA, 133 bp, Homo sapiens; identical to SEQ ID NO: 4582
  misc_feature 1..133: note = chr19:10406278-10406411
  misc_feature 1..133: note = hyper
  source 1..133: mol_type = genomic DNA

SEQ ID NO: 37205 - DNA, 111 bp, Homo sapiens
  misc_feature 1..111: note = chr19:10406919-10407030
  misc_feature 1..111: note = hyper
  source 1..111: mol_type = genomic DNA
catgaggactgacttcgtgcctgtgggagtgcggggggcggtgggagaagccccccggagcttggccaccctccgcgagggtctccaccccgcaggtccgtggctatgggt

SEQ ID NO: 37206 - DNA, 64 bp, Homo sapiens
  misc_feature 1..64: note = chr19:10407044-10407108
  misc_feature 1..64: note = hyper
  source 1..64: mol_type = genomic DNA
cggcggggggcgcggcgctgctggccgcgggggccggcctggccttctacgtgcagtccaccgc

SEQ ID NO: 37207 - DNA, 82 bp, Homo sapiens
  misc_feature 1..82: note = chr19:10530397-10530479
  misc_feature 1..82: note = hyper
  source 1..82: mol_type = genomic DNA
tcagacgacagaggccgaatcgcgtgcacaactccgcaagcacacaccgaccacaaacgcatccaagcgcttgagaacacat

SEQ ID NO: 37208 - DNA, 519 bp, Homo sapiens
  misc_feature 1..519: note = chr19:10531475-10531994
  misc_feature 1..519: note = hyper
  source 1..519: mol_type = genomic DNA
gtctctgtcactgcccgggccccgggagggccaggccaccctgaagcctcccccgcagcacctgtggcggcagcctcggacccccatccgtatccagcagcgcggctactccgacagcgcggagcgcgccgagcgggagcggcagccgcaccggcccatagagcgcgccgatgccatggacaccagcgaccggcccggcctgcgcacgacccgcatgtcctggccctcgtccttccatggcactggcaccggcagcggcggcgcgggcggaggcagcagcaggcggtaagactccccgcggcggatgcgcgcggaacggatgggcgcgcagggaggaggcaactcgagctgccggccgcagggggcgctaggatgcgggtggggtcggtttggctggcgggggcggagggaattcggctgcgggggcgtctgggacctggcccctggttgtgcgctctacgggaggcttcctgctgaagcccatcctggggtccatttagggggcgccacgctgcgcgt

SEQ ID NO: 37209 - DNA, 203 bp, Homo sapiens; identical to SEQ ID NO: 13192
  misc_feature 1..203: note = chr19:10616329-10616532
  misc_feature 1..203: note = hyper
  source 1..203: mol_type = genomic DNA

SEQ ID NO: 37210 - DNA, 114 bp, Homo sapiens
  misc_feature 1..114: note = chr19:10624739-10624853
  misc_feature 1..114: note = hyper
  source 1..114: mol_type = genomic DNA
cgcgtggcgcaggtcgcggttggtgagcgtgtagatgatggggttcagaagtgagttggccatggccagtcccaggaagggatcggcctgcaggagtacaggacaggtgcgcgc

SEQ ID NO: 37211 - DNA, 702 bp, Homo sapiens
  misc_feature 1..702: note = chr19:10624965-10625667
  misc_feature 1..702: note = hyper
  source 1..702: mol_type = genomic DNA
cgcgcccgggtcgaggtggtccccgcagtcccgggccgtgccggcaggcgccgcgcgttggcgcgtacctggcagtagatgcgcgcgtagagtgcacagatagcggccaggatgcccacgaaggcgagcacgcagaagagcacgtaggccttggcgtagagcggcaagacagtggagcaagcgtccaggcgacccaggcaattccagcccagcgctggcaggagcccgaggagcagcgacacgccccaggccgcggctgccatcgccagcgtgcgcccccgactggagacgggcgcgggccccctgcgcgccatggtgaggctgcgctccagcgcgatggccaggaggctcagcacggacgcagtgagtgccacgaagacgcctccctcccgtgcgaaccagagcgcgggggacagtttcagcgtgagcggccccgacagtaggatgttggcggcgtaggcggcgcctgccagcagatccgacaacgtgaggctgcccaggagcaggaacatgggagcgtggaagcgcgggtggcgtccgagcaccaacaacacggctagattctctagcacgatgaaggcgcacaccgccaggcacaccacggcgtcggcgcgcaggccggcacccggctggtagcgcgcaccgcggagcttgccggtgtagttgtaatgcaggacgatgacctcgctcaccggcgccggc

SEQ ID NO: 37212 - DNA, 45 bp, Homo sapiens
  misc_feature 1..45: note = chr19:10625744-10625789
  misc_feature 1..45: note = hyper
  source 1..45: mol_type = genomic DNA
cgtaagcacgctcgcagcagccggctaagtcgtgggaaaggggcc

SEQ ID NO: 37213 - DNA, 19 bp, Homo sapiens
  misc_feature 1..19: note = chr19:10628995-10629014
  misc_feature 1..19: note = hyper
  source 1..19: mol_type = genomic DNA
tccgcggctcaagccatcc

SEQ ID NO: 37214 - DNA, 190 bp, Homo sapiens
  misc_feature 1..190: note = chr19:10629393-10629583
  misc_feature 1..190: note = hyper
  source 1..190: mol_type = genomic DNA
aggccctgctggccgcgggtggggtgagggcgccccaggagagatgagccagaggctgagaataagtgtggatccgggataccctcgtgggaggaaactcagggggcactcaggccgggtcaggcccccatgtagccccttggggatcccagccctcctgcccccgctgttccctcggtgggcagaacct

SEQ ID NO: 37215 - DNA, 118 bp, Homo sapiens
  misc_feature 1..118: note = chr19:10691879-10691997
  misc_feature 1..118: note = hyper
  source 1..118: mol_type = genomic DNA
cgtggggcgggtttgcgactcccctgtgcatttctcagaagaaaggtcccctaaatgcttacggccagtgagctcgaagagcacgcggtcattgaggcccagccgcagctctggcatt

SEQ ID NO: 37216 - DNA, 30 bp, Homo sapiens
  misc_feature 1..30: note = chr19:10806164-10806194
  misc_feature 1..30: note = hyper
  source 1..30: mol_type = genomic DNA
gctgctgcaaaccaccgcttccaaacttcc

SEQ ID NO: 37217 - DNA, 544 bp, Homo sapiens
  misc_feature 1..544: note = chr19:11529608-11530152
  misc_feature 1..544: note = hyper
  source 1..544: mol_type = genomic DNA
ggctagtcccctcctcgctgcgggtcccctcctcccaggtcctgaggacatggggtggcatttggggatgtcccagggcccagtctaatagaacctgtctctagctctttctgccgactgcgctcagagactcgcgcccccatccctaagaggaaccagtcgcttcactgggtcaagggccgcgagtccccaggaggggactccagggcaagttcagattgggagcagataccgtccgacgggcgggcgcttggagtttctggacctgcgggtcaccagggatgcggggtccggggatcccttgtccccttaccagggccagctctttgcctgctgtgcgctccatggccggcgcccgtccctctcagtggcgccgctgagtgaggcggaagggccggcgggtggcgggtggcgggcggcgggcagtggccgggcgctgaggccagaggggcggagcggccgagctgctggggcggggcggggcagggcaggccggacccagcctctgggtgcctccagccggacccagcgccagcccaggaga

SEQ ID NO: 37218 - DNA, 275 bp, Homo sapiens
  misc_feature 1..275: note = chr19:11531328-11531603
  misc_feature 1..275: note = hyper
  source 1..275: mol_type = genomic DNA
gatttactgtgggaacgtctggcccggccccttcctcccctccgggcgccgctggccgcctccgttcccggtccgggccgcgttcagcccctgaaggggccccgtggggcctgcgctagacccggagggatcgggggctccgaagggggccgcctggtgggtgtcaggacgagtctaggacctccgagagcgacggtgcttcttgtgactttcgattaatttctgggaacggatcttgagtgatgcgcgggtcactacctcgttgtcctcctcct

SEQ ID NO: 37219 - DNA, 17 bp, Homo sapiens
  misc_feature 1..17: note = chr19:11532425-11532442
  misc_feature 1..17: note = hyper
  source 1..17: mol_type = genomic DNA
cacgaggcccagcaggt

SEQ ID NO: 37220 - DNA, 35 bp, Homo sapiens
  misc_feature 1..35: note = chr19:11533057-11533092
  misc_feature 1..35: note = hyper
  source 1..35: mol_type = genomic DNA
gtgtggcaggaaccccgcttcgtggctgcgcctct

SEQ ID NO: 37221 - DNA, 30 bp, Homo sapiens
  misc_feature 1..30: note = chr19:11533564-11533594
  misc_feature 1..30: note = hyper
  source 1..30: mol_type = genomic DNA
tagggagcgtaggggcgctccacctcctct

SEQ ID NO: 37222 - DNA, 239 bp, Homo sapiens
  misc_feature 1..239: note = chr19:11590953-11591192
  misc_feature 1..239: note = hyper
  source 1..239: mol_type = genomic DNA
ggccgaggcccggggcgcgcgatccgacgccacccgctttcccagggctctcggggacgctttgtcgctttggcttggcccagcaccagtgatcgggccctgcgtttgcctgggcggcctgcggggtctgggcctggatggaggaagcatccttagccgccgcggcccctcccccatcaggcctgctggagagggggcaatcccgcctccagggcggcgtcggacgcctcccgaatcgc

SEQ ID NO: 37223 - DNA, 51 bp, Homo sapiens
  misc_feature 1..51: note = chr19:11591537-11591588
  misc_feature 1..51: note = hyper
  source 1..51: mol_type = genomic DNA
ccgctgcagatgtggcgatgaaggcggcggctccctcgagggccagggacg

SEQ ID NO: 37224 - DNA, 30 bp, Homo sapiens
  misc_feature 1..30: note = chr19:11591796-11591826
  misc_feature 1..30: note = hyper
  source 1..30: mol_type = genomic DNA
caagtcctctcccctcgcccaccctccctc

SEQ ID NO: 37225 - DNA, 714 bp, Homo sapiens
  misc_feature 1..714: note = chr19:11592671-11593385
  misc_feature 1..714: note = hyper
  source 1..714: mol_type = genomic DNA
aggcgttgggggtggcgcagcctcctttggtgcgcgggcgccggtgcatgtttacgtcggggcgcgggaactagcacacactggggcggggtcgccagggcgtgaggcttcagcaccacagacagcaatccgacagtccggtcgagggcgctgccggcgaggtagcccagaccccctaactggagagcggcagtccccacccaatcctcgttcctgcacgccctttaggctccagactgtcagagagcgccaccagcgaggagagcctaatttgcccaatcaggggcggcccttgagataaccagttactggaagatgccctagagatcgagccaatgggagtgcgcgcaccaggggatgctgccacgcctggaaagggcaggccaatcgcagtggcccgcgcaataggggcggtggcggtgcagatccccgggtggcccctcttgggctcgccggggcgacctggctgcgggcgctaggggccccaagcgatggtctgttccccaccccgtgttcctcccggtttccgtcatcggaaactgagctaggaggggggctgctcctgggcgcgcggaccccgctgcggttcccatggaaacctgccggctccggcagtgcggggagagtggaggggacctgcctcgcggggggagggagctcgcgggggcggccccagcggccggactcgctcatccttgccgattcttctgtccc

SEQ ID NO: 37226 - DNA, 136 bp, Homo sapiens
  misc_feature 1..136: note = chr19:11650677-11650813
  misc_feature 1..136: note = hyper
  source 1..136: mol_type = genomic DNA
cctcctcccccccagcgccggccccagagccgcgcagagccgcgcagagacgccgcgccttataaggcggcctcggggagcccgggccacgctatataagggccggtttgctttataaagccgggctggtggcgtg

SEQ ID NO: 37227 - DNA, 231 bp, Homo sapiens
  misc_feature 1..231: note = chr19:11689321-11689552
  misc_feature 1..231: note = hyper
  source 1..231: mol_type = genomic DNA
tctgcaggccctccacgggaccgcagcctgggagggcaggaggccctgcacctgcggccggtctgacctgctcctcacctccctgcctgcctcctccgtgctgggcgccgccgcgacacgtcccgcggacattcaggagtcccttcagtccctgcgagcgcggacccgggagagagctctcattcaacgctgaggccactggctcacagatctccccgggtcaccctgcga

SEQ ID NO: 37228 - DNA, 171 bp, Homo sapiens
  misc_feature 1..171: note = chr19:11805426-11805597
  misc_feature 1..171: note = hyper
  source 1..171: mol_type = genomic DNA
ggacgcccggggtcccggctgccagcccagccccaccctgcggccgaggggaccgagggccgagctccgccagcggtactccggtccacagagcccggagtcgctggctgggaggccggggacccgccacggccagttccaaccagcccctcctcccgtctcgggatccct

SEQ ID NO: 37229 - DNA, 278 bp, Homo sapiens
  misc_feature 1..278: note = chr19:11909455-11909733
  misc_feature 1..278: note = hyper
  source 1..278: mol_type = genomic DNA
ccacggctcctgtgacgctgtcacctgcgctgtgacctgctccggagtcataaagaggacgccgggacaccaagaagcagggaaatggtaaagtgcccggcctagcgtccagatacgtggaagaggggctgggtggaaccaacaggatcctgctgtggcgggacccaggcctccgctcgggcgaccccggcgattgggacccgcgtcccccatggcgtggcttggccctcggtccgctcggccgccaggtggggctgggcccgcagctgggaccccgg

SEQ ID NO: 37230 - DNA, 158 bp, Homo sapiens
  misc_feature 1..158: note = chr19:11909793-11909951
  misc_feature 1..158: note = hyper
  source 1..158: mol_type = genomic DNA
gctccgcgcccgcagcccggcgtcttcccagattgtgcgggggccacgggagggtcatggggggtcggatgtgtcccgcctttcttctgctaaaaattaaactgaggctctgttaacagttaaagagtttgttggagcaacagcgattccgagtgaga

SEQ ID NO: 37231 - DNA, 333 bp, Homo sapiens
  misc_feature 1..333: note = chr19:11959427-11959760
  misc_feature 1..333: note = hyper
  source 1..333: mol_type = genomic DNA
ctgtcagtctggctccgcagggcctgatacccagggcttccgctgtcacttagacgtggggggcggggccgaacattccatccaatcagaggcactggctcggggccctgcccactgtgcatccaggcacggaggatgttgcattcctgccgtcacctttgtcgctgcgagggcggcggttgggatctggcctttccagccccgagagggacctagtgcctctacccagatttctgtcgctctgtcacctgcgctatgccctgctttactcacaggagctgtagagaggaccccggtacatctgaaagccgggaaatggtgcgtgtgctggcc

SEQ ID NO: 37232 - DNA, 316 bp, Homo sapiens
  misc_feature 1..316: note = chr19:11959761-11960077
  misc_feature 1..316: note = hyper
  source 1..316: mol_type = genomic DNA
ggagtggtgcgatgggggaggggctgcctggaactggcgggacccgggcctccctgtgggcgactccggggtctgggaccgagtcctcctagagctgctcggccctcggtccccgcggccgctggatgtgggtgggccggcagccgggactccgggcgtcctgtcccgtccctgcccgtcgactgcggccttggccccgaagcccttttgtgcagctccgcgcccgcagcccgacgccccagcttgtgcgggggccacgggagggtcatgcgcggatttcgactcgggtgtggatttcgtccgtaggaggagcagc

SEQ ID NO: 37233 - DNA, 30 bp, Homo sapiens
  misc_feature 1..30: note = chr19:11960297-11960327
  misc_feature 1..30: note = hyper
  source 1..30: mol_type = genomic DNA
ctggagtaagtggtccggaggcggctcagg

SEQ ID NO: 37234 - DNA, 30 bp, Homo sapiens
  misc_feature 1..30: note = chr19:11998469-11998499
  misc_feature 1..30: note = hyper
  source 1..30: mol_type = genomic DNA
gctgtggtcagaatccgtctgtctggctct

SEQ ID NO: 37235 - DNA, 342 bp, Homo sapiens
  misc_feature 1..342: note = chr19:11998761-11999103
  misc_feature 1..342: note = hyper
  source 1..342: mol_type = genomic DNA
gtgtagagaggaccccgggacatctgaaagccaggaaatggtgcgtgtctggggccgggtgtcgtgagacgggggaggggctgcctggaccgaccggaaccgactgtggcgagaccctggctttcctgcgggcgactttgggatctgggaccgagtcctcctggagccgctcggccctcggtcccctcgactgctcggtgtggctgggccggtagccgggacaccaggcgtcctgtctcgtctctgcgcggcgactgcggttccagagccctctatgggcagctccgcgcccgcagccacgcgtctacccagattgtgcgggggccacgggagggtcatgtg

SEQ ID NO: 37236 - DNA, 62 bp, Homo sapiens; identical to SEQ ID NO: 13209
  misc_feature 1..62: note = chr19:12075756-12075818
  misc_feature 1..62: note = hyper
  source 1..62: mol_type = genomic DNA

SEQ ID NO: 37237 - DNA, 20 bp, Homo sapiens
  misc_feature 1..20: note = chr19:12076359-12076379
  misc_feature 1..20: note = hyper
  source 1..20: mol_type = genomic DNA
tcgtgcgtgggaggagcagt

SEQ ID NO: 37238 - DNA, 392 bp, Homo sapiens
  misc_feature 1..392: note = chr19:12146632-12147024
  misc_feature 1..392: note = hyper
  source 1..392: mol_type = genomic DNA
tttgaccggatccagcgatagattctttaagccagaggtctgtaacctttttagcaccagaaccggtttcgtggaagacagttctcctacgggggcagatagtttcggaatgaaacttccacctcagatcaggcattttatcctcataaggcgaacccaacctagatccctcgcatgtgcagctcacaatagggttcgggctcctatgacagactaatgcctctgctgatctgacaggaagcatatctctggcgataatgcccgctggctcgcccgccagccgctcacctcctgctgtgcggactggttccttacaggccatggaccgggggttggggacccctgccatagagtactgttgaatagaaactttagctcgtccggcggtgggc

SEQ ID NO: 37239 - DNA, 281 bp, Homo sapiens
  misc_feature 1..281: note = chr19:12163055-12163336
  misc_feature 1..281: note = hyper
  source 1..281: mol_type = genomic DNA
tgtgtttccctcagccgaggtctctcctattcggctcagaataaacttattctacacgatttgggtttttccgttaccaaaccacaagccaggactgggagtttctcattcattaatcgctgtttgctaaaataaactctcattttttaacagtgcctcagtttaatttttaactggaaaaaaaaaggaactggggaccccacagcccacagctcctcccacacgaaccccacacccgaggcaggatcccccatgacccttccatggtcaccgcacaatct

SEQ ID NO: 37240 - DNA, 161 bp, Homo sapiens
  misc_feature 1..161: note = chr19:12163456-12163617
  misc_feature 1..161: note = hyper
  source 1..161: mol_type = genomic DNA
cagcggccgaggggaccgagggccgagctgcgctagggggactgtgtctggagcccagagtcgctgcaggggggcccgggccccgccacagcgggttcctctcggttccacccagtccctcctttcgccttgggactccccagcaccgcatgctcaccatt

SEQ ID NO: 37241 - DNA, 131 bp, Homo sapiens
  misc_feature 1..131: note = chr19:12163881-12164012
  misc_feature 1..131: note = hyper
  source 1..131: mol_type = genomic DNA
tgacagcagaagccccgggtaactgggcgctgcagagccgaagcgactggttctggccacactttccaaggtcagctccctccctccctcccacctttacttcgaatatttgccttcggccaaacttgctc

SEQ ID NO: 37242 - DNA, 706 bp, Homo sapiens
  misc_feature 1..706: note = chr19:12175445-12176151
  misc_feature 1..706: note = hyper
  source 1..706: mol_type = genomic DNA
tcaggatgcagggggcggggcctggcgctccacccaatcagagtcgccggggtggggcccggccaactgtttatccgcgggtcacattgccgttcgcctcagtctttggcccctcccgccgggtgaggttggcaccccgtttttcctgctctgagagggaccggttgccaccgccatacttctgtcgccctgtcgtctgtgttgtgactgctttggacgtgggagtcacctgaaagccaggaaatggtgagtgtgagcccccgctgggagtcccgagacttgggggagggtaggcggaggctggttggaactggctggaaccggctgtgccgggacccggacctccccgcggcgactcgaggtctggggcccgagccccgctggcgcagctcggccttcggtccattcggccgccgggtgcggctgggccggcagccgggacccctgggcgccctgtctcgtcgccgcgcggcgactgcggccccagcccgggagccctctctggacagctccgcgcccgcagcccggagcctctccatattgtgcggggccacgggagggtcatgggggcaatcccgccttgggtgtggggctcgtgcgggaggagctgcgctgtgaggccctcagtgccccctttctcctgttaaaacttaaacaggcccggtgctgggaatagaggcgtgagccaccgcgcctggcctagcgt

SEQ ID NO: 37243 - DNA, 336 bp, Homo sapiens; identical to SEQ ID NO: 1357
  misc_feature 1..336: note = chr19:12203013-12203349
  misc_feature 1..336: note = hyper
  source 1..336: mol_type = genomic DNA

SEQ ID NO: 37244 - DNA, 288 bp, Homo sapiens
  misc_feature 1..288: note = chr19:12203350-12203638
  misc_feature 1..288: note = hyper
  source 1..288: mol_type = genomic DNA
gctgtggcgggacccgggcctccccgcggcgactccggggtctgtggggctgggccggcagccgggacccggggcatcctgtctcgtcccttcgcagcgaccgcggccccggacccggagccctctttgggcagctccgcgtcttcagccgcgggtctcctcagattgtgctgggccatgaggaggatcatggggggaatcccgtctcgggtgtagggttcttgcgtcagaaaagcggtggtctgtggagtccccagtcgtcttttctcctcttaaaagttaaaatgg

SEQ ID NO: 37245 - DNA, 325 bp, Homo sapiens
  misc_feature 1..325: note = chr19:12266983-12267308
  misc_feature 1..325: note = hyper
  source 1..325: mol_type = genomic DNA
ggggactggggaccccgcagcccaccgctcctcccacacgaaccacacacccgaggcaggattgcctccatgaccctcccgtggtctccgcacaatctggggagacgcgggactacgggcgcggagctccccagagagggctccggggccggggccagggccggggtcgcagtcgcagcgcagagacgggacaggacgcctggggtcccggctgccggcccaaccccaccctgcggccgaagggaccgagggccgagctacgccagggggactccgctctgcagacccgaagtcgctgcaggaaggcctgggtcctgctagagcc

SEQ ID NO: 37246 - DNA, 390 bp, Homo sapiens
  misc_feature 1..390: note = chr19:12267309-12267699
  misc_feature 1..390: note = hyper
  source 1..390: mol_type = genomic DNA
gttcgagccggttcctcccggcccctcccccgtctcgggacccccggccccgcacactcaccatttcccggcttccaggtgtcctggcctcctctccacggatccctctaacagtccagtcacagtgcgggcgatggagcgacagaagctatggcggaggcacctggtccctctcggggccggaaaaccgagatcccgacctccctttggtgcaagacgcctgggagtcaggaaagcgggaatgcggcctccccttccccggatggacagttggcaggaccccgccccagcgcccctgattggatgaggctccagtccccgtcccatcggtcctgagtgacagcggaagccctgggtaacaaggcccggcagaaccgaaatgacctgttc

SEQ ID NO: 37247 - DNA, 126 bp, Homo sapiens
  misc_feature 1..126: note = chr19:12306068-12306194
  misc_feature 1..126: note = hyper
  source 1..126: mol_type = genomic DNA
cccgggtccctctggcgcagctgggccctcagtgccctcggccgcagagtggggctgggctggcatccgggaccccgggcatcctgtcccgttcctgcgcgacgcctgcggccccggcctcagcct

SEQ ID NO: 37248 - DNA, 43 bp, Homo sapiens
  misc_feature 1..43: note = chr19:12306229-12306272
  misc_feature 1..43: note = hyper
  source 1..43: mol_type = genomic DNA
cgtgtctccccagattgcacgggagccccgggagggtcatggg

SEQ ID NO: 37249 - DNA, 234 bp, Homo sapiens
  misc_feature 1..234: note = chr19:12475809-12476043
  misc_feature 1..234: note = hyper
  source 1..234: mol_type = genomic DNA
ctcagcaggagaatgcggtttcttcacctcccgtcccaggattcgcctgtcacttccccaccaaccagcgaccccacacttcagccgcccctgtccagacccctaaacacccccatccccaaacctctcatggaggcggaactggggtcttctctcctctccccctattaaactgtttctgctgcaggccttggagtctcggtgcagtgactcggaccgcgaacctgtgccggt

SEQ ID NO: 37250 - DNA, 30 bp, Homo sapiens
  misc_feature 1..30: note = chr19:12476667-12476697
  misc_feature 1..30: note = hyper
  source 1..30: mol_type = genomic DNA
tgggcttcctcccttcgctgtgacctgacc

SEQ ID NO: 37251 - DNA, 254 bp, Homo sapiens
  misc_feature 1..254: note = chr19:12750856-12751110
  misc_feature 1..254: note = hyper
  source 1..254: mol_type = genomic DNA
cagggcaccctactccgctcacctgcgacggcagcagccagtccccacgggcggaggggacctcatgcgacattcagcccgcgagattctcagagactgctcgcccgcaacacgcagtaacgatctcaggagagcccatgatggggcggcgcgtgtcgtagccgagaagactctgtcatcgccggcgacctcctggaactctctcttgcggtttgcagccagatcacttcccatacacgcggcagccaagctca

SEQ ID NO: 37252 - DNA, 180 bp, Homo sapiens
  misc_feature 1..180: note = chr19:12936457-12936637
  misc_feature 1..180: note = hyper
  source 1..180: mol_type = genomic DNA
gggtgtcctgaggggcggggctgggggaagggtcgctcccccaactcagggccacgcgtccgctaggggccgctgccgcttccactgccactcccgctgcccgcagcgtccaggatggaggtgcgagggctgcgggaacgccgggagggagcttcccggccccgtcgtcctggtctggga

SEQ ID NO: 37253 - DNA, 101 bp, Homo sapiens
  misc_feature 1..101: note = chr19:12945480-12945581
  misc_feature 1..101: note = hyper
  source 1..101: mol_type = genomic DNA
ctggtctcgaggctgcgcaggcgcaggagccgtgcgtccactgcacggagtgggacactgaggatcgctgtggagtgtggggaaggcggggacaaactcag

SEQ ID NO: 37254 - DNA, 30 bp, Homo sapiens
  misc_feature 1..30: note = chr19:12949855-12949885
  misc_feature 1..30: note = hyper
  source 1..30: mol_type = genomic DNA
tatgctcagtcactgcggctgtgggtgagg

SEQ ID NO: 37255 - DNA, 36 bp, Homo sapiens; identical to SEQ ID NO: 13221
  misc_feature 1..36: note = chr19:12952093-12952129
  misc_feature 1..36: note = hyper
  source 1..36: mol_type = genomic DNA

SEQ ID NO: 37256 - DNA, 13 bp, Homo sapiens
  misc_feature 1..13: note = chr19:12952130-12952143
  misc_feature 1..13: note = hyper
  source 1..13: mol_type = genomic DNA
ccctgggcgcggg

SEQ ID NO: 37257 - DNA, 98 bp, Homo sapiens
  misc_feature 1..98: note = chr19:12978444-12978542
  misc_feature 1..98: note = hyper
  source 1..98: mol_type = genomic DNA
ggagagggggctctccggagatgtgagcaggggaatggcggagtttgggggcggggtcgaagggggcgtgtcttccataaccacgccccctccatgca

SEQ ID NO: 37258 - DNA, 38 bp, Homo sapiens
  misc_feature 1..38: note = chr19:12996096-12996134
  misc_feature 1..38: note = hyper
  source 1..38: mol_type = genomic DNA
gccctttctcatgtccggggccccgccccctcacctgt

SEQ ID NO: 37259 - DNA, 152 bp, Homo sapiens
  misc_feature 1..152: note = chr19:12996701-12996853
  misc_feature 1..152: note = hyper
  source 1..152: mol_type = genomic DNA
gcccagagtctcgggcggcggcggatattgcgccccggaggcctcgctgggcgccagagcgcaggtctggggcgcgccaccgggctccgggcccgagaagttggtgaggaggagatccaggtcccaggtggcgtccgcgcccctctcatcgt

SEQ ID NO: 37260 - DNA, 30 bp, Homo sapiens
  misc_feature 1..30: note = chr19:13030286-13030316
  misc_feature 1..30: note = hyper
  source 1..30: mol_type = genomic DNA
ggcgcgctctgggtgcgcttgtgtgcccct

SEQ ID NO: 37261 - DNA, 88 bp, Homo sapiens
  misc_feature 1..88: note = chr19:13213616-13213704
  misc_feature 1..88: note = hyper
  source 1..88: mol_type = genomic DNA
ccctctcacccctggcggcgcagcggccggaggatgctggcccagtgcagataagggccaggctgcctggccgcgcctgataaggagc

SEQ ID NO: 37262 - DNA, 280 bp, Homo sapiens
  misc_feature 1..280: note = chr19:13616677-13616957
  misc_feature 1..280: note = hyper
  source 1..280: mol_type = genomic DNA
ctggaagaggggaggcggagggaggagggggaggcgcagctgctgctggggttcgggcaaaaggatatggccattcggtgatctttttggcgtattttctcaccacgttgtcttcgctgaagaggaagagagaccggttaaccgtgaggcagttctgtcggacggggatggggttgtagagtgccatggtccgcgctctctgcgccattgactgcttgtacatcctttgcgccccgggctgcccgccctgccggctgcccccggctcctcgcccgcctcc

SEQ ID NO: 37263 - DNA, 307 bp, Homo sapiens; identical to SEQ ID NO: 1360
  misc_feature 1..307: note = chr19:13617158-13617465
  misc_feature 1..307: note = hyper
  source 1..307: mol_type = genomic DNA

SEQ ID NO: 37264 - DNA, 43 bp, Homo sapiens
  misc_feature 1..43: note = chr19:13617489-13617532
  misc_feature 1..43: note = hyper
  source 1..43: mol_type = genomic DNA
cggtttgcaaaggacgccccccccgggacgcagtggaagcttc

SEQ ID NO: 37265 - DNA, 234 bp, Homo sapiens
  misc_feature 1..234: note = chr19:13617846-13618080
  misc_feature 1..234: note = hyper
  source 1..234: mol_type = genomic DNA
aaggagtcttcacaccgcagggtccaggtttaaaaaaaaaaaaaaaaattttttttcttcctgaatcaccaacggctgcctcttctgctcccggaggaagtgtgagtgtgtatgtgcgcacagcgtttcgctcaatggtgcctcatcttggggttaaattgcagcagtgaaatcctgaaaattcccaacagggggaaaagagagagagagagaggtatgcgccctccgcttagc

SEQ ID NO: 37266 - DNA, 225 bp, Homo sapiens
  misc_feature 1..225: note = chr19:13618288-13618513
  misc_feature 1..225: note = hyper
  source 1..225: mol_type = genomic DNA
acccacccagagtgtcgacacatgagggcccgcgaccaatcgtggaggctcgtggaggcgcgggggtaccgggctcagcggagtttgtgggggagagaggggagcgtcgcatggttgggaggcagggaggggggaattggggtgcttcctcctcccctgggaggaaagcctgttttccaccccgttccatttcggttgcagacagccggacgctccccagcatct

SEQ ID NO: 37267 - DNA, 365 bp, Homo sapiens
  misc_feature 1..365: note = chr19:14320287-14320652
  misc_feature 1..365: note = hyper
  source 1..365: mol_type = genomic DNA
tcctggacttgtgagcggcgtgctcaggaggcaaagagtgcggaggggctggggggcgcgtaaagagccctggcgcccctcaggccttcggctgcgcagccgcagtggaggccgcgccagcaaccgggctccgggaaccaaggcgtccgcgcgcgcacgcagactcgcccgcgcgccgcgtgccccgcgctgcccaggtcggtacccgcgcttcggacaccctgctcccagggcgctcctcgcttccagcctcccactttgcgccttgggctccccatgagccccgctcctgagacaccccacgctctgtgtattccgtcccacgggacctccacgcccacggtgccacgcgcctcgagtacccc

SEQ ID NO: 37268 - DNA, 334 bp, Homo sapiens
  misc_feature 1..334: note = chr19:14583182-14583516
  misc_feature 1..334: note = hyper
  source 1..334: mol_type = genomic DNA
catccaccctggaggcgcacgcggcgtccctgcagccccccgcgcggccccagtggatgccgaagccccgacgggacacacggtcctgcctgggctcgcagaatggctttttattcccaaaggctctgcgccgcgcacctgggcccagcccagggtgggctggcttagtcgttgggcctctggttgtgcttagaagtggctgaggccgctgtgccgggagctgcgcagcgagctggcctcccaggcgctcggtgttaggcccagccccgcggggccgcccttggctccggccctcgggggcaagaggcgaagcagttggcgcagcacggcctgg

SEQ ID NO: 37269 - DNA, 107 bp, Homo sapiens; identical to SEQ ID NO: 13230
  misc_feature 1..107: note = chr19:14583613-14583720
  misc_feature 1..107: note = hyper
  source 1..107: mol_type = genomic DNA

SEQ ID NO: 37270 - DNA, 173 bp, Homo sapiens; identical to SEQ ID NO: 4597
  misc_feature 1..173: note = chr19:14584240-14584413
  misc_feature 1..173: note = hyper
  source 1..173: mol_type = genomic DNA

SEQ ID NO: 37271 - DNA, 321 bp, Homo sapiens
  misc_feature 1..321: note = chr19:14584536-14584857
  misc_feature 1..321: note = hyper
  source 1..321: mol_type = genomic DNA
cgccagccgcccgggggacccaggccgatgaagcaccacgtgcccgggtactgcagctcatagcggcccacgcgcgccagcggcagcagcgccacggccaaggccaccgcggccaccgcggccagcgccaggcgcgcgcgggcgaccgagacccgcgcggcgtggagcagcggccgcgtgacgcccacgcagcgctccacggccatgccacagcccagcagcagcgggcacaggccgaagaagaccatgcagccgcccaggaagtggcaggccccgccggccggagcgcgccccgcagtgtacagacgcagcaccagcgcg

SEQ ID NO: 37272 - DNA, 186 bp, Homo sapiens
  misc_feature 1..186: note = chr19:14667548-14667734
  misc_feature 1..186: note = hyper
  source 1..186: mol_type = genomic DNA
ctccgtccctgacatcggctttgggactgttcctgagccggctgctgcgggtgcccttccagcaggcgggagtaagtctgtgcggccacaagggggcagtggggagcgtcgcagcctccgccgcttgcagccagtcatcccggtggtgacgggtcagctcggcctctgcaccgaaagtatctcgct

SEQ ID NO: 37273 - DNA, 47 bp, Homo sapiens
  misc_feature 1..47: note = chr19:14886822-14886869
  misc_feature 1..47: note = hyper
  source 1..47: mol_type = genomic DNA
cgggcgcccctcccacaggaaaacgctgtggccgcctgttggggtgc

SEQ ID NO: 37274 - DNA, 668 bp, Homo sapiens
  misc_feature 1..668: note = chr19:15090061-15090729
  misc_feature 1..668: note = hyper
  source 1..668: mol_type = genomic DNA
ggggaggtggggagacgggcagggagacccggggataactaaggggataggaaactcaccagaacgaccaggagaaaagcggtggcaacggctctaaggggcaagcaggagctcagagacaaagggcggcggagaagtggggacgtgggcgcagggagcgccccacacgcctgaccccagcgcctcggatcccccacctgcccgcaacctccgcgccgcagccacaccgagtccccgcgccgagccgcggagtccccactcaccggcgtccggagcggcgggggcggcctgcccgcgcctcggcctgcgcgctgcgcccggatgcaggagccggagcccggcgaagcgcccggccggggccgcggggacccgccagggactgtgcagcaccggcgcggggaccggaccgtggaggcaccggcgcggagccgggacgcgctatgctgcgggagggatccgggccggccctgcgctcacgtgggtgtgggggcaccgagcggccgggggagggggcgggatcccctccgcgatgccctccgcctcccccgcgcccagcccaggctccgcagccgtgtgggagaagggggacagcgtgcttgcgaagggagggggactgggggtgggcgggggtgagtggcctctccggcatccagcccccgccccctgct

SEQ ID NO: 37275 - skipped

SEQ ID NO: 37276 - DNA, 120 bp, Homo sapiens
  misc_feature 1..120: note = chr19:15090747-15090867
  misc_feature 1..120: note = hyper
  source 1..120: mol_type = genomic DNA
cccccgccccctaaaccgcctccggagccctcggaggccccagcatccctggcggagcgcggggaacaggccctggcaccgcgggacccgctccagcagcctcggcggaggcctggggaa

SEQ ID NO: 37277 - DNA, 339 bp, Homo sapiens
  misc_feature 1..339: note = chr19:15121641-15121980
  misc_feature 1..339: note = hyper
  source 1..339: mol_type = genomic DNA
gcgtgttggtacccccggctgagcgcagccaggacacacgcgttggggccccagcatggcgcgaggcagctcaggccatggcgaggaccgcgcacattctgaccgatcgctgcgggcaggaggcggtgaccatgtggcagcccaaggacagcgtgctggacccgaacgtggcccaccacctcggccgcgccgcctacatccagccctggcgcttccgcgtggagatgatcaaaggcggcggcaccttggagaagccgccgccaggcgagggcgtcacgctgtggaagggcaagatgaagccgcccgcctggtacgcccgcctgccgctacccttgcacc

SEQ ID NO: 37278 - DNA, 295 bp, Homo sapiens
  misc_feature 1..295: note = chr19:15217958-15218253
  misc_feature 1..295: note = hyper
  source 1..295: mol_type = genomic DNA
gcgccacgatcgtcacgtcccatcgaagctggagcggatccgggcacccggagcccccattccaacccctcccggccccaggcaactacatctcccagcatcgcccgctcgggccgcgggaaaggggaaaaaaaaaaaaagtttgggccaagcattcccggaatgtgcttcctgctggcgcggggcggggggcgggcggggaggcccgggcggggcggggagggcgcggggcggcgcggccggagcccggggcgcgcactcggctcggcccggcccgggccgcagcatggccgag

SEQ ID NO: 37279 - DNA, 683 bp, Homo sapiens
  misc_feature 1..683: note = chr19:15288218-15288901
  misc_feature 1..683: note = hyper
  source 1..683: mol_type = genomic DNA
gcacagagaaacagacggggcaagtggatgggcaggtggaaagagaggcagggcccacggacaaacagactgggatggatgcatagacagacggatcgatcgggtggatgggctcacttgcaagtgcgctcgcggccaccggcgtggcagtcgaagttgtcgtagaggcaggcgggcgagctgcaggcggggtcgcagcggctgttgttgaagaggcgccagcactgcagcgcctcgcattgccgccaggggtcgcccacgctcagcgagcagtcgccgccgtcccagccgcagcctgggctgttgcactcgcggtcgcagcgctggtccccgcgcttggcctggcaggcggcgcgcgggcaccgcggctcctccgagacctcgggtgccgcggcgggcgcctcgcagcgcggcccggtccagccctgcgcgcaagcgcagcggaagaagggcgcgagcggcgcggggcggcaggagcccccgtggagacagggggcggccgcgcagctggcgttgctggcccccggcggcgaccccgggaagctgcggcaggagggtcccgacaaccctggggggcaggcgcagcgcggcccgcggggcgtctgctggcatgggacgcccaccgggcactgcagctcccggcaggagcgcgccacccgctcgcaacgcggaccccagaacgg

SEQ ID NO: 37280 - DNA, 164 bp, Homo sapiens
  misc_feature 1..164: note = chr19:15333656-15333820
  misc_feature 1..164: note = hyper
  source 1..164: mol_type = genomic DNA
aacattccagacacacggatctgtccgagaccctcccctgctggcatgtgaagccttttatagtctcacgtcttcctagcccaaactttcctcccagtctcacggaaatgctaaatcatcccggcgtgggaggcttctgtgggtcggggcgcagctttgcaagg

SEQ ID NO: 37281 - DNA, 120 bp, Homo sapiens
  misc_feature 1..120: note = chr19:15334731-15334851
  misc_feature 1..120: note = hyper
  source 1..120: mol_type = genomic DNA
ctgggggtccctgctcggtcgggacagtgggaccgccctgtgctgtggccgcgcgcagccccccgcaggcttcggcgctcgcactcttgcgtgggactgtccaaccgccacagggagctc

SEQ ID NO: 37282 - DNA, 777 bp, Homo sapiens
  misc_feature 1..777: note = chr19:15342587-15343364
  misc_feature 1..777: note = hyper
  source 1..777: mol_type = genomic DNA
agttctcagggaagccgtgcagaaacagcatgaggggtccgttacctcgtccagccgagacatagtgcagacgcaggcccgagctctagggggagggcacagcctgaagcctggggaaccctctctcccgaggcttgaaccgtctcgaccccacgcgaccccgcagccccgatagcgcccccgtgcgatcaccttgaggttcaggaaaccgtgctcacccagcgaggggtcgctcaggcaggcgggggacgcgctccgacggcgcccgcagcagccgcgccggggccggcacagcacgtgcgtgagcgctatgcagccgtagaccgccgcggccaccagcgccaccgagaacaccaggctccacatgaaggcgcgcagcagcttcagcgacaggcgcgacggcgccagcagcgcggtcaccaccagctccggcatgtcgccgcgctccgggaccacggcggcgctgccggccaggggcacctgcagcagcggcgaagcggtgtcagggctcaggggcccatcgcccttggcctggggcccctccgtgccgtcgggatttgtgggacgcgctgaaggaagaggcgggcggctccgacagaaaacagccagagcgcaccactcacctgagtgccaggtaaacacctgggcgcgacagggacaggaaacaagggtagggtgcggaggctggggaggaagaggttggaaaggggggaaataaatgggcggggcctagcaggtcctgtgcggggcttagggccggggcggggcccaggaaga

SEQ ID NO: 37283 - DNA, 202 bp, Homo sapiens
  misc_feature 1..202: note = chr19:15343929-15344131
  misc_feature 1..202: note = hyper
  source 1..202: mol_type = genomic DNA
gggccaatgagctgacggtaggccggggagggggcggtggggtggggtgggcaatgggcaatgagacggagggcggggccgggacctaatatggcgggtcaggagggtctggaagacgaagaagagggacaggcaatgccaggtctaggactaggagggaggcgcgggcggtattagcggctggaggaggcttcgggaggcc

SEQ ID NO: 37284 - DNA, 208 bp, Homo sapiens; identical to SEQ ID NO: 13242
  misc_feature 1..208: note = chr19:15619208-15619416
  misc_feature 1..208: note = hyper
  source 1..208: mol_type = genomic DNA

SEQ ID NO: 37285 - DNA, 300 bp, Homo sapiens
  misc_feature 1..300: note = chr19:15695292-15695592
  misc_feature 1..300: note = hyper
  source 1..300: mol_type = genomic DNA
cccagacgaggttcccggcgcgatggggccgggatgggggtcctgggcacagtcagagtccccaccccctcccccgggaactgcatcggccagacgttcgccatggctgagatgaaggtggtcctggcgctcacgctgctgcgcttccgcgtcctgccggaccacgcggagccccgcaggaagctggagctgatcgtgcgcgcggaggatggactttggctacgggtggagcccctgagcgcggatctgcagtgacccaccactgtcaggtctcagagccacccgcgccctcctcaggca

SEQ ID NO: 37286 - DNA, 138 bp, Homo sapiens; identical to SEQ ID NO: 1362
  misc_feature 1..138: note = chr19:17007251-17007389
  misc_feature 1..138: note = hyper
  source 1..138: mol_type = genomic DNA

SEQ ID NO: 37287 - DNA, 347 bp, Homo sapiens; identical to SEQ ID NO: 1363
  misc_feature 1..347: note = chr19:17007446-17007793
  misc_feature 1..347: note = hyper
  source 1..347: mol_type = genomic DNA

SEQ ID NO: 37288 - DNA, 100 bp, Homo sapiens
  misc_feature 1..100: note = chr19:17008419-17008519
  misc_feature 1..100: note = hyper
  source 1..100: mol_type = genomic DNA
gggagccctccctggcgtccgagggtgggagtcggggtgtggcaggccgcggtggggggcggcagtggctccgcgcactcacccgggccccgggcagggg

SEQ ID NO: 37289 - DNA, 114 bp, Homo sapiens; identical to SEQ ID NO: 4603
  misc_feature 1..114: note = chr19:17008585-17008699
  misc_feature 1..114: note = hyper
  source 1..114: mol_type = genomic DNA

SEQ ID NO: 37290 - DNA, 296 bp, Homo sapiens
  misc_feature 1..296: note = chr19:17137063-17137359
  misc_feature 1..296: note = hyper
  source 1..296: mol_type = genomic DNA
tggacaactggaaatcgccacccatgatgacagcccgggtcacacgaagggggcgaggtggggcggggggagctgacctcagcacctttagcttttgggagtccctgtacctccacagagccacttcggaaactttagggcgccccctcctcaagacgattcgggaacaagaggccaggtccagcccagcgcggaggctgtgtggccttgggcaggtcgctgcaacactctgagccagtacccgcgacccccaccccagaaggcgaccgacctcctctgtcgccggaggatactca

SEQ ID NO: 37291 - DNA, 65 bp, Homo sapiens
  misc_feature 1..65: note = chr19:17137395-17137460
  misc_feature 1..65: note = hyper
  source 1..65: mol_type = genomic DNA
cgccgacagcagcaggagcaggagcgggagcaacggccagagcagggcgccgctcatttttcggc

SEQ ID NO: 37292 - DNA, 586 bp, Homo sapiens
  misc_feature 1..586: note = chr19:17392502-17393088
  misc_feature 1..586: note = hyper
  source 1..586: mol_type = genomic DNA
cagaccctgcttgagcgcctccgggtgtcaagggcccctgaggacactaaagctctcgaaccccgatgtggacccccgtgcggcgcggggcagcctggctgggaaccctgctcggccctggagaggggccccccgagccgaggggaggagcggcgcatgcccacaagccccccgcgggaagtaggaaatcgaccgaccaggcggtgcgcttcggacccagccagggcatgtgctcggaggcccgcctggctcgcaggttgcgggatgcgctgcgggaggaggagccgtggtgagggcggggccgggggcgggccaggagtgggggtctttggccggggtccactctgaccgcggtgtttgcagggcagtagaggagctgctgcgctgcggcgcggaccctaatttggtgctagaggacggcgcagcggctgtgcacttggcggccggagcccggcacccgcgcggcctgcgttgcctcggggccctactgcgccaaggcggggaccccaacgctcggtaagatagagcctgggtccggggcggggtctccccaagccgaagtctgggaatccgggaaggggcgccc

SEQ ID NO: 37293 - DNA, 490 bp, Homo sapiens
  misc_feature 1..490: note = chr19:17501171-17501661
  misc_feature 1..490: note = hyper
  source 1..490: mol_type = genomic DNA
tttctgtgcagtttccgttcaggacgtctccagggtctaaagctgagtgtcgcatccagcgtgggggtgcctctatacacgtccccgcagaccccccccccatatgtgtcctccaggccgacgcccccttccggcagggggccgactcaccctcgtgcgcgccgcgccggccgccggcagcccccggagggtccggagcgagagcgcgagcgagggctgggccggggtcgggaccccgagcggggacgcggccggggcactctgcgctgtgggctcatctcggcttccaggacgttactgccgggaagggggaagggggctgtcagcctctggacccctgtccccagacatcgccagccctcatccgccagagcgtccctttgctgggaactccatccccagagatccccatctcccagggtttcccgctccccaggatccggcatccgttctcgacccccagccattcccgggacgcctccctagagac

SEQ ID NO: 37294 - DNA, 129 bp, Homo sapiens
  misc_feature 1..129: note = chr19:17559138-17559267
  misc_feature 1..129: note = hyper
  source 1..129: mol_type = genomic DNA
gcagcccccgcagctcggcgcggcccgcctgcagctgaaacagcagctgcgcgcccagcgccgccagcacggccgccgcgatgcccagcagggtcattgcagccagcacccggccgccgtaagaacggg

SEQ ID NO: 37295 - DNA, 737 bp, Homo sapiens
  misc_feature 1..737: note = chr19:17716787-17717524
  misc_feature 1..737: note = hyper
  source 1..737: mol_type = genomic DNA
ccaaggcgcaagccccgtccctccccgcccagcgccctccgcgcaggcgcagtgccgctcggccgaccgcccgcgctaaggcgcaggcgcggcaccgccctcctcggcggagcgcgtgtccgacttgagcttcacgaactccttggccacctcgtcgttgctgcgctgcgagaggattcgcagcaccgtgaggcccgtgtcgtccatgtggatgcggcggccgagcggcagccagcaggcggcgctcccgcgctgggccagctcacgcagctgcagcacggccagccccaccgtgcggtcctcgcgcgcgaagcagtagtccttgacgcacacctgcagctcatagcactcgggacccgcgtcggcgctcagcgtgctgcgtggggaggggcggaacgtgagacaggccacacctactgtgatgccccgcccacggccccgtccccaccgcatttgcgggccacgcccacaccggggtgcccacacctgtcacctcccacgctacgctagccccgcccctgccccgttacttgacctacaaccctgtgcttggccgcgcccacagcagctgaccccgagctgggccacgcccacgcctgttcttcccatttttccacccaccgaaaaatgaccgcatagttttacatccagctcccgcccctcagacaccgccctgcaaggccatgctcccaccctgagatacccgcgcctgtgccctctgccggctgaactgctgc

SEQ ID NO: 37296 - DNA, 377 bp, Homo sapiens
  misc_feature 1..377: note = chr19:17791026-17791403
  misc_feature 1..377: note = hyper
  source 1..377: mol_type = genomic DNA
tctccctgtcttccccggtcagtaaatggtccctgagtcaccgtcttcgtcgtcacatcccgccacctccccgcctgcgccgggttgctgtatcagggtcagcggggcggaagcgccacccttccccagcgggcttcgggtcacacgcatgaggctatttatagcgtgggcgcgcggagggcgtgggaggcgcgccggcggacaggggggcggggatgaggggggtgcccactgctgtccccagcgacgagcgggtgaagacaccgcgtcatgcggcctcaaaggtctttggggcccccagaagcgctgactgatgaatgtagtggccgtacccggggaggctgaggcaggagttcaggctgcgggacacccctgca

SEQ ID NO: 37297 - DNA, 37 bp, Homo sapiens
  misc_feature 1..37: note = chr19:17798697-17798734
  misc_feature 1..37: note = hyper
  source 1..37: mol_type = genomic DNA
ttccgggtagaaccccggatacccgtccacgtccaca

SEQ ID NO: 37298 - DNA, 92 bp, Homo sapiens
  misc_feature 1..92: note = chr19:17798977-17799069
  misc_feature 1..92: note = hyper
  source 1..92: mol_type = genomic DNA
gcctcctacctccaacgcaaagcagagacatgtctccgagctcgcaggtgggccggaggcggccgggccggctctgtcgggtcgggctcagc

SEQ ID NO: 37299 - DNA, 52 bp, Homo sapiens
  misc_feature 1..52: note = chr19:17906008-17906060
  misc_feature 1..52: note = hyper
  source 1..52: mol_type = genomic DNA
tctgggggtgagtgtcggcagcccccggaggatctggcggaccccagtggtg

SEQ ID NO: 37300 - DNA, 327 bp, Homo sapiens
  misc_feature 1..327: note = chr19:17958484-17958811
  misc_feature 1..327: note = hyper
  source 1..327: mol_type = genomic DNA
caaccccgcagcccccgtcgcgcatgcgcaatgactcctccaggtccgcaaggcaggcatctcccggccttagtcaaagccgaagcccagagaagcgagcgatcggaggatgcgagtctcggctcacgtctgcctcgcagctttcctccgaggcctggaaggcgagctagcctttgccctggcagcaccctgccccagcccagccatcccccgccaccaccatcctcccccagtgtctgggccgagccctgcggcatcgccagctcttacctagcgggcagggaccctggactttcgaagggcgggcagagccgggaggcagcgaga

SEQ ID NO: 37301 - DNA, 149 bp, Homo sapiens; identical to SEQ ID NO: 13255
  misc_feature 1..149: note = chr19:17983002-17983151
  misc_feature 1..149: note = hyper
  source 1..149: mol_type = genomic DNA

SEQ ID NO: 37302 - DNA, 261 bp, Homo sapiens
  misc_feature 1..261: note = chr19:17983405-17983666
  misc_feature 1..261: note = hyper
  source 1..261: mol_type = genomic DNA
gccagcttctgaactcggtcctcaccgccctgctcttcatgcccgtcttctaccgcctgggcctcaccagcacctacgaggtaccggacagaggcccgggggtaggacctgccccactggcagtgctgggaccccgtgtgggggaggcgctggggctttgggccgctgtacaggaggacgcggatggcacctcggtgctttaacggaaggggcccctaggcagacacgtggggagggttctaggaagaggccccaggcgcc

SEQ ID NO: 37303 - DNA, 285 bp, Homo sapiens
  misc_feature 1..285: note = chr19:17984627-17984912
  misc_feature 1..285: note = hyper
  source 1..285: mol_type = genomic DNA
actgtctacactgtgcgcttgcgggccacgtcggtgtctgctgagcggtggctgctccaggagcccgcgcccgtcaggcgcaagtgggagggcgcgtgcacacgcatggaccagtcctccaggtccacggggtacgcacaggcacgggatggcacctgtgcacgggtgtgtgcgtgcggcggggcccccacgtgcaagaatctggcgggcgcggttggcttccggagggaggggcccacctagagagcagaccagggacccgagaggcctcggctcctgggtaag

SEQ ID NO: 37304 - DNA, 40 bp, Homo sapiens
  misc_feature 1..40: note = chr19:18062522-18062562
  misc_feature 1..40: note = hyper
  source 1..40: mol_type = genomic DNA
tgggaccttccagcccggtcaacgtcgccagctgcccgaa

SEQ ID NO: 37305 - DNA, 188 bp, Homo sapiens
  misc_feature 1..188: note = chr19:18077737-18077925
  misc_feature 1..188: note = hyper
  source 1..188: mol_type = genomic DNA
gcaagagggggagttcgaagaccagccgcatgccggggggttgcagggggcgccggggaatgtgggatctttaaatatgggcggggcttgcggggtcgtcgaaggcggtgccaacccgggctcggccaatcggcggcggctcccgcgtcgcaccgcccccttctctcccggcccgggcgggcgctcgc

SEQ ID NO: 37306 - DNA, 136 bp, Homo sapiens
  misc_feature 1..136: note = chr19:18078136-18078272
  misc_feature 1..136: note = hyper
  source 1..136: mol_type = genomic DNA
ggatgggtgagggtgcgggaggatccaggatctgcagctcagggagcccgaggagggaggcacgtctcggagggggacgcggtttggggcaggggccaagagggagggtctccgtgcggtccggagcctaggagac

SEQ ID NO: 37307 - DNA, 30 bp, Homo sapiens
  misc_feature 1..30: note = chr19:18336422-18336452
  misc_feature 1..30: note = hyper
  source 1..30: mol_type = genomic DNA
ccccatccctccccacgaggtcacagtcgt

SEQ ID NO: 37308 - DNA, 30 bp, Homo sapiens
  misc_feature 1..30: note = chr19:18336877-18336907
  misc_feature 1..30: note = hyper
  source 1..30: mol_type = genomic DNA
cagagtcaccaactgcgagacaaaagtagg

SEQ ID NO: 37309 - DNA, 371 bp, Homo sapiens; identical to SEQ ID NO: 13259
  misc_feature 1..371: note = chr19:18343439-18343810
  misc_feature 1..371: note = hyper
  source 1..371: mol_type = genomic DNA

SEQ ID NO: 37310 - DNA, 84 bp, Homo sapiens; identical to SEQ ID NO: 13260
  misc_feature 1..84: note = chr19:18343879-18343963
  misc_feature 1..84: note = hyper
  source 1..84: mol_type = genomic DNA

SEQ ID NO: 37311 - DNA, 74 bp, Homo sapiens
  misc_feature 1..74: note = chr19:18714507-18714581
  misc_feature 1..74: note = hyper
  source 1..74: mol_type = genomic DNA
gaggtggggtggacacggttcttgggccggccctgatgattttccggggcaaacttggctcgagggctctgtct

SEQ ID NO: 37312 - DNA, 35 bp, Homo sapiens
  misc_feature 1..35: note = chr19:18715047-18715082
  misc_feature 1..35: note = hyper
  source 1..35: mol_type = genomic DNA
ctgcagctgccctcccggggctgggcgggggacac

SEQ ID NO: 37313 - DNA, 78 bp, Homo sapiens
  misc_feature 1..78: note = chr19:18716735-18716813
  misc_feature 1..78: note = hyper
  source 1..78: mol_type = genomic DNA
cagcctggctgaaaacggttctaagcgccgccggtggcggggactccgcggacccccgtgcgccgggtcccgcagggg

SEQ ID NO: 37314 - DNA, 206 bp, Homo sapiens
  misc_feature 1..206: note = chr19:18718176-18718382
  misc_feature 1..206: note = hyper
  source 1..206: mol_type = genomic DNA
catcctgcctcttttcgattctccgcgagtagcctcggccccaggctttgctggaagaaaggagaaaaagcaggaaggcacggagtccctcgccttcgccctggctgcgctgtccccttcgcgcgcgggatgggtttgaggttgctctgggcgccccgggggcctcgggagggagctcctgcgtgggcagacggggagatgtagtc

SEQ ID NO: 37315 - DNA, 123 bp, Homo sapiens
  misc_feature 1..123: note = chr19:18723837-18723960
  misc_feature 1..123: note = hyper
  source 1..123: mol_type = genomic DNA
tccgcgccgtccgcccgcgatcccttcgccccccagctcggggacacgcagaactgccagctgcggtgccgcgaccgcgacctcggcccgcagccctcgcaggtgaggcgcgtgcggtgccag

SEQ ID NO: 37316 - DNA, 20 bp, Homo sapiens
  misc_feature 1..20: note = chr19:18898213-18898233
  misc_feature 1..20: note = hyper
  source 1..20: mol_type = genomic DNA
aaaccagccaagccccgccc

SEQ ID NO: 37317 - DNA, 112 bp, Homo sapiens; identical to SEQ ID NO: 13264
  misc_feature 1..112: note = chr19:18899103-18899215
  misc_feature 1..112: note = hyper
  source 1..112: mol_type = genomic DNA

SEQ ID NO: 37318 - DNA, 126 bp, Homo sapiens
  misc_feature 1..126: note = chr19:18899432-18899558
  misc_feature 1..126: note = hyper
  source 1..126: mol_type = genomic DNA
cgcagtctgcatgctcgtggcactcgctgggcgagccgtcggggcagaagcgctgtgcgcgccgctggcagccggacgcctggtcgcccacgaagccgggctggcacgggccgcactggaaggagc

SEQ ID NO: 37319 - DNA, 267 bp, Homo sapiens
  misc_feature 1..267: note = chr19:18900266-18900533
  misc_feature 1..267: note = hyper
  source 1..267: mol_type = genomic DNA
tgatgacggcaagggcgcaaccgggagaggagaggagagctgttccctcatgggcgaggggaggaaggatgagggcgggcatccccagcagaggggggcaggggtcgtcggggcgtgcgtgcccggcggtggcggggggtctgggcgtgcgttccctggctgtggaagggtcgttgggactggcgatcccctgcggcgaggagggtagctggggcggaccacccctggcggtgagggagtcgtcggggcgggcgtcactagctatgt

SEQ ID NO: 37320 - DNA, 146 bp, Homo sapiens
  misc_feature 1..146: note = chr19:18900756-18900902
  misc_feature 1..146: note = hyper
  source 1..146: mol_type = genomic DNA
gacgtcggtgcagtgcgagccgttgcccgtgaagcccgcggggcaggggccgcagcgcgcgccgctctccgtctggatgcaggccacgccggggaagcagaagccgggcgcgcagtggagcaggggccgcacgctgggtaggccgg

SEQ ID NO: 37321 - DNA, 955 bp, Homo sapiens
  misc_feature 1..955: note = chr19:18901318-18902273
  misc_feature 1..955: note = hyper
  source 1..955: mol_type = genomic DNA
tgtgtctctgtctcccgtctcttctctctcccgaccgccccgccgcgctcaccgcacgcgtcacactccatcaccgtgtttttcaggaacgtgatctccctgacctgcaggggtgggatggaatcagcggggtcccaacctctcctcatccctcgggtctcccctctctctaccccggggtccctttctacagcctcttttcgccaaggactccctacccgccgacccccttccctccccatctcctctccaccttctcgggtacttcctctctcctcgctgggaactgagacccccttccgttccctggcactccctgccccgcacccgggccccgcacctgctgccgcagcagctcccgcacgtcctgcagcgccgcgttggtttcctgcagttcccgaagcatctgcgggcccaggtctgagcctgcggcggcaggggacctggtgaggcgtcatggggccggggaatcccaccaccaactcccaccgttgcagcgaacccggacctccgaggccccactgcgctcctctagtctcggtcccgccacctgctttctgcgcccggcacgtcccctacgaacagtccgtgagccccaaacagcctggatcccgggcctctcacgggtcctacagtccgttgtggggccgtgggcacggcgcgggtgctaacgcggcttacccaacgggctctggccctgtccggacgcgccgagggcagccagggtgagcagaagaacgcaggcggtgtcggggaccatggcggtggcggggagctgggtggctgctcgctttctaccgcccacgaggcccgcggggcctatttatccccaaggcacggccggccccagggacggcccaccacagccctgcccaacgtccagcctcaaggtaaacagatggcgctggcccctgcgttcaagtccccgcccggaatgccccgcgaagtcgcccgc

SEQ ID NO: 37322 - skipped

SEQ ID NO: 37323 - DNA, 30 bp, Homo sapiens
  misc_feature 1..30: note = chr19:18981207-18981237
  misc_feature 1..30: note = hyper
  source 1..30: mol_type = genomic DNA
aggggtcctggggggcgtggccgggaactg

SEQ ID NO: 37324 - DNA, 294 bp, Homo sapiens
  misc_feature 1..294: note = chr19:19006016-19006310
  misc_feature 1..294: note = hyper
  source 1..294: mol_type = genomic DNA
ataggcacaaggcagcgaccgggcagctcctgcctcttcccgattacagcgggcaagccggccccgccgccgcacggacccagcagaaaacgggcagcggacctcgctccgggccggggcgcagcccgcatggcagggaggcgcatggcgcaggccgcggtgcgccgagccctcccgttcccggtcctgggcttctcagtgtctggctcggccctgccggaaagagcgcgcggtggccggagccatccaccgcgcggggccccctggtcccaaactgaccggaaagggccgtgc

SEQ ID NO: 37325 - DNA, 572 bp, Homo sapiens
  misc_feature 1..572: note = chr19:19006592-19007164
  misc_feature 1..572: note = hyper
  source 1..572: mol_type = genomic DNA
agtccggggtcccctcgtcccggcccccggccacactgacccgaaagaggcgcgcagtggccgcggagcgcagggcggtccagcccagcgcgccgagcgccagcagcagcagctcgggcggcgccaggtgcgcgtgctcagccaggccgcgacgcgccagcccccagccgcagtccgtgcagccccgcgccgccgccagcgcgctgccccagccgcgctgcactagctgcgcgtagctcggcatgggctcgggccccgtcggccccgccgcgggccccgccgccgccataccgcccgctcgcccgccgtgcccgtcgcctgcgcccgcccgcggtagccgacggagccgcgcgccccgcgtcacgcgccgcagctgggccgggggcgcgcgggcgggagagcggagggcggaggggcgggaccggcgcaagctccgccccgctgggggcgcggctggggggcggccagcggggacgcggggcgccctggaggcgggcccgcgcccctgcccgtttcccagcagagaaacccaggcgcgggggccggagctgggggcccgttggacctggacc

SEQ ID NO: 37326 - DNA, 269 bp, Homo sapiens
  misc_feature 1..269: note = chr19:19322660-19322929
  misc_feature 1..269: note = hyper
  source 1..269: mol_type = genomic DNA
gggagccccctccctcgcgcagccagaggcctcgggctggcgggggcgcatgcgcagagagccctcgcggcccctttataagcactgaggcggcgctggggccagcggagcgcagggcgcaggggctggacccggcgcggagctggctgagtcggagcgcagcgtcctttgtgcccggcggccgccccgggatgcgtccgagctaggagccaggtgggggatccgtgagggggccgtgttgcgggagaagacttcgggattagagacag

SEQ ID NO: 37327 - DNA, 73 bp, Homo sapiens
  misc_feature 1..73: note = chr19:19373696-19373769
  misc_feature 1..73: note = hyper
  source 1..73: mol_type = genomic DNA
ggccgcgggggcccacgctcccctggagcagtggctggagcgcgggcggagaaagaagcgctctggacttgga

SEQ ID NO: 37328 - DNA, 35 bp, Homo sapiens
  misc_feature 1..35: note = chr19:19383770-19383805
  misc_feature 1..35: note = hyper
  source 1..35: mol_type = genomic DNA
ccaccccaatcctgccgggtcggagctgagctggg

SEQ ID NO: 37329 - DNA, 309 bp, Homo sapiens
  misc_feature 1..309: note = chr19:19649094-19649403
  misc_feature 1..309: note = hyper
  source 1..309: mol_type = genomic DNA
cgccggagttggacccgagcacgccgcggagcccggaccctccctcggacgctctgccccggccatggcgtcgctgctgccactgctctgtctctgtgtcgtcgctgcgcacctggcgggggcccgaggtgaggcgcctccagcccccgcgcccagcccctgaggctcccgagggcctggcagccggccttgggtgaagccgcactcggggagagaacccagggacccacgcgcttccccggggactgggtccccttcaccagtcggatccccgcgaccacctggggcgcggagcgggcctcatccatt

SEQ ID NO: 37330 - DNA, 347 bp, Homo sapiens
  misc_feature 1..347: note = chr19:19651135-19651482
  misc_feature 1..347: note = hyper
  source 1..347: mol_type = genomic DNA
tggaagcgcgcaccacggactgggccctgccgtccgccgtcggcgagcgcgtgcacttgaaccccacgcgcggcttctggtgcctcaaccgcgagcaaccgcgtggccgccgctgctccaactaccacgtgcgcttccgctgcccactaggtgagggcggggctggatgacgggggcggggctttgaatgggcggggctggcgaacgccgggaagagtcgtggtgggtggggctgggaggggcaggaccgtgtgggtgtgggcgtggctgggaagagccgggggacccttaggcgtaggacgacgtcagggggcggggccaggcagggcggggcttttgaagagagg

SEQ ID NO: 37331 - DNA, 336 bp, Homo sapiens; identical to SEQ ID NO: 4606
  misc_feature 1..336: note = chr19:19651512-19651848
  misc_feature 1..336: note = hyper
  source 1..336: mol_type = genomic DNA

SEQ ID NO: 37332 - DNA, 70 bp, Homo sapiens
  misc_feature 1..70: note = chr19:19651990-19652060
  misc_feature 1..70: note = hyper
  source 1..70: mol_type = genomic DNA
cgctggggatgcgtgtcccgggcgtcctctggaggcgcagaagtgcgtgcggcctcggtgtccaggtagg

SEQ ID NO: 37333 - DNA, 438 bp, Homo sapiens
  misc_feature 1..438: note = chr19:19843591-19844029
  misc_feature 1..438: note = hyper
  source 1..438: mol_type = genomic DNA
tggggctcccggctgcgggtccagctcccacagagaggaccgagggccgaactgcgcccgcggtggcccccgggtctgcaaaccccggagttgactgcaaggaggtccccggcctcggccacagacggttccaaccagaaacctcccctcggacactggccccgcacactcaccatttcccagcgtccgggaagtcacggtgtcctccctacggatctgtcagtacctgcaggtcacggcgcgacaaaggatgcgctagagccaccttcggccttcaggagcaggtgaaacgcaatcttcccatgggccaggaatggcgacgtccgcactgcgcaggcccagcgtggcgccgctcacatcttttcagctgaggtcctgattggacagatccaatggccccgcctctttatcactgagtgacagcggagcaggaagggg

SEQ ID NO: 37334 - DNA, 209 bp, Homo sapiens
  misc_feature 1..209: note = chr19:19932203-19932412
  misc_feature 1..209: note = hyper
  source 1..209: mol_type = genomic DNA
aaagacaggacaccccggggacccgctgtcaacgcagccgccatgttatggctggggcggagctgggcaatgagaacttggagcgcagattgtggagctgactgccgggaggcctgagttctgccactgccacagccacagccacttcctccccagttccaaccagcccctctccctctctcgggatgtcgaactggcactctcaccat

SEQ ID NO: 37335 - DNA, 120 bp, Homo sapiens
  misc_feature 1..120: note = chr19:19932472-19932592
  misc_feature 1..120: note = hyper
  source 1..120: mol_type = genomic DNA
cagggccacagaggctgggcctctaggagctgacggcacagagcagtgaagacgatagctggatctctggcgtcagcgagagacaatgggcccgccaaagccggaagccggaaaccgtcc

SEQ ID NO: 37336 - DNA, 28 bp, Homo sapiens
  misc_feature 1..28: note = chr19:19932652-19932680
  misc_feature 1..28: note = hyper
  source 1..28: mol_type = genomic DNA
atgcttgaggccccgccccctcaggtcc

SEQ ID NO: 37337 - skipped

SEQ ID NO: 37338 - DNA, 74 bp, Homo sapiens
  misc_feature 1..74: note = chr19:20011722-20011796
  misc_feature 1..74: note = hyper
  source 1..74: mol_type = genomic DNA
aacagggcggcttctggtttggcgggtcctttgtctctcggtgcagccggagctccaggtctcctcttcactac

SEQ ID NO: 37339 - DNA, 120 bp, Homo sapiens; identical to SEQ ID NO: 13275
  misc_feature 1..120: note = chr19:20012036-20012156
  misc_feature 1..120: note = hyper
  source 1..120: mol_type = genomic DNA

SEQ ID NO: 37340 - DNA, 723 bp, Homo sapiens
  misc_feature 1..723: note = chr19:20149645-20150368
  misc_feature 1..723: note = hyper
  source 1..723: mol_type = genomic DNA
ttccttcaagctcttcggctggacccccaaccacaaaccgtggctgggtgctctctgagcataaatcactgttaacttcaataagttttcaacattttaaaggtgactcccatagtttttaaacaggagaaggaaaagactgaggacccccgggatcacagcacttcccacgcacaaaccacacacggggtctggactctgccctgaggacgcttccattgtccccgcagtcggggcagacgcaagaacgcgcgcggctcttcccagggtgggctccgggcgggaagcgggagaacggaacgggatgcccgcccagggtcccggctgctggcccacctcgcatcctgtgcccggaggtgatcgacggccgagctgtgcctgccggggactccagtccgcagactccggagctgacagctgggaggccccagtcccgtcactgccggttccggccggtttcaaccagccctgcccccacctcgggatgcgcggcctggcacactcaccatttttcggcttccgggatgtcgtggagtcttagctctggatctcacagcatctgcaagtcagagggcaacagaggctgcgacagtcaccgggaactactagagcagaggatactaagcaatgaagatggaccctgagctctggctggagcgagacaaaggccccgccagctccaggacaccgccccctctaccttggctgcgcacctgattggac

SEQ ID NO: 37341 - DNA, 251 bp, Homo sapiens
  misc_feature 1..251: note = chr19:20162654-20162905
  misc_feature 1..251: note = hyper
  source 1..251: mol_type = genomic DNA
gtcaggaaaccagcacgttgggggaggcgggatcacagttacttgctgagacaagctgccctggctacgttcactcccgtcaggtaggagaggttaaagaacaggaaggctccccctccgcagggcggaactgctctgaaggcatggaggagcgacgctgaaggtggaggcttcgcccaccatgccgggagctaaaatttcttaaccaatgccggccagcgatggcagggctgcgggactacaatcccagc

SEQ ID NO: 37342 - DNA, 388 bp, Homo sapiens; identical to SEQ ID NO: 13278
  misc_feature 1..388: note = chr19:20162906-20163294
  misc_feature 1..388: note = hyper
  source 1..388: mol_type = genomic DNA

SEQ ID NO: 37343 - DNA, 240 bp, Homo sapiens
  misc_feature 1..240: note = chr19:20188764-20189004
  misc_feature 1..240: note = hyper
  source 1..240: mol_type = genomic DNA
caggcagctggagcgaagaggaaggctttcgggtttggcgcggccatttgtctcttgctgcagctggtgctccaaatctggtcttagctgcttcgtgtcttcttctccagcctctgtggccctgtgacctgcaggtattgggagatccacagctgagggacccccggaagcctagaaatggtgagagtgcctttccagcattccgagagaggggagggactggttggaaccgatgggaag

SEQ ID NO: 37344 - DNA, 37 bp, Homo sapiens
  misc_feature 1..37: note = chr19:20189420-20189457
  misc_feature 1..37: note = hyper
  source 1..37: mol_type = genomic DNA
caacgtagttcttcttcaaagacgcaacttcctggtc

SEQ ID NO: 37345 - DNA, 30 bp, Homo sapiens
  misc_feature 1..30: note = chr19:21646407-21646437
  misc_feature 1..30: note = hyper
  source 1..30: mol_type = genomic DNA
ccggggtccctgcaccggaggagagtgagg

SEQ ID NO: 37346 - DNA, 86 bp, Homo sapiens
  misc_feature 1..86: note = chr19:21769289-21769375
  misc_feature 1..86: note = hyper
  source 1..86: mol_type = genomic DNA
cggcacctggagtctcggtggaacccggcagcggtgggcgcggaccccggagaggctgccccgagcccgagcaccccctgaccggg

SEQ ID NO: 37347 - DNA, 21 bp, Homo sapiens
  misc_feature 1..21: note = chr19:21769579-21769600
  misc_feature 1..21: note = hyper
  source 1..21: mol_type = genomic DNA
cgcctgcgtgggactccaggg

SEQ ID NO: 37348 - DNA, 300 bp, Homo sapiens
  misc_feature 1..300: note = chr19:22018434-22018734
  misc_feature 1..300: note = hyper
  source 1..300: mol_type = genomic DNA
gcgtgacccaccgcgcccggccgactctcctgtttctaatagaccaaaagagggactagaaatgccacggaccaaagctcttcctattcatgaaactgcatcacgagtcaggattctctcctgacgaccctcctgtggcccctgcacaatttgggagagacgccgcgttgcggctgcagagctgcccacagagggctgcaggccgggacacagtcactgcgcagagaagagacaggacgcccggggctgcctcccagagcagccgccatcttatggctgaaggggattgaggccgagctg

SEQ ID NO: 37349 - DNA, 44 bp, Homo sapiens
  misc_feature 1..44: note = chr19:22018914-22018958
  misc_feature 1..44: note = hyper
  source 1..44: mol_type = genomic DNA
ctggacctctagcagcagaggacacagaagaacgaagacgagac

SEQ ID NO: 37350 - DNA, 218 bp, Homo sapiens
  misc_feature 1..218: note = chr19:22018959-22019177
  misc_feature 1..218: note = hyper
  source 1..218: mol_type = genomic DNA
cagagctccaactgcagccagagacaaaggccccgccacatcccggaagccgccctgtcctctcctgccccgtgcctgattggacggtttccagcccagcgtccctgattggataacttctaaggtcctgcccccgcaaaccctgaatgaaagatgtgatcagacgctgggctgaaagaagaaagaatgacagcctaggctgccgccttttcaggcag

SEQ ID NO: 37351 - DNA, 39 bp, Homo sapiens; identical to SEQ ID NO: 4612
  misc_feature 1..39: note = chr19:22034379-22034418
  misc_feature 1..39: note = hyper
  source 1..39: mol_type = genomic DNA

SEQ ID NO: 37352 - skipped

SEQ ID NO: 37353 - DNA, 592 bp, Homo sapiens; identical to SEQ ID NO: 4614
  misc_feature 1..592: note = chr19:22034446-22035038
  misc_feature 1..592: note = hyper
  source 1..592: mol_type = genomic DNA

SEQ ID NO: 37354 - DNA, 146 bp, Homo sapiens
  misc_feature 1..146: note = chr19:22610555-22610701
  misc_feature 1..146: note = hyper
  source 1..146: mol_type = genomic DNA
gccaggagtctggagcgcaggtgccgggcaggcagcactgggagcgctcggcgacttggctggaggccgaaggtgccgcccctggggaaccagagcgcctttgcaaggtgggctcggcgtacactcccctatccttctgtggcccc

SEQ ID NO: 37355 - DNA, 431 bp, Homo sapiens
  misc_feature 1..431: note = chr19:22715206-22715637
  misc_feature 1..431: note = hyper
  source 1..431: mol_type = genomic DNA
gtggggttggggccacgtcagctagattgcggcttaccactggggaacaattcctgtcggccaccgcgcaactgtgcgactgaccagaggaggcgtaaccagggcctactacagcgcagaatagggggcgtggccgccatcctccaagtccattggtcgatgagaaagatgacagagaaaggaggcgaggccaggcagcagcgcgtccaggtgggtgtgaggcgtcacaaggaaagctgagcaggcaattgctgccccgcccactctgggaagaggggcggggccgcccgctccagagggacggaagcggcggggccgccggatccagggacaatggggtggggcgggctttccctgggtgggcgcagcggcttcctgggtccccctcacgctctgggtcagagttcctttacaggcggacctgagaggca

SEQ ID NO: 37356 - DNA, 60 bp, Homo sapiens
  misc_feature 1..60: note = chr19:22715898-22715958
  misc_feature 1..60: note = hyper
  source 1..60: mol_type = genomic DNA
agctggatccagtcccgggctctcctgcttcccagctcctcctcccgcacccaacagcac

SEQ ID NO: 37357 - DNA, 56 bp, Homo sapiens
  misc_feature 1..56: note = chr19:22806000-22806056
  misc_feature 1..56: note = hyper
  source 1..56: mol_type = genomic DNA
tctccctgccagttgcggtcgtgggcggcctcgccttggagccctggccacggagc

SEQ ID NO: 37358 - DNA, 17 bp, Homo sapiens
  misc_feature 1..17: note = chr19:22806297-22806314
  misc_feature 1..17: note = hyper
  source 1..17: mol_type = genomic DNA
cgcggggagcccagccc

SEQ ID NO: 37359 - DNA, 96 bp, Homo sapiens
  misc_feature 1..96: note = chr19:22817131-22817227
  misc_feature 1..96: note = hyper
  source 1..96: mol_type = genomic DNA
gtctctcgctgcagtcggagtatggtctagtgttcgctgttctgcgtcctctggtcctagaggcccatcctctgtggccctgtgacctgcaggtat

SEQ ID NO: 37360 - DNA, 107 bp, Homo sapiens
  misc_feature 1..107: note = chr19:23253781-23253888
  misc_feature 1..107: note = hyper
  source 1..107: mol_type = genomic DNA
ccaaggcacccaccacgcagcacgccgtccctttcggcgctcggaaagccctcgggcgaacccctcccgagcccacccctcccgggacctcagaagatggctcagga

SEQ ID NO: 37361 - DNA, 144 bp, Homo sapiens
  misc_feature 1..144: note = chr19:23254114-23254258
  misc_feature 1..144: note = hyper
  source 1..144: mol_type = genomic DNA
cgactcacaagggacgcgccagagctctggtcccattgagacagttcagctgaaggctgcgggccttcccgagctccgcccagctcacagcggggacggtccctccctcggcagctgccgctggagctccggaggacaagagaa

SEQ ID NO: 37362 - DNA, 256 bp, Homo sapiens; identical to SEQ ID NO: 1364
  misc_feature 1..256: note = chr19:23257752-23258008
  misc_feature 1..256: note = hyper
  source 1..256: mol_type = genomic DNA

SEQ ID NO: 37363 - DNA, 287 bp, Homo sapiens; identical to SEQ ID NO: 1365
  misc_feature 1..287: note = chr19:23258305-23258592
  misc_feature 1..287: note = hyper
  source 1..287: mol_type = genomic DNA

SEQ ID NO: 37364 - DNA, 79 bp, Homo sapiens; identical to SEQ ID NO: 1366
  misc_feature 1..79: note = chr19:23258652-23258731
  misc_feature 1..79: note = hyper
  source 1..79: mol_type = genomic DNA

SEQ ID NO: 37365 - DNA, 151 bp, Homo sapiens
  misc_feature 1..151: note = chr19:23299633-23299784
  misc_feature 1..151: note = hyper
  source 1..151: mol_type = genomic DNA
ggaggaagtcctgcccgaaaaggctgcagcctacgctgtcactcttcattcagtccagcatctgatcacatctgtcactcagggcctgagggggcggggccttaaacgttatccaatcggggacactgggcggggggccgtccaatcaggc

SEQ ID NO: 37366 - DNA, 30 bp, Homo sapiens
  misc_feature 1..30: note = chr19:23300324-23300354
  misc_feature 1..30: note = hyper
  source 1..30: mol_type = genomic DNA
agctttggtctgtggcgttcccaattcctc

SEQ ID NO: 37367 - DNA, 30 bp, Homo sapiens; identical to SEQ ID NO: 13295
  misc_feature 1..30: note = chr19:23386702-23386732
  misc_feature 1..30: note = hyper
  source 1..30: mol_type = genomic DNA

SEQ ID NO: 37368 - DNA, 496 bp, Homo sapiens
  misc_feature 1..496: note = chr19:23598350-23598846
  misc_feature 1..496: note = hyper
  source 1..496: mol_type = genomic DNA
gtttaacaaaagagactgggagccccaccggccacagctcctcctacgcacacacgagtcgggattctgccctgatgacccgcctggcatccctgaacaatctgggaaacactcggggctgcgtgcagagctgcccagggagctccagatagggcgccgcagggactgggcgggacgcgcgggtcattgctgcgggcccagccaccatcttgcggccagagggacctgggacggagctgcgccagcagggactcaggtcggcaacccaggagcggtgaggaggccagtcccgtcggtttctcagccagctctcccctctcgggatgctcaacccctcacactcaccctttcccaccttctggaatgtcctggcatcttagctgtctgtgcacgtcccaggacctgcagatcacagggcaacagcctgtcaccggctggggcgagaggggggcagaggtggaggacgttgaatagcagaaagcgatcccaagctctg

SEQ ID NO: 37369 - DNA, 209 bp, Homo sapiens
  misc_feature 1..209: note = chr19:23654103-23654312
  misc_feature 1..209: note = hyper
  source 1..209: mol_type = genomic DNA
cgcatcgaggatgtgacccattccctggccaagggtgtgggtggggaacggcaaccgatctcactgcctggcggggcagcttcctttccaggcaaggcggagacctgcagggcgtggagaccccgcccggcgcagaacgcgctggccagtgggcagcttgacagggtccccgtgtgcctagcgaccctcttcagcgctgcatccatgag

SEQ ID NO: 37370 - DNA, 104 bp, Homo sapiens
  misc_feature 1..104: note = chr19:24154540-24154644
  misc_feature 1..104: note = hyper
  source 1..104: mol_type = genomic DNA
agctctgcagttctccgccctgcctggaaaggaagcggccccgccaggtagtgggatcggccgccgcgtcccgtcctcacccttggccccgagggggtgacatc

SEQ ID NO: 37371 - DNA, 172 bp, Homo sapiens
  misc_feature 1..172: note = chr19:29284404-29284576
  misc_feature 1..172: note = hyper
  source 1..172: mol_type = genomic DNA
ccggccagccgctgtcgctgtcgccgccgcactcgcctgtccggacgcaccttcctcctcctccgcggcccccgagaagctgggcgcgcaggcaagggaggcgcggcggcccctgcggctggtcagttcaccaggtgcctgctcccgagcgagttgccaccgaccccgccgc

SEQ ID NO: 37372 - DNA, 391 bp, Homo sapiens; identical to SEQ ID NO: 1367
  misc_feature 1..391: note = chr19:30015572-30015963
  misc_feature 1..391: note = hyper
  source 1..391: mol_type = genomic DNA

SEQ ID NO: 37373 - DNA, 905 bp, Homo sapiens
  misc_feature 1..905: note = chr19:30016024-30016929
  misc_feature 1..905: note = hyper
  source 1..905: mol_type = genomic DNA
cggggaccagaccgcgctccctcagatggctggggagggagcagactccgggtgaaggctgggggaggtaccgggatgccgagtacgccagagcaggcgggggatgggttccggcttcctgccgcctcggcatctcgctttgcaccgggcaaagaaggggccacgaccggcgaagagcgcgtggagacacagggacccgcgatccaggggcaggaaccccgccccctcccggaaacctcccgggccctgagtcgtgcccggcgctccccaccccaccccacccccgccgcccctgccgtcactcacggccgctgcgggctggctagcgtgtgcgctctccgcgccgcaggcacctgctcgctgggcgctgtgcgctcacttctccctcgcgcactgcagactcccggcgctgccgccgccacccagcgtagtctccggctgggcacagcgttccgcccttctcgcggccccgggcgcccacccatccgtcatggcccaggcctgggccaaacagcggggcagctggttgcccaaactggggtaaggagttgagggctgggagctgcagagaggaccgagggacacacggggagcagggatgagcggccgtctcgagccgtgcagactgggaagaagccagggagagtttgggtgggaggactcccaacccaagcgggtgcggggcggggctgtactccaaccagaaagacggtggtccctccgagcgacccccgaggagagagggggagcgctctggggcgggggcggggcgggctgtggcaggagaggggagggcgggggcgatgcagcggtggaggcggcttggcgcccagccactgaccgccccctcccttcccctcccctccccctctccccgcctctctccggctccgggtccgccacgc

SEQ ID NO: 37374 - DNA, 59 bp, Homo sapiens; identical to SEQ ID NO: 1369
  misc_feature 1..59: note = chr19:30017451-30017510
  misc_feature 1..59: note = hyper
  source 1..59: mol_type = genomic DNA

SEQ ID NO: 37375 - DNA, 145 bp, Homo sapiens; identical to SEQ ID NO: 1370
  misc_feature 1..145: note = chr19:30017577-30017722
  misc_feature 1..145: note = hyper
  source 1..145: mol_type = genomic DNA

SEQ ID NO: 37376 - DNA, 974 bp, Homo sapiens
  misc_feature 1..974: note = chr19:30017765-30018739
  misc_feature 1..974: note = hyper
  source 1..974: mol_type = genomic DNA
cgttcccagtcccgccggggccccggctgcggaaaggatgcctgcggggagcgggagtaggcgcgccccagccaggctctggcggtgcggccaggggcgggggagaagcacgagtcgcccctgccgccccgccccatccggagggaagcagtaggcagccgatggccggtccctgcctcggccctgcagccgcttccccgaactttgctagcccctccggccgtgcgccagggagcagctgcggggtggggggcacaaggccagccagccagagaccgactgcctcgctttaggttgccccaggcccccgacctacagctggtcacgcctctctctctctccccacccccagctgcattcacagaagtccccaaagatgtgacagtacgggagggagacgacatcgaaatgccctgcgcgttccgggccagcggagccacctcgtattcgctggagattcagtggtggtacctcaaggagccaccccgggagctgctgcacgagctggcgctcagcgtgccgggcgcccggagcaaggtaacccgccgcccacgcggtaccggcgcgcgcccggctcgcgcccggggcggcgaaggctaacccagggagggaagcagcgggcttcactcgcgcagggcgccgccctgtggcgcagcccatcttccaccttcgcatcccaaagcatcttcaaagtcagcagtggttacccccaaacctgtcaattattttgacagcatcgctgttcccaccacctcccagaactccattcacgcccagcccctaaagagccacacctcagcctggtcgcttgctcgtgctcgctggctgcggccctctgatgggtgctgggtagtgaaggaagcccccttggtcccatcaggctctccccgccctctgccactttgaggaccccagggctcccacggctgcgttccagaggccaccagaaaaccgagtaccggaaagccggcagg

SEQ ID NO: 37377 - DNA, 416 bp, Homo sapiens; identical to SEQ ID NO: 1372
  misc_feature 1..416: note = chr19:30019113-30019529
  misc_feature 1..416: note = hyper
  source 1..416: mol_type = genomic DNA

SEQ ID NO: 37378 - DNA, 81 bp, Homo sapiens; identical to SEQ ID NO: 1373
  misc_feature 1..81: note = chr19:30019530-30019611
  misc_feature 1..81: note = hyper
  source 1..81: mol_type = genomic DNA

SEQ ID NO: 37379 - DNA, 271 bp, Homo sapiens
  misc_feature 1..271: note = chr19:30019660-30019931
  misc_feature 1..271: note = hyper
  source 1..271: mol_type = genomic DNA
cgcgcctgccagcctccgctctgcgggcattcctcctagcaccgggagcgcgcggctgctcgccctcgccgcgaccgtggcgccagcttcccgccccctctgccccgccctgagcatctgctctgcgccctccgctgcaaccctttatcctccgcctggattgcgggtctgggtgcggggtgttgcaggcttgcaggggacggggtagggggtggttgtgccaggctgcgaggggcccgggtcatggggttgctaactctgggaggagatg

SEQ ID NO: 37380 - DNA, 613 bp, Homo sapiens
  misc_feature 1..613: note = chr19:30019993-30020606
  misc_feature 1..613: note = hyper
  source 1..613: mol_type = genomic DNA
cggttcagaggtgagggctccctgggtgtttgttgagagccgtagagcagtacttcccgaagtccccaccggggcgcaggggaggagcacttcgctggggggcttctggagatcccgcggaaaggcgggttggtagcaggtggccagggagccaggcagcagcctcagcgttgcttgccttcttaagaaagcacagtgttagctgtaaagggcggggtccggtgacagggtggctttccttaggaagcgattcgggcaggccctccgtgctccgggaggtgaggagggccggctggggcgggactgtcggttggagcgcgtcggggcgggaaagacgtggggaagttaaggaacaaggaatccagcctggggtttcctgaaggtgcaggagggaggaaggagaggtggactctgcccttctgaagcgccagctacgggaagacaagcagtgttggtttgtatgggcggggcagatgcaaggtgggcgtttggttaacgtgatggggacgtggggacacagtccaaagagctggctgcctggcgtccacgcagagttggaagccctatgccactgggtagacgcgggtgaaagggaagccggatcgtgatggtg

SEQ ID NO: 37381 - DNA, 196 bp, Homo sapiens
  misc_feature 1..196: note = chr19:30020843-30021039
  misc_feature 1..196: note = hyper
  source 1..196: mol_type = genomic DNA
agcacaaggcccaggcgatgctgcgcgtgctctcgcgcttcgcgccgcccaacatgcaggccgccgaggccgtgtcccacatccagagcagcggcccgcgtcgccacggcccagccagcgccgccaacgccaacaacgcgggcgccgcgagccgtaccacctccgagcccggccgcggcgacaagagcccgccgcc

SEQ ID NO: 37382 - DNA, 103 bp, Homo sapiens; identical to SEQ ID NO: 13308
  misc_feature 1..103: note = chr19:30021252-30021355
  misc_feature 1..103: note = hyper
  source 1..103: mol_type = genomic DNA

SEQ ID NO: 37383 - DNA, 402 bp, Homo sapiens
  misc_feature 1..402: note = chr19:30215009-30215411
  misc_feature 1..402: note = hyper
  source 1..402: mol_type = genomic DNA
tctggtctaaatccccgccgtaggattttatttttcggtgctgaggtgctttgctggaggagctgccagggggagctgcgcggggcaggcccggggtaccagaggcccttgctttagcggcggccctgcgtgtgccagaggcttgcagagtgatctgagcacgccaagagattgctgtcaagtaagctcctccacaaatctgcagaaacctcaaagattacagcgctcgcacggcaggagcgcagcggcttcccatacgccggcagacaatggggcggaggaaggaaggggacggtggcctggggacccccgcgcccgcagcacgtgcaccgagcctggagcgcccgctttacagatcttgtcgctccacccctaaaacaaaggccccggggccccatctgt

SEQ ID NO: 37384 - DNA, 30 bp, Homo sapiens
  misc_feature 1..30: note = chr19:30334621-30334651
  misc_feature 1..30: note = hyper
  source 1..30: mol_type = genomic DNA
cgtaccaggccaggccggccctgaggggca

SEQ ID NO: 37385 - DNA, 182 bp, Homo sapiens
  misc_feature 1..182: note = chr19:30713411-30713593
  misc_feature 1..182: note = hyper
  source 1..182: mol_type = genomic DNA
gccgggaggtctccccggggacccccactcagcttgctcaggtcctggaggcatgcagagggcgtcggcgccgacagggggagccggagagccccctgcccggccgtctgcggggctcaggcggggcttggcctccgatgagcgcgctgtctctgcccggtgggtcccaccccgcccggcca

SEQ ID NO: 37386 - DNA, 362 bp, Homo sapiens
  misc_feature 1..362: note = chr19:30713685-30714047
  misc_feature 1..362: note = hyper
  source 1..362: mol_type = genomic DNA
cgaggccgcagaagccttgggcctccaggcctggaaggggctcccctggcctggaggccatgggcccggcccagaccggccagacaccgccagggacccccagaacgacgccaggacgcgcgccgggctccgtgcctcccacggcccaggcgaggccggcggctcgagggttaaaaggcgacccccattctgtaggggagaaagtgccttttctccaagtccatatggtcacttcctttcgacctgctcggccctgctcgcctctttgtccgctctgtcacttataaagaatcacttgacttacaataacaggttcaaaagacgacggagtataatcagttgatccacgaagaattggaata

SEQ ID NO: 37387 - DNA, 230 bp, Homo sapiens
  misc_feature 1..230: note = chr19:30714426-30714656
  misc_feature 1..230: note = hyper
  source 1..230: mol_type = genomic DNA
tctcagggcagggtccgaggatgctggcagcggcaaggcccggtgcccgccgacggcgcgcctggggagaggaccaccggcggtgagggcccaggcccagcgcccagggcagctgcgacgcgtccgtctccaacgccggcacgctaacccagcgctcctcccagcgcaaagttttctgtgtctctcccctcactcttggactggttgcttgccaccgaatgactccttca

SEQ ID NO: 37388 - DNA, 581 bp, Homo sapiens
  misc_feature 1..581: note = chr19:30715288-30715869
  misc_feature 1..581: note = hyper
  source 1..581: mol_type = genomic DNA
tttgcccagaggacccgccttgcaaagttgccttaaaaaagttattttgtttgataattaagtcctggagcccatcgcatgatgattattctacacccataaggcagagaacctgcgtgacgtttttctcgaagtttaattaccgtatgctaatttccttgcctactacgtgattaattaaaatcatattttcataatcatttggcactagtattgttttagaattatcatgatctcctaaatagtgtctgtaaataaagtcgcctctaatggcaggcgcgggaggcgaggctgaggacctctccgcgtttgtatcgcggcgattggcaacataactgccttatttacattaaatacgccacaaggttacagcgcggatcaacgtcatttgatcgctgatgactcccttaaacgcccgggctgtgactgattcttcgcgtcccgctgtccaccgagattcacccgggagtttttttttttttttttttttttcctcccagaaaagaaacagactttaaatagtttcaggagcaggtaagaattacgctttttcctcgccccttctccgtctctctctcctc

SEQ ID NO: 37389 - DNA, 554 bp, Homo sapiens
  misc_feature 1..554: note = chr19:30716216-30716770
  misc_feature 1..554: note = hyper
  source 1..554: mol_type = genomic DNA
ggcgacaatggagagcgtttttaatggtacaatgcatttcacctaccagatagggggaggccgagccggggatggggatgtctgctggggctgggtgatgagtatcaatgaacggggcgattctgaaaagaggctgatgaaaatcgagcccgccctgccccggctgggctgggaacagttcgcagggctctgccgagtgggcgagtgaggcgcgcgagcagggcgcccgtcccccctcagccccggaaaatgatcaagtcaatcgtgtgggcatgtttcattattcattgaacacaatcttttacaacgctccgtttacgtgcccgagtttgctcctgacgcccgcgtttcaatgtttaaggtaaggaaaacaaaggtgggggggggatcgcggggcgcggcgcggtgcggggggcgcggcgcgggggggcggcggcgggtgggggggcagcttcggcgtccgggaggtggcaaagtgagtttggactcttggcgcggcccccccgtcccctccccctccccatctcggcgaggcctgccgcccggttccttct

SEQ ID NO: 37390 - DNA, 782 bp, Homo sapiens
  misc_feature 1..782: note = chr19:30716952-30717734
  misc_feature 1..782: note = hyper
  source 1..782: mol_type = genomic DNA
cgcctccccgcccgcggtcccgggaccgttactttgaaaaggagtcccgaggcctggcgcccggcgcgcgatcgggaccccgcgtccagctccggggacccggccggcgccccccacccgcgagcggcccgcgagccactctcaggccccgggaaactttcaagagggtctggggggtggggggagtaaaaaggggagggggtaggctggggccgcggaaacttctgctcaagtgactttccccattttctcctctgcctgggacgggggttcgccttgcgctctttctctggtccgcgctcactgcggggttccggcccctccgcccgtggagagagggtaatttgcaaccttttttttttttcaattaaagttagctgatgcttacaatgtgtcaaacttgcgggcgccgagagccgctgagatctgccattttgtgattgcatcggcctcctgtgccccgggagcctggccaggctgaggccggagagttggtttcagggctgaggtgccagggtccgaacccgcgaccccaggaaaggccgtggcgcctgcaagcgcaggcggcgcccgcagcacctgccccagccgggcctcggcctgggggcccagccgggggccaaagaggaaataaataaataaataagtaacaggttatggagggaaaagagccggccagtcccaggctggagaaatgaggccaatcagagcgaggaagtgcgggcgtgggggctctggaaggcagaggagaggcagggcttgcgcggcgtctgggaagagtg

SEQ ID NO: 37391 - DNA, 989 bp, Homo sapiens
  misc_feature 1..989: note = chr19:30717942-30718931
  misc_feature 1..989: note = hyper
  source 1..989: mol_type = genomic DNA
aaagtgtccagatctcgacgcgcccatctgttgcagttttgcaaataatttaaaatatagatatctccatatagacggatgtatgtgaagtggaggaaggtcgaaacgcggggaagttagggaaaaagaaagaaaaagggctgggcagagagagacctgtgttgctcactcttcactctgcggagtgaactccggcagggctttctttggggacaggtggaaagttaagtcccccccttttcacttctgtattgtgagtggttcctactgtgtgcctgttggagaacatgtccaccgttcccgagttaggtggaggattggaatgttggggggcggggagcgttggagttgaggacgcagtggccaggggctgggggccgagaaagagcagggcggggtctcagccccgcgtgcgggtggcagcggcggccgggttttgtttgccagatattgttatgtctaacgggtgcctcgccggagacgtgatttgtcagccgccttcgttttcactttagcagaaaatacggcagctgcgaggtgtcccggcctgcggggctcgggcacccggtgcgtcctgggggctgggtcgtgtgcgcgggtgggagccggcggccggcggggccggggcgaggggcgagcgggaggggcggagtgagcgagcgcgcggtacggccctccggttcctcctgcgccttctcccggcagccgccgccgccgccgccgccgctgtgcaatttagcagaaatccgacaggggccgcgtttgctgagcgcatccggcggccgggcagcccgagcgggccgccgggcctggtcggccggtgtagaggcgcggagggggccggcggaggggaccggcggggatgggcgcgggaagcacgcctgaccagagcacgcgccgttccccaaccctggtgtccccggcgagttgggcagccccgcgcgccctgaccttgacgccccagtctccagccagggcttaggtgaact

SEQ ID NO: 37392 - DNA, 29 bp, Homo sapiens
  misc_feature 1..29: note = chr19:30718991-30719020
  misc_feature 1..29: note = hyper
  source 1..29: mol_type = genomic DNA
ggtgagactgggaacgcgctgttttcttt

SEQ ID NO: 37393 - DNA, 803 bp, Homo sapiens
  misc_feature 1..803: note = chr19:30719236-30720039
  misc_feature 1..803: note = hyper
  source 1..803: mol_type = genomic DNA
tggggacagggcccccgcccccgccggggtcgggtttgatggtgaaatagtaaacccacgcacggagggtcgccaggaaagtggacattaccgctttaattaacttcgagatgctccggcggcgggacctggcgtagccgtgacgcgcccccataaatctgcccggcccggggctgctccgagaactcgtacagtagcggcgtcagatccatcccgcgcctcccagtccggagtccatttgcataattggattttttttttttgcctccttctttctccctgaaacttgtttgaaaacccaagtgaaaaccgcgacgatctgcacactcaaaagcaagtgccaagtaagtgccctgcggtggcctcggcgcgccccggggtgagcgcgcaaagccgggagcgaggtgccgcgagctgcgcgccgccccgggccggcctcgcgtgtgggcggctgggcggctgggcggcgggaggacggcctccgcgggctccgggactgcccggctggctgctcgcacaactttttttttttcccccgtctgctgacttttcgggccaggtgaagtgtttgggccacgcgtgtacctgtggcgagactcgggaggcgatcttggggggcgcgcggtcgcagttgggcatcttgcctgggtcgggggcgggcagtcggtcccagtggccgccgctgagggcagagctgcgagcgagcggggccggctgctggtcgcgccgcgccgtaaatgcaagcctgtagccaaatgcttcccccattattctaaggtttgtgtctgcgtgtgcgtgtatgt

SEQ ID NO: 37394 - DNA, 566 bp, Homo sapiens
  misc_feature 1..566: note = chr19:30865459-30866025
  misc_feature 1..566: note = hyper
  source 1..566: mol_type = genomic DNA
cgccctgaagaaaggcgccttggcaccgcctcggtgcccaccagaaggtgcccggattgcctcttttgcgcaaagacaaagggggtaattttttggcaagaaaacaaacccaaggaaaacacaacaaactgagtgttgtttttttttctttccctcctgcaacttctcggaccgtctctgccctctctcctccagagagggcgagtttcatcctggagggaggccgggggagctgcgaggccacccccagccggcgcccgggcggattgcgagcccccgcgggtccggccgggggagcggagactggccccccgcccgggctggggcgcctgccgcccgcgagccggaagagcgccccattcacgagcaggcagccctggcagagggttaattgaggatcattgttgttggttccaggaggagcgaagcgcctggagatcgggcgcgcgggcgcggctctgggagcgggggaaggtgaggggaaatgggacatgatggcattaataatcgttaccaaagacggtgggagtaacaaaggaatgcgtctccgagacgccgcccagccc

SEQ ID NO: 37395 - DNA, 51 bp, Homo sapiens
  misc_feature 1..51: note = chr19:30866452-30866503
  misc_feature 1..51: note = hyper
  source 1..51: mol_type = genomic DNA
cgcacagtgcgctgcggcccggggtgtgggaggtcccgggacttggggtgt

SEQ ID NO: 37396 - DNA, 91 bp, Homo sapiens; identical to SEQ ID NO: 13318
  misc_feature 1..91: note = chr19:31839837-31839928
  misc_feature 1..91: note = hyper
  source 1..91: mol_type = genomic DNA

SEQ ID NO: 37397 - DNA, 1236 bp, Homo sapiens
  misc_feature 1..1236: note = chr19:31839941-31841177
  misc_feature 1..1236: note = hyper
  source 1..1236: mol_type = genomic DNA
cgcacccaaacaggagagcggcgcccggagttactcagtgcgggcagaagagcggggcgaggagcggggtcgcgcccgctggaggcgcggggcgagcggaggaagaggaggaggagagcagaaggaaggggaagcggctcgtacctgctgcgcgccggggcgcctgctgcttcctcctcggcatgatgcttctccggcgactgccactgccgccgccgccgccgctgccgggctgaggacagggagggagggggcggcgggcccgcgggggggcgaggcgggcctgctctcagcctcccccccggagagcggccgcccgcaggatgctgctgcgcccaggctctccgcgtcccccccgcgccgcgctccgccgcgaaccccgaacgtgcggagggaagaaggagggcgggcgagggaggctcggggagggaggagcacgggggggaggaggaggcagaggaggaggaggtggaggaggaggaggaggaccgcgctgccggcggaatgggaagtttgacaaatcgctccagaggccagaggaggagggggcggggaggagcggcggccctgcccccccccgccccgtccccagacgaggtgcgcggggttcggggctggggggcggggagagggcgggcagagcggtgggaggaggagcgcgggagcggcccggaccggtactgccccggcccccgcccctaggccgggggtcacggcatccggggggacgcgcagccgccgccgcggcccggggctcggcggtccagtcttctgcccgtggcgcggctggagcggcggcgtcggcaacaggcaagcttaaaggaaaaggagatgatcgtgtcaatcgcccgcccgcgggggcgccgcgcccccgcccccggccccaggcccgcgtgggacccccgccccgccagcgaaaggggtgccgcccctccgcctccgccccgtgcgcacacgcgggggcgcggcgccagccccgccgagcccgtcccggggcgctcgttaccccccacccctattcccacccagcgttcgtccccagccaccccccagctgccccacccggctcgcactcctctccacccgccgactccggagcccccagcgtggtccccgggccggggctggcgtcccccggggaagccagagcccacgggcaggccccctccagggaggaggcgggcgcgggccggggcgggtgggggcagccctcagaccccgcgccacccagctcct

SEQ ID NO: 37398 - DNA, 59 bp, Homo sapiens
  misc_feature 1..59: note = chr19:31841442-31841501
  misc_feature 1..59: note = hyper
  source 1..59: mol_type = genomic DNA
gagagcctagggggccgccgcgccgtgtcccgcgcccggcctgccggggctgctggact

SEQ ID NO: 37399 - DNA, 30 bp, Homo sapiens
  misc_feature 1..30: note = chr19:31841966-31841996
  misc_feature 1..30: note = hyper
  source 1..30: mol_type = genomic DNA
caccggctgcctgagcgctcctggagcagc

SEQ ID NO: 37400 - DNA, 195 bp, Homo sapiens
  misc_feature 1..195: note = chr19:31842286-31842481
  misc_feature 1..195: note = hyper
  source 1..195: mol_type = genomic DNA
ccccggctataaagccgcctccagcgcctttccgcgcgcaggagcgctcggagttgtggggtacggaccccaggcggggcagggagtccgaggcgggctgcggcggggctctcgggctggcggactcgggggctgaggcgccgtgcgcgttgggtgcccgcggccgcagaggccagaaccgctactcctccaggc

SEQ ID NO: 37401 - DNA, 30 bp, Homo sapiens
  misc_feature 1..30: note = chr19:31842828-31842858
  misc_feature 1..30: note = hyper
  source 1..30: mol_type = genomic DNA
cgcgtagccggccgccgccgctgggtcgct

SEQ ID NO: 37402 - DNA, 172 bp, Homo sapiens
  misc_feature 1..172: note = chr19:32715595-32715767
  misc_feature 1..172: note = hyper
  source 1..172: mol_type = genomic DNA
taaatatgttcattccgctcttgcgatcggtgataaaccggaggcggccgaggccgacagaggtcagcaggccgctcgccacgggtctgcgagcggacactgccaccctccggccgcgcgcgggactgcaccggccccaccgcccggctctcccgcccgctcgctgcccgcc

SEQ ID NO: 37403 - DNA, 43 bp, Homo sapiens
  misc_feature 1..43: note = chr19:33166926-33166969
  misc_feature 1..43: note = hyper
  source 1..43: mol_type = genomic DNA
ggatggacgagggagcgggggaccgctaacggggctccctctg

SEQ ID NO: 37404 - DNA, 414 bp, Homo sapiens
  misc_feature 1..414: note = chr19:33166988-33167402
  misc_feature 1..414: note = hyper
  source 1..414: mol_type = genomic DNA
cgcacgtcgagggtcccgggcgggctccgtggacgttggcggtagcgccgagcgagtcacggaccatgaagagcgttcgtgccgcgcggcccaaggccgggatgggggttagccacatcctgccgcgctgagggggaggctaacgggcgcgggcggccgggcccagccggagcccaccgcgatggcgagggaggagtgcaaggcgctgctggacgggctcaacaagacgactgcgtgctaccaccacctggtgctgaccgtcggtggctcggcggactcgcagaacctgcggcaggagctgcaaaagacgcgccagaaggcgcaggagctggcggtgtccacctgcgcccggctgactgctgtgctgcgcgaccggggcctggccgccgacgagcgcgccgagttcgagcggct

SEQ ID NO: 37405 - DNA, 30 bp, Homo sapiens
  misc_feature 1..30: note = chr19:33167843-33167873
  misc_feature 1..30: note = hyper
  source 1..30: mol_type = genomic DNA
ggccctagccgtgtgcgtggcgaagctgag

SEQ ID NO: 37406 - DNA, 42 bp, Homo sapiens
  misc_feature 1..42: note = chr19:33685611-33685653
  misc_feature 1..42: note = hyper
  source 1..42: mol_type = genomic DNA
agccagagccggagccgcagccggaaccggagccggagccgc

SEQ ID NO: 37407 - DNA, 80 bp, Homo sapiens
  misc_feature 1..80: note = chr19:33716537-33716617
  misc_feature 1..80: note = hyper
  source 1..80: mol_type = genomic DNA
tgggactggggagggcgagggcgcaggcctggggttcccgcgcccgctcggctgctgcgtgtggccggccatgtcgctgt

SEQ ID NO: 37408 - DNA, 58 bp, Homo sapiens
  misc_feature 1..58: note = chr19:33717533-33717591
  misc_feature 1..58: note = hyper
  source 1..58: mol_type = genomic DNA
ggtgcaggtcccgcgcgatccagcccggctcaagaaggccaggcgacctggaatgccc

SEQ ID NO: 37409 - DNA, 37 bp, Homo sapiens
  misc_feature 1..37: note = chr19:33717859-33717896
  misc_feature 1..37: note = hyper
  source 1..37: mol_type = genomic DNA
ccttccccccagtggcggcctccgggtttgctggggc

SEQ ID NO: 37410 - DNA, 60 bp, Homo sapiens
  misc_feature 1..60: note = chr19:33792521-33792581
  misc_feature 1..60: note = hyper
  source 1..60: mol_type = genomic DNA
cactcgcgcggaggtcggggtgcgcggcgcccagccccttgagcgcgctgccagggcccg

SEQ ID NO: 37411 - DNA, 295 bp, Homo sapiens
  misc_feature 1..295: note = chr19:33794450-33794745
  misc_feature 1..295: note = hyper
  source 1..295: mol_type = genomic DNA
cgagggtgtccaggccgccgggctgccaggtccgagcacgcacagggagaactctgcccagtggttcgccgggcgctgtagtccccgggatcctagggaccgaggcggccaggccctggggccccttgagtgcggcagctaatgctctcaccgcggcgggggaaggagcttgccaccgagacccccagccacgtgcgtccctcgcattctttaccggggccggggtggcggctacggaccgtcagctgggcccagatggagtcttgggagccctcaagtgtctcctgtccttgcc

SEQ ID NO: 37412 - DNA, 15 bp, Homo sapiens
  misc_feature 1..15: note = chr19:34112272-34112287
  misc_feature 1..15: note = hyper
  source 1..15: mol_type = genomic DNA
atggatgcggacacc

SEQ ID NO: 37413 - DNA, 404 bp, Homo sapiens
  misc_feature 1..404: note = chr19:34112326-34112730
  misc_feature 1..404: note = hyper
  source 1..404: mol_type = genomic DNA
cgagctgaagcccagggatatcccagaatcttcctcaggatcaatcttccgcctttcaccggccctgcgcccccgcagcatcgggtcctgggcgcgcgcccctgccccgctgtggtcaaggcccgccccggtgacgcctggtccttttcccgggttggcgccgcgtgcgacccaccgaggcagtggcagcactggccgcggtctggagcctagcgtcaggccggagtccggctctcctgaaccgggagaccggcgcagccccagccacgaccgctcccacccccgcggccgccggaccgcgcccagcagcgactctttctgagagcgctgccagaggggccgcgggagccgcagagcgcgcgtgggcgcggcgcccgcgagcccccgggagggccgagtgcatc

SEQ ID NO: 37414 - DNA, 82 bp, Homo sapiens
  misc_feature 1..82: note = chr19:34113221-34113303
  misc_feature 1..82: note = hyper
  source 1..82: mol_type = genomic DNA
ccccacccctgttcccgccctgcgcaggctcctggcctgcagagacgccaggaaggggtcccgagcgggccccggactgcac

SEQ ID NO: 37415 - DNA, 32 bp, Homo sapiens
  misc_feature 1..32: note = chr19:34113366-34113398
  misc_feature 1..32: note = hyper
  source 1..32: mol_type = genomic DNA
cggggctcgggtctggttgcactttggggacc

SEQ ID NO: 37416 - DNA, 651 bp, Homo sapiens
  misc_feature 1..651: note = chr19:34113399-34114050
  misc_feature 1..651: note = hyper
  source 1..651: mol_type = genomic DNA
gccccggtagcgggaactttaattagactttctctccttggatctcactcgctgccgcgcttctgggaactgccgtccctcgggccctcttggtccctgcggactcccgctccgcctcctggccctcggtgctgcccgcggggaggcggcgtcgggcgctgagcagcgagcgccgagggccaggcaggagcgctcggggcgctggggcttcctggcgcgctcggagccggggctccggacgggttgcggcgggcagagactatgggggaagtttaagtggccttggcttcctacccagcggctccgtcgcgcgcgtccccgacccgcaactctccagggcaccggcctgtgagtgctggaggcgagtgtgcgtgcgtcagcgatggtgtgaaggtgtgtgcgtgcgtgtgtcgggagtgcgggagtcggagcctggggcggctccagggggcggggaaatgatccgtttggccgcgggaccgagccgagctctgacggcggctgcaactccggctaccgactctgcagacccgctctggcctcgctggaggccagccgggccaggagggcgatcacgggttttggcagtgcccgatgctggggcttgggtctgatgtgaccccgattccttctccagtgcgggactcccgc

SEQ ID NO: 37417 - DNA, 17 bp, Homo sapiens
  misc_feature 1..17: note = chr19:34114286-34114303
  misc_feature 1..17: note = hyper
  source 1..17: mol_type = genomic DNA
cgcgtcccggcccctct

SEQ ID NO: 37418 - DNA, 73 bp, Homo sapiens
  misc_feature 1..73: note = chr19:34175192-34175265
  misc_feature 1..73: note = hyper
  source 1..73: mol_type = genomic DNA
cttgtaacagggcagcggacagcaggtaaattgccttccccgggagtagcgtgccgcccggcaggggcctggg

SEQ ID NO: 37419 - DNA, 75 bp, Homo sapiens
  misc_feature 1..75: note = chr19:34175542-34175617
  misc_feature 1..75: note = hyper
  source 1..75: mol_type = genomic DNA
taagcgagagccgcgcgcagggaagaactagtctgacaaaacagaaggaggtggtgctctcgggggactgggctg

SEQ ID NO: 37420 - DNA, 114 bp, Homo sapiens
  misc_feature 1..114: note = chr19:34288561-34288675
  misc_feature 1..114: note = hyper
  source 1..114: mol_type = genomic DNA
aaacacacccgggggcggacccccgcctctgcagcgcctttctgtcttccggcggcccccacccgcgactgcagaaagataagcttcaagttttcgctccgtatctcaaatgtg

SEQ ID NO: 37421 - DNA, 32 bp, Homo sapiens
  misc_feature 1..32: note = chr19:34311466-34311498
  misc_feature 1..32: note = hyper
  source 1..32: mol_type = genomic DNA
acgcagaccagatctcgcgggggtgggctggg

SEQ ID NO: 37422 - DNA, 79 bp, Homo sapiens
  misc_feature 1..79: note = chr19:34396820-34396899
  misc_feature 1..79: note = hyper
  source 1..79: mol_type = genomic DNA
tccctggggacccaccggatcggagagggggtcgggggcgaaaagcgccaggaggctggcagcccgggctggaacccgg

SEQ ID NO: 37423 - DNA, 30 bp, Homo sapiens
  misc_feature 1..30: note = chr19:34972190-34972220
  misc_feature 1..30: note = hyper
  source 1..30: mol_type = genomic DNA
cgcatctgcgctaggcgcacagtattcctg

SEQ ID NO: 37424 - DNA, 126 bp, Homo sapiens
  misc_feature 1..126: note = chr19:34972522-34972648
  misc_feature 1..126: note = hyper
  source 1..126: mol_type = genomic DNA
cgcggccgccgccactccccccacattccagaggccgcagcgccgtctccttcctcgcattcctgcccccgcaaaggagtccctccgccccgcgcgaggccgcggcgaggagggggcgcggcccgg

SEQ ID NO: 37425 - DNA, 449 bp, Homo sapiens
  misc_feature 1..449: note = chr19:34972675-34973124
  misc_feature 1..449: note = hyper
  source 1..449: mol_type = genomic DNA
cgcgcgccgccgagcagggcgccgcgtcccccggcccgcgcgtggccgccggaacgaccccggcccggcgccggccccgccccgccccgcgcccaggggtcccggggcgggctccgggcttcgggcggacgatgcggcggcccggccggagcggcggcgggaagcggaggcggaggtgacgcgccagggccggcgggccgggccatgcagcgctccagggcgggcgcggacgaggcggccctactcctggccgggctggccctgcgggagctggagcccgggtgcggctctcccggtcgggggcggcgggggccgcggcctgggcctggagacgaggcggcgcccgcgctgggccgcagagggaagggcagcggcggccccgaggccggggcggacggactgagccgcggggagcggggtccccggcgcgcggcggttccggagctcag

SEQ ID NO: 37426 - DNA, 215 bp, Homo sapiens
  misc_feature 1..215: note = chr19:34973242-34973457
  misc_feature 1..215: note = hyper
  source 1..215: mol_type = genomic DNA
cgctccggtcgctcggacccgcgtcccggtcccgggccgccttcggtgggcagcgcccgctccagcgtttccagcctcggctcccggggctcggccggcgcctacgctgacttcctcccgcccggcgcctgccccgcgcccgctcgctccccggagcctgcggggccggctcccttcccgctgcctgcactcccgctgccccctggccgggaggg

SEQ ID NO: 37427 - DNA, 91 bp, Homo sapiens
  misc_feature 1..91: note = chr19:34973553-34973644
  misc_feature 1..91: note = hyper
  source 1..91: mol_type = genomic DNA
cgctcggcccggcagttccctgcgcgcatggctggggtccggggttccgagactgcctcgggtaggcggccggatcagcggaggagagcac

SEQ ID NO: 37428 - DNA, 121 bp, Homo sapiens
  misc_feature 1..121: note = chr19:34973645-34973766
  misc_feature 1..121: note = hyper
  source 1..121: mol_type = genomic DNA
gggctggctgggggtgcagcagtgcacggggttgggacgaggaaggtgcatcccctggggactggggagcgcaaagggtgagtgagtgcgcctggatccccagcagcggcttcacccctgc

SEQ ID NO: 37429 - DNA, 255 bp, Homo sapiens
  misc_feature 1..255: note = chr19:35068601-35068856
  misc_feature 1..255: note = hyper
  source 1..255: mol_type = genomic DNA
cgtgtcctgggggcgggcccgggtggcgtggcttggctggacagggagggtaggggcggtagtggggtttgtggcactccagcgtagcaggttgcatctgcgggtccccgcccctgccccgcccccagcccctcccatggtgctggatccaggcagctgatgtgcaggcggggacccctggctgggcgcggtcctgggcgcgtccctgcgcggttcaggcttccatgcgcgctgagactccgctggctctgtggc

SEQ ID NO: 37430 - DNA, 30 bp, Homo sapiens
  misc_feature 1..30: note = chr19:35168907-35168937
  misc_feature 1..30: note = hyper
  source 1..30: mol_type = genomic DNA
tgagagcgaagtgggcgcgagagcagacgc

SEQ ID NO: 37431 - DNA, 377 bp, Homo sapiens
  misc_feature 1..377: note = chr19:35263586-35263963
  misc_feature 1..377: note = hyper
  source 1..377: mol_type = genomic DNA
cacctcaccctctcccgggatctccataacctagggcatcaaaagggagaagcacagagtcccggcatccgccgtattacagcggatgggtgcatgcgggcggtgacccgagctcgcgcgggctgcggaaccctccactcaccaacgccggcgccgccatgggcccagggggctgggtgaggccgtgagagtcggcgaggaagccggtcctgcgggctcggccgaccccgggctccggctctgggctgcgagggacctcagtccccgccgtcgtgtaaaatgcacacaaggttcgcggcgccgcctctgcgcgccgtgaggacacagggctgtcgccaaggccccaggaagggttttgcagacgcttgtgggggtgg

SEQ ID NO: 37432 - DNA, 26 bp, Homo sapiens
  misc_feature 1..26: note = chr19:35395923-35395949
  misc_feature 1..26: note = hyper
  source 1..26: mol_type = genomic DNA
cccagctgcaagggccggcgcaccca

SEQ ID NO: 37433 - DNA, 216 bp, Homo sapiens
  misc_feature 1..216: note = chr19:35396250-35396466
  misc_feature 1..216: note = hyper
  source 1..216: mol_type = genomic DNA
cgcacaagctgctcttcacgggcaactacctctgcaagcttcacccccggccccgccacgccccgcagggttccctgtctggtctggatcacctcgctctccctgcgcctctctccttggcctagctagacaagtgcttctcacgatccagcgcgtttaccgctcggtttcgtcgccgctaaggggtggtggtgtctgatccgtcaggctctgcgc

SEQ ID NO: 37434 - DNA, 30 bp, Homo sapiens
  misc_feature 1..30: note = chr19:35503957-35503987
  misc_feature 1..30: note = hyper
  source 1..30: mol_type = genomic DNA
agtttgagtcctgggcgcaggccctggagg

SEQ ID NO: 37435 - DNA, 126 bp, Homo sapiens; identical to SEQ ID NO: 13334
  misc_feature 1..126: note = chr19:35531737-35531863
  misc_feature 1..126: note = hyper
  source 1..126: mol_type = genomic DNA

SEQ ID NO: 37436 - DNA, 121 bp, Homo sapiens
  misc_feature 1..121: note = chr19:36024853-36024974
  misc_feature 1..121: note = hyper
  source 1..121: mol_type = genomic DNA
aagtgatgttcatggcgcttcgcgtgaggtgagctttgccctccctgtgatgcacaaaacaaggacacttggaaccttgccggggacgtgctgaccacttcgcaggcgagagctcagggaa

SEQ ID NO: 37437 - DNA, 730 bp, Homo sapiens
  misc_feature 1..730: note = chr19:36048580-36049310
  misc_feature 1..730: note = hyper
  source 1..730: mol_type = genomic DNA
ccaggctgaggtaggcggtctggaaggcctcgcgccactgctcgtccagcggcagctcctggcccttgataaggatggagctgcagcgctccagcacgcgctcgggggcgcccttcatcaccagcaagtgtcgcgggtcccgcgggtcctccagcgtatggatggacagctgtgggcgggggggagaggcgaggctgtggacgggggaacggggcggggctgtggacgagggaacggggcggggctgaggagaggggcggggccgagagctcggtgcgggctctgagagctgcggggaagggtgaaggtggaagatggaggccttgtgtggaggggtccttggtagaaggtaagcgttaaggcggggctaggtgcagatttggagtcctggacgcagggaatgaacagaattagggtgcggagttgggctgggggcggatttggagagcgaggtgctccccatggacagtcccgccgaggagaagctgtgggcggggctgggtggtgggcggggccttgcctctggtggacggggccataggcggagcgggagatggggtggggtttggctgcggagagaaggggcaaggagcgaagcccctcgtggcccgctgatgtgggtgtggcctggggcggggcccgaggtgggcgggcccaggccgtgggcggggccggctgcgcacctggaacttgttggtggagttgaagggtatctcgcagacttttggga

SEQ ID NO: 37438 - DNA, 225 bp, Homo sapiens
  misc_feature 1..225: note = chr19:36334979-36335204
  misc_feature 1..225: note = hyper
  source 1..225: mol_type = genomic DNA
ggtttccatggtgggcggggctcacagtgcacgtccagccgcagccgcgcttccgcggtgccctcagagttctggcagtgcagctgatagaggccgtcgtccgcgcgggtcacattccacagatgcagagccccgctggacaggatgcgatgccgggggccgcccgctggggaaggccagaataagggacctggcaggacctcccatccccgggacccctcccca

SEQ ID NO: 37439 - DNA, 96 bp, Homo sapiens
  misc_feature 1..96: note = chr19:36336604-36336700
  misc_feature 1..96: note = hyper
  source 1..96: mol_type = genomic DNA
gcggattgctgctgacgctgacgcatgtcaagtttaaggcgtctcccgggcgcagtgcggatgcgttggccaggatcgtcacgttagttgggggaa

SEQ ID NO: 37440 - DNA, 102 bp, Homo sapiens
  misc_feature 1..102: note = chr19:36337017-36337119
  misc_feature 1..102: note = hyper
  source 1..102: mol_type = genomic DNA
tcccagatttctccacgctgccgagatgcacgcgccgcgactcctgcggcagccgcgactcggtcacggtgcgcgagtcctacgggccgggagtgactgggg

SEQ ID NO: 37441 - DNA, 208 bp, Homo sapiens
  misc_feature 1..208: note = chr19:36347809-36348017
  misc_feature 1..208: note = hyper
  source 1..208: mol_type = genomic DNA
cccagagacccaggccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttggggg

SEQ ID NO: 37442 - DNA, 147 bp, Homo sapiens
  misc_feature 1..147: note = chr19:36351801-36351948
  misc_feature 1..147: note = hyper
  source 1..147: mol_type = genomic DNA
ttcgtccagttgggccgattctgcaggcaaagccggagcccgtgtccgtggacgtgggggaagacgcttccttcagctgcgcctggcgcgggaacccgcttccacgggtaacctggacccgccgcggtggcgcgcaggtacagccct

SEQ ID NO: 37443 - DNA, 30 bp, Homo sapiens; identical to SEQ ID NO: 13340
  misc_feature 1..30: note = chr19:36361080-36361110
  misc_feature 1..30: note = hyper
  source 1..30: mol_type = genomic DNA

SEQ ID NO: 37444 - DNA, 405 bp, Homo sapiens
  misc_feature 1..405: note = chr19:36449891-36450296
  misc_feature 1..405: note = hyper
  source 1..405: mol_type = genomic DNA
tgtttccagggctgccgcttcatcacggctttctcggaaaacgggggcgctgagaagcccaacttccagctatatatgtcgccaccgcccacagggcccccgacggcgatgctggtgacagcgctccctgcgtgggcgccactctccccgtgctccccgcgcctgcagccaggcacgacggtgtgggtgtgcccgcccggggcagaggagctgcagggctcgcggcaggcggcgctgtgcaagcagcgacgtcgcggcccgaggaagtggaggcggtgaacgcgcgtgggcgcgcctcccgggacacggcgctggctctgcggcgctacctgctgggcactccctaatcgatggtgacgccgtcgctgccgcccggcgaccggcacaaggagtttgcggtggtgg

SEQ ID NO: 37445 - DNA, 15 bp, Homo sapiens
  misc_feature 1..15: note = chr19:36450544-36450559
  misc_feature 1..15: note = hyper
  source 1..15: mol_type = genomic DNA
cgccccagggtcgct

SEQ ID NO: 37446 - DNA, 567 bp, Homo sapiens
  misc_feature 1..567: note = chr19:36523333-36523900
  misc_feature 1..567: note = hyper
  source 1..567: mol_type = genomic DNA
gctggagagggtgcccggcaggctccagggtccaagcccctaggagcttccagggccccgggtggcctccgcgcaactggatcttgggcaaccatagggacccccgttacccatagagggccccggtgtgtgcgcccagcgcctgccacctcccccaggcccagccccccattcttctcctcccgcgtcaggcccctcagtcgcggctgccccctccccgggtttgtttatctcgggattcaggatgcttcgcccctccccttctccgcgggccgccccctccccatcttacctcgggcagacagcgctggggaccaaagtggagactggggagactgtgggagcaatggggtgtcggtgtcaggggacgtgatgggggaggcaagggagacagagagaaggggacgaggcccagacgccgacagggggtgggggcggagagggaggggcgcgactgcgcatgcgcctgctgcccccctaccggcggcgggggaggagggaccaggaggagggaccgggaggcgctcgcattgatggaggggccagaggcggcgactgaaaggggag

SEQ ID NO: 37447 - DNA, 41 bp, Homo sapiens
  misc_feature 1..41: note = chr19:36736016-36736057
  misc_feature 1..41: note = hyper
  source 1..41: mol_type = genomic DNA
agacccggcgagcctcgctgcccttgcgagagccatggatt

SEQ ID NO: 37448 - DNA, 265 bp, Homo sapiens
  misc_feature 1..265: note = chr19:36736314-36736579
  misc_feature 1..265: note = hyper
  source 1..265: mol_type = genomic DNA
cgacgcccacccagaaaatccggatcacatttcccgtggtccaccgcgcatctaggaggttacctgcgtccaggcggtgacttgcgagggaccacctttcccagggtccacggcgcatttaggtggtggcttgctctggactacatttcccagggtccaccgcggatctaggaggaggcttgagatgcagcctcccagcttcgaggctaccacctgcccgaattggtgctttggcagagtctctggtgcccgggtgaatgggttc

SEQ ID NO: 37449 - DNA, 225 bp, Homo sapiens; identical to SEQ ID NO: 4642
  misc_feature 1..225: note = chr19:36822242-36822467
  misc_feature 1..225: note = hyper
  source 1..225: mol_type = genomic DNA

SEQ ID NO: 37450 - DNA, 335 bp, Homo sapiens
  misc_feature 1..335: note = chr19:36822557-36822892
  misc_feature 1..335: note = hyper
  source 1..335: mol_type = genomic DNA
cgtggccgaatagcccaagactgaggactcacacttcccactttgcacctggaggccacctgcagaccaaccttgcgccaggcttccggaaatgggagggcgggcttccggaaacggcggccaatgggaaacgtgatcagatgttactaggcagacagtccgtttccaggcaacacagaagaaaggaacgcgctcagtcagcctcaaatagacggagatttcagccaatggatgtgcaggttccctccacattagccaataagaagtgcttggggcctacctgcctacaagcacagcaaaagctttcctgcgcatttttgcgctggaatggctac

SEQ ID NO: 37451 - DNA, 281 bp, Homo sapiens
  misc_feature 1..281: note = chr19:36909068-36909349
  misc_feature 1..281: note = hyper
  source 1..281: mol_type = genomic DNA
ctcgctctcccagagctctgggattacagatgtgagccacctggtccggcctagtctgcgcgtttctgctgggagtctttggcgtgcagaaactgaccgagggccatttctctgcagctgggcccggtgtgggcagaggatgctggggtcagtcacgcactccacggccacaacaaccttcgctcatacaatagtctctgcacccaagtcagccgcacagactccgtcacgtcccagccccggccccgtcacgcccacgacacacacacccgggcctgagg

SEQ ID NO: 37452 - DNA, 312 bp, Homo sapiens
  misc_feature 1..312: note = chr19:36909623-36909935
  misc_feature 1..312: note = hyper
  source 1..312: mol_type = genomic DNA
cgctcgctggtgcagcccctgctctgcgtgaacccggagccggagctaggtccgtcccagcgaggctgcgcttcgagtcccttagcgcctggggacggcgcggcagggcctggaggggagcggggacagatggctggcgcgttaaagaggggcgcccgcgaccgcctctctatagtgccaactagggagccctgtgagcgaggacggcgctgcgagtctgtccctggcgcgctcctgggtgggattctttcactgggtgtggctgttgggatttgagaccgtgtgactccggagattcggggaagccagttc

SEQ ID NO: 37453 - DNA, 18 bp, Homo sapiens
  misc_feature 1..18: note = chr19:36912332-36912350
  misc_feature 1..18: note = hyper
  source 1..18: mol_type = genomic DNA
cccggcaccaggggacgc

SEQ ID NO: 37454 - DNA, 81 bp, Homo sapiens
  misc_feature 1..81: note = chr19:36912480-36912561
  misc_feature 1..81: note = hyper
  source 1..81: mol_type = genomic DNA
cgagacaagccggtgcgcatcaccatgcgcggcctggcttcggagccgctggacacgctgcgcgcgcgtccctgcgcgacg

SEQ ID NO: 37455 - DNA, 148 bp, Homo sapiens
  misc_feature 1..148: note = chr19:37095665-37095813
  misc_feature 1..148: note = hyper
  source 1..148: mol_type = genomic DNA
cacattcatagtcaccgctcagcgccgtcacacaaacggccccgcccccactcagtcccgcgggcccaatcggggacagtcagggctgtcccgggctgtgcacctgctgtgcacacacaccccctgctgtgcacaccccccgcccccc

SEQ ID NO: 37456 - DNA, 103 bp, Homo sapiens
  misc_feature 1..103: note = chr19:37096487-37096590
  misc_feature 1..103: note = hyper
  source 1..103: mol_type = genomic DNA
gcgaagggggattttgcccgttctgatcccgcggaagcgccatcgctggcggcgggtccccgcgcggagcgggcgctgtgtgttcgcgcgcgcgggcgcgcgc

SEQ ID NO: 37457 - DNA, 629 bp, Homo sapiens
  misc_feature 1..629: note = chr19:37157547-37158176
  misc_feature 1..629: note = hyper
  source 1..629: mol_type = genomic DNA
atagacattcccttccgcggcactggtgagccaggatttcttaccttcagcattctcagggaaggctctggtccaagctctgattcggattccaagcgaagccacacgcccagctcttccttctccaccggcccgggacatccttacctgcctctacccggagaccattcctgcgaggctcctaccggaagtagctgtggacagcagtgtcctctgggaaatgcagtccgaggggagagcgcctggggtggagcgggtgtgttccgccgggctccgggatgcacttgcgcagtttcacccgaggctggagtgacgccaacctgttaatgttcgttttcggattctggacttcgggttccgctgaggacggatttcggaataggcacagtggctgccccgaacccctcaaggcggcctccgcgggctgtggctgaagataattttcggcgggcgcggactaacccggcttccctttgtggagttgtggtgagaaaggtgttttgttgtgcgcgtgtccgaaggtgactccggaggagaaggtggatatgaactgacggtgagggtgtagcgcgtgagatttgtatgtgaaacgatttaaaaaaaaattttttttttggccgggcgcggtg

SEQ ID NO: 37458 - DNA, 1048 bp, Homo sapiens
  misc_feature 1..1048: note = chr19:37263345-37264393
  misc_feature 1..1048: note = hyper
  source 1..1048: mol_type = genomic DNA
ggtactgcacagacacgcaaagtcacacacccaccccgggacacgcagtccaaccacacagtcaccggttcttcacatccgcacgcacaacgagggtcgtccaggacacacacacccactccgggcgcgcacagtcacaagcgcccacctgatcacccagagtcagcaccacacagccacagtcacagaccacggagacccacggcagccatcgcgatcacacacgcaaactcctctcctcagccctccacacacaaaaggaccggagccggattcctcaccctcagcattctctggttccgctcggggccagcctagccaagttcctcaggactccaaggcgcggcggcagctaaatcggcacagcaaacggtcccgccacctggctaagaggaagccaaaatctcgcgagacgtggcgtcggcctgcgggatcctctgggaaatgtagtccagagcccgactgcgggcttccctatgcctctcatttccaagcctggcttgtttccttttaccgctcctctccaacgaggatcgcagagccctcatgccgagcggctcgctatggggccggctcgcccgctagagtggtcaggcctgattatccctggcagctctgttatctggggtaagacacaggaaaacgtgcttccggttctcggcggaagtagccccgaacggtagaaccgatgggaaatgtagtccagggcagaaaagcggtcaacccagccacgatgcgagccaaaggattcttggctccaagcctggtcctggctgttagtttggaactcatgcacccagatgctaactcgccctcagaatgcagaggggatgaaacactgaccggacaattcaatctgtatatgggtgagtccagggctcagtctgcattgcgcggaaaatgaaggtgaaggtggaggtgggacctgatggtctcgtcccggatagggttgaagaagtgggagaaaaggaatcaaaatcgtggatgggataagattgtgcgcgaatgctctctgggagcggatcgtggccgacgagggcccgaagat

SEQ ID NO: 37459 - DNA, 32 bp, Homo sapiens
  misc_feature 1..32: note = chr19:37287904-37287936
  misc_feature 1..32: note = hyper
  source 1..32: mol_type = genomic DNA
tgcttgtaggaaggtcggccacaagcacttct

SEQ ID NO: 37460 - DNA, 189 bp, Homo sapiens
  misc_feature 1..189: note = chr19:37288236-37288425
  misc_feature 1..189: note = hyper
  source 1..189: mol_type = genomic DNA
cacttcttattggctaatctggagcaaacctgcatatccattggctgaaagctccgtctattttagggtgactgagagcgtctcttccttctgtgttgcctggaaacggactgttcgcctagtaacatctgatcacgtttcccattggtcaccgtttccggaagcccgctctcccgtttccggaatccc

SEQ ID NO: 37461 - DNA, 99 bp, Homo sapiens; identical to SEQ ID NO: 1383
  misc_feature 1..99: note = chr19:37288606-37288705
  misc_feature 1..99: note = hyper
  source 1..99: mol_type = genomic DNA

SEQ ID NO: 37462 - DNA, 101 bp, Homo sapiens
  misc_feature 1..101: note = chr19:37288706-37288807
  misc_feature 1..101: note = hyper
  source 1..101: mol_type = genomic DNA
attaaaggtaaaaaacggggctttttcatcccactggggtaaaacgcccttttatttctagccaggtgttctgttgcagaacgcctcgaagggagggagtg

SEQ ID NO: 37463 - DNA, 30 bp, Homo sapiens
  misc_feature 1..30: note = chr19:37328802-37328832
  misc_feature 1..30: note = hyper
  source 1..30: mol_type = genomic DNA
ctccccacacattcacgaaggactatgcct

SEQ ID NO: 37464 - DNA, 165 bp, Homo sapiens
  misc_feature 1..165: note = chr19:37329224-37329389
  misc_feature 1..165: note = hyper
  source 1..165: mol_type = genomic DNA
tcggaatcactcacccggccctgcggtcccttgatggtggaaggttccgcgatctttctattaaccctaaagggacagagggctgacaggaagttgcccggggaacggtgcactctgggaaatgtagtccggagcctgggccgtctttaactgccccggacaccg

SEQ ID NO: 37465 - DNA, 257 bp, Homo sapiens
  misc_feature 1..257: note = chr19:37340845-37341102
  misc_feature 1..257: note = hyper
  source 1..257: mol_type = genomic DNA
cacaagcaggcccaccgcggtctcacacacactcgagccttcctttgcccagtctcacatgcatgactgggatcgcggatttgtccccttccgactccccatgctggttcggtcccagacgctcaggtgccacattggggtgcgctctcccggctcctccacacgctacgcagctgcccgcctcaagagcgtctgcgtgcttccagcgttaagtggaattccaagcagcctccggggcacagttagtctggtcactg

SEQ ID NO: 37466 - DNA, 32 bp, Homo sapiens
  misc_feature 1..32: note = chr19:37341165-37341197
  misc_feature 1..32: note = hyper
  source 1..32: mol_type = genomic DNA
cggcgaggcttggactacgtttcccaggagac

SEQ ID NO: 37467 - DNA, 664 bp, Homo sapiens
  misc_feature 1..664: note = chr19:37341469-37342133
  misc_feature 1..664: note = hyper
  source 1..664: mol_type = genomic DNA
tgctgaagtgctgttcgcaggctatggaggaggcctggccaagcaaaaagggctcagaggagcctgactaaagcttggtctagggactccttgtcaggtgagactcccggaaggctccgatgggcagctcacctcaaagagatagttttgttggtgccagagtccgcgccaggggaatcgggatggctgggctgtagctttcggcaacctgtcgctttctggactacacttcccagaagcctctaggcccagggcactctcccgcgataactagattgtctcttgaggagtgggcgggatcttcccgcggatttgggcaagcggccttggggctttgtgagatagctagggtcgacttgtgtggattctagtagaacggagctgaccctatccgaacaggcgtaagtgaggcggctcggagcctggcgcgacaggaactcccgacctgtgtgggctgcgtggggaacaggctaaggagcgattgtgaggagtgtgtacggttgtgactgggggcgtgtgtctgtgcgaccgtgtatggaactgtgagggcggggaggaggactttttgtttatgtttgtgcgggtgtgagtagagtttaattgtgaccgggttgggcactgtgtttgcgagtgtgaggttcctggaccgcggttgtgactgtat

SEQ ID NO: 37468 - DNA, 387 bp, Homo sapiens
  misc_feature 1..387: note = chr19:37406765-37407152
  misc_feature 1..387: note = hyper
  source 1..387: mol_type = genomic DNA
ctccacctttcaggccgctccgcccgcaggggcccaaggcgccagctccccatcggtcttcggtatcctcacctaagccctttccagtcatcccggatgggaacttgcagacctgagccagttctcctggggaccaaaatatctcacctcccagatctaagggtcccgccaggagtgacgaaacgttcgaattcctgcgagaaaagtggcaggccaccaggccctctgggaaatgtagtccagagcgggacccacgccgattcctgtcagctcctcgcctgggcccacccgaaacggctgctccctcaactctcaacatccagccgagcctcggagttgcgggtcgccgtagcgctgcgcaatggagatgagcctcccggggaaccc

SEQ ID NO: 37469 - DNA, 221 bp, Homo sapiens; identical to SEQ ID NO: 1386
  misc_feature 1..221: note = chr19:37407153-37407374
  misc_feature 1..221: note = hyper
  source 1..221: mol_type = genomic DNA

SEQ ID NO: 37470 - DNA, 215 bp, Homo sapiens
  misc_feature 1..215: note = chr19:37407375-37407590
  misc_feature 1..215: note = hyper
  source 1..215: mol_type = genomic DNA
ctgccgagtccccgcagcagggggcgagcaagggactcgcggttgacgggacacggatcctctaaggcccagagtgtcccgagtagcggcagtggggagtgctcagggtacgctaatggtgagtggttgcagttgatgggacaaaaaactgtgatgggagttagtgtgggtgtgtggttgtgtgtgtgagtgtgacggcacgaataatctgatgg

SEQ ID NO: 37471 - DNA, 520 bp, Homo sapiens
  misc_feature 1..520: note = chr19:37464048-37464568
  misc_feature 1..520: note = hyper
  source 1..520: mol_type = genomic DNA
tttcccagggggccccgcggccaaccttttccggccgaagaaggctagtcacctttccttggcgggtgttggaaagcaaagggctggaacgtcccgggctgcggagctcgctgggttgggatggactcgttcagacctgagtgctaggacgccgaagggggcggtgaggcgtcccggcgaggagctggggtcgtctggagtttaaaagacaggtggctctcggagatgtgcgggctgcatgcccacgcttcaccgctaggggaggtcagggctgtgcgatggggaaggaagagagtgtcggggcggtgcagtcgggatgggagaagggtgtcagggccactggcccccagctcggcagagggcagtgtcgggccgcgcgcaggcagggagtgggtgtggtgtgaggctggcgctggagcggtctgggaatgttaggaggtctagggtatcgcggccctgcgtcctcttgtctggactaaaagtccgggcagttctccccggacctggattgtgggcccag

SEQ ID NO: 37472 - DNA, 72 bp, Homo sapiens
  misc_feature 1..72: note = chr19:37464666-37464738
  misc_feature 1..72: note = hyper
  source 1..72: mol_type = genomic DNA
cgtgtgccgggtcatcgaccccatctttgggaggcctgggagggggcgggacaccctcgctgtacattctgg

SEQ ID NO: 37473 - DNA, 865 bp, Homo sapiens
  misc_feature 1..865: note = chr19:37957671-37958536
  misc_feature 1..865: note = hyper
  source 1..865: mol_type = genomic DNA
tcccactgtcatgcacgtttgcacgcaggttcatactgaaagataaaagggaaagcgcctccacgaaatccgcttacggacacgatcccggggccacactcagccagacgaatgtctggcaaatgacagtcacttcacgccagactctcacagtccttcacacgccactcccactgcctcagggaaccacaagcacaggcatcgccccgcccggcgtcctcctccaaagattggggcaccaggaccgcgggcccccactcccacccagcacaaagagtccggcgctcagagctagcggtttcccgaggactcaccaccaagcccgcggacacaggccccgattccacacttaacgctgccaaagtggcagagccggcgcgggctgggacagaggcggcactgaggccggcgctgtcggtggctgagagcgccacaagtctcggtccgttacaccaggggcgacgcttcccagaggcccccgcggctcacccgggcgggactggcttcactgtttgcgcgtcctgagaagcagaccacggtgttccagggctcacagctccgcgcaggggagctcagcctaggttttgcacgagcggcctcccgcgagcccagctctgagagattgggagcgcaacttggtgctgagaagaatcgaatcgttccgctgcttcctgcgccgaactacatttcccagaggccttcgcggccctacttccccgaccccacctgcaaaaaggcacttccttcttacagtcggctggagctgcaggttcgcaaggtccgtgaaggaagcccggctcagtgtgtttagttccgtctttttgggtctctacctgaggctagaatacagcggggtgaaggtggt

SEQ ID NO: 37474 - DNA, 15 bp, Homo sapiens
  misc_feature 1..15: note = chr19:37959786-37959801
  misc_feature 1..15: note = hyper
  source 1..15: mol_type = genomic DNA
cctcccaattttttt

SEQ ID NO: 37475 - DNA, 632 bp, Homo sapiens
  misc_feature 1..632: note = chr19:37959873-37960505
  misc_feature 1..632: note = hyper
  source 1..632: mol_type = genomic DNA
cgcacaaaccttttccctgcggccaacctgcgattctcaactccccgccctggttgctaagggaggcgcgcagagcgcttgtgcctgcgcacttccacaccagcccgtgtagtgtgacgctgggccccgtccctgtgaccgggccaggctcggagctgcagggaatccggactttcgggctctctggaaggccggggagaggccagtgtgggaggacctggtggggaggaggccgtgttacaaaccctgcgcggagctgcaccgctgctgccagacactgcgacgccgcgaccttttctactccggactacgtttcccagcggaccccgcgggagttgggccggcggcccctttgtgtcctccgggggcggaggcagctgaggcgcttctttccgggcccgtaagggctgggttccatccaactaagggtagcggtgagacccgagtgcagattccccgagccttcggggcaggaaggagatcttccaccagttctgttctgcaggtcgggagtgggctgaggagtggcgtgtgggtctccggaagctcgtcgcaggccatctgtgtgactccggtgcgagtggaggttggtaccgttcagtgcgaggctgtcaccccgtgtgcctgtccac

SEQ ID NO: 37476 - DNA, 30 bp, Homo sapiens
  misc_feature 1..30: note = chr19:37960799-37960829
  misc_feature 1..30: note = hyper
  source 1..30: mol_type = genomic DNA
agagactgtgtgccacggagaggcttttaa

SEQ ID NO: 37477 - DNA, 107 bp, Homo sapiens
  misc_feature 1..107: note = chr19:37997089-37997196
  misc_feature 1..107: note = hyper
  source 1..107: mol_type = genomic DNA
tatgcactgtatattcgttcccatcgctcccgtctcacttctccatcccccacctaccaaataaactgcttgcactcattctttcctcaggtcggcttctcgggcaa

SEQ ID NO: 37478 - DNA, 304 bp, Homo sapiens
  misc_feature 1..304: note = chr19:37997687-37997991
  misc_feature 1..304: note = hyper
  source 1..304: mol_type = genomic DNA
agttttaaacatggccgccccaggtaggagtcaagtgggcgtcgccatcatacctccaattacagctttgagaaacccagaatcctgttcactggaaggttgccgggtggcggctgacagcctcaaagtcgcaattgagtctgcgcaccggccattcaggatgggacgaccttataccgcggtgaggcggcgtggcaggacgaccaatttcagattcagggcgcggatgcagcataaatgggaaggcacggtttgagaaacggtcaaacctgggactagtggaggatagtgagctgccgactac

SEQ ID NO: 37479 - DNA, 131 bp, Homo sapiens
  misc_feature 1..131: note = chr19:37997992-37998123
  misc_feature 1..131: note = hyper
  source 1..131: mol_type = genomic DNA
gtggccgactgggtcagctatgggtgcccgtgagggtcaatgacaagggaactgaagggttaagagattcggcgtctgagcctcgcggggcctcagtggtggcggacagaggtttgcgggagtcagtggca

SEQ ID NO: 37480 - DNA, 465 bp, Homo sapiens
  misc_feature 1..465: note = chr19:38042365-38042830
  misc_feature 1..465: note = hyper
  source 1..465: mol_type = genomic DNA
tggccccctcctctccgggggatcgtcgccttggtcccccgaccctaggagtcgggcagggcagaaccaggctaaagaaacgtccagcgtagcttcaaggatgcaccgcgtgatccctatcggatctccccgacgcgtcaggcctgcctagacggtgctgggagcgcgtctccttgaacgttgtcccgcctgggattgcgaggtaggtaccgcctgcctgtgtgtaccggggctgctgtctccggggaggggcttctggcggacaggagaaccaagcagcctcaggagctgcctgggtgtgtgtgtttctgtgcgagtgttgcatatctctgtgtgtgtttctgtgcaagtgttgcatgtctgtgtgtgtggggggggtggtgtctggtgaaaagaatgtgtctcgtgcggtggagcgccgtttctctgtagtccgcgggctctcttatgcgccctcttgtggtc

SEQ ID NO: 37481 - DNA, 40 bp, Homo sapiens
  misc_feature 1..40: note = chr19:38086122-38086162
  misc_feature 1..40: note = hyper
  source 1..40: mol_type = genomic DNA
gtgtgggtctgtgcgcgcgcgtgtccgagtgtcctctgtg

SEQ ID NO: 37482 - DNA, 1254 bp, Homo sapiens
  misc_feature 1..1254: note = chr19:38146010-38147264
  misc_feature 1..1254: note = hyper
  source 1..1254: mol_type = genomic DNA
cctcttgggccttttcgctacggccgagcctaagtggctgaagcgcggacgaggatgcgcggggcctcggtctccaactgcaccacaggccgcacccacgaacctggtccggcacagttactaccgcccgggcctccaggcctcagggctgcagaagctcagtcccgggaaaaaaagcacaccggcctgaggctccacaggaaccttttctccaccttggcccggcctgcaaaacctggcccactccgcgctcttttccctcagaaaagcagcggccacagtggcgcccggctcccagccccagcctcacccgactcagaggatagcccagccctgggagtcagcggcgccagaatacgggagagcgcctgtctccgtcgcgaatgcgctagcgcgcgggggggcggaggcaagtcccgcagctgctccgggccgggaggggcgcgtggggccgggtctcggcggggatagtcgggccggggagacggagccagaggggccgcagtgtccctcgcctcaggcctctacctgtaatggccgccccgtgactgaccagtgccattaaagataatccaggcctgctcccctgtggacactgcggtccaaaatttaaaaaaacaatattccgcctttttatttttcatttggttctcggctcggagacaggcggaggctgcgagccccgccccgcccccagcgacgcctcaccggaacctttggaaatcggcttctgcctcgagtgcgcaagcgcgcggggggcgaacgctggggcccttcagggagcaagggagaagtgtggggccgcacctgccgaggggtcgggaggtttggaggagggtggaggttggctacaggatcccgatggggatggagtgttcaaatctaggcctgtagccgtgaccctggcgtgagttggatggaggaaaccccagtatcgcgagcctggaccaaggcgcggcgcgtgctgcctgtggtgtttgctgagtgacggccgccgcgcccccgcgtacctggaccgagtgcctggccgctggcggagtagtgtttccgtgcacggggctgctgcgtgcgcgtgtgccgttctctagcgggggattaggatggtgccgcagagaaggctgcgcggtggtgcctgactctgacgctggctgtagcgggtctctggggtctttgcggtttgtgtctgcgtttgtgacgtacctgacatcggatctgtgactgtggctctgcctcatccagcgttatttccagaat

SEQ ID NO: 37483 - DNA, 145 bp, Homo sapiens
  misc_feature 1..145: note = chr19:38182815-38182960
  misc_feature 1..145: note = hyper
  source 1..145: mol_type = genomic DNA
caggtgacgatccctcgcgggcactcactctcgctcacactacaatcagatcctccatgcggctttcatatactctgtcacactcgcagccagaatcccctcggatggactcttgcaaacctccagccccatcccgggatccgtg

SEQ ID NO: 37484 - DNA, 148 bp, Homo sapiens
  misc_feature 1..148: note = chr19:38183111-38183259
  misc_feature 1..148: note = hyper
  source 1..148: mol_type = genomic DNA
cgctcccacgtctccgggcgcagcttgtgccagcgactactaggtcagggggcgcagctgagagaattcaagcaacctccccgcaaccggttccgccgcgtttgtgggctggtagcccggaatacatttcccagaggccttcgcggcc

SEQ ID NO: 37485 - skipped

SEQ ID NO: 37486 - DNA, 211 bp, Homo sapiens
  misc_feature 1..211: note = chr19:38183263-38183474
  misc_feature 1..211: note = hyper
  source 1..211: mol_type = genomic DNA
tgcttcgcgcaggaacgcagccgcctcccgactggaggacgcggtagcggagctgctcaaagcgaggtgctcagccctgggaggctcagggctgcccgaggggcttagtcccagagccagtgctgtcaggggctgagcatgtgaatagggcagtcggaagaccatgtgtgtctgtggcttttaaatacaccccgaacgtctatctctttta

SEQ ID NO: 37487 - DNA, 141 bp, Homo sapiens
  misc_feature 1..141: note = chr19:38210017-38210158
  misc_feature 1..141: note = hyper
  source 1..141: mol_type = genomic DNA
tttctctgttgtagtcgtactaggctgaggaaggcacaggaagcagcagggaacctggagccaagggtcaatagaccccacagagcccagcgaagcacgctttacaaaggacacacacggcatgtacaggtcacacaaggt

SEQ ID NO: 37488 - DNA, 180 bp, Homo sapiens
  misc_feature 1..180: note = chr19:38210571-38210751
  misc_feature 1..180: note = hyper
  source 1..180: mol_type = genomic DNA
aatcctaaaaacctacgagaaatacggcagcgaccacttggaccgcgcctcccacccaccgctcgagccccggagacttctgggagtggccgccttgcctcgagtgcgcatgcgcagatcggccactactgggcccctggcctgaggcttagggtggagttagtgcgttcttagggccag

SEQ ID NO: 37489 - DNA, 90 bp, Homo sapiens
  misc_feature 1..90: note = chr19:38308247-38308337
  misc_feature 1..90: note = hyper
  source 1..90: mol_type = genomic DNA
tggggctgctggaggcgttcagagcgcggaggccccaggcgcgggccgggctctctcccgcctcctcaggcccgggggtgctggagctgc

SEQ ID NO: 37490 - DNA, 145 bp, Homo sapiens
  misc_feature 1..145: note = chr19:38308394-38308539
  misc_feature 1..145: note = hyper
  source 1..145: mol_type = genomic DNA
cgacagggccgggcgtgcctgtgtgacgtgggtgcagctgtgggactgtgaggggtgcgtggtcgaccttgcgtaacctggatgtgcagtgcgtgtcctttgcaaagcgtgcgttgctgtggctccgtggcgtcagcaacccttc

SEQ ID NO: 37491 - DNA, 30 bp, Homo sapiens; identical to SEQ ID NO: 13381
  misc_feature 1..30: note = chr19:38701199-38701229
  misc_feature 1..30: note = hyper
  source 1..30: mol_type = genomic DNA

SEQ ID NO: 37492 - DNA, 500 bp, Homo sapiens; identical to SEQ ID NO: 13382
  misc_feature 1..500: note = chr19:38701550-38702050
  misc_feature 1..500: note = hyper
  source 1..500: mol_type = genomic DNA

SEQ ID NO: 37493 - DNA, 92 bp, Homo sapiens
  misc_feature 1..92: note = chr19:38718791-38718883
  misc_feature 1..92: note = hyper
  source 1..92: mol_type = genomic DNA
atacaccacctcacacggacccgagccccacacacccgctcccggcaccctgctcacggcgaagccacacgtgtaggcgcttgcctctaagt

SEQ ID NO: 37494 - DNA, 310 bp, Homo sapiens
  misc_feature 1..310: note = chr19:38746768-38747078
  misc_feature 1..310: note = hyper
  source 1..310: mol_type = genomic DNA
ccgggctcaccatgccgcggtacagctcctccaggcgcccgtcgatccacttctccacgtccagccgccgctgcagctcccgccggtcatacttgacggtgacgcgcgcgtgccgcttctgcagccccccgggactgccccctggcccgcgggcccgcgatggagactgcagcttgctcagcacgcgcttgcccagccgctgagctgccatcgcgctgctggacccagcctggccccgcgctgtgcgccttcgcctcgcgccccgggtgcttcttacgggccagggcggggctagccgggggcgggggct

SEQ ID NO: 37495 - DNA, 95 bp, Homo sapiens; identical to SEQ ID NO: 13384
  misc_feature 1..95: note = chr19:38747106-38747201
  misc_feature 1..95: note = hyper
  source 1..95: mol_type = genomic DNA

SEQ ID NO: 37496 - DNA, 206 bp, Homo sapiens
  misc_feature 1..206: note = chr19:38747202-38747408
  misc_feature 1..206: note = hyper
  source 1..206: mol_type = genomic DNA
gggacccagagtcccgggcgggtccctgcatcgggggctcccgggccgggatcctgtggggcgggggcctgggacagacactcgggacccggcctgtctgcgccctctggcggtggcggggtggggggctgttggtgcgggagcgcctgcgccgctgtcgctgtagaaggtcgagcggtcacttgttccttcgttcattcattcac

SEQ ID NO: 37497 - DNA, 68 bp, Homo sapiens
  misc_feature 1..68: note = chr19:38853068-38853136
  misc_feature 1..68: note = hyper
  source 1..68: mol_type = genomic DNA
agaaatggacagctacgaaaagatctacaacctcgagtccgcgtacgagctgccggagcgcattttcc

SEQ ID NO: 37498 - DNA, 339 bp, Homo sapiens
  misc_feature 1..339: note = chr19:38877688-38878027
  misc_feature 1..339: note = hyper
  source 1..339: mol_type = genomic DNA
cgagggtgaggcctggggctcccggggtaccatgagtcccgggggtgtggcgctgccagggaaccagacacccagcccacgagtcaggcgcatggcctgggaggtcatctcgggctccaccagggacgtccggcgggagtcgggggcgcggtccgagggctgcacttttcgggagcccccgcccgcggatggctccgactgcaagttccccatttctgacggagctcggagactagtcagaaaaatttactccagtcagcctgccagggccgtggggaccctacgaggctggctgtacttgatctaatgcgtccgcaccggccccgcccctgttctcca

SEQ ID NO: 37499 - DNA, 35 bp, Homo sapiens
  misc_feature 1..35: note = chr19:38879840-38879875
  misc_feature 1..35: note = hyper
  source 1..35: mol_type = genomic DNA
ggacaaaggaagcagcgtcacgtgactgctcattc

SEQ ID NO: 37500 - DNA, 170 bp, Homo sapiens
  misc_feature 1..170: note = chr19:38924266-38924436
  misc_feature 1..170: note = hyper
  source 1..170: mol_type = genomic DNA
tggtccaatggggcccgggggcggggacttcctcccatctctgtccagcatgcgtgtactcctcgcagttccatctacctcgcgggtgcctctggtgtctccagaggtctccgaccccagcccgcccccagccctcccgcccagcccgcagccccctccctctgttcccc

SEQ ID NO: 37501 - DNA, 95 bp, Homo sapiens; identical to SEQ ID NO: 13388
  misc_feature 1..95: note = chr19:38924437-38924532
  misc_feature 1..95: note = hyper
  source 1..95: mol_type = genomic DNA

SEQ ID NO: 37502 - DNA, 85 bp, Homo sapiens
  misc_feature 1..85: note = chr19:39282953-39283038
  misc_feature 1..85: note = hyper
  source 1..85: mol_type = genomic DNA
caccctcggggcagacgcgatggcagcggccccggctctgcggaacagctgggaggactcgaaggacggcgtgggttttccctgg

SEQ ID NO: 37503 - DNA, 86 bp, Homo sapiens
  misc_feature 1..86: note = chr19:39283060-39283146
  misc_feature 1..86: note = hyper
  source 1..86: mol_type = genomic DNA
cgccctccgctctccccgacggcccggaccccggtcctagccctggtcactgtgacgggaggggaagcggacgccaagtgcagccc

SEQ ID NO: 37504 - DNA, 362 bp, Homo sapiens
  misc_feature 1..362: note = chr19:39466200-39466562
  misc_feature 1..362: note = hyper
  source 1..362: mol_type = genomic DNA
gtcccctacctgtcccggcgctcacctggcgggctgctcggaggcggcagcggcgggctaagcttccctttcccactttgttctgggaggcagtcgaggggctccccgtgatcggcgtggcccagggggccccgggaccggcggtctgggcggtcggtcctctcccggggcgtggcggctgcagcccggcgccgggggcggcgactctgagatccagcgggcgggggcgggaggccgcccctcctccggctgcggggcccagcgggagcgagggcgggcgggcgggggagcttggagggctgcgtgcagcgagggggaggcccagttgccgcgaggccagcggggagcggggccagccccgc

SEQ ID NO: 37505 - DNA, 92 bp, Homo sapiens
  misc_feature 1..92: note = chr19:39522783-39522875
  misc_feature 1..92: note = hyper
  source 1..92: mol_type = genomic DNA
ttggctcaggtccagcgcctcttcgggttccggctccggcgcggggacccgggcggcccggcccctggagaccgaggcgcccatggtccccc

SEQ ID NO: 37506 - DNA, 118 bp, Homo sapiens
  misc_feature 1..118: note = chr19:39589701-39589819
  misc_feature 1..118: note = hyper
  source 1..118: mol_type = genomic DNA
tgggggctgacaacccgaaggccgtcccccggctgcgcagggacacccagcagggcatgtatgacgccgttctccatgtgggtgaggcatccgcaggggcgcgcgcagggacggtggg

SEQ ID NO: 37507 - DNA, 56 bp, Homo sapiens
  misc_feature 1..56: note = chr19:39687591-39687647
  misc_feature 1..56: note = hyper
  source 1..56: mol_type = genomic DNA
tgaaaccgggacagtcgcgcagcctcgagggatggaggaggtgcgtgagggacacg

SEQ ID NO: 37508 - DNA, 222 bp, Homo sapiens
  misc_feature 1..222: note = chr19:39687755-39687977
  misc_feature 1..222: note = hyper
  source 1..222: mol_type = genomic DNA
cgtcgctgccatcgcccgcagccccggaggcccccgagctccccgagccggcgcagccgtccgaggctcacgcccggcagctgctgctggaggagtgggggccgctgagcgggggcctggagctgccccagcgcctcacctggaagctgctcctgttgcggcggccgctctaccgcaacctgctgcgctcgcccaaccccgaaggtgcgcaagggcccagag

SEQ ID NO: 37509 - DNA, 359 bp, Homo sapiens
  misc_feature 1..359: note = chr19:39754874-39755233
  misc_feature 1..359: note = hyper
  source 1..359: mol_type = genomic DNA
gggcagaggccaaggcgaggagggggccggctcccgctctctctccctctgtgtgtgctgcgcctcccctgtgagcctaacccaaggcaggggactggacgcgtgggaccctctctttggcctccctgacgtccctcaggagcagagatgcgaccgagtgtgtgggccgcggtggccgcgggactgtgggtcgtgtgcacggtgggcgcggcgatccgccagcgctgcctgctctcgcactaccgctcgctggagccccggacgctggcggcggtcaaggcgctgaggaaccgctaagtgagtgaccgcccagcccttgcgccccccggtacactggccccgccgggttcccacacacc

SEQ ID NO: 37510 - DNA, 247 bp, Homo sapiens
  misc_feature 1..247: note = chr19:39755264-39755511
  misc_feature 1..247: note = hyper
  source 1..247: mol_type = genomic DNA
cgcccagcaggcgcctcttgtacgtcagagcccacagttcccaccacgagatccccgcagtccccgtcgtcagcgcgaacgcaggctcagggtcagtcacaaaaggagccctgcagggcggactcggctccaggtcgcgggcgcagggctatgccgggggagagcgggatgcaattcaaccctggttcacgccttcggggagctccctggttcagtacacgacaggcacgaccgtacgctgccagta

SEQ ID NO: 37511 - DNA, 415 bp, Homo sapiens
  misc_feature 1..415: note = chr19:39989727-39990142
  misc_feature 1..415: note = hyper
  source 1..415: mol_type = genomic DNA
ggggaggggtgagtgcgacctgaaggtcctggggaaggagcgtggggcggacgggaagcctgggtcctcccggccgcctcaccctgcgcccgtctccgtcccagacacggcccgctggcgtcttcgagctgcagatccactctttcgggccgggtccaggccctggggccccgcggtccccctgcagcgcccggctcccctgccgcctcttcttcagagtctgcctgaagcctgggctctcagaggaggccgccgagtccccgtgcgccctgggcgcggcgctgagtgcgcgcggaccggtctacaccgagcagcccggagcgcccgcgcctgatctcccactgcccgacggcctcttgcaggtgcccttccgggacgcctggcctgtaagtgctgcccccgggggactcccggt

SEQ ID NO: 37512 - DNA, 258 bp, Homo sapiens
  misc_feature 1..258: note = chr19:39993399-39993657
  misc_feature 1..258: note = hyper
  source 1..258: mol_type = genomic DNA
gcatccatgttcggccgggcccaccccagcacccctcctttgcctgtcctcgcagggcccgcctggagcctgctggcgcgcgtggctggcaggcggcgcttggcagccggaggcccgtgggcccgggacattcagcgcgcaggcgcctgggagctgcgcttctcgtaccgcgcgcgctgcgagccgcctgccgtcgggaccgcgtgcacgcgcctctgccgtccgcgcagcgccccctcgcggtgcggtccgggactg

SEQ ID NO: 37513 - DNA, 45 bp, Homo sapiens
  misc_feature 1..45: note = chr19:39997688-39997733
  misc_feature 1..45: note = hyper
  source 1..45: mol_type = genomic DNA
cctggacctgggccacgccctgcgctgccgctgccgcgccggctt

SEQ ID NO: 37514 - DNA, 335 bp, Homo sapiens
  misc_feature 1..335: note = chr19:39997748-39998083
  misc_feature 1..335: note = hyper
  source 1..335: mol_type = genomic DNA
cgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcaccccgacggcgcaagcgccttgcccgcggccccgccgggcctcaggcccggggaccctcagcgctaccttttgcctccggctctgggactgc

SEQ ID NO: 37515 - DNA, 150 bp, Homo sapiens
  misc_feature 1..150: note = chr19:40005754-40005904
  misc_feature 1..150: note = hyper
  source 1..150: mol_type = genomic DNA
ccgcgtctcagaacccggtgcgggagacgctctccccgcccaaagagggaaggcgggcgggactccccaaccggcttgccccggtccccctgggccccatgaataaccaggcgcggaccccagccccctcctcggcgcggacttcaacct

SEQ ID NO: 37516 - DNA, 251 bp, Homo sapiens
  misc_feature 1..251: note = chr19:40006197-40006448
  misc_feature 1..251: note = hyper
  source 1..251: mol_type = genomic DNA
ctgactcctccagtccgggtcccagccccagccccagcccagctcctggcagggattcgggccgcgctccccgtcttggactcctacctggccccggccctacctttggatccgcccccggaacctgctccggagctgcctttgttgcccgaggaggaccctgagccggcgccgagcctgaagctcatcccgtcggtctccagcgaggccgggcccgccccggggccccttcccacgcgcaccccgctggc

SEQ ID NO: 37517 - DNA, 164 bp, Homo sapiens
  misc_feature 1..164: note = chr19:40006498-40006662
  misc_feature 1..164: note = hyper
  source 1..164: mol_type = genomic DNA
cggccatcgggctggcggatccccccattcccagtcctgtcccctcgcccatcctggggaccatcccgtcggccatctccttacagaattgtacggaaaccttcccctcctccagcgagaacttcgcgctggacaagagggtcctgattcgagtgacctactgg

SEQ ID NO: 37518 - DNA, 204 bp, Homo sapiens
  misc_feature 1..204: note = chr19:40324814-40325018
  misc_feature 1..204: note = hyper
  source 1..204: mol_type = genomic DNA
ccacgccctggactccgcccccatccctccctctccgctcccctcacgtgacccacactgacactccgcctgcgcgagatggccgcttacctgcacgcatgcgcagcgagctaccaatcccacccaagaaccgaaatccaggctgccgctgcgcaaaggcagctagaaacggagcatgcgctctgtgaccgagtgagaatttac

SEQ ID NO: 37519 - DNA, 489 bp, Homo sapiens
  misc_feature 1..489: note = chr19:40723945-40724434
  misc_feature 1..489: note = hyper
  source 1..489: mol_type = genomic DNA
tggtgggcccgggggcgggggcgggcaggccgctagggcgggccccctgcgccgccttcagctgcagcagcgctcggtggtacttgccgatggcctcccggaacttcttctctcgatagcagcgctggccctctgccttgaacgccacggcggcacgcaggctgctgtcgagcgccgcgcccaggctccccgacggctctggggtaggaccgggacgagccgagccatggcgggagcccgagcctgggcccgagcccggtggggagagggcgggaggcgggcgcggcggaggctccggggcagcgctgagcatcagcaccggggacagcgcgccgcgctgcattgtgggaaactcctgccgccgccgctgcagctaccgcatcgccccccgcggggctggtccccaccctttctccgccccctcacctccggcagccgactccggctgccccctatgggtctagggaaacccctcgagacttcccccat

SEQ ID NO: 37520 - DNA, 121 bp, Homo sapiens
  misc_feature 1..121: note = chr19:41018532-41018653
  misc_feature 1..121: note = hyper
  source 1..121: mol_type = genomic DNA
caggtcatctgcaaccgcgtgaaccacgtgcacggctgcctggcggagctgcaggagcaggcagcgcggcgacgcgcggagctggaggcttcgcggagcctgtgggcgctgctgcaggagc

SEQ ID NO: 37521 - DNA, 15 bp, Homo sapiens
  misc_feature 1..15: note = chr19:41019048-41019063
  misc_feature 1..15: note = hyper
  source 1..15: mol_type = genomic DNA
ctgctggactggctt

SEQ ID NO: 37522 - DNA, 47 bp, Homo sapiens
  misc_feature 1..47: note = chr19:41019075-41019122
  misc_feature 1..47: note = hyper
  source 1..47: mol_type = genomic DNA
cgcctggcagccgccggtgacttcggccacgacgaagcttccagccg

SEQ ID NO: 37523 - DNA, 522 bp, Homo sapiens
  misc_feature 1..522: note = chr19:41025379-41025901
  misc_feature 1..522: note = hyper
  source 1..522: mol_type = genomic DNA
cgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggccc

SEQ ID NO: 37524 - DNA, 48 bp, Homo sapiens
  misc_feature 1..48: note = chr19:41055131-41055179
  misc_feature 1..48: note = hyper
  source 1..48: mol_type = genomic DNA
tgggagagctgcaggcgcagacggcggcgctgccgctggagccggcga

SEQ ID NO: 37525 - DNA, 444 bp, Homo sapiens
  misc_feature 1..444: note = chr19:41059909-41060353
  misc_feature 1..444: note = hyper
  source 1..444: mol_type = genomic DNA
tacatggtcttggcacgtggttagcgagctgggggtgcttgttaattgccccgtgggccgtgccagtagcagaggagcgtgtggtcttgcagggcctcggaacgccccctctccacccacatccccttacctcctgcccccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggtgcgcccgagctgggggtgcg

SEQ ID NO: 37526 - DNA, 303 bp, Homo sapiens
  misc_feature 1..303: note = chr19:41073555-41073858
  misc_feature 1..303: note = hyper
  source 1..303: mol_type = genomic DNA
cctccatcctcagatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggc

SEQ ID NO: 37527 - DNA, 132 bp, Homo sapiens
  misc_feature 1..132: note = chr19:41074018-41074150
  misc_feature 1..132: note = hyper
  source 1..132: mol_type = genomic DNA
cggaggcggcggccggagcggcaggagtcagcggagcacgaggcggcacacagccttaccctgggccgctatgagcagatggagcggcggcgcgagcggcgtgagcggcgcttggagcggcaggagtccagc

SEQ ID NO: 37528 - DNA, 43 bp, Homo sapiens
  misc_feature 1..43: note = chr19:41102899-41102942
  misc_feature 1..43: note = hyper
  source 1..43: mol_type = genomic DNA
gaactcgaggtcccccgcgcccctagtccggcacctgtccctg

SEQ ID NO: 37529 - DNA, 13 bp, Homo sapiens
  misc_feature 1..13: note = chr19:41105989-41106002
  misc_feature 1..13: note = hyper
  source 1..13: mol_type = genomic DNA
gctctactgaagc

SEQ ID NO: 37530 - DNA, 69 bp, Homo sapiens
  misc_feature 1..69: note = chr19:41106351-41106420
  misc_feature 1..69: note = hyper
  source 1..69: mol_type = genomic DNA
gctggcccgttagaaagctccgccgaaccagcccagacaacaaaagcgattgtgcgggttggcgcctgc

SEQ ID NO: 37531 - DNA, 39 bp, Homo sapiens
  misc_feature 1..39: note = chr19:41119370-41119409
  misc_feature 1..39: note = hyper
  source 1..39: mol_type = genomic DNA
cggctcctttgcctgtacttgtgcccctggctaccgacc

SEQ ID NO: 37532 - DNA, 21 bp, Homo sapiens
  misc_feature 1..21: note = chr19:41119669-41119690
  misc_feature 1..21: note = hyper
  source 1..21: mol_type = genomic DNA
ggggggcggtgtttgcaggga

SEQ ID NO: 37533 - DNA, 59 bp, Homo sapiens; identical to SEQ ID NO: 13408
  misc_feature 1..59: note = chr19:41354396-41354455
  misc_feature 1..59: note = hyper
  source 1..59: mol_type = genomic DNA

SEQ ID NO: 37534 - DNA, 232 bp, Homo sapiens
  misc_feature 1..232: note = chr19:41354575-41354807
  misc_feature 1..232: note = hyper
  source 1..232: mol_type = genomic DNA
cgatgcctcgcttgcccaccccgaagtcccgcagggtggcgatggagaagcgccggagctgcttggcgcgctccccgttgctgaataccacgcctggggaggtgaacgcgggaatggagacaggccagggggcggcaggggcaggagcggagcagctccaaggggctccccaagggtggaggagagagggagtagggtgggagagagatggattcagcgccattgcccagca

SEQ ID NO: 37535 - DNA, 75 bp, Homo sapiens
  misc_feature 1..75: note = chr19:41596078-41596153
  misc_feature 1..75: note = hyper
  source 1..75: mol_type = genomic DNA
cgacgccctccggggcacgcacggtgagtaggggaccccgagtgcgagggcgggaacccgcgctttctgcctggg

SEQ ID NO: 37536 - DNA, 185 bp, Homo sapiens
  misc_feature 1..185: note = chr19:41641726-41641911
  misc_feature 1..185: note = hyper
  source 1..185: mol_type = genomic DNA
ggagcccagcaaaggcggggccaatgtgtggatagggcacttggaggtctggtaaggcagcaaaacgaacgaagccggccgcaggagtcggaggccccgaaagggatgtagccagtgacccggcgcttcctggatggggcgtggccggttcccgggcccgcctcctttcccgtccccaccacagg

SEQ ID NO: 37537 - DNA, 459 bp, Homo sapiens; identical to SEQ ID NO: 13412
  misc_feature 1..459: note = chr19:42028283-42028742
  misc_feature 1..459: note = hyper
  source 1..459: mol_type = genomic DNA

SEQ ID NO: 37538 - DNA, 46 bp, Homo sapiens
  misc_feature 1..46: note = chr19:42419428-42419474
  misc_feature 1..46: note = hyper
  source 1..46: mol_type = genomic DNA
ccgccgtgtctcacacgcgtctctgccatctcgcagtctctgtgcc

SEQ ID NO: 37539 - DNA, 60 bp, Homo sapiens
  misc_feature 1..60: note = chr19:42445049-42445109
  misc_feature 1..60: note = hyper
  source 1..60: mol_type = genomic DNA
gcccgctcccggactcgcgccccccgcgcgtccactctgatttctcggcccatttttctt

SEQ ID NO: 37540 - DNA, 115 bp, Homo sapiens
  misc_feature 1..115: note = chr19:42574036-42574151
  misc_feature 1..115: note = hyper
  source 1..115: mol_type = genomic DNA
gagagctgggagacccggagaggccaagaagggggcaaatgaggtggagagatagggaggagggagaggaggatggagaggagcaggtggaagagaaaggcggaggagggtgggg

SEQ ID NO: 37541 - DNA, 221 bp, Homo sapiens
  misc_feature 1..221: note = chr19:42636368-42636589
  misc_feature 1..221: note = hyper
  source 1..221: mol_type = genomic DNA
agctgtgggggttagcggggacccggcatgggagagagggagttgctagagtacagaggagaaggacaatggagacagctgaggaggaggggcaggcagggcccgcagagcaaacctaaatgtgctgcctgtcctctgagcagtggcacaggcaccagcccccttacctggagcccccatgctggagtgaaccatgctgcccgccccgccagggctggggg

SEQ ID NO: 37542 - DNA, 116 bp, Homo sapiens
  misc_feature 1..116: note = chr19:42683705-42683821
  misc_feature 1..116: note = hyper
  source 1..116: mol_type = genomic DNA
aggaggacgcaggcacgcgctgcgcggtcttggcttagcagctgcaaccgcccttcgctttgttaccagcaaggctaccccatgcatactgagtggacacgcgggaccctcatgtg

SEQ ID NO: 37543 - DNA, 42 bp, Homo sapiens
  misc_feature 1..42: note = chr19:42774775-42774817
  misc_feature 1..42: note = hyper
  source 1..42: mol_type = genomic DNA
atatttgggggcctgcggggggctagccgactcagccaccct

SEQ ID NO: 37544 - DNA, 104 bp, Homo sapiens
  misc_feature 1..104: note = chr19:42827981-42828085
  misc_feature 1..104: note = hyper
  source 1..104: mol_type = genomic DNA
cgcccctggagtacctgaccccgctcccggccccgccgccgcccccagcgcccggacccctgagccctcctcctgcctttcgcactccccgcgccccaacaccg

SEQ ID NO: 37545 - DNA, 184 bp, Homo sapiens
  misc_feature 1..184: note = chr19:42828316-42828500
  misc_feature 1..184: note = hyper
  source 1..184: mol_type = genomic DNA
cgtgcgtccacacctggggtggaagggttctccgggggagggggacgggccttcggggccgcatctgccccccgagggtcccggacggcctctgaccctgacccccctcccaggccgggaagcaggtggaggagacagcggtggcggcggcggtggccccgaggggccgcgtggtgaccatggc

SEQ ID NO: 37546 - DNA, 114 bp, Homo sapiens
  misc_feature 1..114: note = chr19:42905723-42905837
  misc_feature 1..114: note = hyper
  source 1..114: mol_type = genomic DNA
cgtccctgcggcggtcgccgcagcagcagcagcaaaaggcagcggtggcgtgcaggtccagccgtctcggtgaccggtgtgtgtgcgcgtccccctccccgtggcgagggtctc

SEQ ID NO: 37547 - DNA, 68 bp, Homo sapiens; identical to SEQ ID NO: 13416
  misc_feature 1..68: note = chr19:42906129-42906197
  misc_feature 1..68: note = hyper
  source 1..68: mol_type = genomic DNA

SEQ ID NO: 37548 - DNA, 54 bp, Homo sapiens
  misc_feature 1..54: note = chr19:42927424-42927478
  misc_feature 1..54: note = hyper
  source 1..54: mol_type = genomic DNA
tcatcccgttgtccccgcaagcggcaatgggccagtccgcggacccccccaact

SEQ ID NO: 37549 - DNA, 238 bp, Homo sapiens
  misc_feature 1..238: note = chr19:42928122-42928360
  misc_feature 1..238: note = hyper
  source 1..238: mol_type = genomic DNA
agggggaaagtggggcgcctctgagcctctgcctggggtgggggcgggccaggtcctctgccaactcaaagacgaggcggggcgccagcgctggaggcgtggctgtgcctgagagccgttggaggagggagccccgctttccctctcctgtctcctagttctcctattgcgcttttcctgggggatctttctccctctgtctccgccccctaatccatgctcccgataatgagggtgg

SEQ ID NO: 37550 - DNA, 140 bp, Homo sapiens
  misc_feature 1..140: note = chr19:44203673-44203813
  misc_feature 1..140: note = hyper
  source 1..140: mol_type = genomic DNA
cttgcaccctgtctccgtctcggcaggcggccggaacgtgaacgtacgcggctgcggctcccgagacctgtgcagcgccctggactggacccacgggctctctgtgctcccaagacactggctgtcgagccactgcagcc

SEQ ID NO: 37551 - DNA, 229 bp, Homo sapiens
  misc_feature 1..229: note = chr19:44302881-44303110
  misc_feature 1..229: note = hyper
  source 1..229: mol_type = genomic DNA
gcccagcggaggccacgccttccccgaggctgccaggcctctcatcgtccctcccggagcccagccccgctctcccgcgcaccttggctcaggttggggagggcgtcatgagtcatgaggtgggcgttgcatttgtcagttgtgcagccgcgcaccaccgagtagtctggcggcagcgcgtccgcgttcgattgcgtctggcccgcaggaggcccggtccagcagccct

SEQ ID NO: 37552 - DNA, 61 bp, Homo sapiens
  misc_feature 1..61: note = chr19:44324840-44324901
  misc_feature 1..61: note = hyper
  source 1..61: mol_type = genomic DNA
tgggaattgtagtcccgggccggaaacgcaggagacgccagaaacccaagtttgggacggc

SEQ ID NO: 37553 - DNA, 15 bp, Homo sapiens
  misc_feature 1..15: note = chr19:44324902-44324917
  misc_feature 1..15: note = hyper
  source 1..15: mol_type = genomic DNA
cgtcccaagggtttc

SEQ ID NO: 37554 - DNA, 16 bp, Homo sapiens
  misc_feature 1..16: note = chr19:44405908-44405924
  misc_feature 1..16: note = hyper
  source 1..16: mol_type = genomic DNA
tgatttctgtggagac

SEQ ID NO: 37555 - DNA, 162 bp, Homo sapiens
  misc_feature 1..162: note = chr19:44405925-44406087
  misc_feature 1..162: note = hyper
  source 1..162: mol_type = genomic DNA
atctactcaccacgtaggggctacagcagctcggacaccggaaaaagatctagagctcgagggtgaccctagcgcggtgacttctgggaaatgtagtccacccggaataaccatgtccacggcgcccgccattctgtagcctatgctcggagggcacatgag

SEQ ID NO: 37556 - DNA, 46 bp, Homo sapiens
  misc_feature 1..46: note = chr19:44455621-44455667
  misc_feature 1..46: note = hyper
  source 1..46: mol_type = genomic DNA
gcatcccgagggactcggtcctgtcacgtttcgccctatttggggg

SEQ ID NO: 37557 - DNA, 110 bp, Homo sapiens
  misc_feature 1..110: note = chr19:44488496-44488606
  misc_feature 1..110: note = hyper
  source 1..110: mol_type = genomic DNA
tgaggtttggagatgcgaggggtgggagggaagtttcgttgccgtcgatggagccttctggcgttgggggctgtactcaggtccaccggaggagtcgtcgggggttcggg

SEQ ID NO: 37558 - DNA, 431 bp, Homo sapiens
  misc_feature 1..431: note = chr19:44711532-44711963
  misc_feature 1..431: note = hyper
  source 1..431: mol_type = genomic DNA
gaagctcaggttactcggaagtatttccgctccaaggagcggaactatggccggtttcccctggggcattctgggaagtgtagtcaggggcccgcgtagcctggggcacttccgcttttggatggcggagctagggaattgtgggaagtgatccggggtttctctttagttgctgggaagttttttcgctctaggagggcgaaaacaagtgtttggatccgctgggaccctccaagttttctcagcctcgtcagggagcaagcggggccctggccctcgtctggaggaaggctagagaagctgtggccagctgggaggctggagttgggagcagtttgtgttctttcctctcggctgagcctcacgtttggagcagttcttgcgtccccgggttgggagcgtcctggatcggttgtcgcttggttagaggg

SEQ ID NO: 37559 - DNA, 195 bp, Homo sapiens
  misc_feature 1..195: note = chr19:44905416-44905611
  misc_feature 1..195: note = hyper
  source 1..195: mol_type = genomic DNA
actgaccctaagcttcgacccgaagaggcacagcgcaagtcgctgtcacgaaacgtgaagatgcactgttttgtcaaacccagggctgctccccaaaccgagcccacgctcgagcccacgctcttcccatcctatcccgggtaggtcgggccgctgaacttccctagtctaccccacctacgaggccttatcatt

SEQ ID NO: 37560 - DNA, 336 bp, Homo sapiens
  misc_feature 1..336: note = chr19:44952282-44952618
  misc_feature 1..336: note = hyper
  source 1..336: mol_type = genomic DNA
ccacaagtgggtgggcggctaccctgagaaaattcatgtcatcgatccgcaactgacacagtggagtctcccgcactgcagatctcatctcaaagccagagctggcctcaaactgcttttccaagcctggactgcgagggctgccgacccgggcccaccccgcacaggcgctcagaatgttcgatacgtgcgcctccttacacccctgcctcaccaggccgagctcatggaaatccgtgggcttcgaccctccgccgcacgttgtcccttcacactggtcctatagagccgatcctaattcccatggcctgacagtacaaccgcatggagatgcac

SEQ ID NO: 37561 - DNA, 46 bp, Homo sapiens
  misc_feature 1..46: note = chr19:44952619-44952665
  misc_feature 1..46: note = hyper
  source 1..46: mol_type = genomic DNA
tctctaagacgcctcaccactgcctaagaagcaatcaaggtgacgc

SEQ ID NO: 37562 - DNA, 85 bp, Homo sapiens
  misc_feature 1..85: note = chr19:44952666-44952751
  misc_feature 1..85: note = hyper
  source 1..85: mol_type = genomic DNA
cccaccggaaacggaagtagtcgactcgaggtgtgggactacctttcccagaaccctccgcagcgcagtccgatcctaggggcga

SEQ ID NO: 37563 - DNA, 80 bp, Homo sapiens
  misc_feature 1..80: note = chr19:45300099-45300179
  misc_feature 1..80: note = hyper
  source 1..80: mol_type = genomic DNA
acagctcaggaagtccgggaacattattcgaccacagcaaacaagagagccagcaggaagcggggcggtgggggggaggg

SEQ ID NO: 37564 - DNA, 158 bp, Homo sapiens
  misc_feature 1..158: note = chr19:45655399-45655557
  misc_feature 1..158: note = hyper
  source 1..158: mol_type = genomic DNA
cggcttgagcgcgctgacggctcggatgagacccatgcgccggcggatggagtggtccaggttgaccgtgcagcgcagcaggctctgcgcctcggccacggtgaaggggaagtcggcgcccaggaagcgctcgaagagctcggggtcgccgtccaggt

SEQ ID NO: 37565 - DNA, 747 bp, Homo sapiens
  misc_feature 1..747: note = chr19:45655647-45656394
  misc_feature 1..747: note = hyper
  source 1..747: mol_type = genomic DNA
cgcccccggtctgctgccggtcctccaggcactgcagcgcccagctcaggcggcacggccactggttggcgagcaccacccacgccaccgcctggcgcggcgtggggcccccaaagtccccctgctgctgctgctgctgcagcaggcgcacggtgatgggcacggtgttgacgatgcgccgcatggacaccacgttgtcgggcacgtactcgtagaggcagtcgcgctcgtcgtgaaggcagaagagcgcctcctggattcgccgcgccgcctcgtcgtcgatgcggccctgcccgcgctccgtccccgcctgcgcctgcaccgccagcagctgcgcgctctcgcccccggcgtcccccggcagccacggcttgcgcgtcatctcgcggtacaacaggtcgtcgcggctctgcaccgcatcgtgcaggaactgcagcttggtgcggcggcccataatgggcacagagaagggcagcgtgacagtgcggttgaggaagaggtagccgttatcggccgtgcccttcatgttgcccgcgctctctaggcacgcggccaggatgctggggtccacgaccaggatgaagatgaagggcgcgtggctgtcggacagcagcgtgttgatggcgttgagcacgcccaccacgcgctccgggtagcacgtgtccagcccggtgacctccagcaccacgcgcagcctgcgccgctggtagatctccaggaagcacaggaagtcggtgagcagctcca

SEQ ID NO: 37566 - DNA, 82 bp, Homo sapiens
  misc_feature 1..82: note = chr19:45656661-45656743
  misc_feature 1..82: note = hyper
  source 1..82: mol_type = genomic DNA
gcagccccaggcacacgcggcgccgacaatgccactcgctctggcagcagtcctgcctggtggccggcttgttgcccagcac

SEQ ID NO: 37567 - DNA, 171 bp, Homo sapiens
  misc_feature 1..171: note = chr19:45656790-45656961
  misc_feature 1..171: note = hyper
  source 1..171: mol_type = genomic DNA
cgcacaacgtggtcaccaggccggcccacagcttgtcggtgcccgcgtactgccaggcgctaaagcggatgaaaaggaactgcacgttcctgcgccgcaggtgcacctcggtgatgatgggctgcaggaacaccaggtaccacagtagctgcgggacgccccagccgctca

SEQ ID NO: 37568 - DNA, 164 bp, Homo sapiens
  misc_feature 1..164: note = chr19:45657177-45657341
  misc_feature 1..164: note = hyper
  source 1..164: mol_type = genomic DNA
taaagagctggaagccggtgcagaagcgggggcgtggagaggcctggagccgggcttggaccggaagcggtctgaaggccaggctgtggggtcgggatgggcagaggtagagccggcagaggagagatgggaggaggcaaaaagagatacgaggaagagccagg

SEQ ID NO: 37569 - DNA, 30 bp, Homo sapiens; identical to SEQ ID NO: 13431
  misc_feature 1..30: note = chr19:45755404-45755434
  misc_feature 1..30: note = hyper
  source 1..30: mol_type = genomic DNA

SEQ ID NO: 37570 - DNA, 472 bp, Homo sapiens
  misc_feature 1..472: note = chr19:45826794-45827266
  misc_feature 1..472: note = hyper
  source 1..472: mol_type = genomic DNA
taaccctcgccccctcggtgccactgggagatttccgctgtgcgggggacagggagggtctcggtcgccgggaaaggagttatttttagagggcgctttgctgtctcctctgccgcaaaggccgagacccgaggcgctgggtatgggggggttcgggggcaggtgttggaggggggttcgccacgtgtcctggttaattataaccgggcgtctcgggtgtcctcgggcctcgcctccttacaagggcagccacggggccctgggtggccgctcccacctcccggggaagggggctgggcagcgacgccgttcagagcgcgggcgccagactcgcgcagatctgggcagagcaagcgctctcggcgcctcggctgtgagcaaggacttccagggctgagaggggggttctgtggaggagagtacagtatagaggaagccgctttctcctcctgggacgcgccaggattgcagg

SEQ ID NO: 37571 - DNA, 388 bp, Homo sapiens
  misc_feature 1..388: note = chr19:45888837-45889225
  misc_feature 1..388: note = hyper
  source 1..388: mol_type = genomic DNA
agtcagcataaccctcgcggtaagggtcgcacttctcgaaggcggtggcgccgtcgctgagcgtggtggcgaagattgcagcgccgtgctgcaccagcgccatgcagatgactgtgtcgttgcacgacgccgcgcagtgcaagggtgtcctaggcgtgggggtggggggttgcggggaacgatgcgtgagaggctgcgcgtccgcccacgggggacccagcccaccgcgcgggtcggggctcaccagccgtggctgtcgggggagttgacattggcacccgcggtgatgaggaaatccacgatagagtagttggcgccgcagatggcgttgtgcaaggcagtgatgccctcctcgttgggctggctcgggtcgttcatctgagtgcac

SEQ ID NO: 37572 - DNA, 91 bp, Homo sapiens
  misc_feature 1..91: note = chr19:45889315-45889406
  misc_feature 1..91: note = hyper
  source 1..91: mol_type = genomic DNA
cgcctgctgcaccacctccagctccccggtcagcgccgcgtccaggaggagcaccagagggttgaggcgcgcgcggcgggccttgcgcggg

SEQ ID NO: 37573 - DNA, 58 bp, Homo sapiens
  misc_feature 1..58: note = chr19:45931217-45931275
  misc_feature 1..58: note = hyper
  source 1..58: mol_type = genomic DNA
aacgttagttaagagcgaggggaaaaaattgccctgggttctacgttatttccaagtt

SEQ ID NO: 37574 - DNA, 634 bp, Homo sapiens
  misc_feature 1..634: note = chr19:46001719-46002353
  misc_feature 1..634: note = hyper
  source 1..634: mol_type = genomic DNA
agggctgaaggatggcggtcctggcccgccagctgcagcgtctcctctggaccgcttgcaagaaaaaggagagggagaaggaggggagggaggaagaggaggaggaggaggcggggcgcagggcccccgaagggcctcggtctctgttgacagcgccgcgccgcgcccagcggccgcacgggggtgccgaggcgtctgggggcctgcgcttcggggcgagcgcagcgcaaggctggcgcgcgcgcatggaggatgctcactgcacttggctttcgttacctggtctgcccccgggctgggccttgtttgccgtcctcgacggccacggtggggctcgagctgcccgcttcggtgcacgccatttgccaggccatgtgctccaggagctgggcccggagcctagcgagcccgagggcgtgcgcgaggcgctgcgccgagccttcttgagcgccgacgagcgcctgcgctccctctggccccgcgtggaaacgggcggctgcacggccgtggtgttgctggtctccccgcggtttctgtacctggcgcactgcggtgactcccgcgcggtgctgagccgcgctggcgccgtggccttcagcacagaggaccaccggccccttcgaccccgggaacg

SEQ ID NO: 37575 - DNA, 91 bp, Homo sapiens
  misc_feature 1..91: note = chr19:46105207-46105298
  misc_feature 1..91: note = hyper
  source 1..91: mol_type = genomic DNA
gagcaacagagggggcgggcaccgagacggcgcgggagactgaggcagcccccgagggggcggggaggagcggtctcgccacgagcagggc

SEQ ID NO: 37576 - DNA, 34 bp, Homo sapiens
  misc_feature 1..34: note = chr19:46148823-46148857
  misc_feature 1..34: note = hyper
  source 1..34: mol_type = genomic DNA
ggccaggattggctgcgcccggatccccctaggt

SEQ ID NO: 37577 - DNA, 65 bp, Homo sapiens
  misc_feature 1..65: note = chr19:46173896-46173961
  misc_feature 1..65: note = hyper
  source 1..65: mol_type = genomic DNA
gctctaaggggcagacggcgggggagctgtaccagcgctgggaacggtaccgcagggagtgccag

SEQ ID NO: 37578 - DNA, 113 bp, Homo sapiens
  misc_feature 1..113: note = chr19:46180359-46180472
  misc_feature 1..113: note = hyper
  source 1..113: mol_type = genomic DNA
ggctggggtgagctccgatcccgtcccccgcccaacccagcgcgcctctcctcggctcccccaactgccctgctggttggcctctgcgggtctcctcccgtctctaggcttct

SEQ ID NO: 37579 - DNA, 21 bp, Homo sapiens
  misc_feature 1..21: note = chr19:46283058-46283079
  misc_feature 1..21: note = hyper
  source 1..21: mol_type = genomic DNA
tcaccttcagaatctcgaagt

SEQ ID NO: 37580 - DNA, 484 bp, Homo sapiens
  misc_feature 1..484: note = chr19:46379893-46380377
  misc_feature 1..484: note = hyper
  source 1..484: mol_type = genomic DNA
cgccttgccggctgcgtgtcacccccgccccctgccgcgctggctccccgtccgtcccaccagccttgctgtcctgggcaggccggggaattcctcccggttcctggaaaaaacaactggggccgagagaaaggccctcagtctccccaggcacccgcccccctccctcgggcctgggggtctctcccggagtcggccagcccgaggcaggaagccctgcggtttctggcttctcccaggcggcctccggatctggcccccgccccccggccaacagcccaaatattattccgcgggaggagtcggtggtggcgggaggaggcccaggctgaaagaggctttcagggcggccaggcctggggcttcctgtccccaggctcgggcctcaggccgccccagtggggacctcaggtggccggaggggcggggtgttgttgtagggtcctcgggggagggtggggccatccgtcggggtgtctggtgg

SEQ ID NO: 37581 - DNA, 117 bp, Homo sapiens
  misc_feature 1..117: note = chr19:46476943-46477060
  misc_feature 1..117: note = hyper
  source 1..117: mol_type = genomic DNA
acagagcctggagagcggccgtgagcaggatggcagggccgaggggggtctccgatagggccgggaaagaactgagaggtggggtctctcctgggaccacagaggctggggactgga

SEQ ID NO: 37582 - DNA, 354 bp, Homo sapiens
  misc_feature 1..354: note = chr19:46477118-46477472
  misc_feature 1..354: note = hyper
  source 1..354: mol_type = genomic DNA
cgagccccccagaccctgctcggggtggggggccggaggagcgtggccggagtgggaggcggaggcggccgctagtgggggcccggggggcggcgggcgcgggcggcggcggcgacggggctggcggtggctgctggcccgagcatcttcttcccggaggctcccacagcgcctggcccctcccacccaacgaggtcacgcccatgccgggtagggccacgcccttcggcgcccccattggtccagccttgaagcctggaccacgtccctctgggttggccacgcccctcccggcggcagagagctggacccgactcccccaggctgctgggaggaccccgggctcctccaagc

SEQ ID NO: 37583 - DNA, 259 bp, Homo sapiens
  misc_feature 1..259: note = chr19:46519255-46519514
  misc_feature 1..259: note = hyper
  source 1..259: mol_type = genomic DNA
cgcgattgagtttgtcggggcgggcgggaagctgacagctgcctctgtggtctcaggaggcggactccgccggtgcagccgcccccgacgcgggaggaccgggcctcatcgtcccgggagcgctccgcgtcgcgaggccgcggcgccgcgcgctcctcatcccgggagagcggccgcgggagccggggtcggggccgccctgcgcgcccctcgccctcgcccacaggtctgtgcccctgccctgcggtagggaggggac

SEQ ID NO: 37584 - DNA, 30 bp, Homo sapiens
  misc_feature 1..30: note = chr19:46907252-46907282
  misc_feature 1..30: note = hyper
  source 1..30: mol_type = genomic DNA
gcatcccccagatggcgtccccttcctctg

SEQ ID NO: 37585 - DNA, 215 bp, Homo sapiens
  misc_feature 1..215: note = chr19:46907501-46907716
  misc_feature 1..215: note = hyper
  source 1..215: mol_type = genomic DNA
ggctgaccccagatgcgcctagttgggaatgtgctggaaagatacgccccctggagggagtgcgcccaggaagtggggaggagcgtttgagatcgaaggagtggccgcgtaaaggccctgaggtctcgcaaggaagggtcccggggcgtcccaggccctgttctaggtgcaagaaacaggaacctcctggagcgagcatgcggtggggaggcagg

SEQ ID NO: 37586 - DNA, 30 bp, Homo sapiens
  misc_feature 1..30: note = chr19:46908092-46908122
  misc_feature 1..30: note = hyper
  source 1..30: mol_type = genomic DNA
cgggttggatttccacgtgcctggagttta

SEQ ID NO: 37587 - DNA, 416 bp, Homo sapiens
  misc_feature 1..416: note = chr19:46916572-46916988
  misc_feature 1..416: note = hyper
  source 1..416: mol_type = genomic DNA
agctccaagttggggcgcgcgggctgccagcgactcttcctgccccaggccccagggacgcggctggaacttgggacaggacttcgcagacaaagacggtccagtcgaagctattcaatatggccgaggcgctgggaggccccagcccgggcctccagtagggtcccccgcccccaggcaggccgccacccagctccaggctgaccttgacgcgccgcagcctgccagcccgcgcgcttagagctctgcaccgtggagcgcgcgggcaggaagttcctcctcgccctccgccagaatgaggcccaccttcccccgtctcatcttacactcccagactctggaagactgacaggggggctgtccactcccttcggggcggcctccttcccctcccccacaggggtgtggccgcgccc

SEQ ID NO: 37588 - DNA, 15 bp, Homo sapiens
  misc_feature 1..15: note = chr19:46917060-46917075
  misc_feature 1..15: note = hyper
  source 1..15: mol_type = genomic DNA
cggttcccaaacctg

SEQ ID NO: 37589 - DNA, 140 bp, Homo sapiens
  misc_feature 1..140: note = chr19:46930026-46930166
  misc_feature 1..140: note = hyper
  source 1..140: mol_type = genomic DNA
attttctgcaaagggcgcaggcgcctggggtcagcctgtggtctccatagcaacggtcggacgcgctgctaggttctggctctgactgcgcctgcgcggctggtcccgcggggtctcccgagtagcggaagatatttgtg

SEQ ID NO: 37590 - DNA, 275 bp, Homo sapiens
  misc_feature 1..275: note = chr19:46932061-46932336
  misc_feature 1..275: note = hyper
  source 1..275: mol_type = genomic DNA
agagtgtcgtaggcgcggccctggcaggcagggaggcgcgtccctcaccgctggcccagaggttgcactcagtgccctgtcgccggactaggacgaggatgtggccgctgcacttgctcccgcggtgacgtcaccgcctccttccgctctgcggcctggcggtctccatggcaaccgctgaagcatccatctcctctgccattggccgactggccgcattgaaatcaagagtctgagggggtcattcggaggtgaggggtcggccaccagccctc

SEQ ID NO: 37591 - DNA, 67 bp, Homo sapiens
  misc_feature 1..67: note = chr19:46974500-46974567
  misc_feature 1..67: note = hyper
  source 1..67: mol_type = genomic DNA
gccccggtgctcacacgtgtccctgaatctgcagcaaaaggccctaggaccctcccccgggcctgac

SEQ ID NO: 37592 - DNA, 41 bp, Homo sapiens; identical to SEQ ID NO: 13444
  misc_feature 1..41: note = chr19:46974568-46974609
  misc_feature 1..41: note = hyper
  source 1..41: mol_type = genomic DNA

SEQ ID NO: 37593 - DNA, 291 bp, Homo sapiens
  misc_feature 1..291: note = chr19:46992718-46993009
  misc_feature 1..291: note = hyper
  source 1..291: mol_type = genomic DNA
ccccagcctccccaccgcatgctccctgcgggagggtcctgtttcctgcaccaagaacagggcctgggacgcgccagccctggataaatctcatggactgcgcggatggcgctgagggctcctcccagacagtcgccttctctcccaggagggggcaaccgcgctccgctccacccgtcgccagaggctccacgcgcgggacagacccggctgctgcagcctgtgctggtctctgtgcaccgggacccttccctgcaggatctcaaggcctttacgcggctgctccttcga

SEQ ID NO: 37594 - DNA, 15 bp, Homo sapiens
  misc_feature 1..15: note = chr19:46993246-46993261
  misc_feature 1..15: note = hyper
  source 1..15: mol_type = genomic DNA
gagctggccctaagc

SEQ ID NO: 37595 - DNA, 107 bp, Homo sapiens; identical to SEQ ID NO: 13446
  misc_feature 1..107: note = chr19:46993281-46993388
  misc_feature 1..107: note = hyper
  source 1..107: mol_type = genomic DNA

SEQ ID NO: 37596 - DNA, 77 bp, Homo sapiens
  misc_feature 1..77: note = chr19:46996589-46996666
  misc_feature 1..77: note = hyper
  source 1..77: mol_type = genomic DNA
tttcctcctcccatccgggcttcctccgtcgggatcgctggcgcccccggcctgcgagggcccgagaggggaacgtg

SEQ ID NO: 37597 - DNA, 45 bp, Homo sapiens
  misc_feature 1..45: note = chr19:47143100-47143145
  misc_feature 1..45: note = hyper
  source 1..45: mol_type = genomic DNA
acagacactgcctgccgtgagcgcagcctccgttcctctcctgag

SEQ ID NO: 37598 - DNA, 14 bp, Homo sapiens
  misc_feature 1..14: note = chr19:47152977-47152991
  misc_feature 1..14: note = hyper
  source 1..14: mol_type = genomic DNA
cgtcagaaagggcc

SEQ ID NO: 37599 - DNA, 170 bp, Homo sapiens
  misc_feature 1..170: note = chr19:47523113-47523283
  misc_feature 1..170: note = hyper
  source 1..170: mol_type = genomic DNA
ctgggcgccacagcccgcgcgtcccgctgcgccccgcgcgccccggggtctatggagctgcccctccgcgccgcccggccggccccacgccgcgcccggagcctgctctgcggccaagtaatcggactggcggtcctgcgggtaggggaagcttgcgggctggcaggagg

SEQ ID NO: 37600 - DNA, 162 bp, Homo sapiens
  misc_feature 1..162: note = chr19:47523562-47523724
  misc_feature 1..162: note = hyper
  source 1..162: mol_type = genomic DNA
aggacacctgggccccgagtgtcgggtcaatcctgggggcgtcctggggcagaggctgcggcggctgcgtccggggctggggctcgcgcgccggggtcttcagggaggaagttgtggtcgtggggatgtggcggtccgaacacgtggcgccatcccgagagg

SEQ ID NO: 37601 - DNA, 162 bp, Homo sapiens
  misc_feature 1..162: note = chr19:47524772-47524934
  misc_feature 1..162: note = hyper
  source 1..162: mol_type = genomic DNA
ccgttcccaaggccccgggaggcggggctcgcccccagttcccaagcccctgagccccggggccccgccgacacctcctccgcgccgcccgcccagcctgcaggcgcagcgcaaggagaagtcccggaacgcggcgcgctcgcggcgcgggaaggagaacct

SEQ ID NO: 37602 - DNA, 202 bp, Homo sapiens
  misc_feature 1..202: note = chr19:47742701-47742903
  misc_feature 1..202: note = hyper
  source 1..202: mol_type = genomic DNA
cgcagggcctgagtcctggctttccgcggtggggaaggggtctcccgggtcccctcggtgtggccggccctgcaggccgggaggctggaccggggccgggtgggggctgggcgggggcgcgggcgtccgcagggtccgagcggccggcgcgcgtgtgaaggttaccgcttcccggcggggcgggggccgcgcgctgttgctg

SEQ ID NO: 37603 - DNA, 30 bp, Homo sapiens
  misc_feature 1..30: note = chr19:47746438-47746468
  misc_feature 1..30: note = hyper
  source 1..30: mol_type = genomic DNA
agctcccgaatcctgcggtaacttggtaac

SEQ ID NO: 37604 - skipped

SEQ ID NO: 37605 - DNA, 57 bp, Homo sapiens
  misc_feature 1..57: note = chr19:47921726-47921783
  misc_feature 1..57: note = hyper
  source 1..57: mol_type = genomic DNA
cctgtcttctatccccgttcccatccccagggagacaggctccgtggggccagcagc

SEQ ID NO: 37606 - DNA, 39 bp, Homo sapiens
  misc_feature 1..39: note = chr19:47925553-47925592
  misc_feature 1..39: note = hyper
  source 1..39: mol_type = genomic DNA
ctttctatctctcctcgccctctccgtcttttttgttgg

SEQ ID NO: 37607 - DNA, 573 bp, Homo sapiens
  misc_feature 1..573: note = chr19:47933200-47933773
  misc_feature 1..573: note = hyper
  source 1..573: mol_type = genomic DNA
agccaggggagggggcggagaagggaggccgagtcccaggagaggaggccgagtctggggggaaaaggagaccagggtccaagagcaggtgcagccgagtccctagccccgggcgggcggtggggacgagtctctgcgcgaggccctagaagccccggatgtggcagtacgcctccaggctggcgaagaggatgtacaggagccagaggcccaggaagagcgcggtggtggcgagcttgggtccgcgcgggccgcccagctcgccgccgatgtgcggccggcgccggtacagcagcacggcaatgcccacgaaggcgaagacggtgaagagcgtgacggagaaggccagcgtgccagtgcgcacctcgaaggggcggccctgcaccgcccagtacacggcggccacagaccaggcgacgcccaggccaaggaacacgttcaccgcgttggagccggtcacgttgccgatggacgcgtcggcgcactggtcctgcagcgccgccaccttgctggcgaacgtgtctgcgaggcagagacatacaggtcggaggggctttgcgccgccacccacag

SEQ ID NO: 37608 - DNA, 143 bp, Homo sapiens
  misc_feature 1..143: note = chr19:47960799-47960942
  misc_feature 1..143: note = hyper
  source 1..143: mol_type = genomic DNA
cgaataccacgcacaccgggaagaagaccagggtcagcagcgcctcccacacctgcgggcggcgggcgtcagggcgaggccgggcgggccgccttctccctccccgcctctctgtctcagtctctgtccgcctctgccactcc

SEQ ID NO: 37609 - DNA, 207 bp, Homo sapiens
  misc_feature 1..207: note = chr19:48076465-48076672
  misc_feature 1..207: note = hyper
  source 1..207: mol_type = genomic DNA
cacgcgcggcgcaggcgcgcgtacgtgaccgcgggccgcctcacgcctcccagagcggcctcgcgcgtgcctcctggccgcgcgctctcggctgcttctccgaggggcggggcttgccgcgggcgggaaaggaggcggttggtcgccattttgggagggggcggttgagggcggagagtgagaagagtgagccggggaggagcggcg

SEQ ID NO: 37610 - DNA, 49 bp, Homo sapiens
  misc_feature 1..49: note = chr19:48774925-48774974
  misc_feature 1..49: note = hyper
  source 1..49: mol_type = genomic DNA
acgaatctctgtagtcggtccttcctggcggcctcgttaggttgattta

SEQ ID NO: 37611 - DNA, 41 bp, Homo sapiens
  misc_feature 1..41: note = chr19:48775188-48775229
  misc_feature 1..41: note = hyper
  source 1..41: mol_type = genomic DNA
ggaaaggggaaggcacgaatgacccacgtgttcagaccccg

SEQ ID NO: 37612 - DNA, 32 bp, Homo sapiens
  misc_feature 1..32: note = chr19:48867764-48867796
  misc_feature 1..32: note = hyper
  source 1..32: mol_type = genomic DNA
ccttaaaggggagaccgcgattctaagaaggt

SEQ ID NO: 37613 - DNA, 231 bp, Homo sapiens
  misc_feature 1..231: note = chr19:48901882-48902113
  misc_feature 1..231: note = hyper
  source 1..231: mol_type = genomic DNA
cagcccgggcctagacgtgcggcccgtggcgctggtgctcaacggctcggacccgcgcagcctcgtgctgcagctctgcgacctgctgtcggggttgcgcgtgcacggcgtggtcttcgaagacgactcgcgcgcgcccgccgtcgcgcccatcctcgacttcctgtcggcgcagacctcgctgcccatcgtggccgtgcacggcggcgccgcgctcgtgctcacgcccaa

SEQ ID NO: 37614 - DNA, 205 bp, Homo sapiens
  misc_feature 1..205: note = chr19:48918159-48918364
  misc_feature 1..205: note = hyper
  source 1..205: mol_type = genomic DNA
caagggtttctgcatcgacattctgaagcggctggcgcataccatcggcttcagctacgacctctacctggtcaccaatggcaagcacggaaagaagatcgatggcgtctggaacggcatgatcggggaggtgagggggcggacgggaggcggggaatcttcggggcggagtcgagaggcgggcacagccgggcgtggtggctca

SEQ ID NO: 37615 - DNA, 85 bp, Homo sapiens
  misc_feature 1..85: note = chr19:48918604-48918689
  misc_feature 1..85: note = hyper
  source 1..85: mol_type = genomic DNA
gcacagagtgagactcagtctcaaaaaataataataaaaaaaaagaggtcggcaccctggggcaggggcgcggccaaattgagga

SEQ ID NO: 37616 - DNA, 14 bp, Homo sapiens
  misc_feature 1..14: note = chr19:48947361-48947375
  misc_feature 1..14: note = hyper
  source 1..14: mol_type = genomic DNA
ggagaggatttggt

SEQ ID NO: 37617 - DNA, 42 bp, Homo sapiens
  misc_feature 1..42: note = chr19:48994825-48994867
  misc_feature 1..42: note = hyper
  source 1..42: mol_type = genomic DNA
ggggacaaaccttcacgtcccatttaccgcatcccccaaaag

SEQ ID NO: 37618 - DNA, 406 bp, Homo sapiens
  misc_feature 1..406: note = chr19:49127373-49127779
  misc_feature 1..406: note = hyper
  source 1..406: mol_type = genomic DNA
ccttaacaaagatggcgacaacggcgctgtctatggggccgcgacgtcgtctccgctgcgcgtcggccctcacccacgatggcggccagtctcccgaagcgcgaggccccgcccagctctcggcctctcccgcggccggtccctgcaccaagctcgcgagctgactggctccaccccccgcgccctcgtattggtgcggcccaggccggctgcacggccattggctgagcggatgcacaccctccccccacccctaggtctgatgggggctgttggtgctgacttgcgggaccgcctggaggaggacccggcgtgtgaggagggtgcgggggtcggggcagggaccggagtctaggggactgagggaccaagaggaacagagactcaggcccgggactggggcacc

SEQ ID NO: 37619 - DNA, 184 bp, Homo sapiens
  misc_feature 1..184: note = chr19:49242534-49242718
  misc_feature 1..184: note = hyper
  source 1..184: mol_type = genomic DNA
gcgccgtggccagcacgctcttgtagttggcgcccgatgccagtccggcgccgaagatcttgaggacccccggaggcgccgtggcgcgggtagccagcgggggctcgggggccacgcccgccgccagctccggcagcttcttctcgctggcccagcgctgcgcgccccccggggtcccagggcc

SEQ ID NO: 37620 - DNA, 131 bp, Homo sapiens
  misc_feature 1..131: note = chr19:49399218-49399349
  misc_feature 1..131: note = hyper
  source 1..131: mol_type = genomic DNA
caagcacagccctgccgctggattgttgcgggctccgcacgtaaagaatctcgcgccaggctctcgtaatgagaccgcgccccgccccggacccctagaccccgtctccgcaatcccgggtttggggtggg

SEQ ID NO: 37621 - DNA, 105 bp, Homo sapiens
  misc_feature 1..105: note = chr19:49560299-49560404
  misc_feature 1..105: note = hyper
  source 1..105: mol_type = genomic DNA
gccagcccaggggctcggcgtgcaccggccatggcgggggctgtgcaggaggcggtgccgagcgagagcccggcttacttgggatagaaccgaaagtcccgcgcc

SEQ ID NO: 37622 - DNA, 30 bp, Homo sapiens
  misc_feature 1..30: note = chr19:49649675-49649705
  misc_feature 1..30: note = hyper
  source 1..30: mol_type = genomic DNA
ggaccatttcatcatcgtgggttgtggggg

SEQ ID NO: 37623 - DNA, 30 bp, Homo sapiens
  misc_feature 1..30: note = chr19:49652144-49652174
  misc_feature 1..30: note = hyper
  source 1..30: mol_type = genomic DNA
gtggggggcgtggcccgaagagaccaaatg

SEQ ID NO: 37624 - DNA, 109 bp, Homo sapiens
  misc_feature 1..109: note = chr19:49924453-49924562
  misc_feature 1..109: note = hyper
  source 1..109: mol_type = genomic DNA
cgcagcagacgcggccggctccactctcttctttaaaccaatgagagcgcggtccgcacgaacggcgccccaggcgcgctgatctagccctctgcggaccaccgggttg

SEQ ID NO: 37625 - DNA, 445 bp, Homo sapiens
  misc_feature 1..445: note = chr19:49925697-49926142
  misc_feature 1..445: note = hyper
  source 1..445: mol_type = genomic DNA
ttattaagatggggacgggcagcgcgctcagggcgcatccaacaccagcagcttgtgcatgtacgagttcagccagtggcggcgctcgagggcggccagcaaccgcgcgcgctcccggaaggccgcgtcgtccgccagcgccaggctcctccgcggcctgggggtggcgggatccgcccaggcccgtcctggggggcggaggctgtggagagacgcggtgaccgcgcgtccagactcgctcttgccgccgcctgtcctccccgcggtctaactcgaagccccgttactgcccagtccgtggagtggctcggtccggctccccctgtctctctcgttctctgtgtgggtctctgtctctctgctcaccaggttcgaaactccccaggtactgagaccgagtctgatgcacttgtccgcccacagcgctcagcgcatggccaggcgc

SEQ ID NO: 37626 - DNA, 34 bp, Homo sapiens
  misc_feature 1..34: note = chr19:49926495-49926529
  misc_feature 1..34: note = hyper
  source 1..34: mol_type = genomic DNA
actcccgaggcagtgcggacgccccagggcacca

SEQ ID NO: 37627 - DNA, 134 bp, Homo sapiens
  misc_feature 1..134: note = chr19:49932009-49932143
  misc_feature 1..134: note = hyper
  source 1..134: mol_type = genomic DNA
cgcgggggtcgcccgcagcgtctggaggccctgtcccccgccacgctccccaacaacttcgtgtgagccccaccgagttctgccggacctgcacatccccacagtgaaggaaaaccctgcgcttctggtatgct

SEQ ID NO: 37628 - DNA, 633 bp, Homo sapiens
  misc_feature 1..633: note = chr19:49935736-49936369
  misc_feature 1..633: note = hyper
  source 1..633: mol_type = genomic DNA
aggctgtcctagagccggcccaggccccgccccactcacctccgcagttcatcaacttgcgcacgttggtggtggacatgatgcggcggctccgcaggaagtccgcgatctggccgccgatgggcacgatgatggtcatgaccaggtggggcagcgcggacaccaggcctacctgcgggaacaggtgtacagggacactagggttcggggccgccggctcggcgtctctgcccggtccgtgcaccaccggctcctccctgcctcgggatcgccgccagttccctcccgccgacccctccgcgcccccctgccctctcctcctgggctctaccttgctgatctcgaagccgaacacttcttcgaagtaggcgggctgggagatgagcagcaggtagaacgtccagctgcggcagaagttggccacgatgatggcatagactggcatagacgtgaagaagcgccgccagggagtgctaaacttctgtgggggcgaggggagggccgctaagacggggagcggggctgagggcttctccgcgtcccttcagggaccacagtgtagttctgcagaaaccaaaggatcccgaccgcactgaaacttctatggacccaaaggcgcgggctacaccatgt

SEQ ID NO: 37629 - DNA, 345 bp, Homo sapiens
  misc_feature 1..345: note = chr19:49936853-49937198
  misc_feature 1..345: note = hyper
  source 1..345: mol_type = genomic DNA
tagcccctctctttgcgttccagtcccgtctcctctagagtctgcaggaaccgtccctgatctacacgctgtgcaggttcgtggcttgctatctctccccgccccttccccgaagatttggtcccggaccgtgagggggttcatgagtttcgcgctctctccgatggcgtcctcgatgtacttgcgctcctcctccgagatgctggggtgcagcgcgggggactcgtaggagacgagcagccagaacaggtaccagaagatcccgaagctgcctgggggggtcaggagggggatgggagcgaggtgaggaccggccccgctccgccccagcgccacccggaacca

SEQ ID NO: 37630 - DNA, 770 bp, Homo sapiens
  misc_feature 1..770: note = chr19:50194104-50194874
  misc_feature 1..770: note = hyper
  source 1..770: mol_type = genomic DNA
acctggggtgggctgcgacctcccagctgagccttgttcctcgaagagacaggagactaagagacaatgagctgagtgaggagcccaggaacccgggttccgaacagctgcgtagaatgcgagcggccaaatggtggagaatctggccgggtaaaaggagacggaggactggggatcgaacggatgtaggggattggacgccgtggctcgaagggggcggggatagaacgcggggattggaaggaggcggggataaaacccgggacctgaatacccggctagggacacgagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtggtaagtactggaccccaggggctcgggctccggcggggcctggagtcctgtgtctagggttgggcgtgcaagcctctccatcacttgtcctcgacgctcgcctccgctcacagcctcagcatcccaggctgcgaggcatgcgcagtgggtgcttccttccccattccctccagcacgggcggggggaggggacgctgagcggatgaatttatagacaccatccccctcgccttggcatgaaaagcggcaatggggtggacagcgtcaatgtctaaca

SEQ ID NO: 37631 - DNA, 506 bp, Homo sapiens
  misc_feature 1..506: note = chr19:50316207-50316713
  misc_feature 1..506: note = hyper
  source 1..506: mol_type = genomic DNA
acaccgaacccccttcggtttagatacaggcgtccaaggccccacctgctgacgggcgggggcgccgccgcgactgctcctgcagaatagggggaccccgctggaggccgcgaggcacagcagatgcacagtgccgcccgtcccctcctcccccatttaggactcccaccgcggtccctcacgtggggactgtcagtgcgggtcttggagcatggcggtaatcagagtaactcggcctgtggtccggagccgccagagggcgagatggggagctgattggaagaggattaacttcccgccttcttcacccaactcaaacagaccctcaaaccctattcaggcacctcccccaaacccattaggttctcttccgccctagccggaagtcacggtacccctaacaaagatggcggcaaattgaatttgcaaagctttctagtttctccgaggaggtaaagagaaccaagaagccggattgaagatgatgactgcgccaaggcgttgcc

SEQ ID NO: 37632 - DNA, 15 bp, Homo sapiens
  misc_feature 1..15: note = chr19:50393562-50393577
  misc_feature 1..15: note = hyper
  source 1..15: mol_type = genomic DNA
gaacaccttggtggc

SEQ ID NO: 37633 - DNA, 40 bp, Homo sapiens
  misc_feature 1..40: note = chr19:50393971-50394011
  misc_feature 1..40: note = hyper
  source 1..40: mol_type = genomic DNA
gtcatccacctctcccgaccccgcccgtccctgacatccc

SEQ ID NO: 37634 - DNA, 391 bp, Homo sapiens
  misc_feature 1..391: note = chr19:50553997-50554388
  misc_feature 1..391: note = hyper
  source 1..391: mol_type = genomic DNA
tgggggcttggacctcggatcggcctcccacgcgaagcttgctccccaccagcatccccacgttggtggcgacgctgccccggccccacggatacttccgcgcctgtcagactccctgatgaactacccttcccagagtaccgcgggagctcgggctcctgagggcgacggtcctctgatggcagatgcgggagaaactctggcgtcaggcggccctcgcgtggagcacacgaagtcgtggcttattctggcttcagtatgtggggtggagaaggcgatccacgcagctgcgtctatttcctgtggatcaatcgcaaaatacgttctgtaagccccgcccccactgcgtgcgggcggcttttgtctccacggcaaccgtcaactctggaaa

SEQ ID NO: 37635 - DNA, 30 bp, Homo sapiens
  misc_feature 1..30: note = chr19:50651036-50651066
  misc_feature 1..30: note = hyper
  source 1..30: mol_type = genomic DNA
gtgcagtgctgctttcgggttctggggtca

SEQ ID NO: 37636 - DNA, 30 bp, Homo sapiens
  misc_feature 1..30: note = chr19:50651328-50651358
  misc_feature 1..30: note = hyper
  source 1..30: mol_type = genomic DNA
gacccaacttgggcccgcccccggagcttc

SEQ ID NO: 37637 - DNA, 30 bp, Homo sapiens
  misc_feature 1..30: note = chr19:50706864-50706894
  misc_feature 1..30: note = hyper
  source 1..30: mol_type = genomic DNA
ctgtcctggcggacacgcccctctttctcc

SEQ ID NO: 37638 - DNA, 30 bp, Homo sapiens
  misc_feature 1..30: note = chr19:50815293-50815323
  misc_feature 1..30: note = hyper
  source 1..30: mol_type = genomic DNA
agcttctgcattgggcggttcatgcaccca

SEQ ID NO: 37639 - DNA, 271 bp, Homo sapiens
  misc_feature 1..271: note = chr19:50815780-50816051
  misc_feature 1..271: note = hyper
  source 1..271: mol_type = genomic DNA
agagtccctttagctcgctctctccctccccgaatcccacactattgacttgggggatggggtgggaggggaggagaatcacgttttgtagaagtttatcatgattgtggttattttgaaaagctgaactcaaaagctgggtacgtgtggcggactggcgagcagggggagacgttgggaagaggtcagtaccctttggaaaagaccctcaccccctttccccgcctccttcggctttcgtgaaggtcaggggaaacgggggggcttgtta

SEQ ID NO: 37640 - DNA, 53 bp, Homo sapiens; identical to SEQ ID NO: 13470
  misc_feature 1..53: note = chr19:50816431-50816484
  misc_feature 1..53: note = hyper
  source 1..53: mol_type = genomic DNA

SEQ ID NO: 37641 - DNA, 734 bp, Homo sapiens
  misc_feature 1..734: note = chr19:50818424-50819158
  misc_feature 1..734: note = hyper
  source 1..734: mol_type = genomic DNA
agagacacaaaaggacggatgacaagagacagatggacagagatggaccaaggagatggagagagaaagtgaacaaatcggggagtcagtcaacatcgatgagaaagggggagacatcggggaggggggagagactccggattaggaggcaggttggtgcccaccgagcctcccccgccccattcccaccacagtccaccgcccttccccccctccactggtcccctcacctgaggcaaaaggtggggggcagcaaggcgggatggtgggcggcaggggcgtggggaggggctgggtggaatgcatgtgggagcagccagcggagagggcagggaacggtgcggccgccgtagcggggctgggggctgacctagttgtagggaaagagagcaggcagggggtggggtctgcaagggggctgagtggagcgaagctggcagtgcccttggggaatccgatgagaactccaggagcagtgggggggggtggggggggagggaggctcctccagaagattctaaggacggggtcgggggtggggggcggtgaggcggagggctggggagagggacatctttaaagggtccaagaaggctctgagcttctgacgggtgcgggaaggctctcacaggcatctcacagctaatgggactcaagatccagcaacagtgtgtgtggtttctgcaaagcctggggctgcctgcagggttctgcacccccgcagggagctctgt

SEQ ID NO: 37642 - DNA, 84 bp, Homo sapiens
  misc_feature 1..84: note = chr19:50829625-50829709
  misc_feature 1..84: note = hyper
  source 1..84: mol_type = genomic DNA
gggccatgtcccttccgcacctcctcttccccacctccccccatccaaccccaaatctcgccaactcagcgctttctggggacc

SEQ ID NO: 37643 - DNA, 510 bp, Homo sapiens
  misc_feature 1..510: note = chr19:50831498-50832008
  misc_feature 1..510: note = hyper
  source 1..510: mol_type = genomic DNA
cgaagagcgcccacacgcggggctgccagcggcgccaccatgtgccgcccgcgccgcccgcgccccctggcggccccccggcgccgccgcccgcgtcctggaagcagaggcgcttgagctcgccgcccgctccgtccaggccgccgccgcccgcgcccgcctcgtcgtccaggcctccgtcgtgggcgcctgcggcgttggcggcgttggcggcgcccgcggggtcgggcgcctcgaaggagtcgagcgcctcctcagcgtcgcgatgctgccggtaggtcatccagcagcaggcctccacgtcggtctcgtcgatgccccagaagccgagctcctcctcaaacaggggcccgcacacgtcggctgggcagtgcagcttgccggtgcggtagtagttgagcacgtacgcgaagactcccgggtgccggtcaaagaagaactcgtcggcgcccgggtcgtagtcgaagcgtgccgccgcctcgggctccgtcaggccggccagccgcgtcc

SEQ ID NO: 37644 - DNA, 58 bp, Homo sapiens
  misc_feature 1..58: note = chr19:50832951-50833009
  misc_feature 1..58: note = hyper
  source 1..58: mol_type = genomic DNA
tgagactgcatggggcgggaactagagatggaggactttcccgcgcaagggggacagg

SEQ ID NO: 37645 - DNA, 142 bp, Homo sapiens
  misc_feature 1..142: note = chr19:50833828-50833970
  misc_feature 1..142: note = hyper
  source 1..142: mol_type = genomic DNA
taacgaacgctacaccgcggcggactgcagattggaggaccgagggtagatgaggactggtgaggagggggcacgcaaggaggcagagaggacgggagaggggagaggccaaagcgccaggaagcaccgtcaagactgaggc

SEQ ID NO: 37646 - DNA, 35 bp, Homo sapiens; identical to SEQ ID NO: 13473
  misc_feature 1..35: note = chr19:50836356-50836391
  misc_feature 1..35: note = hyper
  source 1..35: mol_type = genomic DNA

SEQ ID NO: 37647 - DNA, 32 bp, Homo sapiens
  misc_feature 1..32: note = chr19:50836392-50836424
  misc_feature 1..32: note = hyper
  source 1..32: mol_type = genomic DNA
ggctgtcttaccgcccccggaccctgagcctt

SEQ ID NO: 37648 - DNA, 66 bp, Homo sapiens
  misc_feature 1..66: note = chr19:50837323-50837389
  misc_feature 1..66: note = hyper
  source 1..66: mol_type = genomic DNA
ccggacaagcagaggcggacgtcaccctgagcaaactgcaaggcgacaaggcggcaactgggtgtc

SEQ ID NO: 37649 - DNA, 30 bp, Homo sapiens
  misc_feature 1..30: note = chr19:51055016-51055046
  misc_feature 1..30: note = hyper
  source 1..30: mol_type = genomic DNA
tggtccctttctccccggctctgtctgtct

SEQ ID NO: 37650 - DNA, 56 bp, Homo sapiens
  misc_feature 1..56: note = chr19:51111640-51111696
  misc_feature 1..56: note = hyper
  source 1..56: mol_type = genomic DNA
tatataattggatgccggaaatttggatcttttctacgtttcgcatttctgtctct

SEQ ID NO: 37651 - DNA, 67 bp, Homo sapiens
  misc_feature 1..67: note = chr19:51142512-51142579
  misc_feature 1..67: note = hyper
  source 1..67: mol_type = genomic DNA
accccctcccacctccgggcccccagctcccgttgagggcttagagactacaattcccggcaggtct

SEQ ID NO: 37652 - DNA, 171 bp, Homo sapiens
  misc_feature 1..171: note = chr19:51142587-51142758
  misc_feature 1..171: note = hyper
  source 1..171: mol_type = genomic DNA
cgctgctgcggcttcatagacccggcgctgcaggatctgctgggagttgaagtccttaatgcctccgggctgcagagaggatgggattttttttttttttttaaggttttggggggttaagatgctggggtcccaagacgcttcaggggaggggaacgatgtccgggactt

SEQ ID NO: 37653 - DNA, 277 bp, Homo sapiens
  misc_feature 1..277: note = chr19:51142834-51143111
  misc_feature 1..277: note = hyper
  source 1..277: mol_type = genomic DNA
cgaggggtgggatacacccaggtgtttcgggacccccttccagggccacgtgcccctcccccggggtggccagagagcgctgcagcgctcccactccccggcccgagatccacgcgcctctgcatctaccccgcccccatgcgccggggccgaccccagggatttgactggggctggggctgtggcaggaggagggggaggagcggactcacccggagccgccgctgccgccgctgccgccgccgccgccgccgcagccccgcgcgccagccgcggt

SEQ ID NO: 37654 - DNA, 30 bp, Homo sapiens; identical to SEQ ID NO: 13478
  misc_feature 1..30: note = chr19:51161225-51161255
  misc_feature 1..30: note = hyper
  source 1..30: mol_type = genomic DNA

SEQ ID NO: 37655 - DNA, 534 bp, Homo sapiens
  misc_feature 1..534: note = chr19:51161720-51162254
  misc_feature 1..534: note = hyper
  source 1..534: mol_type = genomic DNA
gttggaggtaaggtccggtgagatcagagagaaggagggatctcgagtgagtaggggcccgagtttgagtgacccagtagtgaccgggatagaggtctgagcctggaaaggcagctgtgagggggtggaagagactgagcacatagtaggtgtggggccaggggtgatagggtggggacaggcctggagtgcctagggtagagcgcagcctgcagtcgccagtggagggtcgggcctttgggcggtttgagatggagcctcgacagacagtgattaggacgcagaaccaggctaagagagcgtaaggagcctagagcgacccaggcgagagggcagggctggaggggagtttagggacggagcgatggtccgctggaccagggcctgtaaacgactccagggaccaggcagggactcttcgacgatcaaagccagggctgaaacgacctgcgagttccttttccgtccccaccccccttacaggtggctcatcgcggtcacggacttccagacgcgctcgcgcttgctgcgctc

SEQ ID NO: 37656 - DNA, 100 bp, Homo sapiens
  misc_feature 1..100: note = chr19:51162427-51162527
  misc_feature 1..100: note = hyper
  source 1..100: mol_type = genomic DNA
gcaccgccccgcgggctggggccacccacccggagccccggaggacagggggcgttgccttcccaggaaggaggcggggccggctcgagggggtggatac

SEQ ID NO: 37657 - DNA, 49 bp, Homo sapiens
  misc_feature 1..49: note = chr19:51162729-51162778
  misc_feature 1..49: note = hyper
  source 1..49: mol_type = genomic DNA
ggaagacctgggcaccggggctttcagcgcgtgccgagccctgtctcag

SEQ ID NO: 37658 - DNA, 15 bp, Homo sapiens
  misc_feature 1..15: note = chr19:51170723-51170738
  misc_feature 1..15: note = hyper
  source 1..15: mol_type = genomic DNA
cagttttcaaggaac

SEQ ID NO: 37659 - DNA, 164 bp, Homo sapiens
  misc_feature 1..164: note = chr19:51171112-51171276
  misc_feature 1..164: note = hyper
  source 1..164: mol_type = genomic DNA
cgaggactccttcagcgctcgctcgcgggcggccagggccagccccagcggggaggcgggatccagggccttgccggtcagcgggtgcaccaggggtcgcgggggcaggaagctggtgaaggcgctgctgcccccgccacccccgtaggctcggctaccggccc

SEQ ID NO: 37660 - DNA, 291 bp, Homo sapiens
  misc_feature 1..291: note = chr19:51197503-51197794
  misc_feature 1..291: note = hyper
  source 1..291: mol_type = genomic DNA
agccacactgacacacgcaccgtcgcacagtgacacgcagcggaaaaagaggaggggaggggaagccgggggcgggatgcgtgtgtgatggaggggggatgactgtgaatgggagagaggggtatgaatggggggacttgccaacaccgtgaagaggtgtggggatgtggggatcagagggacaggggcctgggatgtaggcggatgcgggtaagccacggtggctccccacagggagggctccggggaatgggggcgctaagggcggcagaaaggcgagtgggctccaaa

SEQ ID NO: 37661 - DNA, 60 bp, Homo sapiens; identical to SEQ ID NO: 13484
  misc_feature 1..60: note = chr19:51198175-51198235
  misc_feature 1..60: note = hyper
  source 1..60: mol_type = genomic DNA

SEQ ID NO: 37662 - DNA, 634 bp, Homo sapiens
  misc_feature 1..634: note = chr19:51198514-51199148
  misc_feature 1..634: note = hyper
  source 1..634: mol_type = genomic DNA
cgggggcgcggggcgcggggtcgggccgcggcggtagcgcgaggaccgcggacggcgccggcttcagcaccgcggacagctccggaggcgggcggcgggcgcgaggcttaaccccttggcgtcctgcgccgggcggcggagggggccgggcaggggggagggggccgggaggggaacgcgggggcccccttggcgggagaagggggaggggcgaggcttggaggggggaggagaaggggaggcacttccggtctgggcccccccttaatccccctcccccctccagagccctcccgcgcaggtgcagagctagagagcgcggggagagggaggcacaacatcacacaagatgcctcgcagccgcgtgcacggacgcgcggacggagccccgcttccccggcagggacaccgcgggtgagagaggccccaggcggggacacgcagcccaccaccacagaccaacacgcaacgcacctcgacacagtcggcaagaaaggccaggacattcagactgggccccaaggccatgagcaacacccctcccccaccagagaagcccaggcggaggggcgaacacaccaccacagctccccgagagagcgtggaccccgagccagcgcggggagggggcggc

SEQ ID NO: 37663 - DNA, 396 bp, Homo sapiens
  misc_feature 1..396: note = chr19:51227602-51227998
  misc_feature 1..396: note = hyper
  source 1..396: mol_type = genomic DNA
ggtcctcaggccccccgctgcatctccaggctccccctccagcatgatccctgtctgtccgcagtgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggtgagtccgcggcgcgcggggtggaaaaaaatgagactatctgggccaggaatgggactggttgagaaggtgaccctaggtgtccggggcgggagagttcgggagagctgctgtgtgctagcggacggggttagagagct

SEQ ID NO: 37664 - DNA, 21 bp, Homo sapiens
  misc_feature 1..21: note = chr19:51228248-51228269
  misc_feature 1..21: note = hyper
  source 1..21: mol_type = genomic DNA
gcctccttctctacccggccc

SEQ ID NO: 37665 - DNA, 271 bp, Homo sapiens; identical to SEQ ID NO: 4679
  misc_feature 1..271: note = chr19:51228368-51228639
  misc_feature 1..271: note = hyper
  source 1..271: mol_type = genomic DNA

SEQ ID NO: 37666 - DNA, 91 bp, Homo sapiens; identical to SEQ ID NO: 4680
  misc_feature 1..91: note = chr19:51228702-51228793
  misc_feature 1..91: note = hyper
  source 1..91: mol_type = genomic DNA

SEQ ID NO: 37667 - DNA, 167 bp, Homo sapiens
  misc_feature 1..167: note = chr19:51281496-51281663
  misc_feature 1..167: note = hyper
  source 1..167: mol_type = genomic DNA
ggtgggtttgagtctcggggagcgcgcgggagctgggcacggccccgtgcttgagaggatctggcattttcctgggcagcctcggcgagagagagtcgtggaaggtgagttaagcctccggattatactctgccaagcagggactaaaaattcgtatccaacagaat

SEQ ID NO: 37668 - DNA, 121 bp, Homo sapiens
  misc_feature 1..121: note = chr19:51412508-51412629
  misc_feature 1..121: note = hyper
  source 1..121: mol_type = genomic DNA
tctggaaacagtgtgcggctgacagcacccactgcggatgcaccaggacgcccgagcagaacaattcgttttccatgaccagtgccgcctgccagggctgcgagtgcgggctgcagtcctc

SEQ ID NO: 37669 - DNA, 354 bp, Homo sapiens
  misc_feature 1..354: note = chr19:51520138-51520492
  misc_feature 1..354: note = hyper
  source 1..354: mol_type = genomic DNA
ctcaaggagaatcagcgggagaggagtgacgggcccagaaatgcggaaaaggaccacaccgccccctggcggccacagcgcaagcccggtctctcctcctgctggaaggacaccggggaccgcacctccagctgtgggagttccgagagaccccgccctgcccgctcctccctggaggccgcctccacagccccccgtggcgtcctcggggatggatctcctcctacttgtttccgcagtgcgcggccgtcagcacccaactctggtccaccaggacacccgcgcagtggaacgagaggccgttgaagagcgagacctgccagggctgcgagccgcgcgcgcacggggagccat

SEQ ID NO: 37670 - DNA, 54 bp, Homo sapiens
  misc_feature 1..54: note = chr19:51522680-51522734
  misc_feature 1..54: note = hyper
  source 1..54: mol_type = genomic DNA
tttccccctccttcacgcgcggggtggggatccgaggctcggagccagtgggag

SEQ ID NO: 37671 - DNA, 132 bp, Homo sapiens
  misc_feature 1..132: note = chr19:51568572-51568704
  misc_feature 1..132: note = hyper
  source 1..132: mol_type = genomic DNA
ctcaccccaggaagccgtccctcctcccctgccctctggcgagctgggtggtcggtgcactctcgcccttttcctccagagtctgccttccattctacccctctgggtctgtccacacgcttggtattagcc

SEQ ID NO: 37672 - DNA, 30 bp, Homo sapiens
  misc_feature 1..30: note = chr19:51814766-51814796
  misc_feature 1..30: note = hyper
  source 1..30: mol_type = genomic DNA
tggggacgcctggggcgggaggggtagggg

SEQ ID NO: 37673 - DNA, 172 bp, Homo sapiens
  misc_feature 1..172: note = chr19:51815103-51815275
  misc_feature 1..172: note = hyper
  source 1..172: mol_type = genomic DNA
gcccccccctgcgcccggggcccggctccggcttctcgccgccgccgccctggccggcttggccgtcatcagccgaggtaccgcagcgccgggggcggggggctcggccgggacgccagggtcttgggtgggtaatcgggggatcaggggtgggggtcgagggctgcatccc

SEQ ID NO: 37674 - DNA, 135 bp, Homo sapiens
  misc_feature 1..135: note = chr19:51830260-51830395
  misc_feature 1..135: note = hyper
  source 1..135: mol_type = genomic DNA
ggcgggggctgggggcgggaccccttcgtccccacgcggctaggagaattcgctgacccttgcccctcgccagatcctccgaccatcacggacgtgaccagcgcccgcaccgcgctgggccgggccgccctcctg

SEQ ID NO: 37675 - DNA, 182 bp, Homo sapiens
  misc_feature 1..182: note = chr19:51830821-51831003
  misc_feature 1..182: note = hyper
  source 1..182: mol_type = genomic DNA
gcggtgggagtgacccgaggtacatgaggtgctagaacccgaggcgatgggtcactggggtagggggcagaatgctgggtcaccggggaacggaggagcctgagagtcggggggctggcctggctgggcgctgcggcccggcccctgacccggatccctggcaggctgagcagcggcacggc

SEQ ID NO: 37676 - DNA, 270 bp, Homo sapiens; identical to SEQ ID NO: 1395
  misc_feature 1..270: note = chr19:51831120-51831390
  misc_feature 1..270: note = hyper
  source 1..270: mol_type = genomic DNA

SEQ ID NO: 37677 - DNA, 85 bp, Homo sapiens
  misc_feature 1..85: note = chr19:52074277-52074362
  misc_feature 1..85: note = hyper
  source 1..85: mol_type = genomic DNA
ttgtccttggctgtacggaataaaagccctttgacgatggcggcctccaatatcataatccgtatgggtgcggccatgccgtcct

SEQ ID NO: 37678 - DNA, 30 bp, Homo sapiens
  misc_feature 1..30: note = chr19:52097396-52097426
  misc_feature 1..30: note = hyper
  source 1..30: mol_type = genomic DNA
cccatggctgcagggcgcgccgaagagccc

SEQ ID NO: 37679 - DNA, 60 bp, Homo sapiens
  misc_feature 1..60: note = chr19:52205780-52205840
  misc_feature 1..60: note = hyper
  source 1..60: mol_type = genomic DNA
ctcggagcaatgcttcgggccttgtaacattagctaggggagcatcgggcaagggttctt

SEQ ID NO: 37680 - DNA, 450 bp, Homo sapiens
  misc_feature 1..450: note = chr19:52207294-52207744
  misc_feature 1..450: note = hyper
  source 1..450: mol_type = genomic DNA
gacttgtcctatttccgagatatgccgcgggccgaaggatacctggcgcggatccggccggctcagctcacgcaccgcgggacgttctcctgcgtgatcaagcaagaccagcgccccctggcccggctctacttctttcttaacggtggggcggggcgcggccgcgtgagtgagcggggtcgggagaggggtggggctcgtgcctggctgacgtgcgcgcccccgcagtgacgggcccgcccccgcgggcggagacagagttgcaggcctcgttccgggaagtgctgcgctgggcgccgcgggatgccgagctgatcgagccctggaggcccagcctgggcgagctgctggccaggcccgaggctctgacgcccagcaatctgttcctgcttgcagtcctcggggccctcgcatcagcgagtgcgacagtgttggcgtggtgagttctgg

SEQ ID NO: 37681 - DNA, 494 bp, Homo sapiens
  misc_feature 1..494: note = chr19:52222430-52222924
  misc_feature 1..494: note = hyper
  source 1..494: mol_type = genomic DNA
cgagtgggctgaaggcgcctctactcacctgcacgtagtccaccgaatctccgagcgccttgaaggctgtgtacatgacctcgcgcttgccgccccagcgctgcgccacgcacacgcacctgcgagtcctcaccagcgcctccactgccagccgcccaggatcctccgcctccacctcccgataggctccggcgcccaccgcgcccgccgccgcgggttcccagggctggtggtagttgccgtcccacacgtacgtggcggggtcctcgtcagcgaagacctcgcggaacatgtcgaccatgtagaggtcctcggcgcggttgccatccaccaccatgaggacgcgcagccgcgcgcgcgggtacagcagggcgcgggcggacgccaggcactggcgcaggtacgcggggtcctcctggtaggcggagatggtcagcgccacactgcgcgcggtggctgcatccagcggcccccgcgccgccgccgccacccgc

SEQ ID NO: 37682 - DNA, 17 bp, Homo sapiens
  misc_feature 1..17: note = chr19:52223142-52223159
  misc_feature 1..17: note = hyper
  source 1..17: mol_type = genomic DNA
cgcgtcctgctgggagc

SEQ ID NO: 37683 - DNA, 214 bp, Homo sapiens
  misc_feature 1..214: note = chr19:52408028-52408242
  misc_feature 1..214: note = hyper
  source 1..214: mol_type = genomic DNA
acaagaactctcccacgccggaccgcaaaggcaccccaacccaaaggctccaccgcccaggccgccagctctccccacaggctcctcagaagctccctacccctttaacctactccacggagagacccaaacactcacctgattttcttctggctacacctaaattccctgaatgcttcctttcctggcccttaaaccccggcactggcctatg

SEQ ID NO: 37684 - DNA, 30 bp, Homo sapiens
  misc_feature 1..30: note = chr19:52430054-52430084
  misc_feature 1..30: note = hyper
  source 1..30: mol_type = genomic DNA
attggattccttttccggttggctggtggc

SEQ ID NO: 37685 - DNA, 76 bp, Homo sapiens
  misc_feature 1..76: note = chr19:52511308-52511384
  misc_feature 1..76: note = hyper
  source 1..76: mol_type = genomic DNA
catcaccactgtccacgaacacgcccagccacggacagaatttcctcccccgtcaccacagcgaccacccagtgac

SEQ ID NO: 37686 - DNA, 434 bp, Homo sapiens
  misc_feature 1..434: note = chr19:52531450-52531884
  misc_feature 1..434: note = hyper
  source 1..434: mol_type = genomic DNA
cacagacccacaggccgcgagtccatgcccagaactcgactcacccgagcccgaacctctccagacaccactggcagcgacaaaacgccgcatccacgtccgaaaacgcttcctattcagacgcgctcctgcgcggactccgggaagctgagcggtaaagaccgtgaagcgaggcgaggaccacggagcctgcccgggatcgcgagttcagactgcgggcgccgctctatgaggtcacagggctgcgcccatcgcagcgtttctgacaggagcggccataatggctgtgggaatcactcttagtcacctcagtgcctttctctcttcgttgcaagggacactcaagagtcgggtgcccagccaaggccaacacggcgcagtggcattctattcagcctgctgtggaaaaaagatggcggcgccctttgtgccca

SEQ ID NO: 37687 - DNA, 89 bp, Homo sapiens
  misc_feature 1..89: note = chr19:52800826-52800915
  misc_feature 1..89: note = hyper
  source 1..89: mol_type = genomic DNA
ggccctggagcacagcgctccaatctcaatccaggagaagccgcgtcttctgcccagtgctgggattctgcagacgccacccatctctt

SEQ ID NO: 37688 - DNA, 93 bp, Homo sapiens
  misc_feature 1..93: note = chr19:52839463-52839556
  misc_feature 1..93: note = hyper
  source 1..93: mol_type = genomic DNA
ccgctctctatgctgcgcgcgcgcagttttttgcagacccggaagcggatcgcgtgggtagaaggtcacaccgcagcgcgtcagtttcccttt

SEQ ID NO: 37689 - DNA, 46 bp, Homo sapiens
  misc_feature 1..46: note = chr19:52839996-52840042
  misc_feature 1..46: note = hyper
  source 1..46: mol_type = genomic DNA
ttttcctccttgatccgggccttcctactccccaggcctccccttc

SEQ ID NO: 37690 - DNA, 38 bp, Homo sapiens
  misc_feature 1..38: note = chr19:52840043-52840081
  misc_feature 1..38: note = hyper
  source 1..38: mol_type = genomic DNA
cagccatcgctactcccgacccccgggtgtggggacgt

SEQ ID NO: 37691 - DNA, 29 bp, Homo sapiens
  misc_feature 1..29: note = chr19:52872845-52872874
  misc_feature 1..29: note = hyper
  source 1..29: mol_type = genomic DNA
tgcagcgcacgacctcggctcactgcagc

SEQ ID NO: 37692 - DNA, 172 bp, Homo sapiens
  misc_feature 1..172: note = chr19:52872934-52873106
  misc_feature 1..172: note = hyper
  source 1..172: mol_type = genomic DNA
gcgagcgcccctacagccgatttaaaattaattttaatagcaggaattttcctggatctaatcatcaacaaactttccctctgccgggacacaatctatttccagatagctgagttcttccagtctccacggcaggtctagcctccaaaacgagacgagctgggagcgaggc

SEQ ID NO: 37693 - DNA, 427 bp, Homo sapiens
  misc_feature 1..427: note = chr19:52873107-52873534
  misc_feature 1..427: note = hyper
  source 1..427: mol_type = genomic DNA
gagggaagcgcaggctccgcccaatcccacccgggcctggcctcgcctcgcctctcagctgcgcgcgcagtttcctggagacccggaagcagattacgtggagtgacggtcatgctgcggcgtgtgagtttccctttgtttagattaaatctgggatgctgagtcccctcgcgcttctgtacccggcatctcaggggtcacacagaccttgaaatccccgcatcgctccctccaccccgactaaactcagacgttctaatgagagtctggcggtcgcttccctgagtgttaaaatcgctcggaggctggtcctgtccccggtctttcaccacagggccatgtagacagctcctgtcgcggagtttgcctgcttcaaatccttcagtgacccctagacacggcccgcgctgcgtaaagttctcacccg

SEQ ID NO: 37694 - DNA, 89 bp, Homo sapiens
  misc_feature 1..89: note = chr19:52900885-52900974
  misc_feature 1..89: note = hyper
  source 1..89: mol_type = genomic DNA
gatataatctacaaccgattttgctctgcgcaggtaagatccgttttcagaccaaaaccctgaaaacaagcgcagccagtcaagcgaac

SEQ ID NO: 37695 - DNA, 69 bp, Homo sapiens
  misc_feature 1..69: note = chr19:52900975-52901044
  misc_feature 1..69: note = hyper
  source 1..69: mol_type = genomic DNA
gaagcgcaggcccggcccaggctttgtcccggcccgccctggtcccagccagtccggcctctaggatgc

SEQ ID NO: 37696 - DNA, 266 bp, Homo sapiens
  misc_feature 1..266: note = chr19:52956606-52956872
  misc_feature 1..266: note = hyper
  source 1..266: mol_type = genomic DNA
ttggctgctggtcaccgatagggtctttcctcaaaaacctggagaacagacgcgcccagagacaggccgaaggcagcgcagaccccgcccctcaccgccccaccctctcttctctcgggtctcgcccatccctggcctcagctgcgcgcggtttcctggaaacccggaagtgaatcatggggcgtgaactcgcaagcgcagtttcctgaagacccggaagccgatcgcgtggggagccggtcttggagcagcgggtgagtttccct

SEQ ID NO: 37697 - skipped

SEQ ID NO: 37698 - DNA, 33 bp, Homo sapiens
  misc_feature 1..33: note = chr19:53031314-53031347
  misc_feature 1..33: note = hyper
  source 1..33: mol_type = genomic DNA
gcccctggagcgtcgcgccgcagccccagtccc

SEQ ID NO: 37699 - DNA, 91 bp, Homo sapiens
  misc_feature 1..91: note = chr19:53073313-53073404
  misc_feature 1..91: note = hyper
  source 1..91: mol_type = genomic DNA
cgtgcttcagccttcctgaccgctctcgcctccaaagcccgaaaaatagagtcgctgggagcgaggctgagagacgcacaggtcccgcccc

SEQ ID NO: 37700 - DNA, 368 bp, Homo sapiens
  misc_feature 1..368: note = chr19:53073405-53073773
  misc_feature 1..368: note = hyper
  source 1..368: mol_type = genomic DNA
gccccgccctctgccggttctaaagggcaaggtctctccgcctggggccccgcctctacctcgatcaggccccgcccaccttctcgttggctccacccaggcctggctttagtcctgtgcgcacacatccgcgcagaccaggaagcggatcccgtggagtgaaggtcgcaccgcggcggtgagttttgctctgtgttgtattaagtctgcactccccatatccccggcacttccgtacctgggacgtggggtcaccacagacctgtaaattctcgcccatcttccttcaaccagagcaaatgcagacgttcccctgggaatccggaagtcgcttccttttgtgtttaaagtcgccctgaggctgttcc

SEQ ID NO: 37701 - DNA, 46 bp, Homo sapiens; identical to SEQ ID NO: 4684
  misc_feature 1..46: note = chr19:53073819-53073865
  misc_feature 1..46: note = hyper
  source 1..46: mol_type = genomic DNA

SEQ ID NO: 37702 - DNA, 172 bp, Homo sapiens; identical to SEQ ID NO: 4685
  misc_feature 1..172: note = chr19:53073866-53074038
  misc_feature 1..172: note = hyper
  source 1..172: mol_type = genomic DNA

SEQ ID NO: 37703 - DNA, 38 bp, Homo sapiens
  misc_feature 1..38: note = chr19:53104584-53104622
  misc_feature 1..38: note = hyper
  source 1..38: mol_type = genomic DNA
ggagtgaaggtcccacggcagcgcgtgagtttctctct

SEQ ID NO: 37704 - DNA, 58 bp, Homo sapiens
  misc_feature 1..58: note = chr19:53104953-53105011
  misc_feature 1..58: note = hyper
  source 1..58: mol_type = genomic DNA
gcccctcgagtgcagcgccgtgcccccagtcccgcggaggctgcgtcctctgcctggt

SEQ ID NO: 37705 - DNA, 280 bp, Homo sapiens
  misc_feature 1..280: note = chr19:53141079-53141359
  misc_feature 1..280: note = hyper
  source 1..280: mol_type = genomic DNA
tggagcagcagggcccgccacgaggagggaggtgggggggagacggcgccttaagacaaggttggggtctgcaggattccaggaccaggcaaagtacgcggcctccctgggactggggccctggcgctgcgctccagtggcctacgaaggcgagggtgggaggcgcccagggcgggaatccagctctcgggtgaggactttaaaaagcgaggggcgggaggagtcagaaaacagttttgagcaggaaaactacgcgacaggaagtgtatacatcgcccta

SEQ ID NO: 37706 - DNA, 200 bp, Homo sapiens
  misc_feature 1..200: note = chr19:53141419-53141619
  misc_feature 1..200: note = hyper
  source 1..200: mol_type = genomic DNA
atccggactctcatggggacgtctcaatttgtcctgggtgaaggaagaagggagagaatttccaggtctgtggggaccccacgtctcaggtacagcagcgccggggacctggtaagcgcagacttaatagaagagcgaaactcaccgccacggtgtaactttcactccacataatccgcttccgggtttgcgcgcatgtg

SEQ ID NO: 37707 - DNA, 216 bp, Homo sapiens
  misc_feature 1..216: note = chr19:53193364-53193580
  misc_feature 1..216: note = hyper
  source 1..216: mol_type = genomic DNA
ggcgggaatccacttcgcgggtgaggacgttaaaaagcgcggggcgggaggagtctgaaaatgattttgagaaaaaaaaaaaaaaaacaacaacaactacgcgataggaagtgtatacattgccctagagcagaaagacaggggatgggaccaacctcagggcgactttagacccaaaaggaagcgacttccagactctcacggggatgtctctat

SEQ ID NO: 37708 - DNA, 30 bp, Homo sapiens
  misc_feature 1..30: note = chr19:53193928-53193958
  misc_feature 1..30: note = hyper
  source 1..30: mol_type = genomic DNA
tttgggaggcgacagcggccaggaagtatg

SEQ ID NO: 37709 - DNA, 161 bp, Homo sapiens
  misc_feature 1..161: note = chr19:53194235-53194396
  misc_feature 1..161: note = hyper
  source 1..161: mol_type = genomic DNA
gtgcaggcgcgaaggcgggagcctgaggtcccagctactcaggaagtaggagcaggaagatcgctgagccctggggtccaggccagcctgggcgacaaagtaacaccccctcccgcaaggccaccttccttgtctccctctctctccgtctctctctctct

SEQ ID NO: 37710 - DNA, 111 bp, Homo sapiens
  misc_feature 1..111: note = chr19:53361072-53361183
  misc_feature 1..111: note = hyper
  source 1..111: mol_type = genomic DNA
ccccaggaaggcagacggataattcaaaagccctggaatagtctggaaggaggatgcaaactagaatgtaaaatgcaaagccctttctgggcggaacgtaggatttcatgc

SEQ ID NO: 37711 - DNA, 403 bp, Homo sapiens
  misc_feature 1..403: note = chr19:53400389-53400792
  misc_feature 1..403: note = hyper
  source 1..403: mol_type = genomic DNA
ttgattgcatatattcgttttccaggagttggaactaggtagcaacaccgcacaaggagggaggtggggagcgacggagccttcggacaggggtggcgtctgcaggatcttaggaccaggcagaggacgcggcctcccgggaaccggggttgaggcgcggcgctcctgaagccgccgagagcgacggtgggaggcgcctagggctggaatccagctcgcgggtgaggacttgaaacagcgcgaggcgggaggacaggtcaggaagggttttgagaaggaaaattccgcgataggaggtgtctgcacgaccccactgcagaaagaccgaggacgggacctgcctcagggccactttaaactcgaagggactcacggactctcacccggacgtctcaatttgctc

SEQ ID NO: 37712 - DNA, 80 bp, Homo sapiens
  misc_feature 1..80: note = chr19:53426559-53426639
  misc_feature 1..80: note = hyper
  source 1..80: mol_type = genomic DNA
caggtacagaattgccggggacctggaggcacagcctcaatacaacacagagcaaaactcaccgccgcagtgtgacttcc

SEQ ID NO: 37713 - DNA, 36 bp, Homo sapiens
  misc_feature 1..36: note = chr19:53466073-53466109
  misc_feature 1..36: note = hyper
  source 1..36: mol_type = genomic DNA
actaggaaacgcacacgccgccgtgcaactttcagt

SEQ ID NO: 37714 - DNA, 187 bp, Homo sapiens
  misc_feature 1..187: note = chr19:53496179-53496366
  misc_feature 1..187: note = hyper
  source 1..187: mol_type = genomic DNA
ctgcgctccagggaccgacgagggtgagggtgggaggcgcccagggtgggaatccacctctcgggtgaggactttaaaaagcacggggtggagggagtcagaaaatagttacaaacaggaaaactacgagatacgaagtgtatacgttgccctatagcagaaagaccggggacgggtctagcctcag

SEQ ID NO: 37715 - DNA, 139 bp, Homo sapiens
  misc_feature 1..139: note = chr19:53496648-53496787
  misc_feature 1..139: note = hyper
  source 1..139: mol_type = genomic DNA
tatgtggggaccccacgtcccctgggacagaagtcccagggacctgcggagcgcagacataacacaacacagagcaaaactcaccgctgcggtgactttcactccacgcgatccgcttcccggtttacgctaaactggg

SEQ ID NO: 37716 - DNA, 15 bp, Homo sapiens
  misc_feature 1..15: note = chr19:53496813-53496828
  misc_feature 1..15: note = hyper
  source 1..15: mol_type = genomic DNA
cgggacatggcaggg

SEQ ID NO: 37717 - DNA, 135 bp, Homo sapiens
  misc_feature 1..135: note = chr19:53497254-53497389
  misc_feature 1..135: note = hyper
  source 1..135: mol_type = genomic DNA
cttccctagagccaccgcctgggatgcgggatggagtgctcaggccagggaggagtgaggtcaccacctgctggttaaacacagcagagatgcgggcgcacaagggggcgtgggagggcgcggggtgggatcctg

SEQ ID NO: 37718 - DNA, 304 bp, Homo sapiens
  misc_feature 1..304: note = chr19:53561495-53561799
  misc_feature 1..304: note = hyper
  source 1..304: mol_type = genomic DNA
tatgcgggaagaagacgcgaatggcaggggacagggactggtctcagagcgagttttacccacatggcgaggtccgtatttacctcgggtgaagggcgcgatgcggggattttaaggtcagcagagcgggtgtggaaaagcgggacggcgaatcgaaggcttaatctacacctaggcacactcttgctcggcggtgtcaccttcacacaccgcgatccgcttccgggactccaagaaactgcacgtgcgcgcagagcccgggtagcctggggcggagcccggggagaggcggggtctgcagagg

SEQ ID NO: 37719 - DNA, 103 bp, Homo sapiens; identical to SEQ ID NO: 13514
  misc_feature 1..103: note = chr19:53635501-53635604
  misc_feature 1..103: note = hyper
  source 1..103: mol_type = genomic DNA

SEQ ID NO: 37720 - DNA, 75 bp, Homo sapiens
  misc_feature 1..75: note = chr19:53635885-53635960
  misc_feature 1..75: note = hyper
  source 1..75: mol_type = genomic DNA
ggaaaaggttttaagcgggaggaagaagcaaaaggccggggacggggagcagcctcaaagcgacttcaacccaaa

SEQ ID NO: 37721 - DNA, 420 bp, Homo sapiens
  misc_feature 1..420: note = chr19:53661466-53661886
  misc_feature 1..420: note = hyper
  source 1..420: mol_type = genomic DNA
gactgcgaaggggaggcctggggagcagcagggcccggcacgaggaggagggaggtggcggggcgacggcgccttagaagaggggtggggtctgcaggatgccaggaccaggcagaggacgcggcctcgccggtaccggggctgaggagctgcgctccaggggccgacgagggcgaggctgggaggcacccagggcgggaatccacctcgcgggcgaggactttaaaaagcccggggcgggaggaggggtcaggaaagggttttaagcgggaggaagacgcgaaaggccggggacagggagaagcctcagagctacttcaacccaaagagaagcgactccgaacccacaccgcgagtcagctggggtggagggcgcggtgcggggatcttaaggtctgtagctgccgggcgcagtggctc

SEQ ID NO: 37722 - DNA, 318 bp, Homo sapiens
  misc_feature 1..318: note = chr19:53662186-53662504
  misc_feature 1..318: note = hyper
  source 1..318: mol_type = genomic DNA
tagcgagcccgggaactggctgcggaaacggggcacggcggttcgcaagtttaatccatactgagggacactcacgctcggcggcgtcacccgcacccaacacgatccgcttccggaactgcagaaaactgcgcgtgcgcggaaaagagcccgggcactctgggggcggggcctggggagaggcggggtctgcggacgaaacgctggggcggagctggggcggggtctgcgcttccctcagcctgcctagcccgcagtctcatttttcccggtttagaaacgctggagtgttcactatgtccccgggagcaccgttcc

SEQ ID NO: 37723 - DNA, 482 bp, Homo sapiens; identical to SEQ ID NO: 4686
  misc_feature 1..482: note = chr19:53696167-53696649
  misc_feature 1..482: note = hyper
  source 1..482: mol_type = genomic DNA

SEQ ID NO: 37724 - DNA, 13 bp, Homo sapiens
  misc_feature 1..13: note = chr19:53696650-53696663
  misc_feature 1..13: note = hyper
  source 1..13: mol_type = genomic DNA
gtggggaaaggcc

SEQ ID NO: 37725 - DNA, 100 bp, Homo sapiens
  misc_feature 1..100: note = chr19:53700343-53700443
  misc_feature 1..100: note = hyper
  source 1..100: mol_type = genomic DNA
ggttttctgtagacccggaagcggatcgcggggagtgaaggctgcgccgccgagcctgagtttcgctctctctagattaaatctgcgcttcgcagtcccc

SEQ ID NO: 37726 - DNA, 31 bp, Homo sapiens; identical to SEQ ID NO: 13520
  misc_feature 1..31: note = chr19:53700646-53700677
  misc_feature 1..31: note = hyper
  source 1..31: mol_type = genomic DNA

SEQ ID NO: 37727 - DNA, 30 bp, Homo sapiens; identical to SEQ ID NO: 13521
  misc_feature 1..30: note = chr19:53757742-53757772
  misc_feature 1..30: note = hyper
  source 1..30: mol_type = genomic DNA

SEQ ID NO: 37728 - DNA, 73 bp, Homo sapiens
  misc_feature 1..73: note = chr19:53758105-53758178
  misc_feature 1..73: note = hyper
  source 1..73: mol_type = genomic DNA
cgcgagatccgcttccgggtcggcaggaacctgcgcgtacgcgagtgcactggggcggcgcaaggggcaaggg

SEQ ID NO: 37729 - DNA, 32 bp, Homo sapiens
  misc_feature 1..32: note = chr19:53868692-53868724
  misc_feature 1..32: note = hyper
  source 1..32: mol_type = genomic DNA
attctactttgcatccgcgtttcagacaattc

SEQ ID NO: 37730 - DNA, 214 bp, Homo sapiens
  misc_feature 1..214: note = chr19:53868957-53869171
  misc_feature 1..214: note = hyper
  source 1..214: mol_type = genomic DNA
agacgcgcgcaaacccggaagcagatcgcgtggagtgaaggtccctcagcggcgcgtgagtttcgctccatcttgtatgaagtctgctcttcccaggtccccggcgcttctgtccctgggacgtggggtccctacagacctggaaattctcacccgtcttccttcgcccagagcaaattgagacgtccccgtgagagcccgggggtcacttcct

SEQ ID NO: 37731 - DNA, 70 bp, Homo sapiens
  misc_feature 1..70: note = chr19:53966826-53966896
  misc_feature 1..70: note = hyper
  source 1..70: mol_type = genomic DNA
ctgggccgtggatgtcgcctgctctcatcctcttgccctccaggactgggtcctccgggttctgattggt

SEQ ID NO: 37732 - DNA, 28 bp, Homo sapiens
  misc_feature 1..28: note = chr19:53970370-53970398
  misc_feature 1..28: note = hyper
  source 1..28: mol_type = genomic DNA
agacgaggaaggaagcgctgcgggaggg

SEQ ID NO: 37733 - DNA, 180 bp, Homo sapiens
  misc_feature 1..180: note = chr19:53970458-53970638
  misc_feature 1..180: note = hyper
  source 1..180: mol_type = genomic DNA
gcttcctgagtagctgggacctcaggctcctgcccccgcgcgcgcatccctcccaccccggcgccccatccagcaggtggtcacctcactcctccctggcctgagcactccgtcccgcatccatggcggtggctttagggaaatctctgaagttgagcacggggtggacttgccctcctg

SEQ ID NO: 37734 - DNA, 282 bp, Homo sapiens
  misc_feature 1..282: note = chr19:53970758-53971040
  misc_feature 1..282: note = hyper
  source 1..282: mol_type = genomic DNA
cagacaattccagggcttttgaatagtgcctcaaccttactggccggtctcgactccaaaaccctaaaacaggcgctggagcgagggtgacggactcacaggtcccaccccggccccgccctctgcgccttccaaagggcaaagtctctccgcctctcgccccgcccctgcttcgtcaggccccgcccacctcccaggtcccgcccaggcctggcttctgtcctgcgcgcagattcgcgaaaacccggaagcggatcgcgtggagtgacggtcccacggcag

SEQ ID NO: 37735 - DNA, 336 bp, Homo sapiens
  misc_feature 1..336: note = chr19:53971109-53971445
  misc_feature 1..336: note = hyper
  source 1..336: mol_type = genomic DNA
cgtggggtccccacaaacctggaaattctcagccgtcttccttcacccagagcaaattgagacgaccccgtgagagtccgggggtcgcttccttttgtgtttaaggtcgccctgaggctggtcccgtcccgggtctttctgctatagggcaatgtatacactttctatcgcgcatttttcctgctctaaacctttctctgactcctcccaccccgcgctttttgaagtcctcacccaaggggtggattctcgcccacttcggccggtggagcgcagaaccgcggccccagtcccgggaaggccgcgtcctctgtctggtcccgggatcctgcagac

SEQ ID NO: 37736 - DNA, 562 bp, Homo sapiens
  misc_feature 1..562: note = chr19:54024000-54024562
  misc_feature 1..562: note = hyper
  source 1..562: mol_type = genomic DNA
cccttccagatacgtcgattcccgggttatgagctacatttcccagaagccctcaaggcaggacgcccttagggtcgcgtagagttgcatgctgggaaatcctgacagccgcttccaactctgtggatttccgggttatggactacatttcccagaggcctctgggtcacggctccatttgcgccgtgtagagttgcatgctgggaaacactgacgggcgcccttccagctgcgtcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgag

SEQ ID NO: 37737 - DNA, 262 bp, Homo sapiens
  misc_feature 1..262: note = chr19:54024622-54024884
  misc_feature 1..262: note = hyper
  source 1..262: mol_type = genomic DNA
ccagaggctgcctggtggggccccgccgtggcccagtgactgagataattgtcttcgtctgtggggtaatgcgaacaagccccgttcccctaagccgtgatgcatgcggggttgacgcggccgggctctgtccccataaactgtgacacaggtgtgtgtagacgtctatgagggccatagcgccgggctgtaagggcatctgtaggggtgacgcagccgggctgtgtctctgcacctccgttctgtgcgaggtcaatgctgg

SEQ ID NO: 37738 - DNA, 30 bp, Homo sapiens
  misc_feature 1..30: note = chr19:54371989-54372019
  misc_feature 1..30: note = hyper
  source 1..30: mol_type = genomic DNA
cgctgcgaggaatcccggaggggtgtttcc

SEQ ID NO: 37739 - DNA, 30 bp, Homo sapiens
  misc_feature 1..30: note = chr19:54382737-54382767
  misc_feature 1..30: note = hyper
  source 1..30: mol_type = genomic DNA
gctggtccgcaggctcggactaccagtccc

SEQ ID NO: 37740 - DNA, 413 bp, Homo sapiens
  misc_feature 1..413: note = chr19:54409951-54410364
  misc_feature 1..413: note = hyper
  source 1..413: mol_type = genomic DNA
ctcccacagtgtggccgcagcggcgagaactttgacaagttcttcacgcgggcggcgccagcgctgacccctccagaccgcctagtcctggccagcatcgaccaggccgatttccagggcttcacctacgtgaaccccgacttcgtgcacccggatgcccgcagccccaccagcccagtgcctgtgcccgtcatgtaatctcacccgccgccactaggtgtccccaacgtcccctccgccgtgccggcggcagccccacttcacccccaacttcaccaccccctgtcccattctagatcctgcaccccagcattccagctctgcccccgcgggttctagacgcccctcccaagcgttcctggccttctgaactccatacagcctctacagccgtcccgcgttcaagacttgag

SEQ ID NO: 37741 - DNA, 30 bp, Homo sapiens
  misc_feature 1..30: note = chr19:54411138-54411168
  misc_feature 1..30: note = hyper
  source 1..30: mol_type = genomic DNA
agcgagagaggggcacggagatcactgaga

SEQ ID NO: 37742 - DNA, 155 bp, Homo sapiens
  misc_feature 1..155: note = chr19:54411454-54411609
  misc_feature 1..155: note = hyper
  source 1..155: mol_type = genomic DNA
gagtctggggagtgccggggaccgtgcagatggactacatttccccgcaggcctcgcggcagacccttcccccaagtgcggctccttgccgccagggctgatgggaaatgtagtctccggtcagggccagaccagtggagcggtgtgccttgtct

SEQ ID NO: 37743 - DNA, 91 bp, Homo sapiens
  misc_feature 1..91: note = chr19:54412658-54412749
  misc_feature 1..91: note = hyper
  source 1..91: mol_type = genomic DNA
gggcgcgggcaccggcgaccccggtggcggcggcggcggccgggggaagcctcggggccggtcatgcggctgcggggcccgcggcccggag

SEQ ID NO: 37744 - DNA, 184 bp, Homo sapiens
  misc_feature 1..184: note = chr19:54412808-54412992
  misc_feature 1..184: note = hyper
  source 1..184: mol_type = genomic DNA
cgcccctcgaggtggctgcgagccgggtttggggcaacaagggacccgagtggctccaggggtggtgagatcctggcggtcgggacgcccgaattcgagcggctatgggggatgcagggacacctgggcctggcgatcccggaggacggggtccgagggtcccggagtgggaaactgcactcct

SEQ ID NO: 37745 - DNA, 143 bp, Homo sapiens
  misc_feature 1..143: note = chr19:54413008-54413151
  misc_feature 1..143: note = hyper
  source 1..143: mol_type = genomic DNA
cgagcgtgggctggggagggcagaggccgggtccctgaggaaggcgaggtacggggcgagggcggaggacccaggcccggccagagcaggatgtgggtctggaaaggggtcccagaaagggggagttacggtctcccgagaga

SEQ ID NO: 37746 - DNA, 125 bp, Homo sapiens
  misc_feature 1..125: note = chr19:54413467-54413592
  misc_feature 1..125: note = hyper
  source 1..125: mol_type = genomic DNA
cagggtgatggtgcccgtttccgagcccacagggctgcgaggggaccaggcagctcgcggtcaaacccctgagccgccaggcgggggatgggaggaaaagctggccagagcgttccctgactccg

SEQ ID NO: 37747 - DNA, 44 bp, Homo sapiens
  misc_feature 1..44: note = chr19:54445558-54445602
  misc_feature 1..44: note = hyper
  source 1..44: mol_type = genomic DNA
cggagctccccctgcctcctcctcctcctcgtcttaggggggtc

SEQ ID NO: 37748 - DNA, 30 bp, Homo sapiens; identical to SEQ ID NO: 13533
  misc_feature 1..30: note = chr19:54463032-54463062
  misc_feature 1..30: note = hyper
  source 1..30: mol_type = genomic DNA

SEQ ID NO: 37749 - DNA, 203 bp, Homo sapiens
  misc_feature 1..203: note = chr19:54465531-54465734
  misc_feature 1..203: note = hyper
  source 1..203: mol_type = genomic DNA
gggtggcttcccatgcgatgaggatcgtggagccccctggggcggaggcggcgcgggctaggggcgagggctgtgagtgtgagcggtggtggggactcctccgagtggggttagtgggatggtgggacgactttcttgggcagaagacaggagtggagagagatttcatcttatttattaattattagcggtggtggggactc

SEQ ID NO: 37750 - DNA, 427 bp, Homo sapiens
  misc_feature 1..427: note = chr19:54466163-54466590
  misc_feature 1..427: note = hyper
  source 1..427: mol_type = genomic DNA
tcttctcctctaatgcgagatctcgctccttgccctccaccagccgccgaccatggccgcgctctgaccccctccccggccgcagcctcctcctcgccgcccccctccccagccccgccggccccgggccccccgcttctgcctgcgctgtgaacccccccccagccgccggcacggccccgcccccgctgccccggtggtggcccacggccccccggctgcccgtggtcaaactggagtcgctgaagcgctggaacgaagagcggggcctctggtgcgagaagggggtgcaggtgctgctgacgacggtgggcgccttcgccgccttcggcctcatgaccatcgccatcagcactgactactggctctacacgcgcgccctcatctgcaacaccaccaacctcacggccggcggcgacgacgggac

SEQ ID NO: 37751 - DNA, 102 bp, Homo sapiens
  misc_feature 1..102: note = chr19:54481331-54481433
  misc_feature 1..102: note = hyper
  source 1..102: mol_type = genomic DNA
tcagtggggttgccccgcccccaaccctgaagtatccgcccccaccactgccctccccgctcctccagggttgaaaagaggcgtctgcgtgaagatcaatca

SEQ ID NO: 37752 - DNA, 217 bp, Homo sapiens
  misc_feature 1..217: note = chr19:54481751-54481968
  misc_feature 1..217: note = hyper
  source 1..217: mol_type = genomic DNA
gcggcgactctgcgccgtgactggttgtggaatcccggactgggattggccaccgcgccgcagagctgtggggcaatctgcggcggtgacgggccactactgggagccggctgggaaagcctgtattgccattggtagctaccccgagaacgcggcaaatcctaaatgatgattggctgcggcctcagccaggttccgaaatcgcaaaatctagttg

SEQ ID NO: 37753 - DNA, 371 bp, Homo sapiens
  misc_feature 1..371: note = chr19:54482817-54483188
  misc_feature 1..371: note = hyper
  source 1..371: mol_type = genomic DNA
cagggagagtgatttcgataaataaagagggggaaagatattccaagagagagaaaaatagtccgaagaaaaaagaaaaggacaaagaaaaagagggagagaaaatcagaccgagaaatagagaaattttaaaaacaggagagagaatgaggcaacagtaaaataaaccagaacacagccggagagagagaatcacagaactgtcgggaggcgccgcgagatggggggccgggaagggggcgcaggcggccgcgtctgaccgccctcgctctccctccttttcctttccttcctcccccgcaggagttgtccgggcctccagcatcttccccatccttagcgccatcctgctgctgctcgggggtgtgtgc

SEQ ID NO: 37754 - DNA, 117 bp, Homo sapiens
  misc_feature 1..117: note = chr19:54483189-54483306
  misc_feature 1..117: note = hyper
  source 1..117: mol_type = genomic DNA
tggcggcctcccgcgtctacaagtccaagaggaacatcattctgggcgcagggatcctgttcgtggcagcaggtgagaggcagagggagggggcgaccggggcggcccacctgggcg

SEQ ID NO: 37755 - DNA, 168 bp, Homo sapiens
  misc_feature 1..168: note = chr19:54483364-54483532
  misc_feature 1..168: note = hyper
  source 1..168: mol_type = genomic DNA
cgcgttcgtgtgtctgcaaagccaccttgccccgagcacccccgggggcccggagccttcctaggcggtccccaagctccatcgccacccgctgggtaaggtgggtgtagttctcgcgtcgccttcggaggagtaaaccgacacaggcaggtgtctggcgcgtaagac

SEQ ID NO: 37756 - DNA, 197 bp, Homo sapiens
  misc_feature 1..197: note = chr19:54483533-54483730
  misc_feature 1..197: note = hyper
  source 1..197: mol_type = genomic DNA
ccgggcgcttaggatcccaagcccgccgtcctggagacggaaggggaggagctggggagggggtgggaccttgagacacaattgggctcttgaggatagagaggcggggctgggtcttggagggcgggcccaggagaggtagaaagtgatctgagcgccgatgaggagcctgctttaaggggcgggcctttggagac

SEQ ID NO: 37757 - DNA, 103 bp, Homo sapiens
  misc_feature 1..103: note = chr19:54485544-54485647
  misc_feature 1..103: note = hyper
  source 1..103: mol_type = genomic DNA
ggacctgctcaaggccggcgggggcgcgggcggcagtggcgggagcggcccctcggccatcctccgtctgcccagttaccgcttccgctaccgccgccgctcc

SEQ ID NO: 37758 - DNA, 325 bp, Homo sapiens; identical to SEQ ID NO: 4694
  misc_feature 1..325: note = chr19:54485672-54485997
  misc_feature 1..325: note = hyper
  source 1..325: mol_type = genomic DNA

SEQ ID NO: 37759 - DNA, 29 bp, Homo sapiens
  misc_feature 1..29: note = chr19:54486106-54486135
  misc_feature 1..29: note = hyper
  source 1..29: mol_type = genomic DNA
cgcggcgggggagccgaggggcgtgtccg

SEQ ID NO: 37760 - DNA, 192 bp, Homo sapiens
  misc_feature 1..192: note = chr19:54494879-54495071
  misc_feature 1..192: note = hyper
  source 1..192: mol_type = genomic DNA
gggcggaggccaggccggtggcggtggcgggcacagccggacgcttcggaggcagcgcggagctggggtcggcgcggggccgaggcaggagagcgagaggggcccctgctcgggagtcgggggtgggagccccgagggggggccctggcctggggctgagcctggcgcgaacccgaccgggaaggccctggg

SEQ ID NO: 37761 - DNA, 118 bp, Homo sapiens
  misc_feature 1..118: note = chr19:55684817-55684935
  misc_feature 1..118: note = hyper
  source 1..118: mol_type = genomic DNA
gagtccaggcttggccgggggcttggggtgggagtcagggcgcaggcagcagcctcactcggtccgggggccgcagcgagtgccactgggcaatgggccgccgcgggttggccagcat

SEQ ID NO: 37762 - DNA, 91 bp, Homo sapiens
  misc_feature 1..91: note = chr19:55685239-55685330
  misc_feature 1..91: note = hyper
  source 1..91: mol_type = genomic DNA
gcgcctttcttcctgcgcagccaggtttctaaggaaatgaaccctcaggactcggttgcggagcgggtgtgttcggcgcctcctgggggag

SEQ ID NO: 37763 - DNA, 630 bp, Homo sapiens
  misc_feature 1..630: note = chr19:55690528-55691158
  misc_feature 1..630: note = hyper
  source 1..630: mol_type = genomic DNA
ttgcgcgaacagccgcgcagaaaccggacagccaccgcgagtcatgctgggagttgtagtatcagcctccccgcacttgagagggggtgtccaggacctagttccatcctaaagggataccctcttcctccacggccccacaggcatcccgctgacttctgcctcgtcctcgcccctccgcagggtctgaaccggaagcgggcgaaggcagacgtgggaaccagcagaccgcgttgcccagagcaacagccgggctcctctcaagcggggtgagagcaaagctggttgcccgggcaacgggttgttgccaggacaacgggcggggctgacgcacagacgcggagtcccggcggggcaggctcgctccggggcccaccggtgcctgggaaccccccaatagcccgactgggatcctgaggtcccgcgaggtggggagcgggcagcctgtggtccgagcgcccacagccgactgctccctccgcacctggtcctgggagctgagacgcaggttccctcttccctctccccaattttgctggagggcgggtcgggggctgcccggtgcctgtgctgagccccctcatccttcttggcctgttggtctctccacgcatccgtgctgctctcgtg

SEQ ID NO: 37764 - DNA, 30 bp, Homo sapiens
  misc_feature 1..30: note = chr19:55865272-55865302
  misc_feature 1..30: note = hyper
  source 1..30: mol_type = genomic DNA
gtactcgcagggctgcgtgctcttcccgcg

SEQ ID NO: 37765 - DNA, 237 bp, Homo sapiens
  misc_feature 1..237: note = chr19:55952667-55952904
  misc_feature 1..237: note = hyper
  source 1..237: mol_type = genomic DNA
tacactccagtctcacgcgcagcccgcataatttaaaaaatggacagatggcatcacgcccgagctcaggaccctgcagtggccccatcacacttaggataaacccgggcccgcctacttctcctcacctcctgctgcccaccgccgccagctgcacgggcgcttccctgccctgcaggccaccgagggcctttgcacgcggttcccctgcccaaaacctctcgcccacagatctct

SEQ ID NO: 37766 - DNA, 746 bp, Homo sapiens
  misc_feature 1..746: note = chr19:55953773-55954519
  misc_feature 1..746: note = hyper
  source 1..746: mol_type = genomic DNA
cacccccagcgcccccggcgcccccagctagcggcggcggcgtggtggcccagcgcggcgtgtcgtagttggagcaggaggcctgcgccaggcgcatgtgacggtgctcacagcagaagcggtagtggcaggtgccacagcagaagcggtaggagccggtgctgcagttgaaggtggcgtcgtactggcccatgacatcgtagtagccgtggcagagctcggcgggagggggcgcccgggccgccgcgcccgccccgcccgcggggccggtcctggtgccgttggcgcctgggctcgccgcgcccccgccgcccgtcagcgccccggtcaggcgccgcaggtgcgccagcagggcgggcagcgggcccgcgggctcggcgctcgtggcgttggacgggcgcgccctggcctggccggcgctagaggccaggagtacgaggagcaggagggccggcatggggcttgcagggggtcgcactgggccgccaggctgcggggagaacgagagcagaggttggagcgctgggcgggagagaaacggtcagagggtgagaaacgtagagatgggtgggcagagaggctggggagggcgggcggggggcggcagagtgtggggagcaacaggcgccaggaggcaggaagggcggagggagctgagctgcgtgggcccaagttggccgccccacgcgcggtgggcgacgatgggagagtaatggaaacgcgcccgggcacggctgggggagaga

SEQ ID NO: 37767 - DNA, 35 bp, Homo sapiens
  misc_feature 1..35: note = chr19:55962393-55962428
  misc_feature 1..35: note = hyper
  source 1..35: mol_type = genomic DNA
aatgctcagaggggacgcagcgtcctagagaagtg

SEQ ID NO: 37768 - DNA, 160 bp, Homo sapiens
  misc_feature 1..160: note = chr19:55963107-55963267
  misc_feature 1..160: note = hyper
  source 1..160: mol_type = genomic DNA
ctctctccgtcccggcgcctgtgtcccgggctgtccccagctccgagcctcagttccctgcgcgcctccatttccctccttcccccgcccggtctccgtcacccctctgtctccacatcccgcttgtctctccttcctggctccacgtctctttctctgt

SEQ ID NO: 37769 - DNA, 147 bp, Homo sapiens
  misc_feature 1..147: note = chr19:55963577-55963724
  misc_feature 1..147: note = hyper
  source 1..147: mol_type = genomic DNA
gagagggatgctgggcgctccgacgctgggggccaggggaccggaccttctgggaggggtctgggctcccagggtcggcggtgggggctccgattgcccaacgcggggcgggctgactgacagctctgacgccggtgtctctgagga

SEQ ID NO: 37770 - DNA, 53 bp, Homo sapiens
  misc_feature 1..53: note = chr19:56015184-56015237
  misc_feature 1..53: note = hyper
  source 1..53: mol_type = genomic DNA
cttttttttttctggcgctcagcacgcatgcgcaggcgcggtgggcccgggaa

SEQ ID NO: 37771 - DNA, 30 bp, Homo sapiens
  misc_feature 1..30: note = chr19:56728573-56728603
  misc_feature 1..30: note = hyper
  source 1..30: mol_type = genomic DNA
ttggctctttttgcccgtatgccgaagagc

SEQ ID NO: 37772 - DNA, 131 bp, Homo sapiens; identical to SEQ ID NO: 4695
  misc_feature 1..131: note = chr19:56728658-56728789
  misc_feature 1..131: note = hyper
  source 1..131: mol_type = genomic DNA

SEQ ID NO: 37773 - DNA, 75 bp, Homo sapiens
  misc_feature 1..75: note = chr19:56879479-56879554
  misc_feature 1..75: note = hyper
  source 1..75: mol_type = genomic DNA
ccacggccgaactcacgcctacgtactcagtcaccagcggaaccctctccaccaggctccgcgtcgaggccctac

SEQ ID NO: 37774 - DNA, 90 bp, Homo sapiens; identical to SEQ ID NO: 1399
  misc_feature 1..90: note = chr19:56879555-56879645
  misc_feature 1..90: note = hyper
  source 1..90: mol_type = genomic DNA

SEQ ID NO: 37775 - DNA, 345 bp, Homo sapiens
  misc_feature 1..345: note = chr19:56879646-56879991
  misc_feature 1..345: note = hyper
  source 1..345: mol_type = genomic DNA
tgggggctgcacatgcgcactgcgagtcctcgcctactcccagaaaccacccgggcgcatacgcggtgcggccgctgcttcaggtcggcgggctccagggagacctgggtgggcagcgtcgccgtttctcctttcttgggcagtatttttcccagcgccacgcggaggctgggccattatgaggtttgtgttgcgtcggggcggtccgtctcagaggcgctccggggaggagtgggcggctgaatggccagaggcccagggatccgttcaggtcagcgctggcgtccgggcctgagtttggaggtggcgggtgccttacaagaatgctcgcgtgatcagtgtgtt

SEQ ID NO: 37776 - DNA, 193 bp, Homo sapiens; identical to SEQ ID NO: 1401
  misc_feature 1..193: note = chr19:56904511-56904704
  misc_feature 1..193: note = hyper
  source 1..193: mol_type = genomic DNA

SEQ ID NO: 37777 - DNA, 274 bp, Homo sapiens; identical to SEQ ID NO: 1402
  misc_feature 1..274: note = chr19:56904723-56904997
  misc_feature 1..274: note = hyper
  source 1..274: mol_type = genomic DNA

SEQ ID NO: 37778 - DNA, 358 bp, Homo sapiens
  misc_feature 1..358: note = chr19:56904998-56905356
  misc_feature 1..358: note = hyper
  source 1..358: mol_type = genomic DNA
taaaggcagcagcccggccttgaagccggatctcgcgatgtttcagggtgagccggacgcaggcgtgcctgcgcagtgcgcggaggagtgctgttcgtgtgttcgagtccctgggttgcttcctggggtctgtggtgctgggtgtgctatctgcgtgtgattctctagcgagagattgtgggcgagtgaccgagtgggcaaggggccgtcactgtgtgtgcgtgattttgacagtgtgtggtggtagcttctgactccgcgtgggtcgttgaatgtatgactgggaccgtttagcggtggatacacaactgtgtgcggctgtggaagattgcctcatccgttacgttcccatttccgt

SEQ ID NO: 37779 - DNA, 508 bp, Homo sapiens
  misc_feature 1..508: note = chr19:56915142-56915650
  misc_feature 1..508: note = hyper
  source 1..508: mol_type = genomic DNA
gcccacgacagtgcccgatacagcaggcgctcaataagtggcgaatgaaagacagggcaaggcggagagagaagaaacagaaagggaaagagaaagcccgggccgccagagcgcttaatcacacgtacatcctaccgggcccctctccagctggctcaggctccacactggtcctccagctcccttttctcagcgatggactcacagccccacccggagcgctggagcgcggacgcggtcactgcgcgtgcgcctcaccgcgctggcaccccggcctggcagcctttggggacctgaaccagctgcgcctgcgcaggtggaacgggtggaacgggtgggggagcggacagtcgaacggcctgagagggctcagctggtccgggtgggattctgaaggccagcggaggtgggcttactagggaaaggggcgcagcagtaactacccgcaactgagcggcgggatctgcggccgcccggggccctcggccaacatcccagcatcctctgc

SEQ ID NO: 37780 - DNA, 284 bp, Homo sapiens
  misc_feature 1..284: note = chr19:56915651-56915935
  misc_feature 1..284: note = hyper
  source 1..284: mol_type = genomic DNA
ccgcgccggccccggactccatttcccagcggcccctgcggcctgccctagggctgcggcgcctttgtgagcgcggccgccggccaggatcgagccctggcccgggccctggcccagccccggcctccaaggaccgcgccgaaggaggtgcccactggagggaggaggcggtgaggagcgcgggatggagctgacgccgggagcggccatgccaccatgtgtgggaccgtgtgtgacagtgtgtgagaatgtgtgagacattaaggaaccgtgtgtgacaatgt

SEQ ID NO: 37781 - DNA, 196 bp, Homo sapiens
  misc_feature 1..196: note = chr19:56988468-56988664
  misc_feature 1..196: note = hyper
  source 1..196: mol_type = genomic DNA
cgggccgagaacccacgcaggcgcgagcccaccgcccacgcaagcacccgcgcagacgcccacgccatcgtggatgcgcaaacccacgcgcgccttggcaggaacgtccacgcagtggcgggcgcgccgcccacgccctcagacacacccacactctcgccagcccccttacctcggtcttcccgggctcagaccc

SEQ ID NO: 37782 - DNA, 138 bp, Homo sapiens
  misc_feature 1..138: note = chr19:56988963-56989101
  misc_feature 1..138: note = hyper
  source 1..138: mol_type = genomic DNA
ggtctcctaggggactggcgcctggccctgcttttcatcctctcaggagatcacgtgtggacactgaggcccttcctcgagctctttaaccaaacccaacctccccaattcgccgccttccccgctcccacaaccaca

SEQ ID NO: 37783 - DNA, 102 bp, Homo sapiens
  misc_feature 1..102: note = chr19:56989524-56989626
  misc_feature 1..102: note = hyper
  source 1..102: mol_type = genomic DNA
cagtgagactgactgcgtcggggttgagactgggtggatgaggctcaccccggcggggagaagggacgaggaggggcggacagcggaaggtccgggagtgtc

SEQ ID NO: 37784 - DNA, 261 bp, Homo sapiens
  misc_feature 1..261: note = chr19:57018744-57019005
  misc_feature 1..261: note = hyper
  source 1..261: mol_type = genomic DNA
gccagagtcacaacacggtcggggttcctcgtcgctgtcttattccaaaataagcttaacacagaaagataatgacactcccacggactggcacagaaggccgcgctccgaatgacatcgcgatcacagaggcacagacagcgtcacaaagccccacgcgtactcacaccgaaggctcagccgtcgcgcgtttccctcccaggccccaggaactagtaactagggacgcttctggtctctaggcgaggagagggggagagc

SEQ ID NO: 37785 - DNA, 500 bp, Homo sapiens
  misc_feature 1..500: note = chr19:57019006-57019506
  misc_feature 1..500: note = hyper
  source 1..500: mol_type = genomic DNA
caatctttgcgcctgcgcacactcctgctcttacccgccggaaccctgggccacgcccggctcgcgtaatcacgcactgcgcaggcaccgcccgctctgctctaaggtccctctcactccttcagcagcccgaggacaatcccctcaacactaggccacgccttgtctccgcccctctcgtccgacccctggagagaggctggcgcctgcgcgatggggggttccagcgtcgactcacggagtccttcggatgagagcgtctgggtgccagacgaggccgggggtttgttttgggtggtttgggagtccgagctcgagggctgggccaggaagggcaggcgaggcgggcggctccgacgcgggtcgcgaaggcccagccgcgtcctctgtccccaggacgactacatttcccagaggccagcggggcgcgcgtactcgagtctgcggggcggaggccgcggctcggggctgctgggcgttcggggcggcttggggcggcg

SEQ ID NO: 37786 - DNA, 30 bp, Homo sapiens
  misc_feature 1..30: note = chr19:57019931-57019961
  misc_feature 1..30: note = hyper
  source 1..30: mol_type = genomic DNA
ggctcaatgagaggccggtgtgtgttcgag

SEQ ID NO: 37787 - DNA, 30 bp, Homo sapiens
  misc_feature 1..30: note = chr19:57049841-57049871
  misc_feature 1..30: note = hyper
  source 1..30: mol_type = genomic DNA
ggtgtgtagtcagagcggcctctgcttccg

SEQ ID NO: 37788 - DNA, 238 bp, Homo sapiens
  misc_feature 1..238: note = chr19:57078361-57078599
  misc_feature 1..238: note = hyper
  source 1..238: mol_type = genomic DNA
ctatcgcgtaggccccgcccgcgccccaagccccgccctgtcatggttttcctctccagagggtagccgctacgccttaccgactgcgtttcagtgctgtcccactgctcctgcacaccccacgcctgcgaccctacccaccacggacaggcgctcctgcgagctggaagccagttctctgcgtcctgagcctggcagctgcatctgaacactcggagcctggcgatggcttccagaa

SEQ ID NO: 37789 - DNA, 251 bp, Homo sapiens
  misc_feature 1..251: note = chr19:57079002-57079253
  misc_feature 1..251: note = hyper
  source 1..251: mol_type = genomic DNA
ctgtgagtgcccatacgtggtgagcgtgcggtgctgtgctgaggaggggcgagcgcgcgcggggatggcggcccggtgtgtgactgtccggtgcgtggccgcgaatctgcgcctgcgtgcatggcccggcggcgtgcggaaggcggtgtgtgttggaatgagtgaagcactttaagtggccaagagcaggaaacccggccggaggaggcttaccccgttctcccctgtatcgactgcgtagagcccagtgt

SEQ ID NO: 37790 - skipped

SEQ ID NO: 37791 - DNA, 21 bp, Homo sapiens
  misc_feature 1..21: note = chr19:57106588-57106609
  misc_feature 1..21: note = hyper
  source 1..21: mol_type = genomic DNA
cgcgcgcgggtttctgggaag

SEQ ID NO: 37792 - DNA, 73 bp, Homo sapiens
  misc_feature 1..73: note = chr19:57106836-57106909
  misc_feature 1..73: note = hyper
  source 1..73: mol_type = genomic DNA
gggcgcaggagagggcgtgcaggccgggaccgaggtgcgcctggagaggctgagcggccgaggagaggctgag

SEQ ID NO: 37793 - DNA, 272 bp, Homo sapiens
  misc_feature 1..272: note = chr19:57149347-57149619
  misc_feature 1..272: note = hyper
  source 1..272: mol_type = genomic DNA
agggctttccccaggcggatgggttctttgaaggagggggaaaaaaaaaagtcttctccagctattctgtgtagagcgtcagcaccaccgaacgctaatgcttgaatggtttagaactgcggacagctcacgccagacagattcagcaccacggacagcccccaaggcagctcgtgatgtgaatggttcagcaccgcagacagctcaagcctcgccggacagccctgctggaagtggttcagcaccacggatagccccgctaatatccatca

SEQ ID NO: 37794 - DNA, 666 bp, Homo sapiens
  misc_feature 1..666: note = chr19:57154254-57154920
  misc_feature 1..666: note = hyper
  source 1..666: mol_type = genomic DNA
ccgctggccttggggcgtctgtcgcagggtacctcgaacataacctacgtgctcatcagctagagatggaccagctcggtaccacacccccctgcaaccacgccgcgggtaccccgcctctgcggctcatccactcccttccccacgcgcctccaggtgcaggcttcccgggggtggaggaggggaggaggacacccacgctccccaattcccccacctcccatctcccacctccccccacccccccgcagcctccgcgtctgcgcagccgcagtcagtgcggcgccagctctgcagagcccagacagggtccggttggggagggtgagtccttcgagggacccccgcgggcgggaaggaggcggagaaaaggggctgggggcgcgggcggcgatccggggatgcgcgcgcgagtatggatgcgcagagggtgtgtgtgcctgggcgagggtgaggggcagaaccgctccagggatagggtccggggagagggcgtctccaagcccgtccggtgggagaggaccggggtctgtcggggtcgggtctgtttctccgcagcggaggtctgtgtcctggcttgggggttgcaggtgaattccagcctcctcgtgaggaggggagcacagacctgtgtaccctcgtggggcggcacgggcacgtgcgctc

SEQ ID NO: 37795 - DNA, 215 bp, Homo sapiens
  misc_feature 1..215: note = chr19:57182912-57183127
  misc_feature 1..215: note = hyper
  source 1..215: mol_type = genomic DNA
acacctgcaggaacacgcgcacactacacaccgttgctctcgcctcccggtatcaccttcgaacgcgctggccggccccctcctagcctggtgcagtcggctccgcttctactcagtctcgggtcctcctgggccaacgcagaccctggtgcctccttccttagacgagctaaggtcaagacttctgctgctgcggaggagcccgcgcaccaggc

SEQ ID NO: 37796 - DNA, 36 bp, Homo sapiens
  misc_feature 1..36: note = chr19:57276895-57276931
  misc_feature 1..36: note = hyper
  source 1..36: mol_type = genomic DNA
tagcaagagtgtgagcgagtgcgaatgtccctacaa

SEQ ID NO: 37797 - DNA, 114 bp, Homo sapiens
  misc_feature 1..114: note = chr19:57610714-57610828
  misc_feature 1..114: note = hyper
  source 1..114: mol_type = genomic DNA
gccacgttctcgcggcgccacctggtggccatggaccgccatcgccgctggacgtcagggccgccaggcccagcgagatgtcacctcctctgaggagccttccaggatcgcacc

SEQ ID NO: 37798 - DNA, 232 bp, Homo sapiens
  misc_feature 1..232: note = chr19:57617484-57617716
  misc_feature 1..232: note = hyper
  source 1..232: mol_type = genomic DNA
ggcctccctgcatcccggagcgcactggggatgaggactcacccaggagagcccgagacacctgagcggccggcacaaaggccctagggaagtgtgggggtacccttggtctcaaagcgctgatccgcctgtgccccctgacctgccagggccggcccccgcttgggtcttggagggcgctgcgcaagcctgcgccccgcactcgcccgggaagggaagggcagggaagggg

SEQ ID NO: 37799 - DNA, 32 bp, Homo sapiens
  misc_feature 1..32: note = chr19:57617831-57617863
  misc_feature 1..32: note = hyper
  source 1..32: mol_type = genomic DNA
cgaaaacggcctgggtccggcttcctcctccc

SEQ ID NO: 37800 - DNA, 88 bp, Homo sapiens
  misc_feature 1..88: note = chr19:57618082-57618170
  misc_feature 1..88: note = hyper
  source 1..88: mol_type = genomic DNA
ttcaaggtctgtcaccgtagggggcgggggggcgcgtggagccgctgggggttcggcccaccccgcgaaccgagctcccggccctgtg

SEQ ID NO: 37801 - DNA, 70 bp, Homo sapiens
  misc_feature 1..70: note = chr19:57683265-57683335
  misc_feature 1..70: note = hyper
  source 1..70: mol_type = genomic DNA
caggcaagggaaatgcgtccccgggccggggggcgcgagcgggggtccggggccgcgagctggggtccgg

SEQ ID NO: 37802 - DNA, 110 bp, Homo sapiens
  misc_feature 1..110: note = chr19:57683576-57683686
  misc_feature 1..110: note = hyper
  source 1..110: mol_type = genomic DNA
gggcgcgcgagggggcggggcgcgccgggctcgtcctctccgcggcgctcagtggcagcagggagggccggtgagatgccagagcaaggtagggtcctgtatttggggac

SEQ ID NO: 37803 - DNA, 94 bp, Homo sapiens
  misc_feature 1..94: note = chr19:57683805-57683899
  misc_feature 1..94: note = hyper
  source 1..94: mol_type = genomic DNA
cggttgatgtcaggcagtgctgggaggcgttgctctccgggttcgcttctctcctgttgtcctaactctgcatctctcccgggtgaatcacaga

SEQ ID NO: 37804 - DNA, 100 bp, Homo sapiens
  misc_feature 1..100: note = chr19:57703285-57703385
  misc_feature 1..100: note = hyper
  source 1..100: mol_type = genomic DNA
cggcagcggtgctgacggaccgggcccaggtgagtggacggtggcttcgcggttgccgcttccttgccagcgctgaggcggtttccgaagtgggtgggag

SEQ ID NO: 37805 - DNA, 30 bp, Homo sapiens
  misc_feature 1..30: note = chr19:57832233-57832263
  misc_feature 1..30: note = hyper
  source 1..30: mol_type = genomic DNA
gcgcaggtgagtggacgaggttttggcctt

SEQ ID NO: 37806 - DNA, 212 bp, Homo sapiens
  misc_feature 1..212: note = chr19:57862426-57862638
  misc_feature 1..212: note = hyper
  source 1..212: mol_type = genomic DNA
ctccccctccctgcacgacgcctcttggcagacatccgggagaacccgaaaggcgctcgttgcctggttggatgcagggtacaaactacgttacccagaaatctgtgcccagctcattgttagccggcgtgcagccaatgacagcccagaaactgggcgtttcctgctgctctgggctgcaggggcgagacttctggcgtcgccgtcgtgac

SEQ ID NO: 37807 - DNA, 319 bp, Homo sapiens
  misc_feature 1..319: note = chr19:57862639-57862958
  misc_feature 1..319: note = hyper
  source 1..319: mol_type = genomic DNA
tatttttcctatgcccggtccgtgcattctggttgtgaaggctgagttctagagatcgggtcggctttctacgcggctctcgtggaacctagcaaagaaagacagtgaagactgcaggaccttccttcgcgcttttgttacaatccatgacccctgtcgtgggacgggcggcctctcgcggaggtgtctgccggggctgggctcttaccgaggcctccacacacgtcctcttgtccttgtctcccccagaagcagccgccttagtcttgtgagcgtttttacaccgggtagattgagacttggagtgctacactcagcc

SEQ ID NO: 37808 - DNA, 15 bp, Homo sapiens
  misc_feature 1..15: note = chr19:57989033-57989048
  misc_feature 1..15: note = hyper
  source 1..15: mol_type = genomic DNA
aacactagtaagcgg

SEQ ID NO: 37809 - DNA, 342 bp, Homo sapiens
  misc_feature 1..342: note = chr19:57998952-57999294
  misc_feature 1..342: note = hyper
  source 1..342: mol_type = genomic DNA
tccaatctccatctccgaagttatgcccacttcctggaagtttggaggcacgggaactacattgcccaaaaggcgcagcgccgcgaggcggcgatccctgaccaatgaaaagaggtctgcccgagcgtgcgacacgcaatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctccc

SEQ ID NO: 37810 - DNA, 275 bp, Homo sapiens; identical to SEQ ID NO: 13572
  misc_feature 1..275: note = chr19:58011070-58011345
  misc_feature 1..275: note = hyper
  source 1..275: mol_type = genomic DNA

SEQ ID NO: 37811 - DNA, 178 bp, Homo sapiens
  misc_feature 1..178: note = chr19:58011346-58011524
  misc_feature 1..178: note = hyper
  source 1..178: mol_type = genomic DNA
cgctgtgttctcgcagctcagaggcgggtctgaggctcggtggcggcgcccagggtggcccgggccctttcctcggtcgttgtctcaccgccacaggctccgatggcggcggccacgctgagggaccccgctcaggtgagcgccgcgtcctcccggcctcccccgaatcctaaagccc

SEQ ID NO: 37812 - DNA, 28 bp, Homo sapiens
  misc_feature 1..28: note = chr19:58038557-58038585
  misc_feature 1..28: note = hyper
  source 1..28: mol_type = genomic DNA
attgagtcctcacagcgcggcggactgc

SEQ ID NO: 37813 - DNA, 200 bp, Homo sapiens; identical to SEQ ID NO: 4705
  misc_feature 1..200: note = chr19:58038923-58039123
  misc_feature 1..200: note = hyper
  source 1..200: mol_type = genomic DNA

SEQ ID NO: 37814 - DNA, 204 bp, Homo sapiens
  misc_feature 1..204: note = chr19:58070569-58070773
  misc_feature 1..204: note = hyper
  source 1..204: mol_type = genomic DNA
tgctgtgcactgagacggacacacacacatcacccagggagccgttcaagcttcctcaaccccgggggggggaagagtaaatatttctactttgcgcgcgcaaaaatgaaggacgaggacagtaacgggacttgttcaaggtcgcaggcccgagaaaggacatggttggaagagccacgaggaggactgcggtcgctcctctca

SEQ ID NO: 37815 - DNA, 303 bp, Homo sapiens
  misc_feature 1..303: note = chr19:58071094-58071397
  misc_feature 1..303: note = hyper
  source 1..303: mol_type = genomic DNA
ctcaaaaccctaccccgggtcctacaacggtgcggaggtgagccccagtcgccctaccatccttcccagcacagttctgagagcgcggaccaacacgccccaccacaaacgtccacgccagcgaggccggaagtcccgcccctgtgtcgcggtcgcctgccacgccttttcctgcgccggcccactgccttctaggtaatgtagtcttgtcccgtaagaggccaggcttggctctttttccttttttattatgcacaccatgtttctgtatatctcagatgatcttagcggagcaagtgtaca

SEQ ID NO: 37816 - DNA, 507 bp, Homo sapiens
  misc_feature 1..507: note = chr19:58094961-58095468
  misc_feature 1..507: note = hyper
  source 1..507: mol_type = genomic DNA
cagagcaggagcagccgggggcgcggcccccacgtggcctcccgggacacgtgcccacagcgcgacacctaagtcgctcctttcacagaatagccttggccccggcacggcctcgaacgccttgaccccgcaagggaggggcacgaggctcctttgctcccgcaggagcgtcgaatacgtatggaatacgcgtcggtgtggatctggcctcagcttcctgagcctgaatcaatgcttctaatcacgtgggcgctcagccgcgacgggaccacagaaatcgaccagcggcctgtttaaggagcgacaaggcccagccctctcctgcattgtggcgacgccatttccctgcgcccccagcgcggccgcttggcttttgtttgaggtgacgctgggcggcagcatccttccctcagccctggggaccagcggggactacagaacccagaaggttttgtctccagccgcagggatgctgagccaatccgcgctgagaaaagggtcgtttcc

SEQ ID NO: 37817 - DNA, 308 bp, Homo sapiens; identical to SEQ ID NO: 1406
  misc_feature 1..308: note = chr19:58095469-58095777
  misc_feature 1..308: note = hyper
  source 1..308: mol_type = genomic DNA

SEQ ID NO: 37818 - DNA, 154 bp, Homo sapiens
  misc_feature 1..154: note = chr19:58111112-58111266
  misc_feature 1..154: note = hyper
  source 1..154: mol_type = genomic DNA
ggtccaggagaagggcgacctctgccagcccaagaagcggtgagaactacattacccagaggcccgtgagccaggttcttggcgtggagccaatgaggctcaggggagggacatttccgctctgtccaacttgtcggagcggaacttccggcgt

SEQ ID NO: 37819 - DNA, 323 bp, Homo sapiens
  misc_feature 1..323: note = chr19:58111541-58111864
  misc_feature 1..323: note = hyper
  source 1..323: mol_type = genomic DNA
cccgaaactgagggacgcgtgaagggttttctgcagcccggaccgcactgtccggcacagtgaggcgctggtgctggatctcgtttctggtagtgtggcagggagcgggagagcgacacggtcagggggctgcgcgggcaacagcttggagctgcgcctgagccgggaggctggggagacccaggccggcctcacgcgtgcaggtagcagagggtggggcagcgccgcgctgcattggccccactgagtttcaccagcacactgagggccacagcgcgtaggacagaagaggggcacggccccagtcacgcttctaaaagttt

SEQ ID NO: 37820 - DNA, 631 bp, Homo sapiens
  misc_feature 1..631: note = chr19:58125422-58126053
  misc_feature 1..631: note = hyper
  source 1..631: mol_type = genomic DNA
tttctcagcgcccctcgcagtaccatttggcctttgcccagcgtgcaggggagttagccgtcaccacggccaagtgcacatgagaactgcattgcccagaaacctgtgcgccgcccggcggcggcactcttaggggcgtctccctgcggacggaagctctctgggcgggacttccggtatcttcctcgcggtggacatcttgtcggctcttaggtggaaccatcggagcagaagctcggggttgctgggcggttccgaggtgacggaagcgggagggtgcgggagaagtcgctgttcgctctgcggagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcaggtgggtgctgcctttcccagactttcgcccgccccaaatcctgaagttccaaatgaggagcgcctgtctgagtccctgcagcgcaggccccagtgtccaaggcagcggggcgctggtgggtgggggcgagtgtgactggcagaggggcagcctgagcataggtttggagctggactgagccc

SEQ ID NO: 37821 - DNA, 39 bp, Homo sapiens
  misc_feature 1..39: note = chr19:58126054-58126093
  misc_feature 1..39: note = hyper
  source 1..39: mol_type = genomic DNA
tagcagtcgggagcgtgtgtgaaccgtagtcaggcctgc

SEQ ID NO: 37822 - DNA, 55 bp, Homo sapiens
  misc_feature 1..55: note = chr19:58144370-58144425
  misc_feature 1..55: note = hyper
  source 1..55: mol_type = genomic DNA
gacgcagcttcctagcgctcccagctgtctgcacacaaggcgccctccgtcgcag

SEQ ID NO: 37823 - DNA, 366 bp, Homo sapiens
  misc_feature 1..366: note = chr19:58175608-58175974
  misc_feature 1..366: note = hyper
  source 1..366: mol_type = genomic DNA
atgaaagtgaggggtcgggggtcggggtcgggcgcggcgatgccgcagctgcggggctcggtggactcggcgagcaagagccccaggacgctgctggcggcgggcgaggagctggggcgcggcgcggggcggctctaggcgctgtggccgctcagcgtctgggacccagcgccgcccaggtcagggaatccttggtgttcccgccccgcagcacccggggcgggggaggagtcggcgcggtcgtgcggccgtggaggacagcgagacccggggctgcggctgcaggccgaggggcccctgggacagtgagaagcagcggcgggagctagtcacggggcagggagcgctcagcggtaaagacggctt

SEQ ID NO: 37824 - DNA, 467 bp, Homo sapiens; identical to SEQ ID NO: 1407
  misc_feature 1..467: note = chr19:58219926-58220393
  misc_feature 1..467: note = hyper
  source 1..467: mol_type = genomic DNA

SEQ ID NO: 37825 - DNA, 217 bp, Homo sapiens; identical to SEQ ID NO: 1408
  misc_feature 1..217: note = chr19:58220515-58220732
  misc_feature 1..217: note = hyper
  source 1..217: mol_type = genomic DNA

SEQ ID NO: 37826 - DNA, 413 bp, Homo sapiens; identical to SEQ ID NO: 1409
  misc_feature 1..413: note = chr19:58238326-58238739
  misc_feature 1..413: note = hyper
  source 1..413: mol_type = genomic DNA

SEQ ID NO: 37827 - DNA, 25 bp, Homo sapiens
  misc_feature 1..25: note = chr19:58238987-58239012
  misc_feature 1..25: note = hyper
  source 1..25: mol_type = genomic DNA
gctacaaggaggagccggaagtccc

SEQ ID NO: 37828 - DNA, 180 bp, Homo sapiens
  misc_feature 1..180: note = chr19:58239013-58239193
  misc_feature 1..180: note = hyper
  source 1..180: mol_type = genomic DNA
cccacgcaccccccgcaggcactgaaacacccctctcctgggccctcattgggtatgcaacgtataggtttgtgggtagagtgtggttcccactgagctatccttcaaggcaggggattctcggcctgggctcttgggaaaactcgaagtaggagggccaagttgtttgggaaaagtaac

SEQ ID NO: 37829 - DNA, 371 bp, Homo sapiens
  misc_feature 1..371: note = chr19:58281000-58281371
  misc_feature 1..371: note = hyper
  source 1..371: mol_type = genomic DNA
tcaagccaggacttccggcgtcctagccgtggcagccattttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcaggtgagcgctgcgacctccgggccttacccaccctacccacccagaccctgaggcccctgatcgtgagggccgcctcctcgcgtccctgcagcccaggcctctgtcagggacggagaggcgccggc

SEQ ID NO: 37830 - DNA, 30 bp, Homo sapiens
  misc_feature 1..30: note = chr19:58361192-58361222
  misc_feature 1..30: note = hyper
  source 1..30: mol_type = genomic DNA
cacgtaacgtaaggccgagacttccggggt

SEQ ID NO: 37831 - DNA, 29 bp, Homo sapiens
  misc_feature 1..29: note = chr19:58361543-58361572
  misc_feature 1..29: note = hyper
  source 1..29: mol_type = genomic DNA
gtaggaacactgaggcgctcacaggaggc

SEQ ID NO: 37832 - DNA, 531 bp, Homo sapiens
  misc_feature 1..531: note = chr19:58400042-58400573
  misc_feature 1..531: note = hyper
  source 1..531: mol_type = genomic DNA
tccgggctgcagagccgtgaacaggcgctgctacctcgctgcttttgggtgacgatgaggtgacctgaggacacagaaggccccacaattacctgagcggagagcctcagcgtagccgcggcagccatcgaaccacgtggttttaagcagagtcgggaggatagggcgaccagccaggagatatgggcacgacggtccgtatcctggcccaggagtgggtcacgctgggcgccgtcacagagctccagagtagcctctgtgcagcggaggacaactgctccccgacttctgggttcagtcaccacagtgcggacctagcgctcaggagcctctcctacaaataaatccaacaccaatcaaaatggccgccaccagagggcgccggaagtccggacccattgtcacgtgcacacaggaaacgcctttattctgagccctcagaggtcttctacgctatcattcgaggctgagttttctgggtaatgtagttccctaggcaacaaggagggtaaagggcgcaattcccagagg

SEQ ID NO: 37833 - DNA, 403 bp, Homo sapiens
  misc_feature 1..403: note = chr19:58446443-58446846
  misc_feature 1..403: note = hyper
  source 1..403: mol_type = genomic DNA
agacctgtgaacagtcgccgctctctcgctgcttcaggattcgggttaggatgaggtgacctgagggcagggaaggcacaattacctgagccgggagcctcagcgcggccgccgccatcccgagtacgcggggaaagcactgccgggagcggcgggcgccgttacggggcctaagatctgcctctgtgcagcaagaaggactcttcaccttctgggttcagacaccgcggttcggacccatagctccagcgcctctcacctcacaaaccgcagaaacacacccaacattaaccaaaatggtcgctaccagagaacgctgagaatcccgccactacgttacgtgcgcacacagaaacgcctttattctgagcccttactggttctgttgcgctgtcattcaatg

SEQ ID NO: 37834 - DNA, 194 bp, Homo sapiens
  misc_feature 1..194: note = chr19:58458530-58458724
  misc_feature 1..194: note = hyper
  source 1..194: mol_type = genomic DNA
gggctcaagccaccccgtagccccatgcctggccttggagccgggtgccctcgcaatggctgtgtcacctctgtgccccagggctcagtggcgcctctcatcaggggctccttgccagtcgcgccctcccttccctagcacaccaggtgttggaaacgggagcccctccggcgagcccccgtgtcctgtcctgg

SEQ ID NO: 37835 - DNA, 183 bp, Homo sapiens
  misc_feature 1..183: note = chr19:58459049-58459232
  misc_feature 1..183: note = hyper
  source 1..183: mol_type = genomic DNA
ccacaaggaggacaacggaagtcccgccgcgaccgcgcgtgcgcttacggaaacaccacctttcggaggcctcattggctgaaggtcgccgtcgcccaacgcaggccattctgggtaatgttcccacaggcgcacggcgggagagtgagggtcgcctccacctccttccggaagtaaaggcca

SEQ ID NO: 37836 - DNA, 1028 bp, Homo sapiens
  misc_feature 1..1028: note = chr19:58513683-58514711
  misc_feature 1..1028: note = hyper
  source 1..1028: mol_type = genomic DNA
tgcttccagagctcccgacccaaatttcctcctcaagaccgacgcggccgcgacgctgcaaaagctcgtcccggcctcacctggctcgcggccggcggtcccccttgaaggcggcgcagcaggatcggggtctgcccgcctggggcgtttggcttttgtcccgcgccgaggtccggcccaggagtgcgcttgggagctcccggcgcggcctcggggacaaaggcccgcggagccgacgtgcagcagagttcacccaggcccgtccgaccagaaaacgaagaacgcccggaggcgggaggccggaggcaggctgctggctggagaaccgacggcaacgacggcgcaaagccggcgcggaaagggcaggcgcaggacccaccctgacgccgcctctcccagccggctctcctgaccccccaagccccgcagctacggcggccccacagcctgagcaaaggcctcacctcagccgcggacaatggcggctgcttccccggcgtcgaccggagcgcgccgcggggtctgctgggagctgtagttccaggcgggcacttccggcgtcgggcagcggcgccgccatgacaggttcctgggccgcgccgcctcgccctgcctgggcggggttgggacctttctggcacctgcgtcgaagccggcggcaggatggactttgttgtcccggtcccagaccaccctcctccaccgtcgcctcccactgcaaaaaggcctgggtaagtcgcggccccgcgggcctcggtttgcccatccgcaaaatggcgcctcgtggtaccgggtttcccgggaggagctcggcgagttctcagcgctctcgagggatccttccatttggcgttcgcaagattgtgagaaagtgactgctgttattctctttaagataaggaacctaattcgagctacccttctctgtgaagctcgacggctgagaacgtcagggctcgttcccaagtctctttccagaggccaggctttatgggagcatgggttaccagcgacgcaccctgtgagtt

SEQ ID NO: 37837 - DNA, 52 bp, Homo sapiens
  misc_feature 1..52: note = chr19:58520901-58520953
  misc_feature 1..52: note = hyper
  source 1..52: mol_type = genomic DNA
gcctctccgccctgacgctgatgctcgtctggctgcccgttctttggcatca

SEQ ID NO: 37838 - DNA, 48 bp, Homo sapiens
  misc_feature 1..48: note = chr19:58521268-58521316
  misc_feature 1..48: note = hyper
  source 1..48: mol_type = genomic DNA
tggccgaatccaggacgaccaggccagacccaccggcagtaccttgcc

SEQ ID NO: 37839 - DNA, 288 bp, Homo sapiens
  misc_feature 1..288: note = chr19:58545100-58545388
  misc_feature 1..288: note = hyper
  source 1..288: mol_type = genomic DNA
ggacactgtataaaacggttgcgtgtctggaatgccgtcgttttgccccgcggccccatcgtacatgcgcatccccgcagccgccaccgtctccactttccgcagcagcgtccctgacgctgcgcgacccgttgccaaggcgactggaaccgcggcccgaggtaactggagggcacggcgggggcggggcgctcatcccaggcggcttctgattggcctcggccgcctcgtgcgtcacagccccgcccctgcccgggagtcccgcagcggtgacttgtcaccgacgcc

SEQ ID NO: 37840 - DNA, 13 bp, Homo sapiens
  misc_feature 1..13: note = chr19:58545577-58545590
  misc_feature 1..13: note = hyper
  source 1..13: mol_type = genomic DNA
cgggacgcccacc

SEQ ID NO: 37841 - DNA, 76 bp, Homo sapiens
  misc_feature 1..76: note = chr19:58545651-58545727
  misc_feature 1..76: note = hyper
  source 1..76: mol_type = genomic DNA
gtcgggggaggcgggcccgggcccgggagggggcgggccgggccggggttccagagcccatcgggagtcctgaggt

SEQ ID NO: 37842 - DNA, 60 bp, Homo sapiens
  misc_feature 1..60: note = chr19:58570949-58571009
  misc_feature 1..60: note = hyper
  source 1..60: mol_type = genomic DNA
cgccccgcccctggccccacctctgccccacaccgggcactgggccgccacctttgttga

SEQ ID NO: 37843 - DNA, 54 bp, Homo sapiens
  misc_feature 1..54: note = chr19:58609472-58609526
  misc_feature 1..54: note = hyper
  source 1..54: mol_type = genomic DNA
cgtcctcaccgtctaccctgttggggtcgctctctgacccccgcgctgcatccc

SEQ ID NO: 37844 - DNA, 32 bp, Homo sapiens; identical to SEQ ID NO: 4715
  misc_feature 1..32: note = chr19:58609712-58609744
  misc_feature 1..32: note = hyper
  source 1..32: mol_type = genomic DNA

SEQ ID NO: 37845 - DNA, 256 bp, Homo sapiens
  misc_feature 1..256: note = chr19:58609745-58610001
  misc_feature 1..256: note = hyper
  source 1..256: mol_type = genomic DNA
gcgtcccgcccactccggcgcctgcgtcattttgggcaccatggcaacgaagtaaacaagcgggtaaataatagacccctgacagccagagacccggagaaacaaagacggtgagaaacggagaaacaaagacaaaaagacgcgcagaccgggagggagagaagcatgaaggcccacagacgctcgggggcagaccaagacgccctggggtccccgaaacagagatgtacagagtcggacacggaaagggagagac

SEQ ID NO: 37846 - DNA, 30 bp, Homo sapiens
  misc_feature 1..30: note = chr19:58629357-58629387
  misc_feature 1..30: note = hyper
  source 1..30: mol_type = genomic DNA
agagtagagggctcgcgccctgcggggaga

SEQ ID NO: 37847 - DNA, 353 bp, Homo sapiens
  misc_feature 1..353: note = chr19:58661991-58662344
  misc_feature 1..353: note = hyper
  source 1..353: mol_type = genomic DNA
caggtgaaacccacccgcggacgcgcccctcgccgccccacaaggacccggcggacctccacccgccaagacttccctccgcaggaaacggaggcagcgcagggctcagggatgcgtcggcacttacggttggcggccggcggcagccatgttccgggcgattgcgcttgcgcggctgccgggacaaggatgtgcgcgtgcgcggagtccccgagcttcccccgcccaacgctggggcggccgcgggtaccgggttattcattaccctggcgtggacttgcctcggggcggacgcgcaggcatttactttctcctatggtctcctctgatttttaacccgatgctatcattct

SEQ ID NO: 37848 - DNA, 262 bp, Homo sapiens
  misc_feature 1..262: note = chr19:58666233-58666495
  misc_feature 1..262: note = hyper
  source 1..262: mol_type = genomic DNA
cccattcctcccagccgcagacgcggagcccacaggagtccccgcagccctagcccgtgcacccacggcggagccgaggccgcgactccgggcctgttggctggaacccgcagccgtgtctcgggccgccccggtagcggccacccctgagagcactcggccccgttctatcccgcagtggtttggggagtgcaggtcatcactcccacccgccaaggcggacgccggaccctccattgcgcatgagcgcccactgcggcgc

SEQ ID NO: 37849 - DNA, 183 bp, Homo sapiens; identical to SEQ ID NO: 13601
  misc_feature 1..183: note = chr19:58666550-58666733
  misc_feature 1..183: note = hyper
  source 1..183: mol_type = genomic DNA

SEQ ID NO: 37850 - DNA, 703 bp, Homo sapiens
  misc_feature 1..703: note = chr19:58694552-58695255
  misc_feature 1..703: note = hyper
  source 1..703: mol_type = genomic DNA
tagtgtggggccctgcggcctagcgtccctcaccagaggcctccccttgcctagctggaccgccgagggacatcgacgagtatcctcctcctgctgtccccggcttcgcctgccgcccctaaccggccagtcaagatggccgccgctgggtgaggcaagctggcgcgccgcgggggcgtctgggagttgtagttcgggacggcgggctgacgcacttcgccgccggccgacgggcgccattgtgcggcgcgcgccgggtgagtgccgcgcgaaacctgcgtccgtcgggggctgcgctgggcgggtccagaaccgttagttgggggcgagcgcggcctctgcattttccgccgagctcgggtaccctgagccggccgtgcctgcagtcctcccgccgctctgtgggatggggtcggtgacccggaaccccgaggggagacagtgctttcggggcgccgcggtggagagaacagatcgcctccggaagcgtggggtctgggccagggaggcgatcccctccgatgcgcgggacagaggaggctcggtgtcctctcggggaggggaaaactggtcctatccagtcctgtgggagtcctatgactcactctgggcgttttccagtttgggtggacttgtcatttcccgctgagggagccgttcctgggcggaggctgcggtagctccccagcggacaccttaagcc

SEQ ID NO: 37851 - DNA, 179 bp, Homo sapiens
  misc_feature 1..179: note = chr19:58740209-58740388
  misc_feature 1..179: note = hyper
  source 1..179: mol_type = genomic DNA
agcaacggctaccggcgcgcggccttctgggagttgtttgttgcgcggagcgcgggcacgtccgccggccaccggaagcaccgccattggccggtgcgtgcaggtgagtctggcggcctcaaggttggctcggaggtttcactgttagccgggtgcggccggagcgcaggaccaggcca

SEQ ID NO: 37852 - DNA, 333 bp, Homo sapiens
  misc_feature 1..333: note = chr19:58951068-58951401
  misc_feature 1..333: note = hyper
  source 1..333: mol_type = genomic DNA
caggatcctgagggccggaatcccagcgggtgagggcctggggcacactccacttacctgcgccgggcccatcagcaacgctggcaaccccattagaacctgtgggctgggcagggccataacaggaggcccagggctagccctgccgctgggccgaaccctcacacttccgctgggtgacggtcgcactcaggacctgtcttcccaaatgcaaaatgcgcgcaaggcctctgggcaccgcagggacgaaggctgggtatggagaccctggagacgcgtggcgctggctccactttcgggaacaccttggctcataaaagcagagtaattagc

SEQ ID NO: 37853 - DNA, 74 bp, Homo sapiens; identical to SEQ ID NO: 1413
  misc_feature 1..74: note = chr19:58951525-58951599
  misc_feature 1..74: note = hyper
  source 1..74: mol_type = genomic DNA

SEQ ID NO: 37854 - DNA, 178 bp, Homo sapiens; identical to SEQ ID NO: 1414
  misc_feature 1..178: note = chr19:58951600-58951778
  misc_feature 1..178: note = hyper
  source 1..178: mol_type = genomic DNA

SEQ ID NO: 37855 - DNA, 279 bp, Homo sapiens; identical to SEQ ID NO: 1415
  misc_feature 1..279: note = chr19:58951779-58952058
  misc_feature 1..279: note = hyper
  source 1..279: mol_type = genomic DNA

SEQ ID NO: 37856 - DNA, 78 bp, Homo sapiens
  misc_feature 1..78: note = chr20:291085-291163
  misc_feature 1..78: note = hyper
  source 1..78: mol_type = genomic DNA
aaggggagttgggggcgagcgccgaaatctgagtggctctttcaagcctccgttgccatagaaaccggccgcacaggc

SEQ ID NO: 37857 - DNA, 153 bp, Homo sapiens; identical to SEQ ID NO: 1417
  misc_feature 1..153: note = chr20:291220-291373
  misc_feature 1..153: note = hyper
  source 1..153: mol_type = genomic DNA

SEQ ID NO: 37858 - DNA, 272 bp, Homo sapiens
  misc_feature 1..272: note = chr20:590327-590599
  misc_feature 1..272: note = hyper
  source 1..272: mol_type = genomic DNA
ggccgcagcgagggacgcagcacactcacccccttgcgctggttgctgaggcagaaggtgcagatggagcgcggctggcggccgccgtcggcggcggcggggacggcgcccttggcactgcccgcggcacggaagcacggctgcccgtcgtcggccgagtcgcccagcagcagcacgttggccaggtgcgcgatgtagctggacgccaggcgcacggtctcgatcttggacagcttgcggtccaccggctcggtggggatgagcgtgcgcag

SEQ ID NO: 37859 - DNA, 108 bp, Homo sapiens
  misc_feature 1..108: note = chr20:590967-591075
  misc_feature 1..108: note = hyper
  source 1..108: mol_type = genomic DNA
ggcccccgccttataggcgagggaggggccaatggcaaggccgccccggccgggggcggagggctccgcccggccaatggggaggcgtccgcccggccaatggggagg

SEQ ID NO: 37860 - DNA, 155 bp, Homo sapiens
  misc_feature 1..155: note = chr20:592405-592560
  misc_feature 1..155: note = hyper
  source 1..155: mol_type = genomic DNA
cctggatccccccaccgccagcatttgaccgtgaccccagccaggctgggctttggggaggagggaaacagccagcatgggccccctccccgcagggctggtcccacacacagccccagaccaggctgctgcttcctgagccgatgaattattac

SEQ ID NO: 37861 - DNA, 274 bp, Homo sapiens; identical to SEQ ID NO: 1418
  misc_feature 1..274: note = chr20:644552-644826
  misc_feature 1..274: note = hyper
  source 1..274: mol_type = genomic DNA

SEQ ID NO: 37862 - DNA, 369 bp, Homo sapiens
  misc_feature 1..369: note = chr20:644985-645354
  misc_feature 1..369: note = hyper
  source 1..369: mol_type = genomic DNA
cggggtcgctgtactcctccggcgccgccggcgggtacgcgggctcggccggggccagctccaggcccggcttctggtccgcatcgtagctgctcgggggcaggcggtgcggggcgtaccctggagggggcgagaagtggaggggcggtgagaggaggcgccgaagagggtttcccgctttgagcgcgtcaccctttgcgccttccagcttggcgcccctgtggcagctccgacagtggtggtctccgacctgcacctcagctcttcctgtcaggcagcctgggttcaattccttcctccatcgacggcagtgcaaatagccgccaccccaacccacggagcatggggccagcacggttgtacagagcg

SEQ ID NO: 37863 - DNA, 139 bp, Homo sapiens; identical to SEQ ID NO: 13613
  misc_feature 1..139: note = chr20:656937-657076
  misc_feature 1..139: note = hyper
  source 1..139: mol_type = genomic DNA

SEQ ID NO: 37864 - DNA, 36 bp, Homo sapiens
  misc_feature 1..36: note = chr20:690741-690777
  misc_feature 1..36: note = hyper
  source 1..36: mol_type = genomic DNA
ccccacaccccctcccggccccgggcctttgtgcgc

SEQ ID NO: 37865 - DNA, 96 bp, Homo sapiens
  misc_feature 1..96: note = chr20:708614-708710
  misc_feature 1..96: note = hyper
  source 1..96: mol_type = genomic DNA
acggactggtgcttgcgtgcggggcttttccactggttcccttccgtactcgggcttcccccgctgttgttactccctcaacgggaacacaactcc

SEQ ID NO: 37866 - DNA, 30 bp, Homo sapiens
  misc_feature 1..30: note = chr20:866071-866101
  misc_feature 1..30: note = hyper
  source 1..30: mol_type = genomic DNA
tcaagtgtggtggaacgtcctgtgcccact

SEQ ID NO: 37867 - DNA, 128 bp, Homo sapiens
  misc_feature 1..128: note = chr20:982671-982799
  misc_feature 1..128: note = hyper
  source 1..128: mol_type = genomic DNA
gcccccggtctgccccgcagcgcctgcccggccgccctgcccagccaccccttgtaccttgcttcttccttcggttcagggcgagcatgtccacggcgtgggcgacgagcaggagcaggcagagtggc

SEQ ID NO: 37868 - DNA, 307 bp, Homo sapiens
  misc_feature 1..307: note = chr20:982891-983198
  misc_feature 1..307: note = hyper
  source 1..307: mol_type = genomic DNA
gggggctgctgtgggcgcgccgggcgcatccgccaggcgcgggtcggtccggccgccaggtctagtgagggcgttggcggagccggggcactgccctggcggggaggagccggcgcggcgggggcggcgcgttaaccagctcggggcccgggagcgcgcgcggggagggggcgggggtcacccgggtcggggccctcgagttcgatctgtcccgcagccggcggtcttgcgtctttcccgcccccagcactgcccccgagcacgtgcacgtgcccaccgccagccacaggtacgcacgcgcgcgcag

SEQ ID NO: 37869 - DNA, 50 bp, Homo sapiens
  misc_feature 1..50: note = chr20:1206113-1206163
  misc_feature 1..50: note = hyper
  source 1..50: mol_type = genomic DNA
gcgccaggacaaagccggagactgcgcactaggaccggtgcgccttgctc

SEQ ID NO: 37870 - DNA, 985 bp, Homo sapiens
  misc_feature 1..985: note = chr20:1783321-1784306
  misc_feature 1..985: note = hyper
  source 1..985: mol_type = genomic DNA
tccaggcagtaggttcgccagccattgcttgtgcgtcttcgcggagagagaggggggagatgccccggcgctccttacccggctggataagaccctttggggaacttgctgcttcgcaagtcttacttgtgaggacccggagggtttgcctttgaccccgcctgtgaccttaagaaaacccctttctaccctgcgcctgtcccacagctggaagtgataattttaagaatgaattaagcactcggtgtgtgacactgcggcactaagcactttctggactgtgttaggccccattttacagacggggaagctgaggcctccagaggcggagtaacctgctcatggttacaaagctggtcagcggcgggcaggatttgaatccagggttcccggttcctaatcctctgcttttaccacttaatttatcctgcctccaagggctgctgggaaaaaggcggatttcaaaggagaagcagctaaggaaaagctctggaaagggccaacggagcggatattcccggagcccctctgcgagccacgcgcccctctgggaagcccgcttccccctgcagacaggcgctgtgacacgcttgcgccccggtcgaacaggcgaagaggccgaggcccagagcggcgcagggcgagcctggaggctgcgccccagacctggaccagccacggacgccgctcccgccgctccctccgctccgctgcgctccgcacgctggcgccggctccccgaggccccgggcgccccggccgcacgcctgggtaaaaggtcccgaggagtccgcagaagcgcgcccacgcccgagacggccgtttccgccggcctgggaaaggggcggagaagggggtcgcccgggccgcagcgtgccggtccccgccggccgagccgtgtttggggccagtccccgcaccccgcttcttccccacctggggagcggggcgccgcggtaggggcactggagcgcacgatgcaccc

SEQ ID NO: 37871 - DNA, 155 bp, Homo sapiens
  misc_feature 1..155: note = chr20:2187759-2187914
  misc_feature 1..155: note = hyper
  source 1..155: mol_type = genomic DNA
gaccttgccctgccccgcggcccgcgtcaccatggcaactgcaggcagccagcaccgacggcgggaaaacgaggaccggagccgcgttacagccttggccttcgagcagcccagggagagtctctgcgtcctccagcccccgcttcccttcatgt

SEQ ID NO: 37872 - DNA, 133 bp, Homo sapiens
  misc_feature 1..133: note = chr20:2539419-2539552
  misc_feature 1..133: note = hyper
  source 1..133: mol_type = genomic DNA
ggtgtgttgtggctccgattctgggcattcgctccgcgcgctcccgctccttcgcggcccttccccttcccccgtgagggactgatgcccccctccccggggagaggcagcccgtgccctcgctctggcttcc

SEQ ID NO: 37873 - DNA, 218 bp, Homo sapiens
  misc_feature 1..218: note = chr20:2539553-2539771
  misc_feature 1..218: note = hyper
  source 1..218: mol_type = genomic DNA
tgcctcccagcccttaccactgccccactctgcggtgggttcttcatcccagaaccgggatgaagatcgcgggtccgcgcgggggagtggccgcgggctctccactccagcgcctcgtggcacccggtgaggcggggcgcgggtggagaggtggcggggcgcgggtggagaggtgacagggcagcgggtgggacacgatcccgcgtcccctgaactcc

SEQ ID NO: 37874 - DNA, 136 bp, Homo sapiens; identical to SEQ ID NO: 13621
  misc_feature 1..136: note = chr20:2668792-2668928
  misc_feature 1..136: note = hyper
  source 1..136: mol_type = genomic DNA

SEQ ID NO: 37875 - DNA, 16 bp, Homo sapiens
  misc_feature 1..16: note = chr20:2672984-2673000
  misc_feature 1..16: note = hyper
  source 1..16: mol_type = genomic DNA
agtccaggcacaaggc

SEQ ID NO: 37876 - DNA, 59 bp, Homo sapiens
  misc_feature 1..59: note = chr20:2731616-2731675
  misc_feature 1..59: note = hyper
  source 1..59: mol_type = genomic DNA
actggtggattaggtcggggccaggctatctgaaaagggcggtgcggggatcaggaaaa

SEQ ID NO: 37877 - DNA, 101 bp, Homo sapiens
  misc_feature 1..101: note = chr20:2780664-2780765
  misc_feature 1..101: note = hyper
  source 1..101: mol_type = genomic DNA
gggaactggggctgccgagtcagcagccattgctcccagcagggagttgagggagtgtgagtgtgtatatgtgtgtgtgcactgtgagtgtgagtgtgcgc

SEQ ID NO: 37878 - DNA, 237 bp, Homo sapiens
  misc_feature 1..237: note = chr20:2780885-2781122
  misc_feature 1..237: note = hyper
  source 1..237: mol_type = genomic DNA
tgtgtgcgcgtgagtgcgagtgtgcgtgcggggtgagtgtgcatgactgtgagtgtgcgtgggtgtgcgtgtgcccgcgtgttagggagggatcgccccacggggcaggagagccgggcagtcggcttgcgggggagcggaccgtcggtcggggaactcaccgttagctgtctccgccggcggctgtgccgggctgctatgcagggccggggtcgagcctgggaccttggtggtccc

SEQ ID NO: 37879 - DNA, 823 bp, Homo sapiens
  misc_feature 1..823: note = chr20:2781123-2781946
  misc_feature 1..823: note = hyper
  source 1..823: mol_type = genomic DNA
ggctgcgcgaggcccagcaccgagttcctgggcgcccccagagccgggccgacggccggcgcgaaggcggccagggcgagcaggagcccccacatggcggggattgagtgccaggggcgcgcgggctacggcgggtggcgggtcggtctcttcctgccgagtgcgccgagccccccgccccttcctgccccccgcccctccgcagcctcctgcccgcccacagcccgctgcccgcctcggacctcggagaggaggagagggccgggaggagcgagcggggctgacctccaaggggccgccccaagtctcaggaccgccgactctgcccttcctctccgccgtctggggccaacccgcctcgttggcgcgctgcgcctttatagtctgcaaagccacactgaagagaccagagatcacctggtggccatcaagtcgaccaacaggaggcaaagccccttatctgagcaattcagaatgacacttccctattgtctaaagccacatctggtaccaagcttccgtcccaagaatttataagtaactagaatttctgtacgtttccggaatgagtgcacgttaagacccattgtgcaaactttgctgacatcaaggcaccaaaatatcgacaaatgtaaccatttaccatgacctaagtgactaatgtggtccaaattaccctgcagttccccgcagggagctcagtcctctcttgctgaagcgcctactgcgctctgctgcctcgtcctttccgtctaataaaactttccttttcagacctacacggttgttgataagttcttttaccacccgggagccaaccact

SEQ ID NO: 37880 - DNA, 252 bp, Homo sapiens
  misc_feature 1..252: note = chr20:2785615-2785867
  misc_feature 1..252: note = hyper
  source 1..252: mol_type = genomic DNA
caccatcaccaagcccggccctgcccctcctctcctttcccttccctcccctactccttcgctcactcacccggctgccacgtcccgtcccggggttacataacccggagagagaagcctgagcgatagcctgcgggctggggctgcggtggaggagccaagggttgatgcactgcctgacctgccctccggctcctcgcccccagcccgtattctcctcggggagccggcagccctgggtctgcccagatc

SEQ ID NO: 37881 - DNA, 69 bp, Homo sapiens
  misc_feature 1..69: note = chr20:2820792-2820861
  misc_feature 1..69: note = hyper
  source 1..69: mol_type = genomic DNA
ccctgcgcctcgccacgtgcccgccgccgtcccgcgcatgcgcgcacccgctcgcgccaattaccaagt

SEQ ID NO: 37882 - DNA, 138 bp, Homo sapiens
  misc_feature 1..138: note = chr20:2852976-2853114
  misc_feature 1..138: note = hyper
  source 1..138: mol_type = genomic DNA
ttccggcctggggtgcgtgagggggactcaggggttgcccggtctggaggagagactcgccgccacctaccccgggaaccgcagactctgggtctgggataaagcgtcccctacccgcaagctcggtttgtgcgctac

SEQ ID NO: 37883 - DNA, 168 bp, Homo sapiens
  misc_feature 1..168: note = chr20:3052524-3052692
  misc_feature 1..168: note = hyper
  source 1..168: mol_type = genomic DNA
cggattttgacgccccgcccttgaccgcggtcgaggcccccacggcgccccagcgcgtctcagccccgctgtcccgcccgaactccgaaccccggaccccagcatccttgcccggcgcaccccggccggcctcgcagggtcctccgagcgagtccccagcgccgcccc

SEQ ID NO: 37884 - DNA, 423 bp, Homo sapiens
  misc_feature 1..423: note = chr20:3052693-3053116
  misc_feature 1..423: note = hyper
  source 1..423: mol_type = genomic DNA
gctcccgctcaccccgcccgtccccgcagtgcctcccctgcggccccgggggcaaaggccgctgcttcgggcccaatatctgctgcgcggaagagctgggctgcttcgtgggcaccgccgaagcgctgcgctgccaggaggagaactacctgccgtcgccctgccagtccggccagaaggcgtgcgggagcgggggccgctgcgcggtcttgggcctctgctgcagcccgggtgagcggggcaaggcgctccggggccagggggaggcgggcgggggtgcggccgggattcccctgactccacctcttcctccagacggctgccacgccgaccctgcctgcgacgcggaagccaccttctcccagcgctgaaacttgatggctccgaacaccctcgaagcgcgccactcgcttcccccatagc

SEQ ID NO: 37885 - DNA, 266 bp, Homo sapiens
  misc_feature 1..266: note = chr20:3063125-3063391
  misc_feature 1..266: note = hyper
  source 1..266: mol_type = genomic DNA
gtggtggcgggggtccgcgctcccacctctctccctttccctcttcccgccagagactgagacagacgcgaggccgtgcattggcggaggtttattgtccgtgctgcaggggcgggcgcgaagagcgcgccggtggggcgagcgcggggctcagtaggcgtcgggctgggcgggctcgaagggctcgggcgccccggccagctgcaccagccgcagcagcaaggccccggccggcccgtccagctgcgtggcgttgctccggtcgc

SEQ ID NO: 37886 - DNA, 185 bp, Homo sapiens
  misc_feature 1..185: note = chr20:3063622-3063807
  misc_feature 1..185: note = hyper
  source 1..185: mol_type = genomic DNA
cgtcgttgcagcaaacgccgaaggcggcgcagcggcccccgctcccgcacgccttctggccggactggcagggcgacggcaggtagttctcctcctggcagcgcagcgcctcagccgtgcccacgaagcagcccagctcgtccgcgcagcagatgctgggcccgaagcagcggcctttgcccccg

SEQ ID NO: 37887 - DNA, 141 bp, Homo sapiens
  misc_feature 1..141: note = chr20:3073251-3073392
  misc_feature 1..141: note = hyper
  source 1..141: mol_type = genomic DNA
ccgtgttccaagtgacgtggcctgtcgcacccgccggggacaatgactgcggccctggggtcccacagacgttccctttgctagacttaaggaagagctaggcctgtccgcgctcccagcccccacgcagccagacacccg

SEQ ID NO: 37888 - DNA, 452 bp, Homo sapiens
  misc_feature 1..452: note = chr20:3073560-3074012
  misc_feature 1..452: note = hyper
  source 1..452: mol_type = genomic DNA
cgcagactgctaagagcagcatgagcacggctccggcggcccccagggccccgcgggtcggcgccaccccggagcgcggtgcccggaatcacttagcgccatcagccgggcggctgggagggggaagcggccgatccgggcggctgggagggggaagcggccgatccaggcggcagcggagggggctgcagcggaggcggccccggcttgcacgctcgcccttccgcctgcccggcagggccccgtctgagccccaggccccaggcccagcggcgccgctcgccggtgaaggaaaccagcgcagagaggccgcgctgccaggcgcgtggtggtccgggggtccacgtgtgagcctcgccctaggctgccaattgagagttccacctccgcccagagagaccccacctcacccctccaacctggggcgcgcgggccggcggaggggtcctggg

SEQ ID NO: 37889 - DNA, 133 bp, Homo sapiens
  misc_feature 1..133: note = chr20:3218701-3218834
  misc_feature 1..133: note = hyper
  source 1..133: mol_type = genomic DNA
aacgcccattgcaggcgcagttcccccgacccccgtcacgcgccccgggtcacacgggggccgacaggcaacggtctccagtcctgggaccgcgtcccggccgcctggaagccagagccgttggtccaaaagg

SEQ ID NO: 37890 - DNA, 190 bp, Homo sapiens
  misc_feature 1..190: note = chr20:3220823-3221013
  misc_feature 1..190: note = hyper
  source 1..190: mol_type = genomic DNA
tcagccgcgctgggacggagtcctcggccactgtgccctaaccatggtagaggaacggggacaggccggggcaagcccacctctgcgaaggaagggcttctggcgcgttggggaagcctcatgcatagattgggtgagtaaggctggcccagttctcctcccggcaagataagaacgcattaggagggaa

SEQ ID NO: 37891 - DNA, 39 bp, Homo sapiens
  misc_feature 1..39: note = chr20:3229253-3229292
  misc_feature 1..39: note = hyper
  source 1..39: mol_type = genomic DNA
ttcctcacctccctgcgcggccagcgggggcccggggtg

SEQ ID NO: 37892 - DNA, 57 bp, Homo sapiens
  misc_feature 1..57: note = chr20:3229576-3229633
  misc_feature 1..57: note = hyper
  source 1..57: mol_type = genomic DNA
gttcctactacagctcggccgcggcaggctggggccgagaaccggcacccgtgcacg

SEQ ID NO: 37893 - DNA, 30 bp, Homo sapiens
  misc_feature 1..30: note = chr20:3388937-3388967
  misc_feature 1..30: note = hyper
  source 1..30: mol_type = genomic DNA
agatcctagctctaccggtttctgcaggga

SEQ ID NO: 37894 - DNA, 238 bp, Homo sapiens
  misc_feature 1..238: note = chr20:3641310-3641548
  misc_feature 1..238: note = hyper
  source 1..238: mol_type = genomic DNA
cggggaccctgagggcgaagtcatcggcccacccgggcggagatatcccctggagaacccccgccctcgcccggatcccggccgcgcgtacccacgaggcccgcgtaggcgcgcaggcagcgggcgccctggtccagcaggcagccgtcgggggcgctgggcgctggggtgcacgagacctgaaaggccaggaggcgaggcctgcgcggcgggagggcggtgagccggagagaggccc

SEQ ID NO: 37895 - DNA, 190 bp, Homo sapiens
  misc_feature 1..190: note = chr20:3641773-3641963
  misc_feature 1..190: note = hyper
  source 1..190: mol_type = genomic DNA
cggcgcagggcccggcggcagcgggcgcggggacagcccccctgcgcagcccggcccaggcactgcgccacatactcggagcgcaaacgctggcaccgcgcgtccgccgtgcaggcttcggccgcgtccacacatcggttccctccgaccgagctcgccgaccctgggaaaggcgcggggaggctgcagg

SEQ ID NO: 37896 - DNA, 246 bp, Homo sapiens
  misc_feature 1..246: note = chr20:3662517-3662763
  misc_feature 1..246: note = hyper
  source 1..246: mol_type = genomic DNA
gcctgcccctcagggcgcaccccgcccgcgtcctcaccttgaagcaccccggcgcctggcactggccagagcagcagcagtagtagcagcagcagcaacggggtcccccgagctctccggggcctccagcccatagctgtgagctcctcggcctctaggcagcggctcgcaactccggctccgcccaggctggattgcggccgacccgtgcccggtgcagcctcaggccgccgccttcggaccttc

SEQ ID NO: 37897 - DNA, 156 bp, Homo sapiens
  misc_feature 1..156: note = chr20:3663018-3663174
  misc_feature 1..156: note = hyper
  source 1..156: mol_type = genomic DNA
aggttcttggaggaccgcggcgtggtgggatgaggcggtgggcaaaggccgcctctcgctgctgaagttggccccaggagcgcgatcttccgtggtctcctggggccgatctctgtcccctccttgctacccgtcctgccccgagggtgccctggc

SEQ ID NO: 37898 - DNA, 146 bp, Homo sapiens
  misc_feature 1..146: note = chr20:3713305-3713451
  misc_feature 1..146: note = hyper
  source 1..146: mol_type = genomic DNA
ggcggcgcgaggaggcgggaggcctcagggccgggcgcacgtcgagggctgcggccgccgcagcgggcacggccaacgagctgcgggcccgggatcgcggcggctggacggggctggagctgtcgggagggcggaggtgagttctg

SEQ ID NO: 37899 - DNA, 821 bp, Homo sapiens
  misc_feature 1..821: note = chr20:3758266-3759087
  misc_feature 1..821: note = hyper
  source 1..821: mol_type = genomic DNA
cctccctactcctggcgatcccacgcctcaccccttcctctccagctgctgcggtctccgtcgccgaggtgggtcccaggtaagctcccaggaggggcaggggagcccctcagcggcccgggacagattcccccatggctgagggcatggggaactagcctggatggagacgccgccgtcctcggagctgggcggggacctgattctgggggtgtggacagagccaagggaccgccccccaaggcccagcgccgggagatgcaaggccgggcccaaggtgttggacactgctttgggggacaggctaggtctctgcacgtggcttctgggctctggaaagcggtccattctcctgacccggatctccggagtggtaggaggcggctcagtcccgggcctgcgctcctagagttcctgtcccatctcctcccacgctcacccatcccaaggaaggagggcactcgggccccagcaggctcgtgagagcagcgggctccgccctcccaatggtctatccatcggtgggtgggtccggcgcggcgtcggggctctggcgggtacccgggcgtccccgcgcggcccgggccgccgctcaccgctgcttacgctccgcctgctggagccgccgggagaggtcttcgatccgcacattcttgagctggagcaggtgctccaggcgccttaccttcatctgcaggacctaagccgcaccgcgcaggcgtcaagcctggcggtctgctccctcctgcccggcctctgctggccgcgagcccccacccgcagccttcctagacccctcacctgcacggtctcttgagagg

SEQ ID NO: 37900 - DNA, 48 bp, Homo sapiens
  misc_feature 1..48: note = chr20:3766983-3767031
  misc_feature 1..48: note = hyper
  source 1..48: mol_type = genomic DNA
cttgttcttcaggatcgtgctcagcgtggacggcgggatgttgaagcg

SEQ ID NO: 37901 - DNA, 154 bp, Homo sapiens
  misc_feature 1..154: note = chr20:4202578-4202732
  misc_feature 1..154: note = hyper
  source 1..154: mol_type = genomic DNA
tggtggccgtagacacgccagagagggcggcggcgccggcgacgacggcactggcagcgcaggagacggaggaaggcgcgcttgaactcgcggctggaacaggggtagatgagcgggttcacgcagctgttgaagtagccgagccagaagatga

SEQ ID NO: 37902 - DNA, 113 bp, Homo sapiens; identical to SEQ ID NO: 13641
  misc_feature 1..113: note = chr20:4229392-4229505
  misc_feature 1..113: note = hyper
  source 1..113: mol_type = genomic DNA

SEQ ID NO: 37903 - DNA, 827 bp, Homo sapiens
  misc_feature 1..827: note = chr20:4229735-4230562
  misc_feature 1..827: note = hyper
  source 1..827: mol_type = genomic DNA
tcctgtgacgcggagcgcggctgtccgagagcggagctgcctggcccgggcggcggccgggctccccgaggccggccgtggagtagcaccgaagagccggggcccgctacgcgcgcggcgctctgagcgtgcccggcaagcgggcaaagcggcggctccggggccgggcggtgcaggcagcggccactgcggcgctcccaactcggcgcggggggcgggaccgaggaggggcagcgccaggaaggaggagggggcgacccgggccgagagacgggcgccacactccagggtagaagggacccttcgctcaggacaagcgattgtgtcggggtccggggggctgcggcgctggcgcgcgctcgggtcccgcagcagccacccacgcctctccgcaggtgcccaagcccgcgctctcccctagcggtgccctttgcgttccttcccgctcctctcccggaccccctcccccttggccctcagcggcgtccctcttcctcccgccctctcccccgagtctctcggtcactcgctggtgcccttgggcgcgcggtgcgttgaaggcgtgagtcccgggtcttcgggatcccggctttggccgccagagagcagcaagcgcctgggatctgcggactgcggaccggacggcgcagtgccgctgcgggttgcctcctgggactgcccgcatggatctgccgcacctcctttttctcacgccactggccagggcagggtttcagacgcctctgtccagtgcgatggcgtgaagagagcccaggaagggtcggaagcctgtgctgggcagaggctgggtacgatgggctcaggag

SEQ ID NO: 37904 - DNA, 960 bp, Homo sapiens
  misc_feature 1..960: note = chr20:4803007-4803967
  misc_feature 1..960: note = hyper
  source 1..960: mol_type = genomic DNA
ctctcccgaaaaacacgttctaggcgccgggattccagatacctgggaaatagagtgcacgcagctgttgagaggcctcgcgcttggcttctcctatcactgaggcgcagaggtgctgtggacagcccagacccacacggcgcccgaggtgaaacagaaccctcagtctccctatgaggccactggcactctcggctgtccccagagctctccgacttagagctgaatgcaaagtaagcgctcgaaatgcagaagtagccggggccgcccacggcacctgcctcgctcggggcgagagaagacgccaggctgaggtcccagcgacctcaggcaccagctccgaaggagggcggggagaccgcaaaggggaagtgcccggagggccaacggcccccgcgcaccctgcgcccctctgaagcgcgccgcctccccgcgccggggactgggacctgcctctggggaatccgcctagaagacggcggcggactggggtcgggcactctccagggctgtcaggccctccccagccctgcacctgccgcgccgccccacctcgccaggaagtctcagagaccccggggatggggtgggagcgccttcccatcgcgggctcaaaaagaaggaaggacgcccccaggggtcgtagaaggaggactagctccaagccacaactttcttcggacccaaggcaggccggctggggctccgcgcctacacggcccctggcgggggtccgcgcgccccgggagccccgcggctcggggaggaaagaggagacaagagacaggcgaggattacggggctgacccagccggggtagggaccatcgtggaaaaactttggcgaggtggggggacgcggaaagagagcggcccgcgccctgcaccttgcgccgggcatcccgcgccagtgcctcgctcccagtgccccgcgccccgcgccccgcgccttgccttcacc

SEQ ID NO: 37905 - DNA, 30 bp, Homo sapiens
  misc_feature 1..30: note = chr20:4981307-4981337
  misc_feature 1..30: note = hyper
  source 1..30: mol_type = genomic DNA
ccccagcctgcaggccgacatcctatcagc

SEQ ID NO: 37906 - DNA, 797 bp, Homo sapiens
  misc_feature 1..797: note = chr20:5296251-5297048
  misc_feature 1..797: note = hyper
  source 1..797: mol_type = genomic DNA
tttggtccactcctgcgaggggaggagaacgccgagggacaggaactgcgcgccagcaaaagacaccctaacctggggtgcgcccgccagctgctttcccaaggtgaaaacctccaagaggcgagatgcaaatcccagtggcgtccacacccggaggtgtcttctctccaggtcgcccctccgtctcatgcgacaccccaatccccgcagcctctgctcagcgtgggaccaagaatggggagtcctacccctcctcggctttccagccccctaacccaagacaagagggcgcgcgcccgggctgggacaggtcccagccgcattttcgtagattgcactccccgcccgggagcgacccgttccagcagcccccttcccgccccatcaacgcggccgcactgtcggcgtctagaggcgacatcctggcaaagacaggaatcaagtcagaaattcaggctctagaagcaaaggctgcggtgcctcctggctggaagaaaacggcgggtgggtggaggatgcggtgcgcgggaatttccccacggacgcttgctgtttcctgctcacctttcaggaaggtgcccctctacctgcaccctcccctgcaatttggagctcgtccgcgagctcagctacccgctggctccctctgcccgcgcccgcacaccacagactccgcttaccgtaccctacccggtcctagagggcccagaggggatctcctgaaaccaactcgcctgcttggagccagccccgacgcatatctcgagagtggcgggaggcaaagcagccggaatgcc

SEQ ID NO: 37907 - DNA, 194 bp, Homo sapiens; identical to SEQ ID NO: 4735
  misc_feature 1..194: note = chr20:5297225-5297419
  misc_feature 1..194: note = hyper
  source 1..194: mol_type = genomic DNA

SEQ ID NO: 37908 - DNA, 65 bp, Homo sapiens
  misc_feature 1..65: note = chr20:5297672-5297737
  misc_feature 1..65: note = hyper
  source 1..65: mol_type = genomic DNA
cgtggcaccgcacccgggtcgcgcgcgcaggaggggagagtcctgtcttccggaggtgcccagtg

SEQ ID NO: 37909 - DNA, 180 bp, Homo sapiens
  misc_feature 1..180: note = chr20:5892057-5892237
  misc_feature 1..180: note = hyper
  source 1..180: mol_type = genomic DNA
ggctgagctagggggcgcccgctcctggctgcccgctcctcccggccctgcggcccccgcctgccctttaaaagagcggggcctgcgccggccgcgccacaccgcggggaccaggaggcacgctggttttccggggccgctccatcgcgccttcctcctgcgcctcgcttctccggtcca

SEQ ID NO: 37910 - DNA, 495 bp, Homo sapiens
  misc_feature 1..495: note = chr20:6032710-6033205
  misc_feature 1..495: note = hyper
  source 1..495: mol_type = genomic DNA
cgcagccctgccccccggagcgcacgcgcagcctggctctgcgctcaggccggctgaaaacgcggggcgcccggactcaccccgttcaaggaacgtgccgctgagatccaggacttcgagcgtgaccaggggcgcgccatcctctccagcgaacgccgcctcggcgatgcccccctgggctccgcgacccagcgcggtgcaggagaggttgaggagctgcagcgcggggaagcaggcgaaggcccggggctgcagcgcccgcagcggattcccggcgagcgccagggcgcggaggctgctcagcgcgggcccggtgcacggcggcagagcggccagctggttgtagctgaggtccagggtgtgcagccccgccggcccacccgggccccagcgcagcgcggcgatgcggttgtggcgcagggtcagcacctgcagctgctccaggtggccgagctcggaagtgctcagggcgcgcagcaggttgtggctggcgtc

SEQ ID NO: 37911 - DNA, 256 bp, Homo sapiens; identical to SEQ ID NO: 13649
  misc_feature 1..256: note = chr20:6033206-6033462
  misc_feature 1..256: note = hyper
  source 1..256: mol_type = genomic DNA

SEQ ID NO: 37912 - DNA, 76 bp, Homo sapiens
  misc_feature 1..76: note = chr20:6103795-6103871
  misc_feature 1..76: note = hyper
  source 1..76: mol_type = genomic DNA
agggcaaagggtggccgaagggctgctcggcggagagaaggcggcgagaacccggggcgcacgctcagtatctgca

SEQ ID NO: 37913 - DNA, 187 bp, Homo sapiens
  misc_feature 1..187: note = chr20:6748784-6748971
  misc_feature 1..187: note = hyper
  source 1..187: mol_type = genomic DNA
gagagcacagccacccgcctcggcggcccgggactcggctcgactcgccggagaatgcgcccgaggacgacggggcgccagagccgcggtgctttcaactggcgagcgcgaatgggggtgcactggagtaaggcagagtgatgcgggggggcaactcgcctggcaccgagatcgccgccgtgccctt

SEQ ID NO: 37914 - DNA, 757 bp, Homo sapiens
  misc_feature 1..757: note = chr20:8112265-8113022
  misc_feature 1..757: note = hyper
  source 1..757: mol_type = genomic DNA
actcaaggagaggagcgggagagggcaccctctttcttcctcggaaaataaaacctttgctttctttaggatgggctttctgtctcgaaagcacaacgtaaccgtttgcccgggtttcaagatcagcgcgctgcaaactctcaggcgcggccaggtttcctcaaagagcctctcaactgcgctcttctctgctgataaatgataattctcttcaaaaagctggtttgtggctggcgctggagagctccagctagagccaaaagccaggggttgcctctttggttcctcccgatgggccccttttcccagccagttgggatccaaagacgctccggagctcgagcccaaattcccaagaaaaccccaaagagcgtaaggctcctggggacccctagcacctctgcaaccagggcacggggcatgctcagagcgaatgcgggaggcaggcgttggctgcaatggggctcgggagccaggaggtgccgctgcgtccccgcttcctggcgcctgacccagcgtgcaaagttgggctgggagccgcggggggaaggaaggacccagcgagcgagggtggcggggaaggggggcgggggggaggaggagggaggagggaaaagagcggttagggggggcgccgggcgtgtgtcactcgctctctccctctgtgtatagaggatgtgctgaatggtgcgctttgaggcggcggcggcggaggagcagaatccgccgcgactggcagcctcggctgaccggctcg

SEQ ID NO: 37915 - DNA, 356 bp, Homo sapiens
  misc_feature 1..356: note = chr20:8113288-8113644
  misc_feature 1..356: note = hyper
  source 1..356: mol_type = genomic DNA
atgagcccagatggccggggctcaacccggagtgcacgccttgcaactcaagcccgtgtgcgtgtccgacagcctcaagaagggcaccaaattcgtcaagtgggatgatgtaagtattggggcggcccgagtcggggcgctggctcgggcaccgggcagggcgggcgtcgtgggggtggggcaaggggcgcgttatgcaatgggcgcactgggagcgggcaggggcagcctcgggcgcacaggttggcatctgccaaagcggatgtccaagggcagaagctttgcgcgcgctcctgtttcatcgggcttcagtagttgccatcctttctgggtctggcaggcgccccctgagggtc

SEQ ID NO: 37916 - DNA, 30 bp, Homo sapiens
  misc_feature 1..30: note = chr20:8113912-8113942
  misc_feature 1..30: note = hyper
  source 1..30: mol_type = genomic DNA
cagccaacaggtggtcgttgatgccaaact

SEQ ID NO: 37917 - DNA, 50 bp, Homo sapiens
  misc_feature 1..50: note = chr20:9487096-9487146
  misc_feature 1..50: note = hyper
  source 1..50: mol_type = genomic DNA
ctccaaactggttggcgtggcacggggttggcccttggcttcgcagtgcc

SEQ ID NO: 37918 - DNA, 81 bp, Homo sapiens
  misc_feature 1..81: note = chr20:9487211-9487292
  misc_feature 1..81: note = hyper
  source 1..81: mol_type = genomic DNA
cggactttaggtggacccggaatggaaggagggtttttgctgcccgcatgcccccagggctctttccgggaaatagaaggg

SEQ ID NO: 37919 - DNA, 180 bp, Homo sapiens
  misc_feature 1..180: note = chr20:9487540-9487720
  misc_feature 1..180: note = hyper
  source 1..180: mol_type = genomic DNA
gggccacccatccctcggtccctgagcccaccctctccctgcaggcacagctatcccaggttccggcccatcaagttgggaaatgagacgatccatcagtgccaggctcccgggagctgcagctggctccaagtgcgtggccggaggcgtcccccatctgcacgagtccccagagtcacc

SEQ ID NO: 37920 - DNA, 159 bp, Homo sapiens
  misc_feature 1..159: note = chr20:9487788-9487947
  misc_feature 1..159: note = hyper
  source 1..159: mol_type = genomic DNA
cgcgttgcctgctgtggctttgctgctctgggctacaaggccgggccggcttgggttgagactcccgaggctgcaggcgaggcggtgggtacaaacttccgtagatcctgctgtttctctgaagaagaagaaaaacattggccccggagaattagataa

SEQ ID NO: 37921 - DNA, 184 bp, Homo sapiens
  misc_feature 1..184: note = chr20:9488328-9488512
  misc_feature 1..184: note = hyper
  source 1..184: mol_type = genomic DNA
cgcacctggcgggctggaccgggacagggggcggtgcgcaccggggctcccaagcagccttagcggtggagaccttccgaggggaggcgagcctgcggtttgtctcccgttaaggtggaagactggatttttcctccagttccgatctagggtgaagtcccttctcccgcgccctcatgcccag

SEQ ID NO: 37922 - DNA, 245 bp, Homo sapiens
  misc_feature 1..245: note = chr20:9489471-9489716
  misc_feature 1..245: note = hyper
  source 1..245: mol_type = genomic DNA
gggtttggacctagccgttgcaagtaggcatgacttttatcacccatcgctatacccagagcagctgctcgaatgtgccaaggagcccaactcgggtgcaaagcgccgacgtctttcccaggttgaggacatcgcgagccagaggtgcaggcagcgaggcgcccaacagtagaatgcatcttccttcccgcgggcagaagccgtcaagtctggagtccgcagcgggcgcgcgggccagcccaggg

SEQ ID NO: 37923 - DNA, 314 bp, Homo sapiens
  misc_feature 1..314: note = chr20:9495258-9495572
  misc_feature 1..314: note = hyper
  source 1..314: mol_type = genomic DNA
ccgtggaccgccgtgcggtcctttcctccgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccgtgagtagc

SEQ ID NO: 37924 - skipped

SEQ ID NO: 37925 - DNA, 30 bp, Homo sapiens; identical to SEQ ID NO: 13658
  misc_feature 1..30: note = chr20:9496079-9496109
  misc_feature 1..30: note = hyper
  source 1..30: mol_type = genomic DNA

SEQ ID NO: 37926 - DNA, 201 bp, Homo sapiens
  misc_feature 1..201: note = chr20:9496330-9496531
  misc_feature 1..201: note = hyper
  source 1..201: mol_type = genomic DNA
ttcctcaaggctcttcgaagacctgggttgcccgccttctttcccacaccccggcaggctgctcccgaatgctgcatggggattccagcttgtaatgccttctgttcccctgcctgctttgaaagtaaacccccttctctccgcttccctatcggggctgcacgtagagcatctaaccgcatgttcccggaacctgggatg

SEQ ID NO: 37927 - DNA, 253 bp, Homo sapiens
  misc_feature 1..253: note = chr20:9496580-9496833
  misc_feature 1..253: note = hyper
  source 1..253: mol_type = genomic DNA
cgccctttacagcccccgccccggggccgggcgagctgagggggcgcggggcgtctgtgttcccagctgatcacagaacaggccgatatcgcattgacccggggagctgaggtgaagggccgctgtggccacagccagtcggagctgcaagtgttctgggtggatcgcgcatatgcactcaaaatgctctttgtaaaggtaactccgagcccagcgggcagaggggccgcaggctccgcgtgggtgtgggaag

SEQ ID NO: 37928 - skipped

SEQ ID NO: 37929 - DNA, 248 bp, Homo sapiens
  misc_feature 1..248: note = chr20:9819466-9819714
  misc_feature 1..248: note = hyper
  source 1..248: mol_type = genomic DNA
cgctcccagcgccatgttcccggtctccccgggcgcacgctggggaactactactggctgggtaggggcaaggggggcgggggccagcgggagggggtgagaggcagagccacagctttctactctccacccaaacctcccccagctactgagcatgcccagctgcccggcttcgcccctcggaggactgtccatgagcgtacgcagctgctccgggttttcgtggcagccggcgggaggcaggctgt

SEQ ID NO: 37930 - DNA, 310 bp, Homo sapiens
  misc_feature 1..310: note = chr20:10198421-10198731
  misc_feature 1..310: note = hyper
  source 1..310: mol_type = genomic DNA
cctgatttgagcatccgagggccccccgaggcagcctgcacgggtaccccggggtttgcgcactgagtgaacccccagattcggccgtgtcccagccgtccttgctctgaatcccccacctcctcccggccgtttggacggttccctcggggcgtctgtgcctccgtggggtacccctaagacacccagcatgaaaccccagcaccgactgcaaattccaccgaaagcagagtcatccgtttttgccctcggcaaacaactcaacttcaagcctcgagtccttgcaaacccacgctggctgggctaactc

SEQ ID NO: 37931 - DNA, 15 bp, Homo sapiens
  misc_feature 1..15: note = chr20:10198940-10198955
  misc_feature 1..15: note = hyper
  source 1..15: mol_type = genomic DNA
cggggatgcccctac

SEQ ID NO: 37932 - DNA, 313 bp, Homo sapiens
  misc_feature 1..313: note = chr20:10199315-10199628
  misc_feature 1..313: note = hyper
  source 1..313: mol_type = genomic DNA
tagaaggtgaaaacacgcaggtttgcaggccagcgcactgggaaccgagtcaagcgcgccgcagcccgggccccgcccccgcccccgccgtgccccgcccccacttcctcccgcccctcgctgggcggctattaaaagctgctgacgtcaaaacggacggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggta

SEQ ID NO: 37933 - DNA, 37 bp, Homo sapiens; identical to SEQ ID NO: 13664
  misc_feature 1..37: note = chr20:10200078-10200115
  misc_feature 1..37: note = hyper
  source 1..37: mol_type = genomic DNA

SEQ ID NO: 37934 - DNA, 43 bp, Homo sapiens
  misc_feature 1..43: note = chr20:10200153-10200196
  misc_feature 1..43: note = hyper
  source 1..43: mol_type = genomic DNA
cgcctgctccacgtcaactgcaggctggcgggaggcgggcggg

SEQ ID NO: 37935 - DNA, 78 bp, Homo sapiens
  misc_feature 1..78: note = chr20:13200556-13200634
  misc_feature 1..78: note = hyper
  source 1..78: mol_type = genomic DNA
taaatctttctaggacgcggagaaggaaggtaggaaattggggagggggaaagggaggcgtgccgtcaagaaagagtt

SEQ ID NO: 37936 - DNA, 367 bp, Homo sapiens
  misc_feature 1..367: note = chr20:13201198-13201565
  misc_feature 1..367: note = hyper
  source 1..367: mol_type = genomic DNA
cctgagcgcctgagccgcgggcactgcgtctctgcagcttccagccaacacctgcgcccgtgaccagacgaacgcctagagagtcggactcccctcccttcccaggctctacggggcgccgcggatccgcgaacagccgtgcccggctagcgggcggcccagcaagtgtcaagacccttcggaacgacactttggcactcctcctctcccccgactgcttcaggcaggggtcgcaggcagacgcatggcttgtccggcgccccctccgttttccatcactgcaactccagctccagtttgccaataaaggtttctaaagcagcccaggcaccaccccacccacccacagccccgagcctcagtgtgc

SEQ ID NO: 37937 - DNA, 30 bp, Homo sapiens
  misc_feature 1..30: note = chr20:13202494-13202524
  misc_feature 1..30: note = hyper
  source 1..30: mol_type = genomic DNA
gcgcggctcgggagccgccgacgggcccga

SEQ ID NO: 37938 - DNA, 121 bp, Homo sapiens
  misc_feature 1..121: note = chr20:17206513-17206634
  misc_feature 1..121: note = hyper
  source 1..121: mol_type = genomic DNA
tagctttgaaacagtcgtcctcatttcgttacatacagaacgttcgtgcttcctccctctcaggcaagaagcggagtccgtcgtcagcagttagcagagtccagtgcgagtgcacgtttct

SEQ ID NO: 37939 - DNA, 41 bp, Homo sapiens
  misc_feature 1..41: note = chr20:17206884-17206925
  misc_feature 1..41: note = hyper
  source 1..41: mol_type = genomic DNA
tcctccagtcaccatcgcgggtggggcgagccgggtctcct

SEQ ID NO: 37940 - DNA, 250 bp, Homo sapiens
  misc_feature 1..250: note = chr20:17207260-17207510
  misc_feature 1..250: note = hyper
  source 1..250: mol_type = genomic DNA
cggggcctctgagagcggcacacaccgtaattcccttcccagagcctacagattcccacaaacaatgacatcactccgccgccgctggcctgattacagctggggggattttcctgggcgcgcggcgggccaggctgagatgggggagctctccggtgctgaaaggggcgggggcgcgggctcgctgcgctgcgctgcgctgcgctgcgcccccagaaggcggaggcggccgggccgggccgggccgggg

SEQ ID NO: 37941 - DNA, 56 bp, Homo sapiens
  misc_feature 1..56: note = chr20:17207874-17207930
  misc_feature 1..56: note = hyper
  source 1..56: mol_type = genomic DNA
tttgcaccctccctccgagtcccctgctccgccagcctgcgcgcctcctagcacca

SEQ ID NO: 37942 - DNA, 268 bp, Homo sapiens
  misc_feature 1..268: note = chr20:17208389-17208657
  misc_feature 1..268: note = hyper
  source 1..268: mol_type = genomic DNA
caggatgccatgctccggggatgctgtccgaggtaccaagttctcgaggctgcctggggatggagggatgaagccctgaacagctaagcctggcgttggctacttggccagggaagtctcccccacccccatcccccggagaaagaatagtttcctacagacgaggctggacgtttggacactgcaattcacctcggtgtttctcccaccccgcgccgggaggacttccctcccagggacttcggtccctgctcctctccgggaacaa

SEQ ID NO: 37943 - DNA, 64 bp, Homo sapiens; identical to SEQ ID NO: 13668
  misc_feature 1..64: note = chr20:17208739-17208803
  misc_feature 1..64: note = hyper
  source 1..64: mol_type = genomic DNA

SEQ ID NO: 37944 - DNA, 40 bp, Homo sapiens
  misc_feature 1..40: note = chr20:17209595-17209635
  misc_feature 1..40: note = hyper
  source 1..40: mol_type = genomic DNA
gctgtggttttggcccgtggcctgccggctgttttgagag

SEQ ID NO: 37945 - DNA, 39 bp, Homo sapiens
  misc_feature 1..39: note = chr20:17919829-17919868
  misc_feature 1..39: note = hyper
  source 1..39: mol_type = genomic DNA
gtggctgtgctgggtcgcccctgccgcctacaggcagaa

SEQ ID NO: 37946 - DNA, 289 bp, Homo sapiens
  misc_feature 1..289: note = chr20:18039647-18039936
  misc_feature 1..289: note = hyper
  source 1..289: mol_type = genomic DNA
agctgccgggtgctgcgggggcgcgtctggtcagggatgccctggagcccaaggctcacccaacagccagcctcacctgtctgtaacctgaccctccgcgctcccagcctacagggcccgggaatcaacacagcggttttccctgttcccttccgccctgaatggcccttggggacacaaccgcctggtaacggatttctcggcgctactggcggactcgcgcggcgcagggagccggggcgcagctctgccggggctgcgggcgggaccggtgcgcggcgcctctagg

SEQ ID NO: 37947 - DNA, 57 bp, Homo sapiens; identical to SEQ ID NO: 13669
  misc_feature 1..57: note = chr20:19192824-19192881
  misc_feature 1..57: note = hyper
  source 1..57: mol_type = genomic DNA

SEQ ID NO: 37948 - DNA, 257 bp, Homo sapiens
  misc_feature 1..257: note = chr20:19193359-19193616
  misc_feature 1..257: note = hyper
  source 1..257: mol_type = genomic DNA
cgggtgggagcgcagcgaggacgcgcggctgctgcgcgcagggctgcctcctgccgctgtccccgccgcggccgcccgcgacaggagcggccgccgcccgccgaggccgccgcccggccgcccgaggatgcggccgtccggcgacgaggaccgcgcgcgtcgccgccgccgccgccgccgccggagggaccttctgctgagccagctctgcttcctggcctcggtggcgctgctgctctggtcgctgtcgagcctgc

SEQ ID NO: 37949 - DNA, 111 bp, Homo sapiens
  misc_feature 1..111: note = chr20:19739455-19739566
  misc_feature 1..111: note = hyper
  source 1..111: mol_type = genomic DNA
agctttgatccccagcgcggaccccactggtgagtccagccagtgtgcagggcagatgctccgaccggagatttcctcccccgggtggaaaagcaggagggttgttgtgtc

SEQ ID NO: 37950 - DNA, 174 bp, Homo sapiens
  misc_feature 1..174: note = chr20:19739612-19739786
  misc_feature 1..174: note = hyper
  source 1..174: mol_type = genomic DNA
cgggcggaggaggagccccggattcctgccgggaagggacggggccactttcccactttgaggcctccccgcccccttctgggcttggcctccacccttggcctgggctcccaccagctcggcgtccacccaccggcggtggcgcgcccctcgaccgcgcggggacagcaggat

SEQ ID NO: 37951 - DNA, 1028 bp, Homo sapiens
  misc_feature 1..1028: note = chr20:20344402-20345430
  misc_feature 1..1028: note = hyper
  source 1..1028: mol_type = genomic DNA
tcctcctgcggcaggcgaggcggggtgcaggtgtgagtggggtgggaggaaggggaaaggatcggggtcgccgcagcctttctggtcagtttcgctgggttttgtcagttccgtttgagaccgaggcgcacggactagcggccgccagcacctcacaggtggaggacacctcttgcgccccaaggtcaatgtcatcccgatgggtcccgtgccgtcctgactctccctgacctaattctttggttatgactttctcaccttctgggcttcgcctctgccagctttcgccgacgtcgcccttcccgccgcccgcccgggccttcctacccgctctcctccctccctggcccgacggtcccactgaggcaaaaacaaacagccctgagggcacttcaaggagcgtgcagtggccccgacggtactctcggggggataaaagaggtggccagccacgccgtcggcccccggccgaataatgggcgcgcagcagattgccagggggcacttgaaactcgaggggagggaaatacttgagcgcggtccctccccgcgaggacgcacgacgcagcctcgcggatcgtcccttgttcgctctctttcatgcactctccttttgtgtggaattatctaaacgggagatccctggcagctttatgctaatgcgccgaacaaaggcaacggcccgcgggcgggaggcccggaaggtgcctggggccgggccgggcggggtggcggccaggcgggctgcgcgtgtctctcgcgtgcccctgggactgacacaacaacccctcattcctgcaaatacaaagcctctcaccggctcgggtcgggcgcacccggcgcagggaggcgctggtccctccgggcggcgggcactgcagcggtaacgcacggttcctgccggttgtggctcgggggactgagggccgggagtgggggcttctgtgaagccagaagagaagtctgcagcagagtggtgatgaggggcgctgacacctcacccccaacgccgacgtctccaaacgcga

SEQ ID NO: 37952 - DNA, 10 bp, Homo sapiens
  misc_feature 1..10: note = chr20:20346166-20346176
  misc_feature 1..10: note = hyper
  source 1..10: mol_type = genomic DNA
gggtggtgaa

SEQ ID NO: 37953 - DNA, 377 bp, Homo sapiens; identical to SEQ ID NO: 1426
  misc_feature 1..377: note = chr20:20347333-20347710
  misc_feature 1..377: note = hyper
  source 1..377: mol_type = genomic DNA

SEQ ID NO: 37954 - DNA, 486 bp, Homo sapiens; identical to SEQ ID NO: 1427
  misc_feature 1..486: note = chr20:20347736-20348222
  misc_feature 1..486: note = hyper
  source 1..486: mol_type = genomic DNA

SEQ ID NO: 37955 - DNA, 28 bp, Homo sapiens
  misc_feature 1..28: note = chr20:20348257-20348285
  misc_feature 1..28: note = hyper
  source 1..28: mol_type = genomic DNA
cggctccggctcgcggattgaaccctcc

SEQ ID NO: 37956 - DNA, 1781 bp, Homo sapiens
  misc_feature 1..1781: note = chr20:20348765-20350546
  misc_feature 1..1781: note = hyper
  source 1..1781: mol_type = genomic DNA
ggcgcagagctgggccgagccgtcgccggcgccacgcgagtcccgcagccgccgcgcccgggcaatgggccgggggcactgagggccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgcagggcccgcgggccgcgcacttcggcaaccccgaggctgcgcaccccgcgccgctctacagtcccacgcggcccgtgagccgcgagcacgagaagcacaagtacttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctcaagatgggcacggcgttctcggctggcgccgaggcggcccgcggcccgggccccggccccccactgccccctgccgccgccctgcggcccccgggaaagcggcccccgccccctaccgccgcggagccgcccgccaaggcagtcaaggccccgggcgccaagaagcccaaggccatccgcaagctgcacttcgaggacgaggtgaccacgtcgcccgtgctggggctcaagatcaaggagggcccggtggaggcgccgcggggccgcgcggggggcgcggcgcggccgctgggcgagttcatctgccagctgtgcaaggaggagtacgccgacccgttcgcgctggcgcagcacaaatgctcgcgcatcgtgcgtgtggagtaccgctgtcccgagtgcgccaaggtcttcagctgcccggccaacctggcctcgcaccgccgctggcacaaaccgcggcccgcgcccgccgccgcccgcgcgccggagccagaagcagcagccagggctgaggcgcgggaggcacccggcggcggcagcgaccgggacacgccgagccccggcggcgtgtccgagtcgggctccgaggacgggctctacgagtgccatcactgcgccaagaagttccgccgccaggcctacctacgcaagcacctgctggcgcaccaccaggcgctgcaggccaagggcgcgccgctagcgcccccggccgaggacctactggccttgtaccccgggcccgacgagaaggcgccccaggaggcggccggcgacggcgagggggccggcgtgctgggcctgagtgcgtccgccgagtgccacctgtgcccagtgtgcggagagtcgttcgccagcaagggcgctcaggagcgccacctgcgcctgctgcacgccgcccaggtgttcccctgcaagtactgcccggccaccttctacagctcgcccggccttacgcggcacatcaacaagtgccacccatccgaaaacagacaggtgatcctcctgcaggtgcccgtgcgcccggcctgctagagcgcgccctccaccccggcccccgaactgtgccttcgcttggagacccacaaagagagtgcgccctgcactccccgaacccgagtccgcgctgggggagcc

SEQ ID NO: 37957 - DNA, 303 bp, Homo sapiens
  misc_feature 1..303: note = chr20:21080654-21080957
  misc_feature 1..303: note = hyper
  source 1..303: mol_type = genomic DNA
gcaaattctgacctccgatggcgcctatcaattaccccgcccgcagtgaaagcgaaagcgacagtttcttctcttcgcttttttttcttttttaagaactcgaaaaaggaaatatttgcaataagcaggcggtagtagcacttcgtagctggaattatttaattgaatcttcaagtttttagggatgcccgtagaggataaaaccccagtgctcagcggagagggtgggaggggtacagggggcggaggaatctgttggtttgactgtacacctgcgggcggcggcaaaatacagccacgagc

SEQ ID NO: 37958 - DNA, 817 bp, Homo sapiens; identical to SEQ ID NO: 1430
  misc_feature 1..817: note = chr20:21081028-21081845
  misc_feature 1..817: note = hyper
  source 1..817: mol_type = genomic DNA

SEQ ID NO: 37959 - DNA, 30 bp, Homo sapiens; identical to SEQ ID NO: 1431
  misc_feature 1..30: note = chr20:21082094-21082124
  misc_feature 1..30: note = hyper
  source 1..30: mol_type = genomic DNA

SEQ ID NO: 37960 - DNA, 1067 bp, Homo sapiens
  misc_feature 1..1067: note = chr20:21082215-21083282
  misc_feature 1..1067: note = hyper
  source 1..1067: mol_type = genomic DNA
cgggccccaggttggagtagccacgctagcggctaggccgttccaccgggtagctccgcccttccttttgctcaggcagctaactttggagccgggcaagacgtgttttcccgctccttcgaatttaaccgcccagtgcctgcctcctggaaaagctgtcacgattgggcttgggcttgggcttggccttggtcaagaaaggtttcctcggctgcgccaccgtggggatggaggtgggagttggaacacagccccctagctgagtgcaggggccagaggctggcgggggcacgcgggggtggttgggggcggagtgcggcgaggggtgagggcgcgaccgccttggggcaggggcggcgatggagtagctccgggctctccacggactcgattggacagccccaggccggctttggatccttggaggcggatacgcaaggccagacctggtggcgtggccagttgggcatcgcggtatcttccccaggcctggagggcagtgctgaaggcccgcggccgaggttttgctttaagtatacttgggcctcgcaactcagctgtttgcgaacagagacctggcgaatcgccgaggagcggcgcggctccgcgtccccacttcaaggccaagtggagagtgaggacacgctgaggccccctgctacctatcatgccatcttaagcgggcaccgactccttacccagaaaagatcctggagctaaagcctgcgcctacaccagagaggggaatttaagtttcccactctcgacgtgtctggaaccttccctctagccgcatacccacaaccccctgctccctggctcctcccagtgtcaaggaaggagaaagactcccaccctgtccccaaagtctcagactaactcgctccaggtcacaggacccactaagagggcctttccagctcatgcccggaacaggggtgcagcggcgaccctctgggatctggagagagagaatttaacacggccttcctgaagtacattcacgcaaatgtgagaaagacttcaacgcacagaatcgccaaagcccttgccgtcttaaataaatc

SEQ ID NO: 37961 - DNA, 972 bp, Homo sapiens
  misc_feature 1..972: note = chr20:21083498-21084470
  misc_feature 1..972: note = hyper
  source 1..972: mol_type = genomic DNA
cagcgaaccccagctcgccggtggccgctcaccccgctcgcctctctctccctctggactcggtgctgaagccccagtgcagctcgctcctccttctgtcagcagctggacccggaagccctgactcccggcttggcgcctgtgctgagagcggagaaggacgtcgcgaccggcaggcctggagggcgcattggtgtgcagagtgtagcggctggtctggccctgggaaccccagacccgcgaagctggagggcgcactccccggcctcagagccccaaaccggaggcgctgtccaaacgcgccaacgctgcaagcaatgtggcagggcacaccgaaatgcgtgtctcgcacacctgcccatctttccctgctcaacacgaaagcgccttgtggctctaagcgcttccttggggtggctggggctgtgcattttaattccaaagtcaagaggttgaaccatctcaaagttggcgggtggagggggcggtggcagggaactagatggctggatgcctttgcctgcggggtggcagggctgtccctaccaatagccacggctcggggctggctttgtagttatttttccaagttctgcccggtgcccatcatattgccctgaaaagcaaaagaggccgatgcaatttattccaatgggcggtttttaagaagctggcaatttgaaccggctgggtgttatttagtgcaatatgaaatcaaatgatcctatttctcaaataacagtgtctgtgaggagaagtgaatcctctgaaagggtaattgtctgctgatggtgtttcccattatacccgatcttggcctaaatggtgttcggcagcggggcggagagcgaggggtgaaatcaatgtgcgccaactcgcgctctggagacaggaaaaggtagcaccgctggcgtcctggcacgtcgagcgaacaatgccaccccacgcgtcactgatcgactcatcttgcag

SEQ ID NO: 37962 - DNA, 377 bp, Homo sapiens
  misc_feature 1..377: note = chr20:21085775-21086152
  misc_feature 1..377: note = hyper
  source 1..377: mol_type = genomic DNA
ctgggttcagcccaccgggtcccctttcgaatgccatttcccagctgaaaatccagccagcacagcctggacgccgagccctctggagccctggtcaggacgctttaattttcaccctcccgctctgggtctgaacaacccccccgtcccccgccccccaccccaaggtgttgtttcctagggtcttctggggacatccctacctgtcgagggcctgccctcctcgggctaaaagttcagcccttcgacagagccatggaataagaggcgactctccctgtgtcccgcaagtggtttctcgaggtacccctctgaggctgcagcccccggagcagacctggctctgcatagcagcaaaagcaaccgcctacctgggc

SEQ ID NO: 37963 - DNA, 430 bp, Homo sapiens
  misc_feature 1..430: note = chr20:21086194-21086624
  misc_feature 1..430: note = hyper
  source 1..430: mol_type = genomic DNA
cgccggccccctcacccggcgagggccctgcgctcacacttcttccaggggaaggagtggccacgcctgagcccccctaaacgacctcttcaggagaaaagagtgccggccaggagtccctccagtaacctcagtttagatcgggttttcgcgcctcccctaggaatccggctggaaaccccggagactctgcgcctagagttttgcgggcgtctctctgcctccccgcagcttccggctctcgcaggcttcatccactccctcttcccccggacctgcctgaaccccgccgagcactaggcaaggccgggctctgcgggctggggaaaagaaggggcttggggtggcccaacccgaccgccacctcggcccggcctgcggggaaaccccacaaagtcaaggcgcggggcggggtcggggggatgggatc

SEQ ID NO: 37964 - DNA, 282 bp, Homo sapiens
  misc_feature 1..282: note = chr20:21086906-21087188
  misc_feature 1..282: note = hyper
  source 1..282: mol_type = genomic DNA
ctgaccttgggaaggcgcagacccaccgctcgccaagcctcgccccgcactgtgcacgggaagagggggctccgcgcgcagcccagtccggttagctggtcggcgtcggcggggctgccgaggtggcgcagagctcccctcccccacgccttataatttaatcacacgcgatattaaattatcaagctgctcattaatcatcacgcgagttattgggactgaacacgccgccgcgtgttttgacagcccagaaccattcgcgggggtcggggtgtgtctggg

SEQ ID NO: 37965 - DNA, 39 bp, Homo sapiens
  misc_feature 1..39: note = chr20:21372154-21372193
  misc_feature 1..39: note = hyper
  source 1..39: mol_type = genomic DNA
ccgcgacctcgcagccgggggcgggatggtggcggcgcc

SEQ ID NO: 37966 - DNA, 437 bp, Homo sapiens
  misc_feature 1..437: note = chr20:21372294-21372731
  misc_feature 1..437: note = hyper
  source 1..437: mol_type = genomic DNA
cgcccggcgcctgggtctcccctgcggctcgctagtcgcccggcccagcccgcagaccccgcggctggccctcccgggagccccgcgagccggccgcacgcacaggatgggcgcggaaagccccttcctctaccctcgggcgcaccctccttcctcgtccgcggcgccgcagcttctcaacctgccgctgcatctcaactccctgcaagcagcagagctgtagaataccagaaatggtcttccttccgaggctgccgttttaagttccaagtgtgaaagtaaccgaattttgctatgcttagaaatctaaaatctggacattccctgaagagtcaacttagagtccccagtttctcgatctggctccgtcccactgactgacgcctcctgcccaccccgaaaggatcctggagctgcgatctcgccagactctattc

SEQ ID NO: 37967 - DNA, 130 bp, Homo sapiens; identical to SEQ ID NO: 1436
  misc_feature 1..130: note = chr20:21376207-21376337
  misc_feature 1..130: note = hyper
  source 1..130: mol_type = genomic DNA

SEQ ID NO: 37968 - DNA, 32 bp, Homo sapiens; identical to SEQ ID NO: 1437
  misc_feature 1..32: note = chr20:21376702-21376734
  misc_feature 1..32: note = hyper
  source 1..32: mol_type = genomic DNA

SEQ ID NO: 37969 - DNA, 253 bp, Homo sapiens; identical to SEQ ID NO: 1438
  misc_feature 1..253: note = chr20:21376876-21377129
  misc_feature 1..253: note = hyper
  source 1..253: mol_type = genomic DNA

SEQ ID NO: 37970 - DNA, 168 bp, Homo sapiens; identical to SEQ ID NO: 1439
  misc_feature 1..168: note = chr20:21377473-21377641
  misc_feature 1..168: note = hyper
  source 1..168: mol_type = genomic DNA

SEQ ID NO: 37971 - DNA, 920 bp, Homo sapiens
  misc_feature 1..920: note = chr20:21377737-21378657
  misc_feature 1..920: note = hyper
  source 1..920: mol_type = genomic DNA
cgagacgccgggcggcatgtggtaggtggcggccgccgccgccgcagctgctgccgccgccgccgcggccgccgcgttgtgacccgccatggcgtgagaaggctgcatgcccgccacggtcgccgcctgcgaggagggcccaggtggcggcgcgcggtaggcggccgcggcccccaggggcgcccccaggccgggtggcgcgccgtccatggcgccgctgaacttcttgtaggtctcctcgatggggctcaggatgtcggacacggagaagggcgtcgtgtgctttgggctcaacgacatggctcggcgggcagccaggtaggggggcctggggcgcgcgccggcaggacgcggcggccgctcgtcgccgccacctcggccgcggcagctgagcctgtgacgaggagtcggcggctcggcgagccccccgggctgcgggatctggggtttattttagtccggcgccaggtttacgacagactcggggggcggagcaacatcccaaacgagcaaacaatggtcattgacatctttttctctcgcccccccaacccccgccccataatggaggcaaaaaaaggtaaaaggggcagttgggtgtttcttggaaagatcactccccgttgcttttcccatctttgcttttcccatcctttgcttttcccatccttcgctcctccatccgcggccgttaccccagccctcgagcaccagaaatagaaactcggaggctggcgtcgaggctagacatggactccgcgcctggccccttccagatcccagttttctaaagtgacttcgcaccaaagtccggtataattgcggaatggggaacgtgctgctaagtttggggggagggtgttgcgggggcttgcttcgtcctctccagttatcagcccctcattcgctccatcacctaa

SEQ ID NO: 37972 - DNA, 730 bp, Homo sapiens
  misc_feature 1..730: note = chr20:21485930-21486660
  misc_feature 1..730: note = hyper
  source 1..730: mol_type = genomic DNA
ctcgcggagacatctcgagtcccgcaggtgtctgagctgcgctgcgcgccccagccgggaagccttttcttatccaaccgcgccgccccgcggaaagcctgggtactgcagacgccctcaccggcccaccgacagctggttttgaagcgggggcttagaaaagtaaaggggacagtgtttggagccacgatgcctttgatgtgaggcggttccacccaacaatcaacgaatcaagctggaactgcaggccctacttttgttggggggaggaccttaaggaatgtcacccccttgtcccctaccctctgccccacgcccagcctctcagaaggcaccaggcgtgagtagagtgcgaggcgtccacaccctcgtgtcccttccattcccggacacctttgcaccctagccgaggcctcagcacggagtgagggttgcctggggtgccctgctgtgtgtggggcgttcttgcctcccgggccctgaccccacggtctgggtcggcgaggcgtctctccctggcgtctggactgtgcgcctgccccgcttccaggcgacgaacggcaggagccgggggtccggcgggacccggatccagggcgggcggaaggcgagggtctctccttcccggaacccccgccccggaaacctgcaaccaaaccgggtccctcctccgcatcgctcccgcgctcccgggccgcctccccacgcgggcacccactctccgggccct

SEQ ID NO: 37973 - DNA, 132 bp, Homo sapiens; identical to SEQ ID NO: 4760
  misc_feature 1..132: note = chr20:21486785-21486917
  misc_feature 1..132: note = hyper
  source 1..132: mol_type = genomic DNA

SEQ ID NO: 37974 - DNA, 627 bp, Homo sapiens; identical to SEQ ID NO: 4761
  misc_feature 1..627: note = chr20:21486954-21487581
  misc_feature 1..627: note = hyper
  source 1..627: mol_type = genomic DNA

SEQ ID NO: 37975 - DNA, 356 bp, Homo sapiens
  misc_feature 1..356: note = chr20:21488158-21488514
  misc_feature 1..356: note = hyper
  source 1..356: mol_type = genomic DNA
gacccaaattatttccgactgcctcgcgccaatttggaccgcttagaggaggcaaaaaatgggcaaattccttggaagccctgctgtgtctccctggtactgaattttgtaagcacgcgatacaggagacattgaaaattaaagaggaagtatctccctcctccaacatggggagagacgctgttggaagaagtttctgaagtggtttcccatcgcaccaagaggccagtgggatggatccccgcgcataattcaaaggaacgcgcgcgtctttagctcttcggggttggtaaccaagtggtccggccgggcgcaagtcgccttggaaccggctgcagcccaagtctagctgggcc

SEQ ID NO: 37976 - DNA, 206 bp, Homo sapiens
  misc_feature 1..206: note = chr20:21488591-21488797
  misc_feature 1..206: note = hyper
  source 1..206: mol_type = genomic DNA
cggggccggtcggttgcgaaatcagggggtggattttcatctacccaggagccgctaagcccgtaggggaccgagcatcacccaggccctgggtaccctgagttgcctcctgagccccaggacggtccgatggtgcagagctcccaggcagaagttagtttcctgatacacacacagcagtgagcaaagtgcgcacaagtgagcca

SEQ ID NO: 37977 - DNA, 57 bp, Homo sapiens
  misc_feature 1..57: note = chr20:21488998-21489055
  misc_feature 1..57: note = hyper
  source 1..57: mol_type = genomic DNA
caactttcagtgtcacggggcctaggcggggcaagcgccctccgaagccatcaaaga

SEQ ID NO: 37978 - DNA, 159 bp, Homo sapiens
  misc_feature 1..159: note = chr20:21489288-21489447
  misc_feature 1..159: note = hyper
  source 1..159: mol_type = genomic DNA
acttctgcctgactccgggattcactgccggcgataagcgcgctgaatggtgcggggtggggcggggggtggggggcgggccccttctccttcttcccctctctctgtccccgcgatcctttctctgtccctttttaatatgcacgcctctaacatctc

SEQ ID NO: 37979 - DNA, 82 bp, Homo sapiens
  misc_feature 1..82: note = chr20:21489621-21489703
  misc_feature 1..82: note = hyper
  source 1..82: mol_type = genomic DNA
cgggcgccgggtccacctcccgggctcccggccggccacaggagcgcacacccagattgcaggcccgcggtcctggccacag

SEQ ID NO: 37980 - DNA, 588 bp, Homo sapiens
  misc_feature 1..588: note = chr20:21490175-21490763
  misc_feature 1..588: note = hyper
  source 1..588: mol_type = genomic DNA
tcaattatccaggggcggtgtggaacgcgggaataaagtgtcatcgcgtccctgggctgctgcgcagagtgctatcgacgcacagatttggtcgcacggataatcatgtttgctttagatattgaattaaacctgatcatcaactacagggagcgagaaagtcagctgggaccgctccttttgcccggcctcctcactgccacccaaccccccagccttgatggtgcagcttcggagagaacagagatacaatttccaaatgcgccgacgttcagtccctcagcgtctgcagcacccgctgggctctgagctagagtcccaagtatttttagaaacccgcgagatagaggagaaaggctcatcctccagttggccaggcttcctaagacgctcccccgcgtggccaagtgtgcgccagcatctgccaaggagatcttcctccagcaacaagggtgggacggaatccgttccccgccggaaagatggatgcgcccttcccgggcgtgcccggggctgtgtgcccacttcccatccggggagctcaccccacccccaaacctctacttcctagcaatccacccagttcca

SEQ ID NO: 37981 - DNA, 532 bp, Homo sapiens
  misc_feature 1..532: note = chr20:21490814-21491346
  misc_feature 1..532: note = hyper
  source 1..532: mol_type = genomic DNA
cgctggagggaaggaggcccgggatccagtccccggagagaggcctggaagcccggaaaggatgggagcgtaagggaagggagaggcatggtttgctgggattgccaaagattctcgctccctggcttcctggggccaaagatcctagggagggctgcagtatcccctccctcccccgagcccagaaccccgcgtacttcccccaagccccctaagccaaagcctcgcgcgccctgaccgttcccacccccagccttagcggtctcctaggtcagcaccagcccgcagattttgaaaaggagtggggagtggggagaaggcagccagtcttaacctcagacccccacccacccactttcttagcgtgaggtaagtcaaatgtaacaaagtgaaagtcatcgagtgtagtggcttcaacagcttctcaggctgaaggagccactcatagatttgggccagcgaggggggtttgctctcctcgcctttgcggctcccgaagtcacttttcctcccgtagccggacgctgccgcc

SEQ ID NO: 37982 - DNA, 107 bp, Homo sapiens
  misc_feature 1..107: note = chr20:21491616-21491723
  misc_feature 1..107: note = hyper
  source 1..107: mol_type = genomic DNA
cggcgcagtaggacaaacgggagggcagggattttttctttttttcttttttaaacacaggatttttattaaaattcttatttaaaaaatcgaaagctttctgcgcc

SEQ ID NO: 37983 - DNA, 319 bp, Homo sapiens; identical to SEQ ID NO: 1445
  misc_feature 1..319: note = chr20:21492507-21492826
  misc_feature 1..319: note = hyper
  source 1..319: mol_type = genomic DNA

SEQ ID NO: 37984 - DNA, 111 bp, Homo sapiens
  misc_feature 1..111: note = chr20:21492990-21493101
  misc_feature 1..111: note = hyper
  source 1..111: mol_type = genomic DNA
cgctttcgcttcttgccggcgtcccccccgccgcccggggtctccttgtcattgtccggtgactcgtcggccgagggctccggggacttggagcttgagtcctgagggggc

SEQ ID NO: 37985 - DNA, 892 bp, Homo sapiens
  misc_feature 1..892: note = chr20:21493102-21493994
  misc_feature 1..892: note = hyper
  source 1..892: mol_type = genomic DNA
ccccggcagccagaccgtgcactggggggagggggagagagaagcgcgtcaggcgtctggaggccgcgcgcagcctgcaccagactcggagcaccctggatcctccgtgcgaccctggacctccgcgcctggcagcccagccccgctgcctttgccatgacccctgccttcctctacgcctgacgaagacgtcgggacctcccagggtaaagagggaaatccgtaggagtgggggctaggggctcgcctttcaaggggctcacatagtgtgggtgagaatttggggggggaagtggcactgaagatcatcgcgggttaagggctccggcgcccttaagcggtttcctctccggcgagacgtgggcagatttttaaaagaaataccccacaatcccagcattgatcggctcggccatttaaggcaggtttttgggggctttcgtttctgctttcgggccttctagacaccccctgcactgcacaaagcgtcctctatgatcgcgcagggggcagggtgagctatttatacccgggccacccgaagcctccccaccctccacccgtacccggacgaggctcgctggctacctccagggcgccaggccagtccctcccagcggccggagtccgggggctgcggctggagccatcggtccgggttgacatcatataccagcccctgggaggtatagcccttctccctctttctccttaacttctcgcattgaaaaaaattttggagaccaagttctttcccggaactaaggaggcttgaagaggagggcagaggacatcctatacaggtgttaaaaatctttctacggatccgagtgagggggtccgggcttacatggccccttcccctttcactcccagcgtccaacccgggctg

SEQ ID NO: 37986 - DNA, 416 bp, Homo sapiens
  misc_feature 1..416: note = chr20:21494360-21494776
  misc_feature 1..416: note = hyper
  source 1..416: mol_type = genomic DNA
cgtggcgctcccctgccccggcgggcgggggaggggggagttggggggagggactgggggaggggaggggggaattggctttaattattgggataattattatttttaaaaagagaaagaaactggggatggggaggaaaaaaatgaagcccaacccagtgcctctctctgtcttctttgaaagcacgcggaaatggacgcaggaagccgggcggcctgcgcgccgagcgccgcgggccccggccttagtttctaactccaggaggggtgccaaggcggcgtcagctcgggctccggcggccgctcggcgcgcggtggcggctggtggcgaggaaaaaatgggccattgcccgagcgatcagtccatataaggctgggctccactcacgaacctggggaggcggggagagggggag

SEQ ID NO: 37987 - DNA, 51 bp, Homo sapiens
  misc_feature 1..51: note = chr20:21494991-21495042
  misc_feature 1..51: note = hyper
  source 1..51: mol_type = genomic DNA
agatgagaggtgtaacgtgtcaattaattgcaaagacggggcgagcctttt

SEQ ID NO: 37988 - DNA, 536 bp, Homo sapiens
  misc_feature 1..536: note = chr20:21495942-21496478
  misc_feature 1..536: note = hyper
  source 1..536: mol_type = genomic DNA
agacccagaaagctgcgggggaggggggtcgctgggtggcccgacgatgcctcgttttctccccagttttcttctcccacgcgagttctttagtgtggtctctttttggacgccttgggtgcgttcggagtacgcgctccacgtttccaggttaagtcaggttagtgtgaagtttccagccactctcggctctgggaactgaactttcccgggacttgcacttcctcctcggcgctggggttggaaaagaccacgccgcatttgccaccccttcttctagttaaaacttttttggggggggggtgcaggggtgtagattggctacctgatgctcgttcgccccagaggagtgtcaggaaggagctttgtctgggggcggggaggggcacagaaggccacccctgcggggtccaggtctagtcttcccacaacctgggctcctccgcgcgggccaagctgagcgcgcgggcaccgggtcctcctcgcgcgcagctgcagcggacgccgccgcgccccagctgcccccgggttgccag

SEQ ID NO: 37989 - DNA, 453 bp, Homo sapiens; identical to SEQ ID NO: 4769
  misc_feature 1..453: note = chr20:21496683-21497136
  misc_feature 1..453: note = hyper
  source 1..453: mol_type = genomic DNA

SEQ ID NO: 37990 - DNA, 1522 bp, Homo sapiens
  misc_feature 1..1522: note = chr20:21497413-21498935
  misc_feature 1..1522: note = hyper
  source 1..1522: mol_type = genomic DNA
tttggcagcaagtgtcgtttctcgcatatccccagagccctcttaggtgggggagtgcccgcagaggcctcccaaagcgtgttcatttcttcagctgggaaccacctcgctgaagttccatgtagttcccaacttctctcccccttccccagcatagtgaccctttcttctcaggatctaaatcagcaccgctgctattgatcaagtcccctcccctcacccgtgggagcctgcaaggtccgcagagcgcctgagagaggattgctttcctaggggaatcctggctcctggaattaatcacggggagggagtgctgccataggcgcctagagaaggaggccctcagcccagttctcaaaggtcgggtttgcctttgcgcctgccccttagcctcaatgaccagccgaatccttctgggtctcagcttgcggtgtcctcttgtcggagcacctgaggcgcccacttcccctgccctcgcaggacgcctcctggactccggcccctcctacactttcaccccagcgagtcttccagtttttatttcccctggcctgggggcagctgggcagggagggagagaattggagagagcttcggccttgcctcctccgcgatcggtgcttccgggtccacagcactcagcctctcccgggacctcgagactcatttccccatcacttctcgtccgtgtggttcccgcgtccatttccagagcgttaacatttgcaattgaaaaggcgctgggagaccgctgggaggtccgtaattgaaggggagaaactgggcttgttagtggaagatcataaaatgcaagtcccccaggagcggcctgtggacgccgggaggcctgcgcaggcccagctggcggccagggcaagtccggtgcccagagcacagtccagtgtctcctcaatttcttgggcccggcttgcgcccaaagagcctaggggccaggcgccaaacgcaccttttctgtcccaattaaacaggtgattgcatcctgaggactccccaagaggcctccccgagagtaccacagctaggccttctagagcccaggagctttggttctctgcgatcccgcacacccgcaggctgagaggccctgccccgctcccttccccctccggagggttcttcagtaagggcccaccactcccaccctgtcagcgtctgcctgcaccagtttcagctcctggtctcccccactcggcattctttagtaaattctttccaggtaccgtcttgcacccaagcgagttcaatgtcctccgttccgtcaagtttgggtttgagctttgggctcagctgccgtggtctggagacctcgtaggcactctgcaagatgcctcgttctgctgcatgcttggggaggaagttgagctgggtgctggaagttctgaacccagcatgccccgggccggaggagatttgcttggtgtctccttagcgtcccgaacaccgcgcgcccctgctggggtaacctgaacagctggacccctcaactcgatctttattatca

SEQ ID NO: 37991 - DNA, 253 bp, Homo sapiens
  misc_feature 1..253: note = chr20:21499324-21499577
  misc_feature 1..253: note = hyper
  source 1..253: mol_type = genomic DNA
ggcaccctgctttcccggcttctgccctcccacgcctcagctttacgccccctgttgtgggggtgcgctctaaacaacagcaaaccaggcaagaaaggaagatacaggagagcaggcgaggcctcggcacaccctacggaggggagcctttcttgtgcctgtggaagaagtgggctccgtggacggcatccgaccctccccccatccctgttctgggcacctctttggagacggcgctcgcatccttccccgt

SEQ ID NO: 37992 - DNA, 247 bp, Homo sapiens
  misc_feature 1..247: note = chr20:21500104-21500351
  misc_feature 1..247: note = hyper
  source 1..247: mol_type = genomic DNA
gttggagactcagagcgtggcatgcacttgaaatcaatggggaaggaaaatgtcacccaatctggtccctgagtgtggcgataaagacgttcaccttaaggatggcatctccaaaacagccccactttggcttcgacttccaatgcgggagcaggggctgcaggaagcagaggtgtcagctctcacgtcctggatgaaagaaataggggaatgcaccccaggagtactaccccgtgctgggaccttt

SEQ ID NO: 37993 - DNA, 701 bp, Homo sapiens
  misc_feature 1..701: note = chr20:21501444-21502145
  misc_feature 1..701: note = hyper
  source 1..701: mol_type = genomic DNA
cgtcagtgttgccttcaggaacgttctttcagccaagcccgaccttccccggatgagggcgatttcaatacgggagatctgggtttctccaggaaacacgcgctgaaagcactctcttatctgaatttacttcttaacacgtgacaaaatcattaccacaagactttggaaaacaagcggctctcctaacgggttgcattcagcacttaaagctgggtcgggcaggctgatgtgaaaagtagttgtcggtggcgcggagaaggcacgctcttagctggagctaagggctggttccgggaaggacagggaatgcacccttgggccctcgggcacagagagggggttcctagggctctgtctctctctctccaatgtgagccccagaggttcacaaccttcccctagacgcaacgtcccctttccacccccaagagccactaaagtcgagaaggcgccagaggagctccaaagggcctcctggtagtgtgtgcgtgtgtgttgtgggaggaggttggggcggagggggcgcccctcggagacaaggaccccaccgaggttcatttctgatcctctggcgatctctactgacacaaacgagaactgtccggcgccgggcgcggcccaggcgacactcgcctcccaaactccagtcttcagtcgcctctccagagacctcagtccactgcgcgggccctcagccc

SEQ ID NO: 37994 - DNA, 257 bp, Homo sapiens; identical to SEQ ID NO: 1449
  misc_feature 1..257: note = chr20:21502443-21502700
  misc_feature 1..257: note = hyper
  source 1..257: mol_type = genomic DNA

SEQ ID NO: 37995 - DNA, 280 bp, Homo sapiens
  misc_feature 1..280: note = chr20:21502837-21503117
  misc_feature 1..280: note = hyper
  source 1..280: mol_type = genomic DNA
cgcacttgcccacctgctgcgtccggactacgcggcttggggatcgagccgagtcaggacccgggagagcgaggggctcataaccggggtccgccgtgaacccgagctccggcgccgctcggcggcgacgacggtgccccgagacccctctctgctggcaggccgcggtgaccgtgcccggagcgcgttcccgcgccgggcggctgtggcaggaggaccagacagtcagcgcctggcagcgagggcgacgccgggcttcctccatcgccaccgccgggct

SEQ ID NO: 37996 - DNA, 281 bp, Homo sapiens; identical to SEQ ID NO: 4775
  misc_feature 1..281: note = chr20:21503617-21503898
  misc_feature 1..281: note = hyper
  source 1..281: mol_type = genomic DNA

SEQ ID NO: 37997 - DNA, 45 bp, Homo sapiens
  misc_feature 1..45: note = chr20:21503899-21503944
  misc_feature 1..45: note = hyper
  source 1..45: mol_type = genomic DNA
acttcgcgggaggtcacagacctctcgccccggctccaggctcct

SEQ ID NO: 37998 - DNA, 95 bp, Homo sapiens
  misc_feature 1..95: note = chr20:21682361-21682456
  misc_feature 1..95: note = hyper
  source 1..95: mol_type = genomic DNA
cgcggagtttcgttgtgttgttacacaagccagcttttggtttgttagttgttcgcattcccccagggtttgcagctccccgatctggctcagct

SEQ ID NO: 37999 - DNA, 39 bp, Homo sapiens
  misc_feature 1..39: note = chr20:21682946-21682985
  misc_feature 1..39: note = hyper
  source 1..39: mol_type = genomic DNA
ccctctgttacttcccgcaagaaccgaaatgcgcacctg

SEQ ID NO: 38000 - DNA, 455 bp, Homo sapiens; identical to SEQ ID NO: 4778
  misc_feature 1..455: note = chr20:21683317-21683772
  misc_feature 1..455: note = hyper
  source 1..455: mol_type = genomic DNA

SEQ ID NO: 38001 - DNA, 17 bp, Homo sapiens
  misc_feature 1..17: note = chr20:21683899-21683916
  misc_feature 1..17: note = hyper
  source 1..17: mol_type = genomic DNA
cgcggactctgctaccg

SEQ ID NO: 38002 - DNA, 28 bp, Homo sapiens
  misc_feature 1..28: note = chr20:21684347-21684375
  misc_feature 1..28: note = hyper
  source 1..28: mol_type = genomic DNA
cgtccccactccccgcacccccggagcc

SEQ ID NO: 38003 - DNA, 30 bp, Homo sapiens
  misc_feature 1..30: note = chr20:21685666-21685696
  misc_feature 1..30: note = hyper
  source 1..30: mol_type = genomic DNA
tggttggctattaaacgtgaagatttcctg

SEQ ID NO: 38004 - DNA, 109 bp, Homo sapiens; identical to SEQ ID NO: 4780
  misc_feature 1..109: note = chr20:21686184-21686293
  misc_feature 1..109: note = hyper
  source 1..109: mol_type = genomic DNA

SEQ ID NO: 38005 - DNA, 435 bp, Homo sapiens
  misc_feature 1..435: note = chr20:21686294-21686729
  misc_feature 1..435: note = hyper
  source 1..435: mol_type = genomic DNA
tcaaattgattcccgcacgctgcagcctcccggtcagacgaatttctcccaatcggatgaagttcaccctgggcctggggtcgcgggcgtggagagtgtcctgggagggggcagcagcggcggcggcaggccctggagcgggcggcagcgcgctccgctgccgcgcacagcgcgtctccagcccgcggctgggccgccgcggctctcggctctcgggcgccctccctctatgcctctcacgcggcggcggcggcgcccaagctctcccggactgcgccgggcccagccccggccaccccggccaccccggcgccaggcagctggccggcccgctcgctatgggtaaggggcgggcgacaggcagggctcgggagggctgatgaggtgggtcgggtccgcctgcctcccttccctctcgtccgctttccctgggcg

SEQ ID NO: 38006 - DNA, 289 bp, Homo sapiens
  misc_feature 1..289: note = chr20:21687009-21687298
  misc_feature 1..289: note = hyper
  source 1..289: mol_type = genomic DNA
gacccttggctaacccgccgggtgttttctccccctccggctcactcttgtctggcgcatccgcagagcagacgtatggcgaggtgaaccagctgggcggtgtgttcgtcaacggccgccccctgcccaacgccatccgcttgcgcattgtggagctggcgcagctgggcatccgaccctgtgacatcagtcggcagctccgcgtatcccacggctgcgtgagcaagatcctggcgcgctacaacgagaccggctccattctgcccggggccatcggggggagcaagcc

SEQ ID NO: 38007 - DNA, 45 bp, Homo sapiens
  misc_feature 1..45: note = chr20:21687755-21687800
  misc_feature 1..45: note = hyper
  source 1..45: mol_type = genomic DNA
cgggcaggcttgcaggagaggactcacactcgctctcctcccggg

SEQ ID NO: 38008 - DNA, 149 bp, Homo sapiens
  misc_feature 1..149: note = chr20:21689912-21690061
  misc_feature 1..149: note = hyper
  source 1..149: mol_type = genomic DNA
ggcctccaaccagcacggcgtgtacagcgccccgggcggcggctacctcgccccgggcccgccgtggccgcctgcgcaaggtcctcctctggcgccccccggggccggcgtagctgtgcatggcggggaactcgcggcagcaatgacct

SEQ ID NO: 38009 - DNA, 30 bp, Homo sapiens
  misc_feature 1..30: note = chr20:21693467-21693497
  misc_feature 1..30: note = hyper
  source 1..30: mol_type = genomic DNA
atcccttcccagacccgtgcctcccctcag

SEQ ID NO: 38010 - DNA, 141 bp, Homo sapiens
  misc_feature 1..141: note = chr20:21694434-21694575
  misc_feature 1..141: note = hyper
  source 1..141: mol_type = genomic DNA
ccacaggtcccaggacgtgctgtgcccacagtggtgagcgcatctggatccccggacctcgtgggcacaacgtagtctgccgctcacttaaagcgcaactgcctcctacgtcggaggaatccaggccgctccagggaaatc

SEQ ID NO: 38011 - DNA, 148 bp, Homo sapiens
  misc_feature 1..148: note = chr20:21748368-21748516
  misc_feature 1..148: note = hyper
  source 1..148: mol_type = genomic DNA
ttaatgggtgtccctcggagaggccgcacccgggagaaagcgctgacgcctccgacccagctccgcgcacagcggcgcccccttctggccctcgtcccgccggagctgcgcttgcgtgaacagccctcaaatgcgtgtttgccctgct

SEQ ID NO: 38012 - DNA, 433 bp, Homo sapiens
  misc_feature 1..433: note = chr20:22557414-22557847
  misc_feature 1..433: note = hyper
  source 1..433: mol_type = genomic DNA
gcgataaagattgggcgtttaaattggccatttggaagattacatctcttcagcgagggtctttctttcaaaactcgcactgaattaagggtcatggctactccgtacccggctctcaaaggcacggcacctttgaattaggttgcggagtggcctgggcgaggggacccggggccatcaaaggcccgagggaaggccgtggggcgacacccgtctaatgacaagtaattgaaggattcgacgccgcgcattaccagcggaacgggaggcattaattatttaaaaacgattagccttgccgtgtgtcctgcaggcgtcccatcatgttcagcgaagataaccagccacccgaggcgagccggggctcggagggcggcgggcgcgctccccagcaggcttcgggtgcggtggacacgggcgcacagcccaaggc

SEQ ID NO: 38013 - DNA, 30 bp, Homo sapiens
  misc_feature 1..30: note = chr20:22558084-22558114
  misc_feature 1..30: note = hyper
  source 1..30: mol_type = genomic DNA
tgcctgctacccaggcgtttaaagaaaaga

SEQ ID NO: 38014 - DNA, 69 bp, Homo sapiens
  misc_feature 1..69: note = chr20:22558627-22558696
  misc_feature 1..69: note = hyper
  source 1..69: mol_type = genomic DNA
agttgagactggactcgaacccctgcgcgccaaggggagggcgtcaccatgctccggcctcagcctctt

SEQ ID NO: 38015 - DNA, 104 bp, Homo sapiens
  misc_feature 1..104: note = chr20:22559138-22559242
  misc_feature 1..104: note = hyper
  source 1..104: mol_type = genomic DNA
gctccctacctgcggcggccggcgggccggctggcgggcgggctgcggagcgtccagctcgcggagggaggaggccgactgctccgagccgaggcatccccgca

SEQ ID NO: 38016 - DNA, 44 bp, Homo sapiens
  misc_feature 1..44: note = chr20:22559632-22559676
  misc_feature 1..44: note = hyper
  source 1..44: mol_type = genomic DNA
gaaagcgcgcagtggcgatttgtgagctcgttatctcggaaccc

SEQ ID NO: 38017 - DNA, 35 bp, Homo sapiens
  misc_feature 1..35: note = chr20:22559677-22559712
  misc_feature 1..35: note = hyper
  source 1..35: mol_type = genomic DNA
ggctaggggagggatttaagcgggaggggggcgtg

SEQ ID NO: 38018 - DNA, 169 bp, Homo sapiens
  misc_feature 1..169: note = chr20:22559973-22560142
  misc_feature 1..169: note = hyper
  source 1..169: mol_type = genomic DNA
aaacacatttcaggccgggctcacgacgtgtgtgtccttgctaggaggagagacggcctgattgctggctgtggcctccggatccccccctccccaatttctcttccttgtgttcttcgggacaatgtggcatgttaagaaagggatttggtggcgggaggggggcagt

SEQ ID NO: 38019 - DNA, 97 bp, Homo sapiens
  misc_feature 1..97: note = chr20:22560398-22560495
  misc_feature 1..97: note = hyper
  source 1..97: mol_type = genomic DNA
agtgtttttacccaccgcaagccactgcgcgcgggagtggctcccaagtctgcctgacccgcgacgacactgatcctgccctcgcccagccagcaga

SEQ ID NO: 38020 - DNA, 283 bp, Homo sapiens
  misc_feature 1..283: note = chr20:22562603-22562886
  misc_feature 1..283: note = hyper
  source 1..283: mol_type = genomic DNA
caggcatgggggaaccgtagccggggtagtgcatcacctgttcgtaggccttgaggtccattttgtggggttggtggtggtggtggctgtggtggtgctgctgctccgaggacatgaggttgttgatggagaacgggtggttgaaggcgtagtggtgttccggcttcaggtgggcctcaggcggcaggcccgggtggtggggcgggcccagcaggtgggccgcggcctgctgctgctgcccgggagagggcgccggctctggggggctcagcgccgcagccgg

SEQ ID NO: 38021 - DNA, 211 bp, Homo sapiens
  misc_feature 1..211: note = chr20:22567354-22567565
  misc_feature 1..211: note = hyper
  source 1..211: mol_type = genomic DNA
cgcaggagaagggggcgctacacttccaaggagcggactttggaagcccccacctccaccacagcactattggtggccggggtcagggacaccagagagcgctcggcgggggcttccacagtgacagggcgccccctgtcggccgccaggcccgcgggaccgacccgagtcctcatttacccccgcgatcccaaccccgcagctccggcac

SEQ ID NO: 38022 - DNA, 133 bp, Homo sapiens
  misc_feature 1..133: note = chr20:22567605-22567738
  misc_feature 1..133: note = hyper
  source 1..133: mol_type = genomic DNA
cgccttcggggggactcggcctttttggagccccaacccctaggttctgcgcgaacccaaaacggcctcctgcaccctggcgaggttctgggagctccggtagggtagggctggatgacgcctcctagagtct

SEQ ID NO: 38023 - DNA, 75 bp, Homo sapiens
  misc_feature 1..75: note = chr20:23029003-23029078
  misc_feature 1..75: note = hyper
  source 1..75: mol_type = genomic DNA
gctggcactggtactcgcagttggctctgaagcacgggtccacgggctccacacactcgccgtccaccaggtcgt

SEQ ID NO: 38024 - DNA, 21 bp, Homo sapiens
  misc_feature 1..21: note = chr20:23029588-23029609
  misc_feature 1..21: note = hyper
  source 1..21: mol_type = genomic DNA
cggcgccgggctccacagcca

SEQ ID NO: 38025 - DNA, 211 bp, Homo sapiens
  misc_feature 1..211: note = chr20:23029875-23030086
  misc_feature 1..211: note = hyper
  source 1..211: mol_type = genomic DNA
ccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtg

SEQ ID NO: 38026 - DNA, 66 bp, Homo sapiens
  misc_feature 1..66: note = chr20:23030291-23030357
  misc_feature 1..66: note = hyper
  source 1..66: mol_type = genomic DNA
cgaggcagcctctgacatgcggatcggccagggctcgagtttataagtgcccggccctccctccct

SEQ ID NO: 38027 - DNA, 30 bp, Homo sapiens; identical to SEQ ID NO: 13739
  misc_feature 1..30: note = chr20:23030745-23030775
  misc_feature 1..30: note = hyper
  source 1..30: mol_type = genomic DNA

SEQ ID NO: 38028 - DNA, 45 bp, Homo sapiens
  misc_feature 1..45: note = chr20:23031034-23031079
  misc_feature 1..45: note = hyper
  source 1..45: mol_type = genomic DNA
cagaccccatctcatcgggtggggaagtcgcggggacactgtcag

SEQ ID NO: 38029 - DNA, 340 bp, Homo sapiens
  misc_feature 1..340: note = chr20:23031293-23031633
  misc_feature 1..340: note = hyper
  source 1..340: mol_type = genomic DNA
atttcgtccagagtccgaattgatacccacgtgcatagaaacgccacttgctcggcaaagggcactgaagagccaccgtcctgtggatgggcagggtggggggggggctggaggaggacatgggaatccgtcactttcgacctcttccggtggttcacttaccgggaatgcggaagagtgggtctccccctcgggtcgcccccataatggtgagaggcaaactgtttaaaaacacccttgcctctctcctctactgtcctcacaacgagcgccagggggcggcgctgtcgagctctaaacaaagccaaggaagttggagaagtttcgggctaaaaagggt

SEQ ID NO: 38030 - DNA, 102 bp, Homo sapiens
  misc_feature 1..102: note = chr20:24449601-24449703
  misc_feature 1..102: note = hyper
  source 1..102: mol_type = genomic DNA
ctggagtctgaactccgcgcccgcttgctcctccagggcttagctggtcaggacttgaacattcgccggatccataaattgggtcatttttaacctcaaaac

SEQ ID NO: 38031 - DNA, 945 bp, Homo sapiens
  misc_feature 1..945: note = chr20:24449759-24450704
  misc_feature 1..945: note = hyper
  source 1..945: mol_type = genomic DNA
cgggcagcaaattcctgtcctcctagtcccccgcagctatcccccgcccccagcctctgtggccctcacattgtcagacactggccgcgggccaccatctggacgcgatcccccgctagggcctccctggtctgggccaaagttggtggccaccttcgcgcgggctgcgccctccttctcttccctgccctcctcccccggggcccgcgcccgctgcctccagcacgcgcgtcggcaggctcggcaagcgaagaggagcggctcgccccagggcgcccctcgcccagcctgccggccaggcgagcgcgacgagagtctccccgcaccccttcctctcccgggggccgagagggttgggctccgccccggcgccgcagctcccgactccccgccgctcgggctgccgccgctgccccgcgcccggcgctcggggcagccgggggcgcaggcggagagcgcagggcggggagaggcgtggggagcagagcggcgctgaggggagggcagaggaggagagagcctggcagcggaggagcagaggcgggcgccgcaccgccccgcacgctcgctcgctcgggagagtcgcgggcggccgcttgggcgcacttgccgggtcaccttgtcccggaggtaagtccagacctcccggccgcgggggcgggcggaggggcccgcagtgggcggggtcgcggcaggggccgcgagctggcggcgggagctggaggctgccctgcgctggcgggtgtcctagtcctggctccgcctcggagcgcgcagacccggcggcggcgtggcgcccgcggtaagtccgggtggtcgccgcgacgagacttgggagacacggggtcgcagggcgggagggggagctgagccggcagagaaaatgcccaggaaggggtcgatgctggcctgggctgcaccttggtgccttgccaccccgggaga

SEQ ID NO: 38032 - DNA, 265 bp, Homo sapiens
  misc_feature 1..265: note = chr20:24450819-24451084
  misc_feature 1..265: note = hyper
  source 1..265: mol_type = genomic DNA
cgggttcgggctgcccctcggagtgacccgaaggagaccagccagggctggtgagccgggcggccacggagctggggacctaggtctgtttgggagtaggaagggaaacagactaattctccgagcggagcggcaggcaaggtgcaagcgcgcttgggatggggaatcccgacgggcgaccgtggcggaagcagagactcctggagcctctttcctctagccaggacaagacctgccttcaaaagctgtctggcccctggcagcc

SEQ ID NO: 38033 - DNA, 52 bp, Homo sapiens
  misc_feature 1..52: note = chr20:24451085-24451137
  misc_feature 1..52: note = hyper
  source 1..52: mol_type = genomic DNA
cgacagcctgcagccctgggagccacagccctggcgccgagatgggagcgag

SEQ ID NO: 38034 - DNA, 609 bp, Homo sapiens
  misc_feature 1..609: note = chr20:24451412-24452021
  misc_feature 1..609: note = hyper
  source 1..609: mol_type = genomic DNA
gggggtttcgttgcacgcagaggcttgggcgcttggcacccagacttcaggtgcgcacagtcctcctgcgacgtcagatgcgctggcgccgcggcgctcctggctcggaccgatgcctgcgccttccctggccacgtcctggtgtttagtgcagcagacaccggccgaaggcttggctgattgggggtgtcgaggggaggggggctgggcgttacacagtggctccgttttctggttggaatcagttggtgaggcgtgcgcgcgcgagtccgtgtatctgtccgtctccctcctacagcccagcgtgtttggtctgagtccaaagaaggaggtggtgtgtgtgctgcgtagacctgcgcctgtggggtgagcagcctcatagcccccagagccggccaacttctccgtgctaggctgcgacctcaagggctgccgcgtcggggatcggaagtggtcttcaaagaggggtctaggtcgcgaaatcctggcagcagccgaagtgaaaaggagctgctaggaggcgggcggggggcagtctgatgtccgttctggcgcggacaggaagaaactgaagtcgaatttttagttgaattgcgtgctctgtgtttg

SEQ ID NO: 38035 - DNA, 361 bp, Homo sapiens
  misc_feature 1..361: note = chr20:25058359-25058720
  misc_feature 1..361: note = hyper
  source 1..361: mol_type = genomic DNA
cggcggagttgagcacggagtctggcagcgggatgcagtggcgcaccatggccccgtacagcccgtactcggccatcacgctgctgccgccccagcgcttctcccgcttgcgccatttggccctgcggttttgaaaccagacctggttggaggcaggagaagcagaaggcacacagaagagacagtgaagaggggcgcctggaggagcggaggcggcgtcccagggctcggatcttctctcccgagcatgatcccatgctatttctgaaggaaatagctcccgagggccaaccagccgccctcagggagagcgcccaggagcccccagcagcgcccacgtgcggtccggactcacgggcat

SEQ ID NO: 38036 - DNA, 43 bp, Homo sapiens; identical to SEQ ID NO: 1451
  misc_feature 1..43: note = chr20:25061746-25061789
  misc_feature 1..43: note = hyper
  source 1..43: mol_type = genomic DNA

SEQ ID NO: 38037 - DNA, 334 bp, Homo sapiens; identical to SEQ ID NO: 1452
  misc_feature 1..334: note = chr20:25061978-25062312
  misc_feature 1..334: note = hyper
  source 1..334: mol_type = genomic DNA

SEQ ID NO: 38038 - DNA, 136 bp, Homo sapiens; identical to SEQ ID NO: 1453
  misc_feature 1..136: note = chr20:25062510-25062646
  misc_feature 1..136: note = hyper
  source 1..136: mol_type = genomic DNA

SEQ ID NO: 38039 - DNA, 111 bp, Homo sapiens; identical to SEQ ID NO: 1454
  misc_feature 1..111: note = chr20:25062707-25062818
  misc_feature 1..111: note = hyper
  source 1..111: mol_type = genomic DNA

SEQ ID NO: 38040 - DNA, 71 bp, Homo sapiens; identical to SEQ ID NO: 1455
  misc_feature 1..71: note = chr20:25062870-25062941
  misc_feature 1..71: note = hyper
  source 1..71: mol_type = genomic DNA

SEQ ID NO: 38041 - DNA, 180 bp, Homo sapiens; identical to SEQ ID NO: 1456
  misc_feature 1..180: note = chr20:25063727-25063907
  misc_feature 1..180: note = hyper
  source 1..180: mol_type = genomic DNA

SEQ ID NO: 38042 - DNA, 1214 bp, Homo sapiens
  misc_feature 1..1214: note = chr20:25063993-25065207
  misc_feature 1..1214: note = hyper
  source 1..1214: mol_type = genomic DNA
cgggaacccggcgcggctgcctgcgcgcacgcagggaccggagcccgagcctgggccctgcaaagtgggtctcccactcgctgcgcgttcgagtggggcctccgctaaacatgcagattaaacaaggggcttccgataaggataattacaggaggctgcgcattgactttccgttactaaaggaagacccaaatctcccccttgcaagctgttcccgggattaccaaaacaatcactttcttttgagatcattgtcttttgaaccactccagctcggggcagaacgctttagacgctggcgttgttttccgctccgcgaggaattttcccccagatttatctctgggtttagggaaggcgttgggcattcgggactgcgtagtcgtttgtaaatccgaatttggggtagcagttaagtgagatacctacgcttccacacagtttgtagcccgagaccagtcaggcaggcagggtagtcgattctaaggtggcccgaccggggtcgcccgcgaatggaaagcctaaggggcgagggcggacgcgggcgccgtgcctgcagccccgggtgccgaccaagtggcctcacctgggacaggtcttggggtctccctcccctaggtctccctggaaggtaggcgatcacgggagtgacagaccccgagtagatagccagtgatccaaagacaccaaaaggccaggcggtaggagcccagcctcagacactctctatagtgaccgcggcgcctcgggaaggatcgtcttaaactcattttgcaggtgagagcaactgggacttattaacccagtcacatcggacacagagacgtggcgagggcgacacagagcaggagactcaatcaaggagcccgtattggagctctaaggggactcagagatgcagaaggaacgaacttctaaggggtcttgcaattcctggactggggcgttcctaatgcatcccgggaccccaatgccagggaggggcctgcaggaccccagcggtgggcgagttgtgtcctgggtcaccttgtgtttcgcagcgtggcggtggcaggagcccagcgcgggaggacattttcatagcctcctacagtgagaaacgccccccacccgacgctgcgctcatctgtgtccccgctgttgccggggctctggtatccacttgcgcgccctatgtggtggggatccacccagagcccagcgtcaagttatac

SEQ ID NO: 38043 - DNA, 255 bp, Homo sapiens
  misc_feature 1..255: note = chr20:25065208-25065463
  misc_feature 1..255: note = hyper
  source 1..255: mol_type = genomic DNA
ggcgcttcactcagcgtcagccaagaccagggaagcgcttcttgccgtttaggagacgtctgcaagagataaaaagctagcccacgatccacccacaatcctcgtgtccccggggtgccctcgcagttgccaaacctacgggccgcgtttaggggaagcctccgcgtcctggcggccaaaagaatgggctccttccagcttccccctaccggataccacctgcaaatctattgccagaggcgcagctcccgcgaa

SEQ ID NO: 38044 - DNA, 35 bp, Homo sapiens
  misc_feature 1..35: note = chr20:25065766-25065801
  misc_feature 1..35: note = hyper
  source 1..35: mol_type = genomic DNA
cccgagaaggtgaaacggatcgccctgtgagtctg

SEQ ID NO: 38045 - DNA, 29 bp, Homo sapiens
  misc_feature 1..29: note = chr20:25129464-25129493
  misc_feature 1..29: note = hyper
  source 1..29: mol_type = genomic DNA
cgcccatccccgtgcgcacgtgttcgctg

SEQ ID NO: 38046 - DNA, 180 bp, Homo sapiens
  misc_feature 1..180: note = chr20:25565489-25565669
  misc_feature 1..180: note = hyper
  source 1..180: mol_type = genomic DNA
gactgcgcgcacaggcgggaggaaaggggcgaatctgcaaaacgagtacaacagataaaattcgcaacagacttctacaccctttcaatcaaccgtcccaagcgccacgaacgcgggtcccgctccgtggggggccgcagccacactggcaggagggaatcctgggcctcgaccagacgc

SEQ ID NO: 38047 - DNA, 392 bp, Homo sapiens
  misc_feature 1..392: note = chr20:25565825-25566217
  misc_feature 1..392: note = hyper
  source 1..392: mol_type = genomic DNA
gtcgggaaaccgggttttcaagcgttcggcccagcgggcgctgtattttagggcgtgacccccgccccgccctcgagggcgaccggaagagcaggcaccacagcagatgcgccgagtctgcgccccgcaccgcgaggagcacccgaggccgcgctcccggagccgggtctggtgactaaggcgcgggtcgcgacgcaggggcggccccggactctcgaccccaccagccgcctgaatgtcccgccggacgcccgggccggctcacctgggaggcgcctccgccgtccgcccgcgcggggccaggagcgcggcaccacccccgtaccgccggccgctctttgtgtctggaggccgcgacgcaacactcctcccggcctcgaggcaccgccccc

SEQ ID NO: 38048 - DNA, 188 bp, Homo sapiens
  misc_feature 1..188: note = chr20:26188774-26188962
  misc_feature 1..188: note = hyper
  source 1..188: mol_type = genomic DNA
gggcacctgggagcccgcagaggggcggctgagggagaaacctcaggcatggccgggccaccaggaaaacacggccgcgggatcccaccgccacagacacgagggcggtcccgcggcgccccgcctgggacgccggaaggccctcggcacccaccaagacctgcctcacgagcccctggtcccgccac

SEQ ID NO: 38049 - DNA, 68 bp, Homo sapiens
  misc_feature 1..68: note = chr20:26189330-26189398
  misc_feature 1..68: note = hyper
  source 1..68: mol_type = genomic DNA
cgctcggccaccaccgcggtggccggcggaaccctcgctctccccccgtcaccccgtcgagggggaag

SEQ ID NO: 38050 - DNA, 23 bp, Homo sapiens
  misc_feature 1..23: note = chr20:26189578-26189601
  misc_feature 1..23: note = hyper
  source 1..23: mol_type = genomic DNA
gaggggcccgcagaggcgctcag

SEQ ID NO: 38051 - DNA, 368 bp, Homo sapiens
  misc_feature 1..368: note = chr20:26189956-26190324
  misc_feature 1..368: note = hyper
  source 1..368: mol_type = genomic DNA
cgtgggaggggcgcgtctcgtctcactcaaccgcctcgaaccccacaccgacgagctccctcaggacccacgcgcggacaccgaggcgccgaccggaggagggggcgctgggggtgggaacgacacaccaccgctcggcctcgggaacctgagggacaacccggagcgctccaggagcaccgcaaaggcccagggggagccaacgctcgcgcaaactccccgggagggcagcacgacgggccggcgggacagcacccccaccgctgcggaggggggccgcccgcaagtcgacaaccacaggaggcgagagcgaggggtgcctgccgcgtcagaggaccccccgacccaccccgcgaggcagaaggcgg

SEQ ID NO: 38052 - DNA, 136 bp, Homo sapiens; identical to SEQ ID NO: 13761
  misc_feature 1..136: note = chr20:30063113-30063249
  misc_feature 1..136: note = hyper
  source 1..136: mol_type = genomic DNA

SEQ ID NO: 38053 - DNA, 275 bp, Homo sapiens
  misc_feature 1..275: note = chr20:30063250-30063525
  misc_feature 1..275: note = hyper
  source 1..275: mol_type = genomic DNA
ttggcaggaataggggggcttcgaaaccgcgtccctagggtgagggtcttcagacctgggacccggagggctggatagccctggacaaagacccctccaaccccaggatgggggattcacacccgggatgccggctgagaaagctcggacccagactccaggaatggcacagcgttcccgggccctgtggtctgccctccccgtcccctgccaggaccctgtcctgtcacctaacctggggcctgaccggcggcagctcccgtccccaaaagcag

SEQ ID NO: 38054 - DNA, 32 bp, Homo sapiens
  misc_feature 1..32: note = chr20:30193960-30193992
  misc_feature 1..32: note = hyper
  source 1..32: mol_type = genomic DNA
gtgggtctcccccaacgcgcctcgccggatct

SEQ ID NO: 38055 - DNA, 56 bp, Homo sapiens
  misc_feature 1..56: note = chr20:30556169-30556225
  misc_feature 1..56: note = hyper
  source 1..56: mol_type = genomic DNA
gctcgtgttcttctccgacggtgccacggacctgtggctggcggcctcctactacc

SEQ ID NO: 38056 - DNA, 221 bp, Homo sapiens
  misc_feature 1..221: note = chr20:30582773-30582994
  misc_feature 1..221: note = hyper
  source 1..221: mol_type = genomic DNA
gtgacttgccccctgcgcctgtgggcggctcggggctggtgcgacagagcgagaggaaccagcgcgcgggagcctgagcaccgcgtccttcccgcaggtacctgcgcgccctgtacctggggctgcagagccgctggcgcggggagcggctgcggcgccacttctactggcagatgctgttcgagagcgccgacgtgagcatgctgcgcttgctggagacc

SEQ ID NO: 38057 - DNA, 374 bp, Homo sapiens
  misc_feature 1..374: note = chr20:30639105-30639479
  misc_feature 1..374: note = hyper
  source 1..374: mol_type = genomic DNA
ccagggtggttccttcgggcagggaactttgcatggccatggtggttccttcgagagaggaactttgcatggtgtctgaatggagcaggcctgcggaagagaaaccgctgaccacagacctgcctggaagtctcgggccgcggagttggggagggccgggccagaagggaggggtcggagtggtggggaaaagagatcacgatgcttccggggtagggtaaggcctttccagggtgggttggaatctttgaagactgtggcaggaatcccttgataggtggggttaggatctctgaagggcagggttggaatctttggaccggcggtatagacccctgggtattaaaactcttaggcggcgggaggttagatcg

SEQ ID NO: 38058 - DNA, 473 bp, Homo sapiens
  misc_feature 1..473: note = chr20:30639783-30640256
  misc_feature 1..473: note = hyper
  source 1..473: mol_type = genomic DNA
ttagggaaagtggagcggaagggatgggggttcgcatccttggtggacgcgttagaagcctcctatggatggtgctaatattttttttctcttcgtggagggtttgggatccttcttgcaggagacggaggttatgaccctcggggagccggttaggatcctggggtggcgtctgaatcttcggggaggtgttaggacacttggggcggagttagcctcgctcagggcgcggctaaggcgcccagatggcctgcgggcgccaccacgtccctggtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatcc

SEQ ID NO: 38059 - DNA, 186 bp, Homo sapiens
  misc_feature 1..186: note = chr20:30640257-30640443
  misc_feature 1..186: note = hyper
  source 1..186: mol_type = genomic DNA
ggctgcccgcgagacgaggagcgggcgcccaggtgagtgccgcgcacaggggaccgggaatacccggcccgcgaggggtcccaggaggcggagggagcccaggagcctggggagggctggctacgggtgcggctgggggcagcgaggggagacggaacgtcgggggagccgcgggtagcccggggg

SEQ ID NO: 38060 - DNA, 45 bp, Homo sapiens
  misc_feature 1..45: note = chr20:30640724-30640769
  misc_feature 1..45: note = hyper
  source 1..45: mol_type = genomic DNA
aagggggtagttgggcggaggcgtgacgtgcgagccacacccagg

SEQ ID NO: 38061 - DNA, 325 bp, Homo sapiens
  misc_feature 1..325: note = chr20:30777885-30778210
  misc_feature 1..325: note = hyper
  source 1..325: mol_type = genomic DNA
tggaggccgcttccccgcgcccaggggaagggaaggcggtcccggggcccgctgcggggtggagggacccgcgccccccagcttctcgggcccgggccgcggggaccgtgcgcgcgtccccctcccgggcaaggccgggcggcgggcgcgccgcggcttctggggtccccgccctcttgtccgccatcgcctgcgggagcctctggcctggaggggctcggggcgcgctggcgactgcgggctcggcgacaggggcggctggtggcgggaggacagtgggaggaaggctccgccccacgcgcccccctctcggatgtgattcgcc

SEQ ID NO: 38062 - DNA, 33 bp, Homo sapiens
  misc_feature 1..33: note = chr20:31797604-31797637
  misc_feature 1..33: note = hyper
  source 1..33: mol_type = genomic DNA
tgaagtaggccaaggcgacgaggaagagccacc

SEQ ID NO: 38063 - DNA, 49 bp, Homo sapiens
  misc_feature 1..49: note = chr20:32803885-32803934
  misc_feature 1..49: note = hyper
  source 1..49: mol_type = genomic DNA
cgtagtcctctgccacgaccgcagcgccaacgccagagacggagttggc

SEQ ID NO: 38064 - DNA, 192 bp, Homo sapiens
  misc_feature 1..192: note = chr20:32803954-32804146
  misc_feature 1..192: note = hyper
  source 1..192: mol_type = genomic DNA
cgctccgcgtcccctggcaccttctcttgagtggcaggcaagcaagcaagcaagcgggcggggtcagcgccccaagaagggaaagagcgcgagggccagctaacgccgccgccgccgtcgccgctgagtcagcgcgaagcgccctctccgagtaggtgccgcgcgggcgggcgctggcgccagcagtctcat

SEQ ID NO: 38065 - DNA, 30 bp, Homo sapiens
  misc_feature 1..30: note = chr20:32899446-32899476
  misc_feature 1..30: note = hyper
  source 1..30: mol_type = genomic DNA
attaactggaggcttcgagatgggatagag

SEQ ID NO: 38066 - DNA, 261 bp, Homo sapiens
  misc_feature 1..261: note = chr20:33146323-33146584
  misc_feature 1..261: note = hyper
  source 1..261: mol_type = genomic DNA
tgcgggagaagctcccgcgctgcccatgacgtcacgggactgtgacgcgcccagaagccccgcccctcgcgtcccggtccgcggacccaggctctctgcgccgtgacgtcacgggtccgggcgggcgggttgtgcgtcggcccaatgggagcggcgcactggcctcccctttaaggaatgttgtgacctgacgtcaccgggcgagttacctcccgcagccgcagccgccgtgctcagcgcgagccccggagcccttgagcg

SEQ ID NO: 38067 - DNA, 24 bp, Homo sapiens
  misc_feature 1..24: note = chr20:34188608-34188632
  misc_feature 1..24: note = hyper
  source 1..24: mol_type = genomic DNA
ttctttttcttctttcgggtgagc

SEQ ID NO: 38068 - DNA, 342 bp, Homo sapiens; identical to SEQ ID NO: 1461
  misc_feature 1..342: note = chr20:34188747-34189089
  misc_feature 1..342: note = hyper
  source 1..342: mol_type = genomic DNA

SEQ ID NO: 38069 - DNA, 326 bp, Homo sapiens; identical to SEQ ID NO: 1462
  misc_feature 1..326: note = chr20:34189166-34189492
  misc_feature 1..326: note = hyper
  source 1..326: mol_type = genomic DNA

SEQ ID NO: 38070 - DNA, 375 bp, Homo sapiens; identical to SEQ ID NO: 1463
  misc_feature 1..375: note = chr20:34189679-34190054
  misc_feature 1..375: note = hyper
  source 1..375: mol_type = genomic DNA

SEQ ID NO: 38071 - DNA, 217 bp, Homo sapiens
  misc_feature 1..217: note = chr20:35491258-35491475
  misc_feature 1..217: note = hyper
  source 1..217: mol_type = genomic DNA
cgcgggctgggccggctgccccgtacggacccccgccgggcccccggccgcggactcggcgtcgctgctcagcgccagctccaggcccagcaggcgcgcctcctccgacgcgcagtccgacacctccgagctgctatccgtgaggctggggggcggcggtggcggtcgcggccccgcacccgagcgcggacggcccttggcacggaccccggtgcgg

SEQ ID NO: 38072 - DNA, 323 bp, Homo sapiens
  misc_feature 1..323: note = chr20:36012930-36013253
  misc_feature 1..323: note = hyper
  source 1..323: mol_type = genomic DNA
ggtgacttgggtgtccggggggtgggggggcggccgtacacactgtgaagcgtccgcgccgccgccgctggctttggggtggagcaagcgcaaaagacacggggtgtggttaatgggttctaattggacgcttaagcccaagaagaagaagggcggcgcgggaccgggcctgttgctgccttggcgcccagtcctttttcgttgcctgggtccgcccagagatgagtcgggacgcgcggcccacgtgcggcggaggggcagctgggtcgctcggggaacggggcaccggatggccccggttgggcccgcgccaggatgcgccc

SEQ ID NO: 38073 - DNA, 440 bp, Homo sapiens
  misc_feature 1..440: note = chr20:36531551-36531991
  misc_feature 1..440: note = hyper
  source 1..440: mol_type = genomic DNA
cgtgcgctcgctccccgaagccggggctgggccggagccgggcgagggctgggagctgggccgggtccggggacagcgggcgaggggcagctgccggagccgggcagccaggccgctcagggcaggggacagctggcgccggttctgcggtctccggggcccagatgtgaggcggcggcgcccccggcccgagagcgcacgatgggggccccgctcgccgtagcgctgggcgccctccactacctggcacttttcctgcaactcggcggcgccacgcggcccgccggccacgcgccctgggacaaccacgtctccggccacggtgagttcggtcgccgcccccgcggacttccccaccaaaccccaacccgggccgcgccactccaacttggccgccccggggctcgaaccggcgccagtcgtggcgggcatcccggggc

SEQ ID NO: 38074 - DNA, 332 bp, Homo sapiens
  misc_feature 1..332: note = chr20:36888856-36889188
  misc_feature 1..332: note = hyper
  source 1..332: mol_type = genomic DNA
tgaaagggggcagagcgaggtggtccaggccttggcgcgttaccatggtgacgggctgccagcggcgggcggcgcggctcctctcctgggcgcggggtctgtgggtccgcgggtccgtctgtctggggcagccctcggtcccgcctagccctggagccaggggatagggcaggcccggggcaccgaccccggcgtcatctcggaggagcggccggggaggacagggagagagactgagagagagacagagagggactgaggctggagacggcgagagacataagggagccgcgggcggcgcgggtcgggccaccagacggggggcggcagca

SEQ ID NO: 38075 - DNA, 30 bp, Homo sapiens
  misc_feature 1..30: note = chr20:37274701-37274731
  misc_feature 1..30: note = hyper
  source 1..30: mol_type = genomic DNA
ctggtcgcccaggtgcgaaaactgaacgac

SEQ ID NO: 38076 - DNA, 847 bp, Homo sapiens
  misc_feature 1..847: note = chr20:37302554-37303401
  misc_feature 1..847: note = hyper
  source 1..847: mol_type = genomic DNA
aggggcgccgtggtgcggcatgaggctggagcctgatcactcggggtcttactggccacggtgaggagtcagggtttcatgcgcccctgcagtcagaaagcatggcccaaccccagtgccctaagtccggaaacattcaaagctggacccagggtagcgggatccggggcctctggggacccgagagggacgttaagttcagggcttcagggtgcagccctggggtcggtacccccagcctccaacccagagctggcagcgctcgcccccttctccgcgcgggccctcagctcagctccctcttcgctccccgtgtccccgcgagcgggagggaggggatgctaggacgccctgtcggcgtcgtcgccgctttccgccattgtttagtcgtgatgctctcattttctctgaatcaacaattttctgctcggctccgcgccgaccggcgaacgcggggcttttcctcgcccgcctgatgacagcagagcggcgcggagcagctggtccggaaggaagcgccaggcgcctgcccggtcccaggcgtccgctgccgcccacccacaccagaccccgcccccgcgcgtcaagccccgcccatccataccaagtcccgcccccacaccctcacccacacaccaggccgtccccaccccgcccccagagccccggggcgccccgcccgctagccgcgcacgcgcagtgagcacggcgacccccggtggtcgggtgtctccgcaggccgaacacgctgctcgcccagctgcggatcattaccgcccttttgttctccgtcgcgcgctcgccccacgctaggaatgcaaactgtaggcgccgccagccccccctt

SEQ ID NO: 38077 - DNA, 837 bp, Homo sapiens
  misc_feature 1..837: note = chr20:37351679-37352516
  misc_feature 1..837: note = hyper
  source 1..837: mol_type = genomic DNA
ttttccgtccgcccccgcccccacttccagtcacagccgctacttctccattcaggctgggactgccaggtggagccctgcggtttactgctcaggaggagcccggccaggacatcagctggggacttacgcagggacccattcagagcagcggaccctcacggagactactacaaagggactaacacaggcacgaacgcaggcaaccccattcgggaacacatacgtaatccaacacactagctctggcacacacactggaatgcgcgcaaaaccacacagacacagaacacacgcggttaccaaacctcattctcagaggccacactgatccaacctcaagcagagtctgatacagcatcggtctttgtctctgggtctctcccttactcgcgctcacacacccgtaccccaatcaacacaaacagcccaagctttcacagcctggaggcggccgtcggagcagggccccagcgcaccgcgagcctctgcttcctccgccttgcagcgccgcgagcccttctttcctccgcgcctggccccgtctgcgcccctctcggcgtgggcattcgcagacccgctaggaggctgacgagaggtgtcctcatagagtcctgccttcttccagacccccaaacgaaaagaaagagaaaagccaacctttcgcctccattctgcacgcatttggagagcggctggtggcgagcgatccgcacaatcgcttccctcgcggcgtccctggacgggcggagagaacccgggtgactgagcctgaggctgagcttccttgggagcgatccatgccagccacttctaccttcaagggggactcgcggc

SEQ ID NO: 38078 - DNA, 1113 bp, Homo sapiens
  misc_feature 1..1113: note = chr20:37352606-37353719
  misc_feature 1..1113: note = hyper
  source 1..1113: mol_type = genomic DNA
cggggcgcccagaccagtccttagccagaggatctggggctgcacagctcccggaccctggagggggtggtccgggggtgggagactgcgagcatcagcccacgccggccccctcccaccctgcggcggcgaggtgggaagggccaggatgcgagcttagcacctcccctagaaatgcagcacttcgcccccccacctcccctgccctcggcgctccctctttcacgcgctccctcccgcctccttcccaagggcgcccttcttctgcccccagctcacgtctgaatccctcggcgccccctttctcttctcctagccccttcctcacgtcccctgcctccgggtatttcctctctccaatcccccacccccgcaccgcctgattccgaggggcgggagcgcattgggctgcgcacgggtgggggcgccgcgccagcttcgcgtagctgctctgacgccgctgccgccgccgccgccgccgccgccctccgcagcccagctcgcgccccgcggcagctccgcagtgcactagccaccaccgccgccgccgccgctccgccagacctgctgccagcttgcccggtccagccctgagagagcctcgaacgccagctgcgagggtcatgagccagagagccccggggcgccgcgcggagagcaagcggagatagcgactttgcgccccccagccctcgccttcttgcatcgcgttccccgcatcctcgggtccttctgtcctttccgctgtccccaccgccgccatggccaccttgctccgcagcaagctgtccaacgtggccacgtccgtgtccaacaagtcccaggccaagatgagcggcatgttcgccaggatgggttttcaggcggccacggatgaggaggcggtgggcttcgcgcattgcgacgacctcgactttgagcaccgccagggcctgcagatggacatcctgaaagccgagggagagccctgcggggacgagggcgctgaagcgcccgtcgagggagacatccattatcagcgaggcagcggagctcctctgccgccctccggctccaaggaccaggtgggaggtggtggcgaattcgggggccacgacaagcccaaaatcacgg

SEQ ID NO: 38079 - DNA, 1026 bp, Homo sapiens; identical to SEQ ID NO: 1468
  misc_feature 1..1026: note = chr20:37353806-37354832
  misc_feature 1..1026: note = hyper
  source 1..1026: mol_type = genomic DNA

SEQ ID NO: 38080 - DNA, 239 bp, Homo sapiens; identical to SEQ ID NO: 1469
  misc_feature 1..239: note = chr20:37354993-37355232
  misc_feature 1..239: note = hyper
  source 1..239: mol_type = genomic DNA

SEQ ID NO: 38081 - DNA, 541 bp, Homo sapiens; identical to SEQ ID NO: 1470
  misc_feature 1..541: note = chr20:37355502-37356043
  misc_feature 1..541: note = hyper
  source 1..541: mol_type = genomic DNA

SEQ ID NO: 38082 - DNA, 660 bp, Homo sapiens
  misc_feature 1..660: note = chr20:37356168-37356828
  misc_feature 1..660: note = hyper
  source 1..660: mol_type = genomic DNA
cgccgttgtgtgctgctacaccggcaagatcctcatcgcgtgcctgtacgaggagaatgaagacggcgaggtggtgcgcgtgcgggactcgtacgtggccatagccaacgcctgctgcgccccgcgcttcccaacgctgggcggccgagtggtgaacgtagcgcagatcatcgagctggtgatgacgtgcatcctgtacgtggtggtgagtggcaacctcatgtacaacagcttcccggggctgcccgtgtcgcagaagtcctggtccattatcgccacggccgtgctgctgccttgcgccttccttaagaacctcaaggccgtgtccaagttcagtctgctgtgcactctggcccacttcgtcatcaatatcctggtcatagcctactgtctatcgcgggcgcgcgactgggcctgggagaaggtcaagttctacatcgacgtcaagaagttccccatctccattggcatcatcgtgttcagctacacgtctcagatcttcctgccttcgctggagggcaatatgcagcagcccagcgagttccactgcatgatgaactggacgcacatcgcagcctgcgtgctcaagggcctcttcgcgctcgtcgcctacctcacctgggccgacgagaccaaggaggtcatcacggataacctgcc

SEQ ID NO: 38083 - DNA, 1027 bp, Homo sapiens
  misc_feature 1..1027: note = chr20:37357215-37358242
  misc_feature 1..1027: note = hyper
  source 1..1027: mol_type = genomic DNA
cgtgtccggcttcgtgcactccctcgagggcctcatcgaagcctaccgaaccaacgcggaggactagggcgcaagggcgagcccccgccgcgcttctgcgctctctcccttctcccctcaccccgcccccaccagcccagtgcgccctgccgccgcgcttgggaggccaagctttaaacatctctggttcctagtttctgattattcggggatgggggggatgggaggggacagggattcacgatccatcgcgtctgcgtttctgttgtcctttcttttccacaacaccctggttttggggggaggcggggtgcatttgcgggcagggttctctgtccttccaagtggggccccgacactttggttccagtcatcgagggggttgggaagggagggagagggggcgcagctcgcaggcgtggcaacttgaccttgggggaatatttcacatccatccagagctcggaatctacagcgtccagccatttccagcaagagcgcttcccattccggagacgtttcaaccctgcagcgggaaaggctgactgggaaatccattttgggtgggcaatttccttcaacgaagccggaaggcgagaagccgcggcggggccagcttgcctgccggttttcaggaatctaaactctcatcttgtgcaatttatcaggtgtggaactgttctactgtgcgtgtggtgtgctcgtggtgaataagatgaaatgtatatcagaaaaaaatctatctctaatttagagtgcggtacataattatatccgcaaataaagaagagacaaaggcttgcgcggcccggtgtcgggtttgtgtgttcgtaccagccgggatcccctggcgctgggaggcgtgggaactggctcccgccggctgaaaccggagatggtgagcagctgtggttaaagggtccggggagggctctagggagtacaaagattagttggcggcgaggaggctcctcaggtgtgaggaggaagctgaagacggagagtgctgtagcggccccctcagctg

SEQ ID NO: 38084 - DNA, 104 bp, Homo sapiens
  misc_feature 1..104: note = chr20:37359606-37359710
  misc_feature 1..104: note = hyper
  source 1..104: mol_type = genomic DNA
catctctgtccttcccgtctttaaaaggtcgaaggagacactaggcaggctccggatagcggcgccaactctgcgggctcgcctggatccgctccactaatcct

SEQ ID NO: 38085 - DNA, 241 bp, Homo sapiens
  misc_feature 1..241: note = chr20:37434112-37434353
  misc_feature 1..241: note = hyper
  source 1..241: mol_type = genomic DNA
tggaggagggggcagcgttaggaaaactattccgaagcctggccacgtcccaaccggtttcaacttcctgcagctcagaagaggggtccccacccgagagcgccgggaccctgtcccgcgctgcctcccaagccggatggggttgagcgcgcccaccccagtcccaggagctcaggccccgccttgggggaggagccgagaggcggcgcggaggctcgcggccgagcagagccagctctgt

SEQ ID NO: 38086 - DNA, 234 bp, Homo sapiens; identical to SEQ ID NO: 1474
  misc_feature 1..234: note = chr20:37434488-37434722
  misc_feature 1..234: note = hyper
  source 1..234: mol_type = genomic DNA

SEQ ID NO: 38087 - DNA, 158 bp, Homo sapiens; identical to SEQ ID NO: 1475
  misc_feature 1..158: note = chr20:37434736-37434894
  misc_feature 1..158: note = hyper
  source 1..158: mol_type = genomic DNA

SEQ ID NO: 38088 - DNA, 440 bp, Homo sapiens; identical to SEQ ID NO: 1476
  misc_feature 1..440: note = chr20:37434930-37435370
  misc_feature 1..440: note = hyper
  source 1..440: mol_type = genomic DNA

SEQ ID NO: 38089 - DNA, 229 bp, Homo sapiens; identical to SEQ ID NO: 1477
  misc_feature 1..229: note = chr20:37435487-37435716
  misc_feature 1..229: note = hyper
  source 1..229: mol_type = genomic DNA

SEQ ID NO: 38090 - DNA, 199 bp, Homo sapiens
  misc_feature 1..199: note = chr20:37435717-37435916
  misc_feature 1..199: note = hyper
  source 1..199: mol_type = genomic DNA
gaggtacaggcgccctttcccgcagggctctccctggaaagggcctgccgatggcggcctcagtccgcaggggtacttccctgtgtaccctgccatttcctgcggctggtgaagcaccggagaaaaaccgtccatctaggaggcctcctccaaggctggtaataaagcttcttagcccagccagcgactagctgtctac

SEQ ID NO: 38091 - DNA, 287 bp, Homo sapiens
  misc_feature 1..287: note = chr20:39316048-39316335
  misc_feature 1..287: note = hyper
  source 1..287: mol_type = genomic DNA
tcgcctctcgcctgccgggacgccagagtccctctcctttcctcgttgctctcttcctggcgcggactactctccgggcagcaaagcagctgtcccggcttaacgcgcaaagttcagaaagccaggagtctccagatggccttggtgacttctcgggactatgcctcgccgcccttcagcctggagagaagttactccgggacctcccaccctctcgtctctctctccggctctgctcgagtctaggaggcggcgctggcgtgcgctactctcgccttagccaaggt

SEQ ID NO: 38092 - DNA, 51 bp, Homo sapiens
  misc_feature 1..51: note = chr20:39316983-39317034
  misc_feature 1..51: note = hyper
  source 1..51: mol_type = genomic DNA
cgcttggtgatgatggtgatggtgcgggtgagcgtgcgggcccagctcgtc

SEQ ID NO: 38093 - DNA, 556 bp, Homo sapiens
  misc_feature 1..556: note = chr20:39317035-39317591
  misc_feature 1..556: note = hyper
  source 1..556: mol_type = genomic DNA
tgggccacgccggcgcccgggtacgcgtggtgcgggtgagggtggtggtgatggtggtggtggtgagcgccgcgaaagctgtcgaagctttgcagcggctgtggcactgggtgcgagccgatgagcgcttccaccgcgtcctcgggcgtcaggttgagcgcctcggggttcatctgctggtagttgctcgccatccagtacagatcctcgaggtgtgtcttctgttcggtcgggctgaagctgggcgacgagggcacggagctacacggagtgctgagcggtgtggaggacaccgagccggctggctgcaggcgtgtgcagggcctgcccggacgctccgcgcgccccagtggctccttcttcacgtcgaacttgagcaggtcgaagtcgttgacatactccatggccagcgggctggtgggcagctctggccccatgctcagctccgcggccatcgctgaagcgaggcgcagccgccgctgccgcccgggaaactttgcggccggccggagcgcgccgagccaagcgcgggggggaagagcggagaagagctggg

SEQ ID NO: 38094 - DNA, 217 bp, Homo sapiens
  misc_feature 1..217: note = chr20:39318987-39319204
  misc_feature 1..217: note = hyper
  source 1..217: mol_type = genomic DNA
cgatgtacaggtcctcgggtcccgtcttcgtactcagccgcgagcctcgagccgcgagctccgctctggtcgccccgttgaaattccgtgccccagcgttcgggggtgcccgtcggctgctccctgggccggaaggtcctgggcggaggaaggccggtagccaaaagtggaagcgccacagtgaagcggcccagggccaccgggtgagaaacctccc

SEQ ID NO: 38095 - DNA, 152 bp, Homo sapiens
  misc_feature 1..152: note = chr20:39319514-39319666
  misc_feature 1..152: note = hyper
  source 1..152: mol_type = genomic DNA
cgcgtgagccacaccggtgcagacgcgcctagattatttttaaatgttagaaggtaaaatatttgcctccaattaatctgaaaactctctattctcttgcgccctcggagaggctggggtacggcgtggtattgggccgcctatttttaata

SEQ ID NO: 38096 - DNA, 40 bp, Homo sapiens
  misc_feature 1..40: note = chr20:39994691-39994731
  misc_feature 1..40: note = hyper
  source 1..40: mol_type = genomic DNA
tatctcctacctggccgggccaggggagagaagggaggcc

SEQ ID NO: 38097 - DNA, 20 bp, Homo sapiens
  misc_feature 1..20: note = chr20:39994762-39994782
  misc_feature 1..20: note = hyper
  source 1..20: mol_type = genomic DNA
cggaccgcctttcctcctct

SEQ ID NO: 38098 - DNA, 544 bp, Homo sapiens
  misc_feature 1..544: note = chr20:39995002-39995546
  misc_feature 1..544: note = hyper
  source 1..544: mol_type = genomic DNA
gggtgcccggggcctcgacgccccccgcgggtgcgggcaggtgggagcggcgacgcgcgcgggcccatccctccctcttcccgcccgccgcccgcccgcgcttacttgtgcggccccgggcgcagccgcgggcgccatcccgtcgtgtagagactgtagcgggaggcaccgggcggcgcaggccgcgccaggagcggggtgcccctggcctgcgcccccgagagcagcgccgcgacggcgcacagccagacgagcaggcggcggcggcccatagcggcccccgcgcctctgcccggccccgcgcggtgccccccgccgggtgtccgcctgcagcgccgcgccgcccccgccgctggtcggcccgggtcccgccccgagggtcccggggtccccttcggcccccgagctcgctggcccggccgcctggcgcttcgcggcggctgcgtcccgcggagtggccggcgctgctagcggctggggccgcggaggggaggcgggaggcgggctctttgcggattagcataaacttggggccgcgccgctc

SEQ ID NO: 38099 - DNA, 313 bp, Homo sapiens
  misc_feature 1..313: note = chr20:39995547-39995860
  misc_feature 1..313: note = hyper
  source 1..313: mol_type = genomic DNA
ccgccgccagcccctcgccccagctccgagcggacggccgaggagccgcctgcgaacaggaggttccaaagggagcagccccaggtggcaggggcgcaggccgccgcgccctgggaggccccccgagcacaccagccactctgtcgcctgcgggcacggggcgagacgcagagaagcggacccctgaggccagcctgggcgtggactttccaggagtcgtccaccctcaggatacgcttgtcttcagagtccgtgtgaacccgggaactgctctccagggctctggagccgagatggccgtgactgggggcac

SEQ ID NO: 38100 - DNA, 624 bp, Homo sapiens
  misc_feature 1..624: note = chr20:41817292-41817916
  misc_feature 1..624: note = hyper
  source 1..624: mol_type = genomic DNA
tacaccaaaagcaatcggtgctaagaaactttaaggtgattttgaacttggaagtacacctgcagcactcccttctcttccctccgccgctactcttgggggggggggggctcgggggtggaagctgcctgcggtggggcttggtgatgtgtaagaccctggactgtggtgccctccagcacccgccaacgtgcctttaggagcacggcaggcaccacccccccgcccccgctccccctactctggggaactacctctgctcaccgccttcccgtggccaaacccaaatatgagttccccgaacttttcaggagcggacgcgctcacgggtcaaatccactcccctccaagggccttaacacgggcgcccagctacctcggagaaaagccagcgggtagggcggaggtattgctctcggtcatcaacgcaaacatcccctcgggtgcctacagcggcctgcttaggggagcagcgtgttcagagcaaatggagagcttcctgtatctccgaggaaaaaagaaaagccgccgccccggcagcctcggcctgctggggacctgtcctccccactaaaagcgcgcgctgcccgaggagctgcccgggagagaacgctccaccccggg

SEQ ID NO: 38101 - DNA, 742 bp, Homo sapiens
  misc_feature 1..742: note = chr20:41818007-41818749
  misc_feature 1..742: note = hyper
  source 1..742: mol_type = genomic DNA
cgcggaaagttactccagcccggggggccggcaggaaactgaagcggggaacttcgccaaacgcgggctgccgagggacgcgaggggccgggctcgctggccggggcgcgcggggacactgcttcccgcgcctgcaagctgagacccgggttccggccatggggacccgcgcccccgcgagcccacacaactttctcctccgagggccccgcggctgggggcccgcgcgcatccaggagggagcggggagcccaggggagccgggcgggcgcactcacctgcggcgctctgagcccgggcgccgggcagtggcggcagctgcagcctcaggagcaggctgagggcgagcgcggcgaggctcgccatccgggcggcggcgggcagctcagccccttcccgcgggggccggggccgggactggggcgggcgcggggtggccccgcatcgccggcgcggccgctggctgtgcgcgcggctggctccgctcgggctcccggagccggcgctcctgcgttccaagccgaggcgcggcgcgaactgaggcgggaggctgggcgggggcgggacgcggggggcggggggcggtgtcccccgagtcctaacgccgccgccgttgccgccgccgccgccgccgccgcccgcccgggcgctccgcctcggccgtgcacacaccctcacgcgcacgcccgcgcctggcacacgcccgcggctggcacacgcgggctcccccgcgcaccctctc

SEQ ID NO: 38102 - DNA, 383 bp, Homo sapiens
  misc_feature 1..383: note = chr20:41818804-41819187
  misc_feature 1..383: note = hyper
  source 1..383: mol_type = genomic DNA
cgcacccacacgccgggcagggtcctcgcctcttcgccccgcgccgcgccgcgcagccaagcatcgtctgccctgtgggggcgcaggtacgggggcggtgcggggaggaggaagctgcagcagccgtttgaactcggggtggggaacaggtgaatgggggttcggtggcgagaagagggagggagggagcagccctcgcaactcaagataaggggccaggtgaattgcgaaagcgggtgggggcgtctgcccaaagctggggcaggcggctgctggccagggtctcgggcacaccctgagatgagaatttcatctaagagcgcgcgcgcgcacacacacacaacccactcacactcttctgggcgcatcgctgaccgcgccac

SEQ ID NO: 38103 - DNA, 30 bp, Homo sapiens
  misc_feature 1..30: note = chr20:42019069-42019099
  misc_feature 1..30: note = hyper
  source 1..30: mol_type = genomic DNA
cctctgaggcgggggcggtggggggcgctg

SEQ ID NO: 38104 - DNA, 640 bp, Homo sapiens
  misc_feature 1..640: note = chr20:42136058-42136698
  misc_feature 1..640: note = hyper
  source 1..640: mol_type = genomic DNA
cggtccctgcgcccccgctgcgctctgctagctgtgatgcaggggttcgggggcaggaaaaatctcgacccgccacgcccgtgcggcaaacctgtcctaggttgagggggcatgaggcgcgcacaaccagggcctcgaaggcaggcaagagggcgcgggcgccacagaagcctgggcctgcgcctgggccgggcagatgtgcccggcgctcgggccccgcgctctgcgtcctgcagggaggcggacccgccccccgaacgcgcaggcgcgcggcgcccggctcggaccgtagctaggcgctgggcggccaccggctggccaggcaggtaagcaaccagcggtgcgtgggctcagaccttgcgtcccctgggcgccgcgccaccccgctccgtccagggcggcgagggctcaggtctgcggccccggcgtctcgctccttccgagcgcctccggcggggggcgcgggctggggaggaggttcgggaaaacgccggggaaagcggtctgggcggagcgcgcagggggccaggcgggtgcgggactccaggcccagccgaccctgcggcgtggcttcgggctgcgatcaggaggggcgaggagggtggaggctgcgtgtttggagatacgcaatcaattaaga

SEQ ID NO: 38105 - DNA, 62 bp, Homo sapiens
  misc_feature 1..62: note = chr20:42543184-42543246
  misc_feature 1..62: note = hyper
  source 1..62: mol_type = genomic DNA
ggcttctctcctcaccgtgggtggcgaaaggcgggacggaaaagcgccgtctggacaggcgc

SEQ ID NO: 38106 - DNA, 1043 bp, Homo sapiens
  misc_feature 1..1043: note = chr20:42543491-42544534
  misc_feature 1..1043: note = hyper
  source 1..1043: mol_type = genomic DNA
actgcccgcgggagccgccgccgccgccgccgcgcccgccatggacgtccgcctgtacccctcggcgcccgcggtgggcgcgcggcccggggccgagccggccggcctggcgcacctggactattaccacggcggcaaggtaggcgggggcgggcgggggtccccggcgggcggggccggagtcacctggcagctcgggactcaggcgctcccggggtcacacggggccgcgcacatcagccccgccgacgggcacgggcggctcacatcgatcccctcgcggccacgctcacgccctgagttgttgggatcgcgggcagaagtcatcccgacagccacccgtgcgacgacacagtggcccctcactcgcgtccccctgacagcctcgcagtcattcacaagccgtcacagtgacccacagccacacgcaggcggccaggcactgcttacacggtcccgccgtcccacgcaagtcaccctgacagtcacttatacacaacgacacgcaaccactcacccgcaaacagcctcaccgccacagacgagtcacccacagacgctccgatgccccacacaccgtgacatgcccccacccgctgtcacacccaggcacaacgggggacagtcacacaaagaagtcgcccgacagtcacactctcgcagccacaacgcctcacccaggcgcacgctgtcacacacagccacccccctggacggtgagcctcagacacagatcgtcctgacggccacacagtcacacgcggtcacacccagggacggccacacctcggtcatccacactcgcgcgtcgaggtttaacttctcagcgccgcagcacactaattgggcagtttactaattggccgtcactgcctggcggggcctcggattccgagtaggctgcggccaatcgaggcctgtgtcctcccgggagcggtgagccggcgtccctccaggctggggctgtagtgccggacaccctccctcctccatgtttccaggatctatccccccaccccagccaggtcccagctgcgctgcgc

SEQ ID NO: 38107 - DNA, 288 bp, Homo sapiens
  misc_feature 1..288: note = chr20:42544727-42545015
  misc_feature 1..288: note = hyper
  source 1..288: mol_type = genomic DNA
cgtcggtcccgggccggctggagccaagcgcgggttttcgtcactcggagcccggattgaacagcgcgcgtgggtttcccgcagccctggcgcagacgcgtgggctccgtggcgatgcggggtgagtgcgcgtccagtggctggatcggcgccccccagggtctctccccaacctcgcaggcttttcgtcaggcccctggtagtggggatgaggcaggagagaggcgtcccggcgcggatcccggggcctcccgggctgggcctccctgagtgcgccctcaggcccca

SEQ ID NO: 38108 - DNA, 170 bp, Homo sapiens; identical to SEQ ID NO: 13811
  misc_feature 1..170: note = chr20:42587835-42588005
  misc_feature 1..170: note = hyper
  source 1..170: mol_type = genomic DNA

SEQ ID NO: 38109 - DNA, 30 bp, Homo sapiens
  misc_feature 1..30: note = chr20:42876029-42876059
  misc_feature 1..30: note = hyper
  source 1..30: mol_type = genomic DNA
cgctggagagcgatgcggccaagccagcgg

SEQ ID NO: 38110 - DNA, 35 bp, Homo sapiens
  misc_feature 1..35: note = chr20:42876632-42876667
  misc_feature 1..35: note = hyper
  source 1..35: mol_type = genomic DNA
ctgcccctctgtctgcgggccgccttctggctagg

SEQ ID NO: 38111 - DNA, 61 bp, Homo sapiens
  misc_feature 1..61: note = chr20:43017338-43017399
  misc_feature 1..61: note = hyper
  source 1..61: mol_type = genomic DNA
gaggagcccaggaagcgcaaagcgcagcactgcggagagtcttggccgcctcctccgggac

SEQ ID NO: 38112 - DNA, 57 bp, Homo sapiens
  misc_feature 1..57: note = chr20:43438029-43438086
  misc_feature 1..57: note = hyper
  source 1..57: mol_type = genomic DNA
ctggctgaggttgtgcgcaggcctgggaggaggaggttcaagccgctggctggtggc

SEQ ID NO: 38113 - DNA, 885 bp, Homo sapiens
  misc_feature 1..885: note = chr20:43438334-43439219
  misc_feature 1..885: note = hyper
  source 1..885: mol_type = genomic DNA
cgccgggcaggggtcttgggcagggatcctctggatgtggccaagacaaagatggagaggtaaggtctgcgcgccacctccaatggcggggggcgcgtcggagccccaggggtgggacggccaaagcccagggcttgaagagtgggcacattcaggagactcagggagggtggcaggtcggctccagggacgaggcaaggggcctccaataggcgcgggtgaggagggagatgggtcctggcgacccaaagggcccacctgcgggaaaggtgaatgcagacaatctcggggtccctgggggagaaggccagaaggtagcgcatcctggagaccctggggtcccgtgggtgcggaaggagaccctgggggcgccttcccaggggattgggggtggggaggagggcgcacgggtcggggagggggctaccggacctggatcccgggacaccccgggggtctggggggcgggccgcgcgcttacctgcgtcctcgtcgtcgaaggagttcatgcacgggaagtagatggcgagcgcctcgaaggaggcggacagactgaggcggctctgcgagcgctccatgcccgcgccggcgccgggcgcctcggccgcggcggcggcggcggcggcgggcggcttgggcagcttggccgccccattcttgacgcggagtacggcgcgcggcgtggtggcggcggcccggggccgggccgaggctccgctgcggggctggcgggcgcggcggggccggcgggcgggccaggagctggcggcgcgcggagcccgaggcgcgctgtgctgctggcggcggcggcggcggcggcggtggcggcggcggtggcggcgcagcgcgctctggtccgcggcgccccccgccggcagcgcgagg

SEQ ID NO: 38114 - DNA, 305 bp, Homo sapiens
  misc_feature 1..305: note = chr20:43439247-43439552
  misc_feature 1..305: note = hyper
  source 1..305: mol_type = genomic DNA
cgtgccgccgggggagggggcgccgctgcggggcgtgggagcccggagggcgcgggctgcggcctcttctagcagcccccgggcccggcaggtgcgcgcggggaggcaggcgccgggcgaggttgtctgggccctggtccgagggctgttcccgaccccgcctcggcccccaccctcagccggccgacttgcggagaggccggcgtccagtccctcacccagacaggcctctcccagagacactggcgcgctcggaggggatgcgctcaaagggtcccgcccaggcgggtcggcactcggcctcc

SEQ ID NO: 38115 - DNA, 102 bp, Homo sapiens
  misc_feature 1..102: note = chr20:43726528-43726630
  misc_feature 1..102: note = hyper
  source 1..102: mol_type = genomic DNA
ggcgccagcaggaggcgcgacgacacctcgaagctgaaccaggcgatgcagaagtactcgaggcgtcgcagcaccgggtcgtcgcgcacgccttccgggctg

SEQ ID NO: 38116 - DNA, 24 bp, Homo sapiens
  misc_feature 1..24: note = chr20:43726764-43726788
  misc_feature 1..24: note = hyper
  source 1..24: mol_type = genomic DNA
cgagtagcccgggttctccatggt

SEQ ID NO: 38117 - DNA, 30 bp, Homo sapiens
  misc_feature 1..30: note = chr20:43922213-43922243
  misc_feature 1..30: note = hyper
  source 1..30: mol_type = genomic DNA
cctgacgccgcagtccgcctaatggtccgg

SEQ ID NO: 38118 - DNA, 371 bp, Homo sapiens
  misc_feature 1..371: note = chr20:44452668-44453039
  misc_feature 1..371: note = hyper
  source 1..371: mol_type = genomic DNA
ctttcatcagagattcgatctcctcgtccgtcacgtgctccccggaggccctgaaaatctcagccagctcctccgggtcgatgtagccgtctgcattccttcaggtccgagggacagggcagggctcagggccggggcgagctgccctggccaccacactcgacgccccgcttccgcactcccaacacggggaagcttccagcgctgccggccgggttctgactgctaagcccctccctcggctcccgggcccccagcgcacctgtcgaagatgcggaagcactcggccagctcctcctcgctcttccctttcgcgtcctctttcatctggcgcaccatcatgaccaagaactcctcgaagtcgatggtgc

SEQ ID NO: 38119 - DNA, 78 bp, Homo sapiens
  misc_feature 1..78: note = chr20:44519124-44519202
  misc_feature 1..78: note = hyper
  source 1..78: mol_type = genomic DNA
ctgtagagccctggccggctgcggcccaccaggcggtcccggggaatgcgaaactgctcaatgcgcagatatggttcc

SEQ ID NO: 38120 - DNA, 30 bp, Homo sapiens; identical to SEQ ID NO: 13818
  misc_feature 1..30: note = chr20:44540105-44540135
  misc_feature 1..30: note = hyper
  source 1..30: mol_type = genomic DNA

SEQ ID NO: 38121 - DNA, 364 bp, Homo sapiens
  misc_feature 1..364: note = chr20:44540444-44540808
  misc_feature 1..364: note = hyper
  source 1..364: mol_type = genomic DNA
acgttgccacggcaacgactgcacgcgcattcttggagggtggcttgcggtctcataggcctcgcgcccggggaggagaggaggtggccgaccagaccgtgggctcccgggtctcccggctccctcaggtcctaaatctctcccattagagattctgcctggagcccccatgttagcgttctccttcatcggctctcctccccacgccggcttcagtgcaccacgcggctcggcgagggactgggaacgggatagggacgcgccccaactcactcagcggtggagctggggggcggcgcggtcacgtgggatggcgggcagctcaggggatccgggcgacggggtctggcgggcagggttgttc

SEQ ID NO: 38122 - DNA, 348 bp, Homo sapiens
  misc_feature 1..348: note = chr20:44639148-44639496
  misc_feature 1..348: note = hyper
  source 1..348: mol_type = genomic DNA
gcgggcggtgattgacgacgcctttgcccgcgccttcgcactgtggagcgcggtgacgccgctcaccttcactcgcgtgtacagccgggacgcagacatcgtcatccagtttggtgtcgcgggtgagaacgtgaggagggaaaatccaagagacctgggcggggtcagggaagggaggaccacggagagcgtggaggcagcagtggccccggcttcctcttgcctgcccgcgctgccctggcttatacggcccctcctgccagacagtgcacagggccagggcgccaggctgggagagcttcgcgcaggcgggatttcagcccgcacttatttcggagcccttgcctt

SEQ ID NO: 38123 - DNA, 15 bp, Homo sapiens
  misc_feature 1..15: note = chr20:44639731-44639746
  misc_feature 1..15: note = hyper
  source 1..15: mol_type = genomic DNA
ctcccactcatcacc

SEQ ID NO: 38124-38125 - skipped (2 entries)

SEQ ID NO: 38126 - DNA, 25 bp, Homo sapiens
  misc_feature 1..25: note = chr20:44640312-44640337
  misc_feature 1..25: note = hyper
  source 1..25: mol_type = genomic DNA
cgacggctaccgctggtgcgccacc

SEQ ID NO: 38127 - DNA, 33 bp, Homo sapiens
  misc_feature 1..33: note = chr20:44640787-44640820
  misc_feature 1..33: note = hyper
  source 1..33: mol_type = genomic DNA
tgatggggggcaactcggcgggggagctgtgcg

SEQ ID NO: 38128 - DNA, 261 bp, Homo sapiens
  misc_feature 1..261: note = chr20:44650230-44650491
  misc_feature 1..261: note = hyper
  source 1..261: mol_type = genomic DNA
gattcaggaacccttcgcacagcgggcactaggaccctgcgcggcgccgcgtctcgcggggggcgggcgggcggagggggttgggggatccgctctttctccctcctagagcctggttgcagccacttgtgcgatcccggaccttgccgcggccgcctggctcctttccgcgccatgagccgcaggttcacggtcacctcgctgccccccgcagggcccgccagaagccctgacccagagtcccgccggcattcggtcgca

SEQ ID NO: 38129 - DNA, 58 bp, Homo sapiens
  misc_feature 1..58: note = chr20:44657782-44657840
  misc_feature 1..58: note = hyper
  source 1..58: mol_type = genomic DNA
tgctgagagggggcgcgcgcgggtgtgagcgtgtgtccgtgtgcgagtgtgtgtgcgc

SEQ ID NO: 38130 - DNA, 34 bp, Homo sapiens
  misc_feature 1..34: note = chr20:44658183-44658217
  misc_feature 1..34: note = hyper
  source 1..34: mol_type = genomic DNA
tccattggaatgctccgggcgctgtccaaggtgc

SEQ ID NO: 38131 - DNA, 171 bp, Homo sapiens
  misc_feature 1..171: note = chr20:44659126-44659297
  misc_feature 1..171: note = hyper
  source 1..171: mol_type = genomic DNA
ctcagccatccatcacggctgtcagccacccccaccccccactctccagcggcgctgcgtcccctgcgcactagcgcgcctcccgcgcctgctgtctgcgctcagcgccttcaaacgttcccctgggcactgcttgaccctatgagcctagactcccgcagatccctctgg

SEQ ID NO: 38132 - DNA, 30 bp, Homo sapiens
  misc_feature 1..30: note = chr20:44660307-44660337
  misc_feature 1..30: note = hyper
  source 1..30: mol_type = genomic DNA
cccagccccaggccccggggaggcttctta

SEQ ID NO: 38133 - DNA, 30 bp, Homo sapiens
  misc_feature 1..30: note = chr20:44660605-44660635
  misc_feature 1..30: note = hyper
  source 1..30: mol_type = genomic DNA
cgttcagggaggggacgaaatcagccctgg

SEQ ID NO: 38134 - DNA, 107 bp, Homo sapiens
  misc_feature 1..107: note = chr20:44660842-44660949
  misc_feature 1..107: note = hyper
  source 1..107: mol_type = genomic DNA
ggtcgccatggagaccggcgcggggccacctagttgcagggtctcgggccaggaagcccctattcctgtcccctgagcgccacccgcccccgcgaaggaggaggcgc

SEQ ID NO: 38135 - DNA, 30 bp, Homo sapiens
  misc_feature 1..30: note = chr20:44685865-44685895
  misc_feature 1..30: note = hyper
  source 1..30: mol_type = genomic DNA
gaagaaatcccgggacgccaagcttgtttt

SEQ ID NO: 38136 - DNA, 193 bp, Homo sapiens
  misc_feature 1..193: note = chr20:44686422-44686615
  misc_feature 1..193: note = hyper
  source 1..193: mol_type = genomic DNA
cgccgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcc

SEQ ID NO: 38137 - DNA, 166 bp, Homo sapiens
  misc_feature 1..166: note = chr20:44686627-44686793
  misc_feature 1..166: note = hyper
  source 1..166: mol_type = genomic DNA
cgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacg

SEQ ID NO: 38138 - DNA, 129 bp, Homo sapiens
  misc_feature 1..129: note = chr20:44687107-44687236
  misc_feature 1..129: note = hyper
  source 1..129: mol_type = genomic DNA
ctgcggctgcagagacgcgagcaacctcttctcatcggctcttatgcaagttggggccaggataggggaggggtgctcctcaagaggaagaaaccgagaggcccgcgccccaccgaggaagccccgccc

SEQ ID NO: 38139 - DNA, 30 bp, Homo sapiens
  misc_feature 1..30: note = chr20:44747259-44747289
  misc_feature 1..30: note = hyper
  source 1..30: mol_type = genomic DNA
cactggctgcccaagcgtgcctagacggcc

SEQ ID NO: 38140 - DNA, 77 bp, Homo sapiens
  misc_feature 1..77: note = chr20:44803049-44803126
  misc_feature 1..77: note = hyper
  source 1..77: mol_type = genomic DNA
gcaggaaagggggtccgcgggggaaacgcgttgtcctggggccccggcgtgtgctgggcgggtgagcagccgcgccc

SEQ ID NO: 38141 - DNA, 638 bp, Homo sapiens
  misc_feature 1..638: note = chr20:44803172-44803810
  misc_feature 1..638: note = hyper
  source 1..638: mol_type = genomic DNA
cggtggccggcgtagagcgcggccaggggccggaagcgcggaccccagctgctgagataggcgaagtcctgctcggagcccgacgagccgctgtgcagggagctgagcgaggcggccggcgagtccgcgccctcgaaggcgtaggtctggaaggcgtcgtagggcggcaccgacaggtccccgtccgccagtgccaccttgcggctgatgaagtccctgaacactgagaagtctggctcggggctcggcggcccctgcggcagcgagtggcgctcggagggcaggtgggcctgcggggggctgcccgcgcccccgcccgagcccccgcccgctcccccgcccgcgctgccgcccccgtcgccgcccttgagctcgccgaagtcgtagaggctccgcagcgccgacatgtcgtaggcttcggtgtcctgctcgccgccgccttcgtcgttgtatttgatgacgttgtcccgcatgtcttcatcctcgtccgagctcaggtggctcttgtggtggcgcctgagggtgaggatcagcagcaccagcactgcgagggggacagagggggcaactgagggccaagcccctcccagggcattagaaggaccctctaccccatctcctcccgcctcccacccagc

SEQ ID NO: 38142 - DNA, 45 bp, Homo sapiens
  misc_feature 1..45: note = chr20:44879746-44879791
  misc_feature 1..45: note = hyper
  source 1..45: mol_type = genomic DNA
cgcgtttgacgcggccggctcccagcgcgccgtcctgccgagctc

SEQ ID NO: 38143 - DNA, 127 bp, Homo sapiens; identical to SEQ ID NO: 13829
  misc_feature 1..127: note = chr20:44880040-44880167
  misc_feature 1..127: note = hyper
  source 1..127: mol_type = genomic DNA

SEQ ID NO: 38144 - DNA, 26 bp, Homo sapiens
  misc_feature 1..26: note = chr20:44880275-44880301
  misc_feature 1..26: note = hyper
  source 1..26: mol_type = genomic DNA
cgggttggggccggcagatcctgcca

SEQ ID NO: 38145 - DNA, 157 bp, Homo sapiens; identical to SEQ ID NO: 13830
  misc_feature 1..157: note = chr20:44936314-44936471
  misc_feature 1..157: note = hyper
  source 1..157: mol_type = genomic DNA

SEQ ID NO: 38146 - DNA, 92 bp, Homo sapiens
  misc_feature 1..92: note = chr20:44936608-44936700
  misc_feature 1..92: note = hyper
  source 1..92: mol_type = genomic DNA
cgaggttgtggggacgggtgggagctgcgggcttcgggccgagaggcggctcggctccgcgccggggaaagtttggacgtgggaaactccct

SEQ ID NO: 38147 - DNA, 263 bp, Homo sapiens
  misc_feature 1..263: note = chr20:44937023-44937286
  misc_feature 1..263: note = hyper
  source 1..263: mol_type = genomic DNA
agcgagagggggagccgcggcggcgtgtgcgcgcgtgtgtgtgagcgagagagcgagagagcgagagagcgagggagtgagcgagcgagcgggagcgagggagtgtgcgtgtctgactggggggaagtgtgcaagggacggatcccttccttcctcccgcagcctctggtggagactcggagaatgcagggcccgccgggcaggagccgcgcagcgccaagccgcaggcggccgccggcccggacccccgcagccggggaacc

SEQ ID NO: 38148 - DNA, 93 bp, Homo sapiens
  misc_feature 1..93: note = chr20:44937550-44937643
  misc_feature 1..93: note = hyper
  source 1..93: mol_type = genomic DNA
actactgcgggaggccgccttcagaggagcaggggcgcaggccagggtaggagcaggcttctcgaacagtggccgccccggcttgctgcccag

SEQ ID NO: 38149 - DNA, 177 bp, Homo sapiens
  misc_feature 1..177: note = chr20:44941484-44941661
  misc_feature 1..177: note = hyper
  source 1..177: mol_type = genomic DNA
aggggacggggaggccgcccttggctgggggcgccaggacggggaggggcgagcctgcgggagccacaggcgccgaggccgtgcgcccttaagcacctccacctcatggcgttaatcctcgcagaccccgcagccagactgcctgggttcaaatcccatcaccgccacttgccagct

SEQ ID NO: 38150 - DNA, 205 bp, Homo sapiens
  misc_feature 1..205: note = chr20:45141834-45142039
  misc_feature 1..205: note = hyper
  source 1..205: mol_type = genomic DNA
ctagctacttggatgcgtaaacctttcaccttcaccaagcgccttcttcgggcaaatcagggccctagagagagctcgcccgtggcctgcaggtcaggagcccaatcctgccctggctgcctcgcctcccgaccacaggaaaccctccctccaaagacagggagagcgcgcgtccaccctccgcagacccgaggcccgctccgcc

SEQ ID NO: 38151 - DNA, 77 bp, Homo sapiens
  misc_feature 1..77: note = chr20:45142151-45142228
  misc_feature 1..77: note = hyper
  source 1..77: mol_type = genomic DNA
cgggaccagggattcacgggctgcaggaccctcacccggaagagcctggcgaaccggaagggcgtccaggtaaaaaa

SEQ ID NO: 38152 - DNA, 128 bp, Homo sapiens; identical to SEQ ID NO: 1483
  misc_feature 1..128: note = chr20:45279854-45279982
  misc_feature 1..128: note = hyper
  source 1..128: mol_type = genomic DNA

SEQ ID NO: 38153 - DNA, 263 bp, Homo sapiens
  misc_feature 1..263: note = chr20:45280039-45280302
  misc_feature 1..263: note = hyper
  source 1..263: mol_type = genomic DNA
cgctgctgccagcgccgccatcagcgcgatcgcctggcggtacgggccggcccgggactgccccgcctggccccggcgccggcttaaagcctgggggagggtcggggaggggactgcgctggggaacccgccctctccctgctcctcctggaggaaaagggtggtgcctgcgcccctgggaccgggtgaaagaggcccgggaacgttggagaaagttaggcactagaattagcaaacgggaccccagccgcagggcagtgtgg

SEQ ID NO: 38154 - DNA, 386 bp, Homo sapiens
  misc_feature 1..386: note = chr20:45338398-45338784
  misc_feature 1..386: note = hyper
  source 1..386: mol_type = genomic DNA
tgcctgctggaagcccgaccccttcccagggtgtagacaccgcccccacgctcccctaagagtgcgcgccccctggctcccccagggccgccccggccggataccgcctctcgggtggccagcccgagactgcaggcctgcggcgggggctgggacggggctcggtcgcgcttccttccatcttcctttctgccccggaaaagtggcccctcacttgctgcagcgcccactcgggcccaggcactctcccgggcgccctgatccgacagccccaggcaagtgcagctgttcctggtctgcagatgaagaaatggaggctccgaaagaagcaaagcagttcatcgattcgctgagcgcggttgtgccccaggcgctgttgtgggcct

SEQ ID NO: 38155 - DNA, 1382 bp, Homo sapiens
  misc_feature 1..1382: note = chr20:45523196-45524578
  misc_feature 1..1382: note = hyper
  source 1..1382: mol_type = genomic DNA
ggaggtgcggggtgtcggtgggtggggaggaggctgggccctggcctccaggaccggcgagagtgagcgcgctctgctcggctgcaggctcaggaagcggcgcggcggcacgtgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtgagtaccgccagcggcgcccaccccaggccgcccgccgggattcgccgggcggggggagttgttcaccgggaccccctcgccctgcgcctctttctggcactcgccaagcggggcctccgcagctgtcgggacgttctggggcgcacgggcctcccagggccaggaaggcacaagggcagaggggacagcagcagagcccccctctggaaaggctctcccaggctcggggccccagtttccccatgcgctttggggcaacgaccctgaagtttgctctcccgcgcgcgggacaagtgcatggcgcgcaggcggtgtagacgcggctgggtccttggcgttttgttcgattatggtcccggcggttcgcgataaggggcgctcccccagtccgcaaactcaagccctcaggtagtgtttatgggataaccaagaagcagagccaaccgctggaatcccggcttggggctggaacggcccgctgagactttgccttctagctattgatatatttcttttcaaaagtccgtttgcgctcggcccgctctggttcaggtctggggctttgaaccggggcagggaatcctggcgcctgctgcgggtagagttgaaacttagaaaagtttacatccgaagggtgtttagaaggcggcaaggatttcgttgtaatgggagaaagtgggaaatggaattgttttttagtcatgaagtctggaggttaaacggccgtgctggcccaggctccttcaatatattcctgcctgcctcccccccagcaataaatagtttataagctcaaggaatactaggaaagcgtgactggtgaacgtactcctatcgcaaaagactcagtgcgcttttctcagctgttgaactggaagcgccttttgcagtgcgaggttcctgcttccccgaagccgaggctgagagttgacagcgtgcaccctgccgc

SEQ ID NO: 38156 - DNA, 128 bp, Homo sapiens
  misc_feature 1..128: note = chr20:46413326-46413454
  misc_feature 1..128: note = hyper
  source 1..128: mol_type = genomic DNA
accggcagcttctggcgcgcaggagccagatcctgttcagccgcgtttccctggaacagaacgcggtgcccggcacgagggggtgctccagaaatgcttgtagaacgaatgaacgaactactataagg

SEQ ID NO: 38157 - DNA, 279 bp, Homo sapiens
  misc_feature 1..279: note = chr20:46414635-46414914
  misc_feature 1..279: note = hyper
  source 1..279: mol_type = genomic DNA
ccccggccccggccccgaagtccagctccggacggggcagtgaacgcagagctggggtcccggcggctctcgacctcccgatgcctccggactcggctggccgcgctcccggcgccgagcgcgcaccctcgccgggacacacagacgcacactcactcgacacactctcgctcctgctcgccctcggcggagagttgaaacagatgtgggattcgcccaggagctggaaacgagggagggaagcgagccagagccttgtgtgcacgtgtgtgtgcgtaa

SEQ ID NO: 38158 - DNA, 30 bp, Homo sapiens
  misc_feature 1..30: note = chr20:46415157-46415187
  misc_feature 1..30: note = hyper
  source 1..30: mol_type = genomic DNA
cggtctgcaaacactcgactgcctttgccg

SEQ ID NO: 38159 - DNA, 42 bp, Homo sapiens
  misc_feature 1..42: note = chr20:46415427-46415469
  misc_feature 1..42: note = hyper
  source 1..42: mol_type = genomic DNA
gtctaccgtggtttccgctgtccctcgcgccacagaagaggc

SEQ ID NO: 38160 - DNA, 218 bp, Homo sapiens; identical to SEQ ID NO: 4822
  misc_feature 1..218: note = chr20:47443719-47443937
  misc_feature 1..218: note = hyper
  source 1..218: mol_type = genomic DNA

SEQ ID NO: 38161 - DNA, 297 bp, Homo sapiens; identical to SEQ ID NO: 4823
  misc_feature 1..297: note = chr20:47443944-47444241
  misc_feature 1..297: note = hyper
  source 1..297: mol_type = genomic DNA

SEQ ID NO: 38162 - DNA, 186 bp, Homo sapiens; identical to SEQ ID NO: 4824
  misc_feature 1..186: note = chr20:47444242-47444428
  misc_feature 1..186: note = hyper
  source 1..186: mol_type = genomic DNA

SEQ ID NO: 38163 - DNA, 129 bp, Homo sapiens; identical to SEQ ID NO: 4825
  misc_feature 1..129: note = chr20:47444452-47444581
  misc_feature 1..129: note = hyper
  source 1..129: mol_type = genomic DNA

SEQ ID NO: 38164 - DNA, 184 bp, Homo sapiens; identical to SEQ ID NO: 4826
  misc_feature 1..184: note = chr20:47444609-47444793
  misc_feature 1..184: note = hyper
  source 1..184: mol_type = genomic DNA

SEQ ID NO: 38165 - DNA, 295 bp, Homo sapiens; identical to SEQ ID NO: 4827
  misc_feature 1..295: note = chr20:47444920-47445215
  misc_feature 1..295: note = hyper
  source 1..295: mol_type = genomic DNA

SEQ ID NO: 38166 - DNA, 163 bp, Homo sapiens
  misc_feature 1..163: note = chr20:47934824-47934987
  misc_feature 1..163: note = hyper
  source 1..163: mol_type = genomic DNA
cacaagatctgtctccgttggcgtcccggtacctagcttgagcccgaccatgggcatgcgtggcgtggcgcgaatcctgtccctgtcgctcgtcctggccgcggtggccacgggggcctgggagcgggggccgctgggcgtgctcttgccctggcagggctcc

SEQ ID NO: 38167 - DNA, 1064 bp, Homo sapiens
  misc_feature 1..1064: note = chr20:47934988-47936052
  misc_feature 1..1064: note = hyper
  source 1..1064: mol_type = genomic DNA
ccgcgctgggccgctgctgtcctggccgtgacccgatgtttgtcgcccgcgggcccccgcgctgcttctgcgaccaagcgtgcggcgcggcgcggcgcgggactgctgcgcagactatacgcgggtctgcccaggtgcacccggggaaaggcaaggcactagcggaacgctcggagcggaggggagctggggcgggggatgagcggaggaagggagcccagcacctagggggctctgggcttggaggggtcacacgagccgagggcggggcgcggcgcttggggactggaagggtgcgccgcggggcagacgggacgtgcagggggtcgcgcgggcaaggagggacgcagacactcaggacctaaaggggaagcactggctgtggagctgcgagccgagaaagacgcgcaggttatgaacctgggtgcgttcatctcgggggacctgaaggagagggactcgtggagagttgaggggtgtttcggaggaggggcgcaaggactgctcacaggacttgaagggcggcaggaaggtggaggattcggcccaggtgcgggacgcaggcggtggaagggaaatgagcacaagaggcgcaggcaggaaggagagcgcctggtgcgagagaggaaggagcgcacccagtaagcggtgtcgggggggtcgtgaagcttggagggcctcgaggggagggaggcgcttgggttgaggtagggcgccagatttcgcaaatcaaaatacagcacacccagttaaactcgaatttcagataaacaaatctttctagagaaaaatatgtcctaaatatcgcatgggatatacttatactaaaaaattatttgttgtttttctgaaattgaaatctaactcggagtcctgtattttatctgagagccccagctggggacgggcgcggggccaagagagctgcgagggaggaggggttgcaagcttctttcgggcggaggggtcacaaggcgaatggagaaggtgacaaggagcatggagaaaccaagaaaagggctaacgcttggagagcaaggatggaaagacgctcaaagcggagg

SEQ ID NO: 38168 - DNA, 138 bp, Homo sapiens
  misc_feature 1..138: note = chr20:48099124-48099262
  misc_feature 1..138: note = hyper
  source 1..138: mol_type = genomic DNA
gggtgcagggggccccgcgggcgcgcgtcacggccgtcttctcacctccatcccgacggctgcgaggcagaaagcgaaagcggacgcgggtcagcaaacggggagctgggcatgctgtccccccgccccccacctctc

SEQ ID NO: 38169 - DNA, 30 bp, Homo sapiens; identical to SEQ ID NO: 13849
  misc_feature 1..30: note = chr20:48099543-48099573
  misc_feature 1..30: note = hyper
  source 1..30: mol_type = genomic DNA

SEQ ID NO: 38170 - DNA, 30 bp, Homo sapiens
  misc_feature 1..30: note = chr20:48100342-48100372
  misc_feature 1..30: note = hyper
  source 1..30: mol_type = genomic DNA
gcctgcctcccaccccgctcccctccagcc

SEQ ID NO: 38171 - DNA, 53 bp, Homo sapiens
  misc_feature 1..53: note = chr20:48184239-48184292
  misc_feature 1..53: note = hyper
  source 1..53: mol_type = genomic DNA
ccacccacaaaccctcggtcctcacctgaaaccccctcctaggtccctgccgt

SEQ ID NO: 38172 - DNA, 327 bp, Homo sapiens
  misc_feature 1..327: note = chr20:48184328-48184655
  misc_feature 1..327: note = hyper
  source 1..327: mol_type = genomic DNA
cgattcgccccgggggacctaccggaccccgcaccttcccaccttgcaccttcttggcagggggagcacggcctggccccctcacccacgtgcggggccccgggactcccacctccgagggtctcgccttgcccgggatactggagcgggactcgggccgggccggccgcgggctccgagacccttgggctgcagcccgggcgggagccgccccctttgtctggcggggccgagcggagcaggacactcaccgcgtgcggcggcggctcagtagcagcagcagcaacagtgcggccaggaggccgaggagcgcggcccaagccatcg

SEQ ID NO: 38173 - DNA, 109 bp, Homo sapiens
  misc_feature 1..109: note = chr20:48788910-48789019
  misc_feature 1..109: note = hyper
  source 1..109: mol_type = genomic DNA
gggctctttgccttccgatccaagctccgccctctgcagctctgctctgtgtatcccagagctgaccctgcggcgcctttcccaggctcgcgtccggtgagttcctatt

SEQ ID NO: 38174 - DNA, 129 bp, Homo sapiens
  misc_feature 1..129: note = chr20:49435030-49435159
  misc_feature 1..129: note = hyper
  source 1..129: mol_type = genomic DNA
cggccatcttgatctcgtccttccctcgagatggtttttattccgcagaggagccaggagtggaccacaaggtggcactctcgggcaccgatgcagggagccgttcagcggggacgctagactatattt

SEQ ID NO: 38175 - DNA, 30 bp, Homo sapiens
  misc_feature 1..30: note = chr20:49575750-49575780
  misc_feature 1..30: note = hyper
  source 1..30: mol_type = genomic DNA
ccaagtgctgcatggcgaggcactggctgg

SEQ ID NO: 38176 - DNA, 33 bp, Homo sapiens
  misc_feature 1..33: note = chr20:49576086-49576119
  misc_feature 1..33: note = hyper
  source 1..33: mol_type = genomic DNA
gaccaactgcgcggacggcggggtgctcggtgt

SEQ ID NO: 38177 - DNA, 11 bp, Homo sapiens
  misc_feature 1..11: note = chr20:49639123-49639134
  misc_feature 1..11: note = hyper
  source 1..11: mol_type = genomic DNA
cggcggcgaac

SEQ ID NO: 38178 - DNA, 50 bp, Homo sapiens
  misc_feature 1..50: note = chr20:49639135-49639185
  misc_feature 1..50: note = hyper
  source 1..50: mol_type = genomic DNA
tcccggacttcgcatcccggtgaccccttgggatgaaccgaagccggacc

SEQ ID NO: 38179 - DNA, 317 bp, Homo sapiens
  misc_feature 1..317: note = chr20:49639217-49639534
  misc_feature 1..317: note = hyper
  source 1..317: mol_type = genomic DNA
cgccacgcaccagcggtgactcccgagtcctctgtcgccctggcctccccgcaggcgggtttcgaggcccccgcagggagttcagggccacggccacgtgcagccgcccccgagcccgagtttgcaggctcggggtccggttcgcgctttggtggcgcccggcgaggctgcagcgcgcaaagttcccacctcaagttcccgtcgcggcgtccccgcctcggagttggcccggccgcggcttccgttccccccggctgcccacgggtccggggcgaggacgcgagaggggcctggaagtcgcccggggagcccgctct

SEQ ID NO: 38180 - DNA, 83 bp, Homo sapiens; identical to SEQ ID NO: 13853
  misc_feature 1..83: note = chr20:49639774-49639857
  misc_feature 1..83: note = hyper
  source 1..83: mol_type = genomic DNA

SEQ ID NO: 38181 - DNA, 115 bp, Homo sapiens
  misc_feature 1..115: note = chr20:49639882-49639997
  misc_feature 1..115: note = hyper
  source 1..115: mol_type = genomic DNA
cggccagttcctgagcccgcgtccgggactgctcgcgctacgccctccctcccgttgccttcttccccgtctgctctcccaggagcgaccaccctgcggccccttcgcctgcacg

SEQ ID NO: 38182 - DNA, 131 bp, Homo sapiens
  misc_feature 1..131: note = chr20:49640094-49640225
  misc_feature 1..131: note = hyper
  source 1..131: mol_type = genomic DNA
cgcggtgcaagtgctccggtggtcccgggtccgcgcccctagcagcaccgccccagggtctacatgtgctagatattaaaaccccactctccgctgccccggggccgcgctccacgcgcttacacatcctg

SEQ ID NO: 38183 - DNA, 45 bp, Homo sapiens
  misc_feature 1..45: note = chr20:49708478-49708523
  misc_feature 1..45: note = hyper
  source 1..45: mol_type = genomic DNA
gatctccacccctaccgcccttcatggtttcgggagaaagctgct

SEQ ID NO: 38184 - DNA, 118 bp, Homo sapiens
  misc_feature 1..118: note = chr20:49836918-49837036
  misc_feature 1..118: note = hyper
  source 1..118: mol_type = genomic DNA
ccgtcctgcaggtggcgcgcctgagcccgtgcacggcagcctctccggaaggtgaagcacgctgccgcactgggggcctgcctggggctctgaaagcccattacgctgttctccttgg

SEQ ID NO: 38185 - DNA, 270 bp, Homo sapiens
  misc_feature 1..270: note = chr20:50157750-50158020
  misc_feature 1..270: note = hyper
  source 1..270: mol_type = genomic DNA
gacaggcttcctccacgagccagtcagcacaagcccttcctacacactagatggaggcaagcccagagtgcgtctggaagctactaacaggcctgccactgagccttcaacaagcattggctgggctgggctgggctgtcaaaatcaggaagcctggttgggttttttgttttttccaagacaacctgctaaccagaaatacacagtgaggttgggcgtgtggccgcttccccctcctcctcctcctccctctaacgaatgctcctgtta

SEQ ID NO: 38186 - DNA, 65 bp, Homo sapiens
  misc_feature 1..65: note = chr20:50158354-50158419
  misc_feature 1..65: note = hyper
  source 1..65: mol_type = genomic DNA
tcaacacaaagtccccgtcaaccactgctcacaggaggtgatgggagctgcgtggcctcacttca

SEQ ID NO: 38187 - DNA, 30 bp, Homo sapiens
  misc_feature 1..30: note = chr20:50179106-50179136
  misc_feature 1..30: note = hyper
  source 1..30: mol_type = genomic DNA
acagaccccatgatgcggaggggatggcag

SEQ ID NO: 38188 - DNA, 48 bp, Homo sapiens
  misc_feature 1..48: note = chr20:50417842-50417890
  misc_feature 1..48: note = hyper
  source 1..48: mol_type = genomic DNA
cgctggccgcggaagcgtgggccaggtcagccgcgggagttcgctctg

SEQ ID NO: 38189 - DNA, 809 bp, Homo sapiens; identical to SEQ ID NO: 1485
  misc_feature 1..809: note = chr20:50720392-50721201
  misc_feature 1..809: note = hyper
  source 1..809: mol_type = genomic DNA

SEQ ID NO: 38190 - DNA, 437 bp, Homo sapiens; identical to SEQ ID NO: 1486
  misc_feature 1..437: note = chr20:50721234-50721671
  misc_feature 1..437: note = hyper
  source 1..437: mol_type = genomic DNA

SEQ ID NO: 38191 - DNA, 48 bp, Homo sapiens
  misc_feature 1..48: note = chr20:50721988-50722036
  misc_feature 1..48: note = hyper
  source 1..48: mol_type = genomic DNA
gggcagcccgcgccacctgggagctcgttagaaatgcagactctcggg

SEQ ID NO: 38192 - DNA, 120 bp, Homo sapiens
  misc_feature 1..120: note = chr20:50722096-50722216
  misc_feature 1..120: note = hyper
  source 1..120: mol_type = genomic DNA
atgcacattaaagtttgagaaaccgtgtctgcattttaacgagatccccaggtgattcgtttgcccattaaaatttcagaagcgcagctctcctccaactttaatgtgcgcacgagtcac

SEQ ID NO: 38193 - DNA, 30 bp, Homo sapiens
  misc_feature 1..30: note = chr20:50722730-50722760
  misc_feature 1..30: note = hyper
  source 1..30: mol_type = genomic DNA
ggttgagctaattagcgttcatgctcagac

SEQ ID NO: 38194 - DNA, 118 bp, Homo sapiens
  misc_feature 1..118: note = chr20:51589821-51589939
  misc_feature 1..118: note = hyper
  source 1..118: mol_type = genomic DNA
cgaagtagaggatgccgaggagaaaacagcaggcacccaagcgggcggcaggtaagagaaacggctccgcttcggggctgccctgtgcgccgagctcctcgcccgccctccttgcccc

SEQ ID NO: 38195 - DNA, 115 bp, Homo sapiens
  misc_feature 1..115: note = chr20:52789445-52789560
  misc_feature 1..115: note = hyper
  source 1..115: mol_type = genomic DNA
acaggatcagcagcccgtagccttctttgcggtagtcgcgataggccttccacggtttgatctccagccgctgcgggtacgcgctctcggtgcggtacagcgcttccagcaggca

SEQ ID NO: 38196 - DNA, 96 bp, Homo sapiens
  misc_feature 1..96: note = chr20:52789853-52789949
  misc_feature 1..96: note = hyper
  source 1..96: mol_type = genomic DNA
ggtttaccagggtgtcgtgctgtttcttgagaccccctttccagagaatctgcagcaggctgcccagcagtggccagctggtggggcccggcaggg

SEQ ID NO: 38197 - DNA, 100 bp, Homo sapiens
  misc_feature 1..100: note = chr20:52790081-52790181
  misc_feature 1..100: note = hyper
  source 1..100: mol_type = genomic DNA
cggcaagcgagcggctcttgctgatgggggagctcatggcagcgggggacaccggagcgcgggaaggcaggaggatggggtggggcgaggttggtacgag

SEQ ID NO: 38198 - DNA, 39 bp, Homo sapiens
  misc_feature 1..39: note = chr20:52790612-52790651
  misc_feature 1..39: note = hyper
  source 1..39: mol_type = genomic DNA
cggctggccagactccgagggacgcgggacccaggggag

SEQ ID NO: 38199 - DNA, 329 bp, Homo sapiens
  misc_feature 1..329: note = chr20:53091752-53092081
  misc_feature 1..329: note = hyper
  source 1..329: mol_type = genomic DNA
ctccccagacacacacgcaaaatcggcccttctcggggaaagggcaggggctgaagggggaggcggggtgggcggcggctggaaaaaagtgaaatttcctctcctcctaaaataagtcattggagcgaggagagcgagcgctatctcagtaggctgtgggcgaggtgcgggggtggcgggggcacgctccgggtccgccaggaggggagggatcggaaggggaagcggggagggaaaggtgggtgggaggcgcggggagcgttccagggcggctgctcacgggtggccgcagcccagtgctgggactcgcgcggctcctcctcttagcc

SEQ ID NO: 38200 - DNA, 92 bp, Homo sapiens
  misc_feature 1..92: note = chr20:53092141-53092233
  misc_feature 1..92: note = hyper
  source 1..92: mol_type = genomic DNA
tccttctcggccgggaggaggcagggctggatccctcagccgccgccgctcctcctcctggcaggccggccgcggagtcagctgacgccggc

SEQ ID NO: 38201 - DNA, 100 bp, Homo sapiens; identical to SEQ ID NO: 13865
  misc_feature 1..100: note = chr20:53092234-53092334
  misc_feature 1..100: note = hyper
  source 1..100: mol_type = genomic DNA

SEQ ID NO: 38202 - DNA, 198 bp, Homo sapiens
  misc_feature 1..198: note = chr20:53092335-53092533
  misc_feature 1..198: note = hyper
  source 1..198: mol_type = genomic DNA
ccttctaaagcctcgcccagcgccgccgaagcagcttcacctctccaactttctcccaccgactgcttgtcttgaccctgccctccaccctccccagagccacttcgggtgcgcgctcttgggtaaagggggggtcaccggctgtctgggatggcttccaattttaatgacatagtgaagcaagggtacgtgaggatc

SEQ ID NO: 38203 - DNA, 182 bp, Homo sapiens
  misc_feature 1..182: note = chr20:53092686-53092868
  misc_feature 1..182: note = hyper
  source 1..182: mol_type = genomic DNA
cgcgtctccggggctgtcactgtaaggccagcgtctaggtatgtaatggatctatctttatctcttggatgacttggctttctgatggtggccgcgtgttgggcttcagtagcccctggagcccatctactcgaaataaatatttctcggtagccatggaagttggagctgagaagcccggg

SEQ ID NO: 38204 - DNA, 337 bp, Homo sapiens
  misc_feature 1..337: note = chr20:53092912-53093249
  misc_feature 1..337: note = hyper
  source 1..337: mol_type = genomic DNA
cgccgccaacttaacttttccgggggatggatcggctggttgagaaagaggacacgcatactcggtgtgaacgaggtcacgaaccctctgaccccagggagagatttctgccaagcgtaaggtgtctttggatccccccacctctgtcccaggtgtcgtgtcaaaggcggtgcgggctggcctctggtcggggccaacttgggtagatacttgaatctggattttccgtggttcgaagccggggtggtggatttctgttgctggaatacaccctggaggtccacggaagggttatttacgtggaacctgatacctggcatagcgcaagtgctcccta

SEQ ID NO: 38205 - DNA, 686 bp, Homo sapiens
  misc_feature 1..686: note = chr20:54578078-54578764
  misc_feature 1..686: note = hyper
  source 1..686: mol_type = genomic DNA
tcatcaagccaaacacggagcaccaggtcgctaaacagcagctacagcttccgtcagctcttcccctactctcatcaacctcaaagtctgtctttccccagctatttgcaattctctgaaaggacatgagcccgggaagggagaactggctcccaagcgctttcctacaggagctcagcgcagttgccaaattccttttcctcccctcctccgcaacttttctctaagtaccggagaagggcttgctgcctactccgaggcagcggcagtgccagcggtgcctggcacacgaacagtggaacctgcaggcgagatctgacccccggctctgcccccgccctccgcggccacctgcccgatctctgaagagtgtggaagcccggggctctcttgggagagaagcttctctacctgggagaaacaaatcaaacatttatcctgttccgcaaaggtacccagggagcagcctcagcggcacccgcagaggagtctgagcaagggcaccaagatctggccaagagataacgacgtccagggaccaggtgcccttcggctcccgccgacctgttgctcgaaacttgccctgagctctcgctgccgggctctgggctcccaagcctctcccccgccgccgcagcagcctcttttaggggcccggaagaaatgggagccggggctggtgagag

SEQ ID NO: 38206 - DNA, 442 bp, Homo sapiens
  misc_feature 1..442: note = chr20:54580080-54580522
  misc_feature 1..442: note = hyper
  source 1..442: mol_type = genomic DNA
gctgggttggcttatcgcgcaacccgcgggctccgagaaaagggggagaaggcgtctggtgaccccatctgagcagctctctcctgacgtttaacgcaccccaaagcaagcggggcgcacagcactggtgattggcaaggttcgaggcccctcagcccctgaaagcccgtggcgtaaaggatgcgtgcccagagaggagcccacggccctgcgctggccccagctccgcgcccactctctcctgctcgatctgagtccgcagaggaggcggctggtcccctcacccctcccagcgcggaactctgccgccgagtgccctccaagcggagcgcggcgctgccaggccgggtcgcgaaaaaggataagccgccgcggacccgcgctgcgcgctgccccgaacctggggaccggcgggcgtcccgaccgcgcctggccgggagcc

SEQ ID NO: 38207 - DNA, 52 bp, Homo sapiens
  misc_feature 1..52: note = chr20:54580621-54580673
  misc_feature 1..52: note = hyper
  source 1..52: mol_type = genomic DNA
cgctccgggaagatgagcctcagaagccgcaggggcgcgccttccccccaca

SEQ ID NO: 38208 - DNA, 65 bp, Homo sapiens; identical to SEQ ID NO: 13872
  misc_feature 1..65: note = chr20:54919287-54919352
  misc_feature 1..65: note = hyper
  source 1..65: mol_type = genomic DNA

SEQ ID NO: 38209 - DNA, 413 bp, Homo sapiens; identical to SEQ ID NO: 1487
  misc_feature 1..413: note = chr20:55199898-55200311
  misc_feature 1..413: note = hyper
  source 1..413: mol_type = genomic DNA

SEQ ID NO: 38210 - DNA, 742 bp, Homo sapiens
  misc_feature 1..742: note = chr20:55200615-55201357
  misc_feature 1..742: note = hyper
  source 1..742: mol_type = genomic DNA
cgtacggatgggctccgggatgttagtggagaggtgacaggagtctaccatcccacggccaagcgtgtgaggcctccggcgggcgggggtcccccccggggcagggcagggggagagtcaggcatgtctctaacgggctccctagtagaaccgctaggaaagtggccttcaaccctaggcacctttgtggctttcaggtagttgggcgactaaaaattcacttttgcctgctgtgaaatgggacaggtggttgtcaggttagagactgtgcccacgaagtctcgtttggcgggccgggactgacgtggacccgggccctcctcggaagcttgggaacctgtgagcccctcagctcctcgcctcactttgcctgtttgaaaaaaggagttgtttgagaggaagagttaaggctcaaaaggttctaaacgaagagcatgcggcctgacgcggagcgcaaagaagcgagcagtgaactgaatctggtgggactgagaccagaggcgtctgtatgcggcggccgcttcgcgccctattaaagcaatctgttatttacgataatcatttttgtaattattttggagtggctgtgacttgatgtctgtggtgccccagggcatgcccttactggacatagatacttcagggtgccctttgacgccagtgtcggtccagtgggtgccagtgccgcgaagggagggtggcgggcgtgaatgccccctcctcctgggtttgccgcaggccc

SEQ ID NO: 38211 - skipped

SEQ ID NO: 38212 - DNA, 489 bp, Homo sapiens
  misc_feature 1..489: note = chr20:55201580-55202069
  misc_feature 1..489: note = hyper
  source 1..489: mol_type = genomic DNA
cgtctggggtgggggcaggggtggcggatgactcaggcctggggccgggagccctgtttccaaaggcaccacctcgcgcctctttggaagtggcgcgctgttggggcgctcccgctgttgcagaggcctggtttgcggtttcataggggcgtgggtccagggcttccagggagtaagtgagtttaggctccctagggggcggtagaggggaacccccgacaaccttccatcctcttctccaggcggctgcgaggcctccggggttccagaggggtccccttctgccggtgccggctgtcttgagcgcggccacgcagtccgcgtcttcacgtgggcaaggggcggggacgttggagggaggctgtcttggatgctggagccttcggttcccggctctgctgagcagaaaagttgaagtcaaggaagggttgaggcttcctcacaagggcgcgcgcgtgcctgggtgccggcccagaagccgagaatgtg

SEQ ID NO: 38213 - DNA, 749 bp, Homo sapiens
  misc_feature 1..749: note = chr20:55202358-55203107
  misc_feature 1..749: note = hyper
  source 1..749: mol_type = genomic DNA
gggcagctttggctagtgttgctgtgggaaaggagagccagggcctgggatgggggatgagcaccttcttgcccattccgggccccagcgtgcaggaggtaaacttgccagcacagacaagacagcttgttcaagctgcacctcaggccgggtcagagaataaaaccgagggctagaaggcccagaatgtcggacagcccagcggcacccgtcagggagtcccaggcgcccgaaagaggcgccgcacctctggcgagtctaggacccatcttcctggacctgtgctctggagtgcctgcgggcctgggtctaatttctgcttctggcaggtgtccccctcccccgccgctaataccaggagcgctgcttctgcggtaacttattttacccccagaagcctgttttgggaccgaagtgtcagggtcctgtgtgtctttttatgcactgttctccttagtgcaaagccctgcagatatgcttggccgaaaagtctcagtggtttcaacttccagattttgttcccgcgtccggtcggaaaatcacctgggatttggctgctgtctaaggccgggggaaagtttcccttggaggacgcctattattattattttcttttaggcccacctgggtctaaataaatgctaaagttcaaacgaacccgagaaggaacagcgaggcagtggatgccgccattccgtggatgggagagtcatgtctactgcaggtgcggacaccgtactgataggcat

SEQ ID NO: 38214 - DNA, 896 bp, Homo sapiens
  misc_feature 1..896: note = chr20:55204104-55205000
  misc_feature 1..896: note = hyper
  source 1..896: mol_type = genomic DNA
gtgacagaaggaaggcgcgtcgggggacccaggcctcgcaggtcttcggctgtcaacgaggcaccgcccactgactccgcgcttcgtccctcacagcgtggggctcggcgctgcgccaggcccgggtgcggggcggagctaggctgggactggctgggggccgccccgcccggcgcctgggcctccgcgccggcccccggggaggagttatgataatttccttctcattaaggcgctcgggtcccccggctatcgccaggacacactgttcgggcgcggctttccccgtccgcggagcggtcttgacactcgcggcggcagcatctacgctcgcagagccgccgatgcgtgtccagtgacccggacagcaaggcccgcgcgcggcgggggcggcggcagacgcctggtcaccgtgaccccgattttggatttaccgcttgggggctggggggatcctggatttaactggcgactgttttgggggacgccggacgccatgttgtggaaaataaccgataatgtcaagtacgaagaggactgcgaggtgagctggggctccggggtgcagccccgccccgccgaggacagtccgggaggcaggggccactggaccgaggtcggggacgagggcataggagccctggcctctcggtgggacgggatccacttctccggacaccccttagtccatttctgcggggcccctttcctgtatagggccttttcctaaatagcctcccctcgggaacgaggcctggaaagagaatggcaaatcccacccacacagcttaccgggcgctttcctaagcggcaaacagccctgcttcccgttttctcggaaaagtgccccgtctgcaaccctcagacgtggcttttacgcacgaagtctctgtcca

SEQ ID NO: 38215 - DNA, 123 bp, Homo sapiens
  misc_feature 1..123: note = chr20:55205304-55205427
  misc_feature 1..123: note = hyper
  source 1..123: mol_type = genomic DNA
cgggagcgcggagctcgggctacggactcgcgggagttcactgcgcctccgggccctggagggctgcccctgcccgcaggcccgggcgcttccgccaggaggcgacagcgccatgttcctcca

SEQ ID NO: 38216 - DNA, 15 bp, Homo sapiens
  misc_feature 1..15: note = chr20:55205765-55205780
  misc_feature 1..15: note = hyper
  source 1..15: mol_type = genomic DNA
ggggcgggggaggtg

SEQ ID NO: 38217 - DNA, 137 bp, Homo sapiens
  misc_feature 1..137: note = chr20:55206293-55206430
  misc_feature 1..137: note = hyper
  source 1..137: mol_type = genomic DNA
cgggtcccccacctctcctccgccgggcagcacctctacagccccgcgccacccctctcccacactggagtcgccgaatatcagccgccaccctactttccccctccctaccagcagctggcctactcccagtcggc

SEQ ID NO: 38218 - DNA, 42 bp, Homo sapiens
  misc_feature 1..42: note = chr20:55405254-55405296
  misc_feature 1..42: note = hyper
  source 1..42: mol_type = genomic DNA
cacccccacaccttccggtttccaccccgggctcatttgtct

SEQ ID NO: 38219 - DNA, 30 bp, Homo sapiens
  misc_feature 1..30: note = chr20:55499420-55499450
  misc_feature 1..30: note = hyper
  source 1..30: mol_type = genomic DNA
ttaaggagagtatcacgtttatactttaaa

SEQ ID NO: 38220 - DNA, 511 bp, Homo sapiens
  misc_feature 1..511: note = chr20:55499791-55500302
  misc_feature 1..511: note = hyper
  source 1..511: mol_type = genomic DNA
aaaggggggggaacccgattagttccaaataagcgtctcttaatcacccttatgaaggcgtaatttgcaaaacactcctaggaagtaacatctttttcatttcaggggaaaaaaaaagtgcattgataaaaaataagtagaacattttaattaaaactcataaagttgtggacatctggttgggattgttcgccgcggcggtgattagcggatccgtgcacctagataatgaagcctggtcgcggttattggcagaagggcccgggcgcgctgtgagaacgctgcaggctcactttgtagtgcggggcctacgcctattagattccaatcagtttcgcctaaaaaggggaggagggcggagtgggaggggggcccagagttaaacacaggaaacaagcgttgagtgtgtgccaataaaaatggtcacaaatcagggctgctgatgtcataaccctgggggtcgggggtcagggggagtgaatgcgcctgaaagggaccgcctgtctgcggc

SEQ ID NO: 38221 - DNA, 230 bp, Homo sapiens
  misc_feature 1..230: note = chr20:55500440-55500670
  misc_feature 1..230: note = hyper
  source 1..230: mol_type = genomic DNA
cggctcttttgcatgcaggcccgcctgaatggggcgcctggaggctgcattgaggccgggctgtgtaaactgtagggtgcctcgccgactcggagccgcagagactggcggcgggtcaacttggaccactttgcattcacgctttgaataggcggagcgggaggcgtcctttcccgcggccgcctttcagccgagagagtgacagattggaggtcagcggctggcgggac

SEQ ID NO: 38222 - DNA, 50 bp, Homo sapiens; identical to SEQ ID NO: 13885
  misc_feature 1..50: note = chr20:55500671-55500721
  misc_feature 1..50: note = hyper
  source 1..50: mol_type = genomic DNA

SEQ ID NO: 38223 - DNA, 63 bp, Homo sapiens
  misc_feature 1..63: note = chr20:55501052-55501115
  misc_feature 1..63: note = hyper
  source 1..63: mol_type = genomic DNA
cgtaggagcttgccggtctccgaccgctgctggcctgcgaagccggcacgtttacaaggctca

SEQ ID NO: 38224 - DNA, 87 bp, Homo sapiens
  misc_feature 1..87: note = chr20:55588889-55588976
  misc_feature 1..87: note = hyper
  source 1..87: mol_type = genomic DNA
tcaaaagcaattttccgaaagtgcctgcctcgacaagcaagccaccggcccgcgcagtccggggctacagagcgctcaagacctttc

SEQ ID NO: 38225 - DNA, 56 bp, Homo sapiens
  misc_feature 1..56: note = chr20:55839612-55839668
  misc_feature 1..56: note = hyper
  source 1..56: mol_type = genomic DNA
tcgcgtcgccggggtcgtcgcggctccagtcggaaaccgggacccccagccgcccc

SEQ ID NO: 38226 - DNA, 87 bp, Homo sapiens
  misc_feature 1..87: note = chr20:55839692-55839779
  misc_feature 1..87: note = hyper
  source 1..87: mol_type = genomic DNA
cgcaacccaatcgccaaaacctgtggtttgcgcgccacacgtggtaaatgctgaaaatagattctgccggcccgggacctaccacta

SEQ ID NO: 38227 - DNA, 672 bp, Homo sapiens
  misc_feature 1..672: note = chr20:55840929-55841601
  misc_feature 1..672: note = hyper
  source 1..672: mol_type = genomic DNA
catgaacatgggtgccgagttgtgcttgccctggaggtgcgggcgcgggcggtggggcaagcccaaaatggagaggatctcgcgctgcatctcccgccgctcctggctgcggaggcgccggtggatgaagctcgagtgcacctcgttgtccaggctgaagtcggccagggcggagcgcagcaggaacaggggtgcccagagcgccacgaagctgtgcggcgccgcagctcgcagtgagcgcacgtgcatcgcgccggctctacgcgctacccgggctccgggctccgggcccgcaccgccccaggtggcagagggggcaggcggccgtccgcgccgctcggtcacttgctgcagacgggccccgctgcgcccgcgccagacatggcccctccccggccggccgcgctctgcccggacccccgccccctgctcggtgctggccccgggcccctcgccccgcactcgcccgggcgcaccgcagggcttggaaagcagccccggcgaacgaaaaggcgagtgaggaggcgggcgcgggtgggaggagcagccagcaagcctaggagtccagagagccaacgccggggaggcagcgaggaggcaggcgggcgggcgagcgctccttcttcccgctcctctggcgctctcgccctcgggcggcggcaacccaccctc

SEQ ID NO: 38228 - DNA, 232 bp, Homo sapiens
  misc_feature 1..232: note = chr20:55842055-55842287
  misc_feature 1..232: note = hyper
  source 1..232: mol_type = genomic DNA
cggtgacccttgagccggtcttgcccctcagtccctgtatccttttaagccagccacgctgacccctccgcgcctccctgaagccgttgccagcctgtctctgcgctcgccattccctccgcctggacctctccccactcaccacctcccgcccccatcagacgctgctttctcctcccagagacctccaagacctgccaagctgaggttgtttcctcgcctcgcccctcgc

SEQ ID NO: 38229 - DNA, 774 bp, Homo sapiens
  misc_feature 1..774: note = chr20:56803351-56804125
  misc_feature 1..774: note = hyper
  source 1..774: mol_type = genomic DNA
cccgcacggtcatgtcgccgcggcagtttgccactcggaacatctcccccgtctcctccagccgcacccgcaggacgaagacgtcaggggccaagtcgggcaaggcactcgcggccttcgggtcacagacgagccgctggctccggccgcgggcacaggccaggggctgcgcggggagggcccgcgagtccgccgagcccaccctgggcccgccgcacccctgagccccggcccgcgcaccgctcctgcgtcccgcattggggtgcaggcgagaggcgcccccagttggccccgccgcccgcgctccgcccgcccccgccgccgcccgccgcatcccccaggcgcggccgcgcgtcatccgcggctcgagtgcggtggccacgcgtcatcgccgcccccgccctgacgccccaaggcgggcccatgcgccccccgccccactgtgacgcccaggccccgccaggaccgccccctccagacgcaaggcgaggcccctccctgcctgccgcccgagcctccagggagaccgatgggcgggcggccccccaaggtcccgcagtcctttcccgctccgcgatgaacaaagccgcagtttcacgcggccgcgggagacggttcttaaataatggaacaggacataagtgcttcccagagcaaccgggagatttattgataaatacagagacatcgccgggcagccacgctccgacaacccgcactgggcccccgtcccgagctcaggccacgtccccacctcctcgaagcctccaagct

SEQ ID NO: 38230 - DNA, 15 bp, Homo sapiens
  misc_feature 1..15: note = chr20:57089445-57089460
  misc_feature 1..15: note = hyper
  source 1..15: mol_type = genomic DNA
ctacaggccaggccc

SEQ ID NO: 38231 - DNA, 280 bp, Homo sapiens
  misc_feature 1..280: note = chr20:57224800-57225080
  misc_feature 1..280: note = hyper
  source 1..280: mol_type = genomic DNA
tcctcacagtgaactcgcccagccctgctcgcggctctctcgattttatgtgggtttcgttggatgcattttgttatttgcctcaatggatgtttcacattaatttttagttgcacaacgaacgcgcgggaacattctccgtgagagaaaaagcacgggtggggggcggttaccggtgcttcccccggtcgcctgggggtcccgcacgcgccccgcgggtgccgctgtctggctggggtccctgggtgagccgcgggcaccggcttcgcgtctccccggg

SEQ ID NO: 38232 - DNA, 195 bp, Homo sapiens
  misc_feature 1..195: note = chr20:57225218-57225413
  misc_feature 1..195: note = hyper
  source 1..195: mol_type = genomic DNA
cgcagcccggcccgcagcctcgccccgcaaggggaagccggccctgcacaggcccggggcccggaaggcgccgccgcacagctctgcgcccccgacccgctccggccgcgcgctgggccaggcccttggcctcaagcctcccgggcggctccgggccggacccgggtctccgtcgcgggacgccagcctgtttgt

SEQ ID NO: 38233 - DNA, 300 bp, Homo sapiens
  misc_feature 1..300: note = chr20:57875589-57875889
  misc_feature 1..300: note = hyper
  source 1..300: mol_type = genomic DNA
agcccctctggggggcggggaggcgacgggggtggtgcagaagccagaaaagcccgagccacagccggccagctccgcgcagggatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctcc

SEQ ID NO: 38234 - DNA, 47 bp, Homo sapiens
  misc_feature 1..47: note = chr20:58152512-58152559
  misc_feature 1..47: note = hyper
  source 1..47: mol_type = genomic DNA
ccgccggcgcctccccgcggccccggctccgctccgcggccctccgg

SEQ ID NO: 38235 - DNA, 238 bp, Homo sapiens
  misc_feature 1..238: note = chr20:58179141-58179379
  misc_feature 1..238: note = hyper
  source 1..238: mol_type = genomic DNA
ttcggagcgagggttcggagggtccggggtgccctagcaggcccaggccaggtggttgcggggaggaagcctcaggtcgctcccctccggtgccggggtgggcgcgtcgggacccactggcctcccagtcccaggagaggaaggaccagggaaaccagctgtctgcagctgctggggaaattaggggctctcagggttccctttcctccgggaggggaggaaacgggactaggaagct

SEQ ID NO: 38236 - DNA, 102 bp, Homo sapiens
  misc_feature 1..102: note = chr20:58179793-58179895
  misc_feature 1..102: note = hyper
  source 1..102: mol_type = genomic DNA
gaatgggaataaacacgaataaataacaaagcgaggccgcgcacgccgggatgcgcctggctgcagccggcgaggctattgtctccccgccctgaagccagc

SEQ ID NO: 38237 - DNA, 190 bp, Homo sapiens; identical to SEQ ID NO: 13892
  misc_feature 1..190: note = chr20:58180213-58180403
  misc_feature 1..190: note = hyper
  source 1..190: mol_type = genomic DNA

SEQ ID NO: 38238 - DNA, 106 bp, Homo sapiens; identical to SEQ ID NO: 13893
  misc_feature 1..106: note = chr20:58180470-58180576
  misc_feature 1..106: note = hyper
  source 1..106: mol_type = genomic DNA

SEQ ID NO: 38239 - DNA, 53 bp, Homo sapiens
  misc_feature 1..53: note = chr20:58508817-58508870
  misc_feature 1..53: note = hyper
  source 1..53: mol_type = genomic DNA
catcccccccacccccgccaacgctcgccggggtcgcccgaggcctgagccaa

SEQ ID NO: 38240 - DNA, 30 bp, Homo sapiens
  misc_feature 1..30: note = chr20:58514777-58514807
  misc_feature 1..30: note = hyper
  source 1..30: mol_type = genomic DNA
cgcaggatgatgggccgcaggcgggggtcg

SEQ ID NO: 38241 - DNA, 94 bp, Homo sapiens
  misc_feature 1..94: note = chr20:59804316-59804410
  misc_feature 1..94: note = hyper
  source 1..94: mol_type = genomic DNA
gaaaccccctgcaggcgcggctgcacctcaagcccggcggggcgaggacgctgagctgcagacagcgccacctagcgtccgagagccacggcgc

SEQ ID NO: 38242 - DNA, 101 bp, Homo sapiens
  misc_feature 1..101: note = chr20:59826877-59826978
  misc_feature 1..101: note = hyper
  source 1..101: mol_type = genomic DNA
cacccctgagctgcccgacctgggttcaagcccgggtcaggggagttagcaaggagacacctgaaaaataaaaggacagaatggaagtgcacactcccacc

SEQ ID NO: 38243 - DNA, 68 bp, Homo sapiens; identical to SEQ ID NO: 4843
  misc_feature 1..68: note = chr20:59828340-59828408
  misc_feature 1..68: note = hyper
  source 1..68: mol_type = genomic DNA

SEQ ID NO: 38244 - DNA, 147 bp, Homo sapiens; identical to SEQ ID NO: 13897
  misc_feature 1..147: note = chr20:59829066-59829213
  misc_feature 1..147: note = hyper
  source 1..147: mol_type = genomic DNA

SEQ ID NO: 38245 - DNA, 30 bp, Homo sapiens
  misc_feature 1..30: note = chr20:60794906-60794936
  misc_feature 1..30: note = hyper
  source 1..30: mol_type = genomic DNA
gagcgcggccagcaccgcggtccaggctgc

SEQ ID NO: 38246 - DNA, 451 bp, Homo sapiens
  misc_feature 1..451: note = chr20:61339658-61340109
  misc_feature 1..451: note = hyper
  source 1..451: mol_type = genomic DNA
cccaggagtgggggtcggcccaaccagctgcgcagccgcccagccctgccagcggggagcttcctccctccctgccctccggatacaccctcaccccaactgagcgagcccagggttgggggaggtgcatagttcccttcctagccggtgcgagaaattgcggagaacagggaagagggtggcaggaagggtctggtgcacgatacccgccgcgcccgctcggaatcctggttccctggagcgctcaccccagcccgccctgccccggggagcgcgagggggcgacccgccaggctgcacccgggcggggcggggatggcggcgggggctgcctccctcctccgccgccaccccccactgctgggcgcgccgcgcggccgccggctccgtggagacgcgcagagccgggagggcgcgggcgcggcgggaggtgtgcggggctggggtgcgc

SEQ ID NO: 38247 - DNA, 579 bp, Homo sapiens
  misc_feature 1..579: note = chr20:61340110-61340689
  misc_feature 1..579: note = hyper
  source 1..579: mol_type = genomic DNA
gagagcgcgagggaggagattctgagcgagggaggggagcgcgcccgggcagcagtgcgtgcgctcctcccggcgccacaagctcgccccgcgcagcccgagccgggctgggcgctgtcctcgggggcctggggaaccgcgcggtttggagatcggaggcacctggaacccgtggcaagcgccgagccgggagacagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcccgttcatcggtccccgcctgagacgcgcccactcctgcccggacttccagccccggaggcgccggacagagccgcggactccagcgcccaccatgcgcctcaacagctccgcgccgggaaccccgggcacgccggccgccgaccccttccagcgggcgcaggccggactggaggaggcgctgctggccccgggcttcggcaacgcttcgggcaacgcgtcgg

SEQ ID NO: 38248 - DNA, 79 bp, Homo sapiens; identical to SEQ ID NO: 13900
  misc_feature 1..79: note = chr20:61447684-61447763
  misc_feature 1..79: note = hyper
  source 1..79: mol_type = genomic DNA

SEQ ID NO: 38249 - DNA, 30 bp, Homo sapiens
  misc_feature 1..30: note = chr20:61448109-61448139
  misc_feature 1..30: note = hyper
  source 1..30: mol_type = genomic DNA
aaggagagaaaagagcgtctttctctcttg

SEQ ID NO: 38250 - DNA, 139 bp, Homo sapiens
  misc_feature 1..139: note = chr20:61560322-61560461
  misc_feature 1..139: note = hyper
  source 1..139: mol_type = genomic DNA
aaaaaaatggctttccgctgttataagcctccttcctaagactcagggtccgcagcagaataccctgacccaaaataaaaatactatgacaaaaatactccaggaggcagccggctttacttcgtttaaagccggattt

SEQ ID NO: 38251 - DNA, 427 bp, Homo sapiens
  misc_feature 1..427: note = chr20:61560528-61560955
  misc_feature 1..427: note = hyper
  source 1..427: mol_type = genomic DNA
cggcccgtcctctccaagaaccggaagccggacagcgtcaggacgttttattcttctcacctgggattcagagaggcagcggccaaggacagggcccccgccgaggccaccgggcagcgtccaggtctcggcctttgggaggggagcagcgggggaggggcacggggaggggcgagggcggggcgcgcctgggcctcggcgctgggctcctcctctgcccgctccgggggacacccacaggattcttgcagacctctgccgaggcaggatggaggcctgcagggatgcaccgcgggcccgcgacccgggcggccggaacatagttctttctggccggagatcggcccggtcgtgagtcgtgtctgtgccaggccccccacgctgtgctccagggcctcagtgcccggcgcgccgggggctgtatcgc

SEQ ID NO: 38252 - DNA, 375 bp, Homo sapiens
  misc_feature 1..375: note = chr20:61585299-61585674
  misc_feature 1..375: note = hyper
  source 1..375: mol_type = genomic DNA
ttcatccaggcctgccgggcagggccagctccccagggattcagggcctcctcactggcggctggtttgagtggctccgccttcactacgtccctcccaggctcgatgtttaaaaaggagcccttgccgcagccttcactacgtccctcccaggctcgatgtttaaaaaggagcccttgccgcagccttcactacgtccctcccaggctcgatgtttaaaaaggagcccttgccacagctcttcaacttcctttgcaggcccttattgggtagcgccaaggattctggaggggcctgtgggtcaaggctgccacacgcacgccttttcctagcccgccctcctgcagccacatcacaaaggctgggccaggcgag

SEQ ID NO: 38253 - DNA, 30 bp, Homo sapiens
  misc_feature 1..30: note = chr20:61636897-61636927
  misc_feature 1..30: note = hyper
  source 1..30: mol_type = genomic DNA
ccctgcagtttagcacgaagggccggctgg

SEQ ID NO: 38254 - DNA, 368 bp, Homo sapiens; identical to SEQ ID NO: 13904
  misc_feature 1..368: note = chr20:61637281-61637649
  misc_feature 1..368: note = hyper
  source 1..368: mol_type = genomic DNA

SEQ ID NO: 38255 - DNA, 222 bp, Homo sapiens
  misc_feature 1..222: note = chr20:61637735-61637957
  misc_feature 1..222: note = hyper
  source 1..222: mol_type = genomic DNA
cgtgcatgcgccgccgctcgcgcgcgttgatgctgagccgcagagaccgctgctctcgcggccgccgccgcccgtccgccgcgctccctggcccgcgccgccgccgccgctgctcgaaggcgtcgtcctcgtccccgctctgttcgccgctgctctccgccgcctgagctggggcgcgaggtgcaggcgccgcggggaggtcgccgcccgggcccggagtgc

SEQ ID NO: 38256 - DNA, 250 bp, Homo sapiens; identical to SEQ ID NO: 1492
  misc_feature 1..250: note = chr20:61638220-61638470
  misc_feature 1..250: note = hyper
  source 1..250: mol_type = genomic DNA

SEQ ID NO: 38257 - DNA, 264 bp, Homo sapiens
  misc_feature 1..264: note = chr20:61638534-61638798
  misc_feature 1..264: note = hyper
  source 1..264: mol_type = genomic DNA
cgactccccggccgccgcctccggccgccccggggattccgccaccaaacgcacgcgtcccaggtgggcacccgcctcggtccgtctttgagtctgaccctagcgcaagagtccctggcgacacgcaggggccagagcgggggggcgcgccgcaatagcagcagcgccagcgccaacaccctgtcccgctgaggggccgcttcgggtcggggtcagggtcgtgggcgctctggtgcagccgcggcgcagcgtgtacccggagcc

SEQ ID NO: 38258 - DNA, 48 bp, Homo sapiens
  misc_feature 1..48: note = chr20:61639020-61639068
  misc_feature 1..48: note = hyper
  source 1..48: mol_type = genomic DNA
cgcgtgaggcttggtgggctttcccggagcctccgaacccctggggtc

SEQ ID NO: 38259 - DNA, 77 bp, Homo sapiens
  misc_feature 1..77: note = chr20:61664493-61664570
  misc_feature 1..77: note = hyper
  source 1..77: mol_type = genomic DNA
cagcaactgagagggcgtcccggcagggtatgaatggccagcaggacgctgaggctgcgtggcgtttccaccgtgct

SEQ ID NO: 38260 - DNA, 27 bp, Homo sapiens
  misc_feature 1..27: note = chr20:61703439-61703466
  misc_feature 1..27: note = hyper
  source 1..27: mol_type = genomic DNA
gcgcctctgaccctccgctccgggctc

SEQ ID NO: 38261 - DNA, 53 bp, Homo sapiens; identical to SEQ ID NO: 1494
  misc_feature 1..53: note = chr20:61703709-61703762
  misc_feature 1..53: note = hyper
  source 1..53: mol_type = genomic DNA

SEQ ID NO: 38262 - DNA, 190 bp, Homo sapiens; identical to SEQ ID NO: 1495
  misc_feature 1..190: note = chr20:61703845-61704035
  misc_feature 1..190: note = hyper
  source 1..190: mol_type = genomic DNA

SEQ ID NO: 38263 - DNA, 180 bp, Homo sapiens; identical to SEQ ID NO: 13910
  misc_feature 1..180: note = chr20:61733260-61733440
  misc_feature 1..180: note = hyper
  source 1..180: mol_type = genomic DNA

SEQ ID NO: 38264 - DNA, 394 bp, Homo sapiens
  misc_feature 1..394: note = chr20:61733694-61734088
  misc_feature 1..394: note = hyper
  source 1..394: mol_type = genomic DNA
gtgcctcggtctctgcgcccggctctccctccggtccgcaagaggaggaaggcccgcggcgtgccgaggtcagcggcgcggagccaccaggcgagacggtcacggacgcctgaaccgaggtcaccgaggccacggggccgggaggccctcagcagagcccgggggctccgcacctcaaggccggccaggaagaaacagcagcaggagcccagggcgccccggggagcccccgacacgcgggccgagcgcccagagcggcccaggccctcgcgaggagaccggcctccccagggcggggcttccgactcgggcgcccgtgagccccggaggcggcgcgaaggggcagagtccgcgtttctaaccagcccccgggtgggcggtggcccgcgcggca

SEQ ID NO: 38265 - DNA, 65 bp, Homo sapiens
  misc_feature 1..65: note = chr20:61734101-61734166
  misc_feature 1..65: note = hyper
  source 1..65: mol_type = genomic DNA
cgccgtgggctggggccggcctgggctttcagggcgagggctttccgcgccggccccagcccacc

SEQ ID NO: 38266 - DNA, 30 bp, Homo sapiens
  misc_feature 1..30: note = chr20:61734471-61734501
  misc_feature 1..30: note = hyper
  source 1..30: mol_type = genomic DNA
gccaatcagagctgccgcttctgatggagg

SEQ ID NO: 38267 - DNA, 208 bp, Homo sapiens
  misc_feature 1..208: note = chr20:61747797-61748005
  misc_feature 1..208: note = hyper
  source 1..208: mol_type = genomic DNA
aagttccctggagttcgttgcagtggaatccatggcccaggtgagcacagctgcagggagctgcgcggggggagccgcagagctgggcacttgcgaattaagtcccggtgaccggtgactgccgaggctctggcaggcggagggcggggtgcggagatgccgttcagaacctcggacagcgccgcggcccatccggccagccagaagc

SEQ ID NO: 38268 - DNA, 418 bp, Homo sapiens
  misc_feature 1..418: note = chr20:61806420-61806838
  misc_feature 1..418: note = hyper
  source 1..418: mol_type = genomic DNA
tcccgctcccgcccccgccggagccacctgacccgtagcgaagttgccggccccgctgcgcgccggcctttgtgcgcaccgaggcggccgccgggaaccgggagcccgagctggcccggcagcgccgccgcccccaccttcgcgccccttttcactcccccactgtccccggagctggcaaataaacaaatccacaaacaaattatccgtgtgctccggagaggcggcggcgtgggcggcggcggagagaaggcgccgggcaaggcgagactaggcccccgcggagcgggggaagcacagaccccagcccgggcccggcagcagtaagttgacttttatgaaacctacgaagctcgcggggccaccgaaaaggtccccaccggagcggactctgcggggcgggcggggcagaggctgc

SEQ ID NO: 38269 - DNA, 334 bp, Homo sapiens
  misc_feature 1..334: note = chr20:61807183-61807517
  misc_feature 1..334: note = hyper
  source 1..334: mol_type = genomic DNA
ggagccggtcctgtacggaaaagagacccaaagaaagatttggggtccccgaagccaaggtaccgatggggggtgctaaggagtctttccccttagaatgggaacaagctccaaggagctggaatcccgaggcgtcctggacccgtccaggaagctaagggtgggggacgggaggggagggggccgggagccggcctccctggccccaacccttggtgagaagagggctgggggtataaagtccgaaagtgaggcggaggtttcagggttccgtttcaacaccatggacagcggatgcctcagactgggagcctaggaccgccctggggactgc

SEQ ID NO: 38270 - DNA, 143 bp, Homo sapiens
  misc_feature 1..143: note = chr20:61807775-61807918
  misc_feature 1..143: note = hyper
  source 1..143: mol_type = genomic DNA
gacacttgcgaagggcgaggaattgcggctgggaagggtcaggttgaagccgcaccaaagggggaggggcgtcctgatggttgaggaccggcggagtcggtgcgggcagaaccaacccgagttcctgccgcccttcctaaccg

SEQ ID NO: 38271 - DNA, 223 bp, Homo sapiens
  misc_feature 1..223: note = chr20:61808158-61808381
  misc_feature 1..223: note = hyper
  source 1..223: mol_type = genomic DNA
cctagagggccagatcgggggcgccccaaggaccctatcgagctggcagtgactgcagtcgggccgtggagtgtcgcctgtgattccgtggtccctacgggcaagagctcccatcccggtctgaaactgtgagaaccgcaagctccgatgggggcggggaaggacgacctttaattcccaccccactgtacggagcccagcagggccatccgcaggaggccgg

SEQ ID NO: 38272 - DNA, 222 bp, Homo sapiens; identical to SEQ ID NO: 1497
  misc_feature 1..222: note = chr20:61808666-61808888
  misc_feature 1..222: note = hyper
  source 1..222: mol_type = genomic DNA

SEQ ID NO: 38273 - DNA, 117 bp, Homo sapiens; identical to SEQ ID NO: 1498
  misc_feature 1..117: note = chr20:61808889-61809006
  misc_feature 1..117: note = hyper
  source 1..117: mol_type = genomic DNA

SEQ ID NO: 38274 - DNA, 339 bp, Homo sapiens; identical to SEQ ID NO: 1499
  misc_feature 1..339: note = chr20:61809218-61809557
  misc_feature 1..339: note = hyper
  source 1..339: mol_type = genomic DNA

SEQ ID NO: 38275 - DNA, 74 bp, Homo sapiens; identical to SEQ ID NO: 1500
  misc_feature 1..74: note = chr20:61809558-61809632
  misc_feature 1..74: note = hyper
  source 1..74: mol_type = genomic DNA

SEQ ID NO: 38276 - DNA, 295 bp, Homo sapiens; identical to SEQ ID NO: 1501
  misc_feature 1..295: note = chr20:61809840-61810135
  misc_feature 1..295: note = hyper
  source 1..295: mol_type = genomic DNA

SEQ ID NO: 38277 - skipped

SEQ ID NO: 38278 - DNA, 122 bp, Homo sapiens
  misc_feature 1..122: note = chr20:61862355-61862477
  misc_feature 1..122: note = hyper
  source 1..122: mol_type = genomic DNA
agtgtgctcttctgccggcgtgctccccctgatggcctctcgacgtccagccgcttgtgtgttctgccaatgggctcctctccgtgtccagggcttaggtgcctgcccgctaggtctcaggg

SEQ ID NO: 38279 - DNA, 412 bp, Homo sapiens
  misc_feature 1..412: note = chr20:61884691-61885103
  misc_feature 1..412: note = hyper
  source 1..412: mol_type = genomic DNA
cctgcaggaaggacacgatgcctccgccgtccctaggtccgcccgcaagcctgtgcccctaagccgagcacaggacacccaagctgcacagccacggactccgagggtttcgctgctcaaaactctgaaacagccccttctggcccttctagcttcaagaggaggaggggggcgcgcggtccagctgcgctccgcagcccacaaagcatcgtttcctttttaagacgggagacccagggccaattagcatcgaagcaaagcagcttccccagcctggacaggcgaggcctttgtttagccccctcccccgagggcaccgggctccgggaaagaatccgccccccaggcgtcccagggagcttcggactccggggcagaatggaaacttggccgagggagccccgaccaatcc

SEQ ID NO: 38280 - DNA, 96 bp, Homo sapiens
  misc_feature 1..96: note = chr20:61885195-61885291
  misc_feature 1..96: note = hyper
  source 1..96: mol_type = genomic DNA
cgggggcgggcggggccggtttgctcgcgggtgggcaggacgttctcaccccccgccccctacactcgcaaactcgcaggcacagcctccgtcatc

SEQ ID NO: 38281 - DNA, 259 bp, Homo sapiens
  misc_feature 1..259: note = chr20:61885292-61885551
  misc_feature 1..259: note = hyper
  source 1..259: mol_type = genomic DNA
ccccacccgaatctcagaatcggaacttggccgctcactcggcgcccggggccggctgcgggaaacgctcgcacagacagagacaggcgcgcacccgggggcgcacccggggccacacacgcctccccaggcgatggggtccaggcggccccgcccgaaggcttccgtccggccagcccatccagccgctgccccgcacctgtccccgccgctccggacccgcggccgccccccgcgcacgcacaccggggacgggacc

SEQ ID NO: 38282 - DNA, 344 bp, Homo sapiens
  misc_feature 1..344: note = chr20:61885860-61886204
  misc_feature 1..344: note = hyper
  source 1..344: mol_type = genomic DNA
cgcccgctccccacgcgccgcagcctggaccccgccccctccgcatcccgttcccccctcctccccgcaacccccggcccagccccagccccgggtaacagctgcgctgcgtctcccctcccacccccgcctgcggcccctgggggcttcgcgccggccggagagggggaccgttcttaaaggggcgatggcgcggcctctcgggtagcgaggggcggcgccgcggccccaggacagacctgcagctgaggggagcccgccctggacgcggcagggatgaccggcgtccgccccctcctgcaggatgacctgcccagcacctgctcccgccgtgcgccctccgg

SEQ ID NO: 38283 - DNA, 20 bp, Homo sapiens
  misc_feature 1..20: note = chr20:61886256-61886276
  misc_feature 1..20: note = hyper
  source 1..20: mol_type = genomic DNA
cgaggcgttttctctgagag

SEQ ID NO: 38284 - DNA, 30 bp, Homo sapiens
  misc_feature 1..30: note = chr20:61886725-61886755
  misc_feature 1..30: note = hyper
  source 1..30: mol_type = genomic DNA
atcagggcaggtggccgggccagggctgcc

SEQ ID NO: 38285 - DNA, 167 bp, Homo sapiens
  misc_feature 1..167: note = chr20:62102801-62102968
  misc_feature 1..167: note = hyper
  source 1..167: mol_type = genomic DNA
ccgcagcccctcccccgggcctcgctctgccaaggaggggtcctgagcccgggatgtgcacgggggcggccggcggctgcagagatgggacagcgcaggagctgagcgcaggagctgagggggttcgcggggccagggaggggcgtcggcgccgagggggcaggaca

SEQ ID NO: 38286 - DNA, 325 bp, Homo sapiens
  misc_feature 1..325: note = chr20:62103301-62103626
  misc_feature 1..325: note = hyper
  source 1..325: mol_type = genomic DNA
cgacctgagcggccccgaccccggaatccttcctgcccgcgcgctgtacaatcgctctccggtctcggcccagcactcccgccggggagcgccggccccggacccagacccaggggcagggagccaaacccgccgcagccagcctggccggggtcgccgatggggtcgccgatgggggtcgccatgggggtcgccacgggggccccgccggccactcacacgtaggcgtggtagatgaacgcccagccgcgcggccgctccagcacgttgtagaggaaattctgcagcttgcggtagaaggcgttgcgcttggggggcttcccgg

SEQ ID NO: 38287 - DNA, 180 bp, Homo sapiens
  misc_feature 1..180: note = chr20:62103667-62103847
  misc_feature 1..180: note = hyper
  source 1..180: mol_type = genomic DNA
cgcttgggggcctcggagccggcgatcagcagcgccccgtcccgggtggagtcgggcgcgccggggtccagccccacgaagcccaccttcagcttcttctccccgctcgggccggggtatacgccgccgttgcgcgacttctgcaccatggtgcctggcgggaggcgccccgggtcgggc

SEQ ID NO: 38288 - DNA, 280 bp, Homo sapiens
  misc_feature 1..280: note = chr20:62119339-62119619
  misc_feature 1..280: note = hyper
  source 1..280: mol_type = genomic DNA
ccccccagcagcaggcgcacacggctctggggtcgctcagtttattggtaaaacgggcactgagcgtggcgagcgctgggcgcggaagcctggggcgggggcgcctttcctcttgaagaacttccactggaccttgatggcgagcatccagtcgctgaccgagggcctctggcaagcggaggtgcagacatgcgcctggcgggggtgcggggcgccggaccggcgcgcggggcgggggcggggcgggggcccgggcccggggttcggagcgcggcaccgc

SEQ ID NO: 38289 - DNA, 150 bp, Homo sapiens
  misc_feature 1..150: note = chr20:62119922-62120072
  misc_feature 1..150: note = hyper
  source 1..150: mol_type = genomic DNA
ggcctcgcgggagtcctgcctgggcggctgctccacggtctgcggggcggccacggggcgggggcagccctaacgctgccactgggcgaccgcgggccttcctcactcgcggggcctccctcactttcggggcctcgtctgcacacaggg

SEQ ID NO: 38290 - DNA, 34 bp, Homo sapiens
  misc_feature 1..34: note = chr20:62283802-62283836
  misc_feature 1..34: note = hyper
  source 1..34: mol_type = genomic DNA
cctcgcgcccgaggtcgcccggcagctcccctgc

SEQ ID NO: 38291 - DNA, 191 bp, Homo sapiens
  misc_feature 1..191: note = chr20:62369082-62369273
  misc_feature 1..191: note = hyper
  source 1..191: mol_type = genomic DNA
tccgcgcacccagctcggcacgcgcgcctgcaccgggccttggacccgaggctgacgaccccgccccccgccccccacctctacccccaaggcccgaggacgctgtagcccccaggaagagggcgcggaggcagcgggcgaggctgcagggcagtgcgacggcggcggaagcggtgagtgccaggctgtcc

SEQ ID NO: 38292 - DNA, 290 bp, Homo sapiens
  misc_feature 1..290: note = chr20:62461349-62461639
  misc_feature 1..290: note = hyper
  source 1..290: mol_type = genomic DNA
tcacaatcttgccaccgtaatccactccaaatgcatcgttgagattgcagcacggaaagcgagagaggaaattcgctgcgaatctcaaactttcttttgtttatatttcttcgctgtcagaaaatatccgttcttcgccccatctggtctgtaccctggctcctcggtccagccctattgtgtgtgcttcgttaaacctacaaacagtgaatctgtcagcggggccaggggaaccccaactagcaggagccctccctctggcgcagagaattccccgtttgccttaggga

SEQ ID NO: 38293 - DNA, 50 bp, Homo sapiens
  misc_feature 1..50: note = chr20:62463147-62463197
  misc_feature 1..50: note = hyper
  source 1..50: mol_type = genomic DNA
cgcgcggttgcactgcgcgcgtctcgcaaacttggcgactcccccagccc

SEQ ID NO: 38294 - DNA, 130 bp, Homo sapiens
  misc_feature 1..130: note = chr20:62463622-62463752
  misc_feature 1..130: note = hyper
  source 1..130: mol_type = genomic DNA
gcattcctggccggcctgcgcaggggtaaaggccacctcgcttcctctccccgggcgcggcgggaagggaggtgagcctgtggccggcagccgcgcgagggagtcgagcccggcccggccaaccaatggg

SEQ ID NO: 38295 - DNA, 87 bp, Homo sapiens
  misc_feature 1..87: note = chr20:62600722-62600809
  misc_feature 1..87: note = hyper
  source 1..87: mol_type = genomic DNA
ggggagagggggctccgccgcgctgcgcgcaggagacgccagcagcgggtccgccgcgtaggccgttcggcccgggaccccggccca

SEQ ID NO: 38296 - DNA, 82 bp, Homo sapiens
  misc_feature 1..82: note = chr20:62673837-62673919
  misc_feature 1..82: note = hyper
  source 1..82: mol_type = genomic DNA
ctggacgcgggttcccgggtcgccttccggcctcgctcccgtcgggaggtcccgacacgggcttcctcgcagcctccccgcc

SEQ ID NO: 38297 - DNA, 15 bp, Homo sapiens
  misc_feature 1..15: note = chr20:62680421-62680436
  misc_feature 1..15: note = hyper
  source 1..15: mol_type = genomic DNA
cgcggcccgggaccc

SEQ ID NO: 38298 - DNA, 41 bp, Homo sapiens
  misc_feature 1..41: note = chr20:62714767-62714808
  misc_feature 1..41: note = hyper
  source 1..41: mol_type = genomic DNA
tcgcacactctcagtcgccgtcaccgcgggaagatggtgcc

SEQ ID NO: 38299 - DNA, 274 bp, Homo sapiens
  misc_feature 1..274: note = chr20:62715272-62715546
  misc_feature 1..274: note = hyper
  source 1..274: mol_type = genomic DNA
gagcgactgcgtccacgggcgcgggtcgggcatgcggtaccccggttccaccgacccgcacgggaaggtggaggccgccgcgcccacgtcctccagcaggtcgccgaagagcagatggcggtggcgctgcgcagggagcatggccgccagtccctgcggcgtcagggcccagcccggcttggggggctctgtcgcgggcgcccccttggcacgctcctcaccctgcgccgtgcctggcgcgctcttcccgcttcgctcccgcgggcccttgcgc

SEQ ID NO: 38300 - DNA, 749 bp, Homo sapiens
  misc_feature 1..749: note = chr20:62733381-62734130
  misc_feature 1..749: note = hyper
  source 1..749: mol_type = genomic DNA
ggcttttctgagcctcggtttccttccgtgtgcaaaggggaccgcagaaccctctttgtggggttgtgggggaaggctggggcgcccgggagggtcccgggtcgcgtccgacctcaggaaggcggggcttcagcagcggcctcggaccctccctccagggggcgctgtgggctcacgcgggcccagccttgggccccggggcgctgcggcgggaaccgcggtgactagcggggtcttaaagcgggtggcggggccgggctctcctgggaccaggagcccagagcgtggagacgtggcgggctgagccgctcagtgcggcccctgccccgcgcccaccccgccccgtgtcaggaggtccgcggagcgggaggacccgcctcccggggagagctcgcccgcccctccctcccggctggccgcggggcggtctgcagaccctttggccgtgccggatctgcctggtccccggggagaagacgctgaggatcccattgctggtctgtggatggggacaggagacgcccgaggtaagaaggggtccgggttctttggaggaatcctggttggcgccttctctgcagcagagacgcccggctggggccggagggcaaactgggggcagggtgggagacctcggccctgagggctgtaggggctcttgcctgggcgctccttaagctcccccgccccctccgccccccaccccgcggtgctcactctcagtcctgccttgcgcacattcccacgcc

SEQ ID NO: 38301 - DNA, 132 bp, Homo sapiens
  misc_feature 1..132: note = chr20:62734172-62734304
  misc_feature 1..132: note = hyper
  source 1..132: mol_type = genomic DNA
cgcctcacacctggctctgccgcgggcttggagcgggtgtctgggaaacacagtctcacttgtctcctcaaggggctccggggcaccgtaacagcgtgcagagcgcagtcaggctgccgtgctgctgctttg

SEQ ID NO: 38302 - DNA, 30 bp, Homo sapiens
  misc_feature 1..30: note = chr20:62793356-62793386
  misc_feature 1..30: note = hyper
  source 1..30: mol_type = genomic DNA
gagctcagaagcttccgtgtgcggagaaca

SEQ ID NO: 38303 - DNA, 101 bp, Homo sapiens; identical to SEQ ID NO: 13928
  misc_feature 1..101: note = chr20:62947884-62947985
  misc_feature 1..101: note = hyper
  source 1..101: mol_type = genomic DNA

SEQ ID NO: 38304 - DNA, 315 bp, Homo sapiens
  misc_feature 1..315: note = chr20:62948007-62948322
  misc_feature 1..315: note = hyper
  source 1..315: mol_type = genomic DNA
cgggggttggggcgcgggggttggggaggcgggggcgcccgggccgcgcttcccttcgcgggtgactcagcagccgccttcctcagcggggcggggcgcggcgggggcgcggggaggctgtgggcacgcggcttccccgcgccggggtgcaggtcctcgccgccgcccccgcgaggaagtgcgaggctggacgctgggaggcgcgcgtgggccgggagattccttctcgcctgccggctaccagccggcccgcccacgccgccgagatcccgactccacgttccctccccacggaggagtcggggcagcgcacgg

SEQ ID NO: 38305 - DNA, 291 bp, Homo sapiens
  misc_feature 1..291: note = chr21:15588524-15588815
  misc_feature 1..291: note = hyper
  source 1..291: mol_type = genomic DNA
ggaggccgacaggaccgtgtttgttgggaatttagaggcccgagttcgggaagagattctgtacgagctgttccttcaggtaccgtctctgggaaggggcggcggaggggcggagcacgtcgggccggaaacatagcgcgcacctggaccacccggagcccggcccccttccgtcccatcctgagcaggggttttaatttcgtttcctcttggcgcacctgtctccaggtgagcggctggggagtgaaatgagggcgcgttccccatccccatccgcgctgcagagtcctg

SEQ ID NO: 38306 - DNA, 152 bp, Homo sapiens
  misc_feature 1..152: note = chr21:16438562-16438714
  misc_feature 1..152: note = hyper
  source 1..152: mol_type = genomic DNA
aattaccaggggaagcgagtgttgttgctgaaattgtttttgcttgacacaaaaaagctaaagtacagcttagtctcacccgaaattctgaaacggcatgcccgtgttaaaacacttattacataagacaaatgagccgatgaggcactcca

SEQ ID NO: 38307 - DNA, 61 bp, Homo sapiens
  misc_feature 1..61: note = chr21:18985496-18985557
  misc_feature 1..61: note = hyper
  source 1..61: mol_type = genomic DNA
ggcctgtgggacccccgcccggccgccctacgtgcgtcagcgccttcgggggtcgcgcggg

SEQ ID NO: 38308 - DNA, 30 bp, Homo sapiens
  misc_feature 1..30: note = chr21:19617785-19617815
  misc_feature 1..30: note = hyper
  source 1..30: mol_type = genomic DNA
cttctctaacacacacgcagaaaagtttaa

SEQ ID NO: 38309 - DNA, 53 bp, Homo sapiens
  misc_feature 1..53: note = chr21:22370172-22370225
  misc_feature 1..53: note = hyper
  source 1..53: mol_type = genomic DNA
agctgcggggcacaccgcccgcctccagatcccccattcacgttgagccgggg

SEQ ID NO: 38310 - DNA, 111 bp, Homo sapiens
  misc_feature 1..111: note = chr21:22370236-22370347
  misc_feature 1..111: note = hyper
  source 1..111: mol_type = genomic DNA
cggtcgcctgcagtatcagtatcagcatcagcatcagcatcagcatctgcatgagcatcagctcagctcagctcagctcagcatcagctcagctgtcctgaggcagccggc

SEQ ID NO: 38311 - DNA, 128 bp, Homo sapiens
  misc_feature 1..128: note = chr21:22370348-22370476
  misc_feature 1..128: note = hyper
  source 1..128: mol_type = genomic DNA
gctgtgaaggagctccaggctgcccccatccccacgcccttctcggctcagggcgtgcatgaacctgcggatggccggcgggcgagtggcgccttcgcgatcgcggccgcccctctaggcggaggcac

SEQ ID NO: 38312 - DNA, 175 bp, Homo sapiens
  misc_feature 1..175: note = chr21:22370552-22370727
  misc_feature 1..175: note = hyper
  source 1..175: mol_type = genomic DNA
cgtgcagcgcggagggatacgcctcggccgcacctcccctcgccgcgcccccgcccccgccgccctccccgcccggctctgctgccgccgcggcggccgctgctgctgctgcttctgccgccgctgccgccgccgctgcctggatatagtgcggcaagagcggagcttgcagtca

SEQ ID NO: 38313 - DNA, 434 bp, Homo sapiens
  misc_feature 1..434: note = chr21:26934367-26934801
  misc_feature 1..434: note = hyper
  source 1..434: mol_type = genomic DNA
gggttgcagaaaaggcgcctggtcggttatgagtcacaagtgagttataaaagggtcgcacgttcgcaggcgcgggcttcctgtgcgcggccgagcccgggcccagcgccgcctgcagcctcgggaagggagcggatagcggagccccgagccgcccgcagagcaagcgcggggaaccaaggagacgctcctggcactgcaggtacgccgacttcagtctcgcgctcccgcccgcctttcctctcttgaacgtggcagggacgccgggggacttcggtgcgagggtcaccgccgggttaactggcgaggcaaggcgggggcagcgcgcacgtggccgtggagcccggcctggtcccgcgcgcgcctgcgggtgccccctggggactcagtggtgtcgcctcgcccgggaccagagattgcgctggatggattcc

SEQ ID NO: 38314 - DNA, 30 bp, Homo sapiens
  misc_feature 1..30: note = chr21:27011446-27011476
  misc_feature 1..30: note = hyper
  source 1..30: mol_type = genomic DNA
tgcttttttttttctcgagttcgaggcgga

SEQ ID NO: 38315 - DNA, 52 bp, Homo sapiens
  misc_feature 1..52: note = chr21:27012069-27012121
  misc_feature 1..52: note = hyper
  source 1..52: mol_type = genomic DNA
ctcctgcgctcctgccgccgggaccctcgacctcctcagagcagccggctgc

SEQ ID NO: 38316 - DNA, 28 bp, Homo sapiens
  misc_feature 1..28: note = chr21:27012148-27012176
  misc_feature 1..28: note = hyper
  source 1..28: mol_type = genomic DNA
cgccaccgcctcctcctgctgctgctgc

SEQ ID NO: 38317 - DNA, 548 bp, Homo sapiens
  misc_feature 1..548: note = chr21:27012177-27012725
  misc_feature 1..548: note = hyper
  source 1..548: mol_type = genomic DNA
ctacctggtggtcgccctgggctgtaagttgctcgggttcctctacccttcctgcctggaccagcctgcccccaccctccagccccccacggggcgctggctgacagtgtctgggcggctctgggccgaggtcgccgcggggcgtctgaccttgcgcccaggcgagcgggaaacccagggtgcccgcgagcggacgctgggagcaagggagcgcgaggtcgtgggtttcttgtgaattgcgtctgattttgtcagttctagatacagaaaattaagggttcccactagcaggttctcatctgtttgcaaagttggggtaagttttcagacagagggacgtgattcgaatgcaaaactcactacccactggtaagatgctaagaccccaagaaagatggcatcactgggaggcgggcgccggccacactttgagtccccggggagggggcagcgtccgcgtggtctgggctctgtagcgtcccagctgagccggcgatatgcagcgcacttgtggggcggaggtggagggaattcgtggctgctgagcc

SEQ ID NO: 38318 - DNA, 235 bp, Homo sapiens; identical to SEQ ID NO: 13934
  misc_feature 1..235: note = chr21:27944913-27945148
  misc_feature 1..235: note = hyper
  source 1..235: mol_type = genomic DNA

SEQ ID NO: 38319 - DNA, 26 bp, Homo sapiens
  misc_feature 1..26: note = chr21:27945604-27945630
  misc_feature 1..26: note = hyper
  source 1..26: mol_type = genomic DNA
cgggcagggggcgggggtggccccga

SEQ ID NO: 38320 - DNA, 1300 bp, Homo sapiens
  misc_feature 1..1300: note = chr21:28216633-28217933
  misc_feature 1..1300: note = hyper
  source 1..1300: mol_type = genomic DNA
cggtctccgctttcccagtcggccggggctcgtcgtccacgaccccgcacgtgccgccgacgtcgccctgccgattccgccgcaggaggtggaactgtagtggtgccggcggcttctcccctggggcggcggtggcgaggcgctcgctggcggcgggcagcggctggatgaaatacgcctcccccagcaggtagaaggcgccgcgcacgccctcgcagaggctgagggcggcagccgagctgggatcgccattcacggtgccggagtagaagcagtgcgccaggtcggtttccggaagcggcgtctcggacccggatttgcgccccacgttctggagcgtgaagccgggcgccaaaaagctgctgtcgggccgcagctccagatccagctgctggtcaaaggcgtgcaggcggaggcgcgtggtcccgtgtcccggggcgcgctccagctccggcaccactagctcctcgtcctcctcggaggggcgcccgagtgcgtccgacacggccagtagcgccgcggcgagcagcagcagcgtgggtactggcccaaagctccgagaccccggagcccgctccgcgttccccatgtcgctgcccagcttgcgccttccgaacccctcgggcacagctcgctgcattggagccccaggagacaccgctcgtagcagcgcacggagcgagggacctttagttcgggtcgggagagcaaagcctcgttggcctgctctggattgttaaaattaacaatttctattattcgttggaagggcgcgcagagccggctacagccgaagctcccggagtcactaaaaggaggcgctgcagttctgccggcgcgcgggaagtttttcttccagcgcaaagttggagacactgagaggcaggcgcaggcagagtggctctgctgggacaagaagcgctctggggcgcctccggggctgaggcaacgcggagattggtgcctggcgcccctcttcggcctccgccttggctgcgatgttgctcactctgctcagggctctcccctctccgtccggtagcgcaccctggctttgcaatagcccctggctcggagccgctttccagcgagtgcaagaaccgggcagccgagcggtccttttatagtggaccagtgaaacccccacccccaccccactcctcccctttggcccttttccatcccaaagacgccgcccccggctccgttggtgctaaaccgcgctccgcgctgcgggctcgggagggggagggggcagcctccgcgctggctccacgccactgctcgtcaatctaggggc

SEQ ID NO: 38321 - DNA, 81 bp, Homo sapiens; identical to SEQ ID NO: 13938
  misc_feature 1..81: note = chr21:28218267-28218348
  misc_feature 1..81: note = hyper
  source 1..81: mol_type = genomic DNA

SEQ ID NO: 38322 - DNA, 99 bp, Homo sapiens
  misc_feature 1..99: note = chr21:28218619-28218718
  misc_feature 1..99: note = hyper
  source 1..99: mol_type = genomic DNA
caagccctaggccagcgtcgcagaaacggccaggaaccccactttcctacccgggggccagcagcgatcgctggggctagcaagcgtgcagagggggaa

SEQ ID NO: 38323 - DNA, 174 bp, Homo sapiens
  misc_feature 1..174: note = chr21:28218958-28219132
  misc_feature 1..174: note = hyper
  source 1..174: mol_type = genomic DNA
cgcaaccctcacactcgcgcgcccccgcgttagtgctcgaactggtctccgcctttccgccccactcccgtccggtctcttggttggctccaagtagatctgggtcctttcctcgctcctccccagatcttccccacttcagttggccccagccagaagcgtcccttctagttc

SEQ ID NO: 38324 - DNA, 44 bp, Homo sapiens
  misc_feature 1..44: note = chr21:28338515-28338559
  misc_feature 1..44: note = hyper
  source 1..44: mol_type = genomic DNA
cgccagggggtgcgggtggccgggaggctcggctcgctcctgca

SEQ ID NO: 38325 - DNA, 210 bp, Homo sapiens
  misc_feature 1..210: note = chr21:28339246-28339456
  misc_feature 1..210: note = hyper
  source 1..210: mol_type = genomic DNA
gagaggggaaaaagccgtaaaaattaaaacaaaaatgcaggggggcagcctgaggcgagctggtgaagcggcgtgtctgtgtcccttcggctgcggtctcctcctgcccgccgtcatccccagtcggcagctgcgagcgccgagagcagcgcgagcgctgtgaagatgcgaggaggtggaacaatgaatttatagcggcatgccatcctg

SEQ ID NO: 38326 - DNA, 31 bp, Homo sapiens
  misc_feature 1..31: note = chr21:28339876-28339907
  misc_feature 1..31: note = hyper
  source 1..31: mol_type = genomic DNA
tcccctttgcacacccgtgcgctctggcctc

SEQ ID NO: 38327 - DNA, 141 bp, Homo sapiens
  misc_feature 1..141: note = chr21:28339908-28340049
  misc_feature 1..141: note = hyper
  source 1..141: mol_type = genomic DNA
cagaccgtgcaactccatccaccagccagagcttttcagcttcccgtgcgtcccctaaccaccgcgttcccttcgcttcctcccctccgtcccggcacccggtttcctccctccccattctccagcctcttgatgctttga

SEQ ID NO: 38328 - DNA, 286 bp, Homo sapiens; identical to SEQ ID NO: 4860
  misc_feature 1..286: note = chr21:28340062-28340348
  misc_feature 1..286: note = hyper
  source 1..286: mol_type = genomic DNA

SEQ ID NO: 38329 - DNA, 230 bp, Homo sapiens
  misc_feature 1..230: note = chr21:31311404-31311634
  misc_feature 1..230: note = hyper
  source 1..230: mol_type = genomic DNA
ccagagtaggggtgccggtccctgcgaacctggatccccgcactctagcccgcgttcctggagcccagattgaaaaacccgccaactgtacctcccggggaaggccggcaccctccaggagggaagcagtgacgcggctcccccttttttgtgtagcctcccatgagcactgacctccaccttccccagctccggctcctgcgccgccgcgcgctgcctcgcccgggacc

SEQ ID NO: 38330 - DNA, 220 bp, Homo sapiens
  misc_feature 1..220: note = chr21:31311700-31311920
  misc_feature 1..220: note = hyper
  source 1..220: mol_type = genomic DNA
cgatcctgagtacttgcggggcggtctgagggaggatatagcagaggaaatagaggagtgcccagctggtgtccctggtccagagcccgggctgggcgaggagtgtgccgtgctccatcttcctagcttcttaattcatgccgagatacagccgctgccggacgcccgagagatgcacccaacttgggccgggtccccgcctcatcctctctggatgctc

SEQ ID NO: 38331 - DNA, 102 bp, Homo sapiens; identical to SEQ ID NO: 4862
  misc_feature 1..102: note = chr21:31312079-31312181
  misc_feature 1..102: note = hyper
  source 1..102: mol_type = genomic DNA

SEQ ID NO: 38332 - DNA, 17 bp, Homo sapiens
  misc_feature 1..17: note = chr21:31312413-31312430
  misc_feature 1..17: note = hyper
  source 1..17: mol_type = genomic DNA
agatactcgcgcgcgcg

SEQ ID NO: 38333 - DNA, 207 bp, Homo sapiens; identical to SEQ ID NO: 13945
  misc_feature 1..207: note = chr21:32716260-32716467
  misc_feature 1..207: note = hyper
  source 1..207: mol_type = genomic DNA

SEQ ID NO: 38334 - DNA, 152 bp, Homo sapiens
  misc_feature 1..152: note = chr21:33245337-33245489
  misc_feature 1..152: note = hyper
  source 1..152: mol_type = genomic DNA
ggatttgaaagtgcacgggctgcggagtggagctcgcatctgttcccgccgcccgcgagcggattaaatttctgcaaattcaaactgaatggggctttcttctgctgccttccagagggcgccggcagcccgccgcgcgcttctctccggcg

SEQ ID NO: 38335 - DNA, 30 bp, Homo sapiens
  misc_feature 1..30: note = chr21:34392013-34392043
  misc_feature 1..30: note = hyper
  source 1..30: mol_type = genomic DNA
ctggttctcaagagccgggtgtaaggaagg

SEQ ID NO: 38336 - DNA, 638 bp, Homo sapiens; identical to SEQ ID NO: 1502
  misc_feature 1..638: note = chr21:34392436-34393074
  misc_feature 1..638: note = hyper
  source 1..638: mol_type = genomic DNA

SEQ ID NO: 38337 - DNA, 1394 bp, Homo sapiens
  misc_feature 1..1394: note = chr21:34395373-34396767
  misc_feature 1..1394: note = hyper
  source 1..1394: mol_type = genomic DNA
aggccggccccgacacgcacccggtcttttgtgggagagaaacacaaagaagagggaaaaacacggaggaggccaacagcaccaggacgcgggggccaaccaggaactcccggagccggggcccattagcctctgcaaatgagcactccattccccaggaaggggccccagctgcgcgcgctggtgggaaccgcagtgcctgggacccgcccaggtcgcccaccccgggcgccgggcgcaggacccggacaagtcctggggacgcctccaggacgcaccagggcaagcttgggcaccgggatctaatttctagttattcctgggacggggtggggaggcataggagacacaccgagaggtactcagcatccgattggcaccagggccaagggagcccaggggcgacacagacctccccgacctcccaagctactccggcgacgggaggatgttgagggaagcctgccaggtgaagaaggggccagcagcagcacagagcttccgactttgccttccaggctctagactcgcgccatgccaagacgggcccctcgactttcacccctgactcccaactccagccactggaccgagcgcgcaaagaacctgagaccgcttgctctcaccgccgcaagtcggtcgcaggacagacaccagtgggcagcaacaaaaaaagaaaccgggttccgggacacgtgccggcggctggactaacctcagcggctgcaaccaaggagcgcgcacgttgcgcctgctggtgtttattagctacactggcaggcgcacaactccgcgccccgactggtggccccacagcgcgcaccacacatggcctcgctgctgttggcggggtaggcccgaaggaggcatctacaaatgcccgagccctttctgatccccacccccccgctccctgcgtcgtccgagtgacagattctactaattgaacggttatgggtcatccttgtaaccgttggacgacataacaccacgcttcagttcttcatgttttaaatacatatttaacggatggctgcagagccagctgggaaacacgcggattgaaaaataatgctccagaaggcacgagactggggcgaaggcgagagcgggctgggcttctagcggagaccgcagagggagacatatctcagaactaggggcaataacgtgggtttctctttgtatttgtttattttgtaactttgctacttgaagaccaattatttactatgctaatttgtttgcttgtttttaaaaccgtacttgcacagtaaaagttccccaacaacggaagtaacccgacgttcctcacactccctaggagactgtgtgcgtgtgtgcccgcgcgtgcgctcacagtgtcaagtgctagcatccgagatctgcagaaa

SEQ ID NO: 38338 - DNA, 104 bp, Homo sapiens
  misc_feature 1..104: note = chr21:34396987-34397091
  misc_feature 1..104: note = hyper
  source 1..104: mol_type = genomic DNA
tacctcagctacctccgtgaggtgcttctccagttcgggcttaattcctcatcgtcaagagttttcaggtttcagagccagcctgcaatcggtaaaacatgtcc

SEQ ID NO: 38339 - DNA, 291 bp, Homo sapiens
  misc_feature 1..291: note = chr21:34397481-34397772
  misc_feature 1..291: note = hyper
  source 1..291: mol_type = genomic DNA
ccctccctccttgcccgccctctacccctcaagtccctgcccccagctgggggcgctaccggctgccgtcggagctgcagccacggccatctcctagacgcgcgagtagagcaccaagatagtggggactttgtgcctgggcatcgtttacatttggggcgccaaatgcccacgtgttgatgaaaccagtgagatgggaacaggcggcgggaaaccagacagaggaagagctagggaggagaccccagccccggatcctgggtcgccagggttttccgcgcgcatcccaaa

SEQ ID NO: 38340 - DNA, 141 bp, Homo sapiens; identical to SEQ ID NO: 13950
  misc_feature 1..141: note = chr21:34397990-34398131
  misc_feature 1..141: note = hyper
  source 1..141: mol_type = genomic DNA

SEQ ID NO: 38341 - DNA, 67 bp, Homo sapiens; identical to SEQ ID NO: 13951
  misc_feature 1..67: note = chr21:34398132-34398199
  misc_feature 1..67: note = hyper
  source 1..67: mol_type = genomic DNA

SEQ ID NO: 38342 - DNA, 22 bp, Homo sapiens
  misc_feature 1..22: note = chr21:34398200-34398222
  misc_feature 1..22: note = hyper
  source 1..22: mol_type = genomic DNA
ctgccaccgggctataaaaacc

SEQ ID NO: 38343 - DNA, 640 bp, Homo sapiens
  misc_feature 1..640: note = chr21:34398223-34398863
  misc_feature 1..640: note = hyper
  source 1..640: mol_type = genomic DNA
gccgagcccctaaaggtgcggatgcttattatagatcgacgcgacaccagcgcccggtgccaggttctcccctgaggcttttcggagcgagctcctcaaatcgcatccagagtaagtgtccccgccccacagcagccgcagcctagatcccagggacagactctcctcaactcggctgtgacccagaatgctccgatacagggggtctggatccctactctgcgggccatttctccagagcgactttgctcttctgtcctccccacactcaccgctgcatctccctcaccaaaagcgagaagtcggagcgacaacagctctttctgcccaagccccagtcagctggtgagctccccgtggtctccagatgcagcacatggactctgggccccgcgccggctctgggtgcatgtgcgtgtgcgtgtgtttgctgcgtggtgtcgatggagataaggtggatccgtttgaggaaccaaatcattagttctctatctagatctccattctccccaaagaaaggccctcacttcccactcgtttattccagcccgggggctcagttttcccacacctaactgaaagcccgaagcctctagaatgccacccgcaccccgagggtcaccaacgctccctgaaataa

SEQ ID NO: 38344 - DNA, 97 bp, Homo sapiens
  misc_feature 1..97: note = chr21:34399162-34399259
  misc_feature 1..97: note = hyper
  source 1..97: mol_type = genomic DNA
ctggggccatggactcggacgccagcctggtgtccagccgcccgtcgtcgccagagcccgatgacctttttctgccggcccggagtaagggcagcag

SEQ ID NO: 38345 - DNA, 664 bp, Homo sapiens; identical to SEQ ID NO: 1505
  misc_feature 1..664: note = chr21:34399441-34400105
  misc_feature 1..664: note = hyper
  source 1..664: mol_type = genomic DNA

SEQ ID NO: 38346 - DNA, 27 bp, Homo sapiens
  misc_feature 1..27: note = chr21:34400231-34400258
  misc_feature 1..27: note = hyper
  source 1..27: mol_type = genomic DNA
cgcgaggaggggcgcaggaccatggac

SEQ ID NO: 38347 - DNA, 327 bp, Homo sapiens
  misc_feature 1..327: note = chr21:34401144-34401471
  misc_feature 1..327: note = hyper
  source 1..327: mol_type = genomic DNA
atgatgaggtaagtgcgcaatgctaagctgtttgctcacgtgactgccagccccatcggagtctaagccggctttcctctattttggtttatttttgccacgtttaacacaaatggtaaactcctccacgtgcttcctgcgttccgtgcaagccgcctcggcgctgcctgcgttgcaaactgggctttgtagcgtctgccgtgtaacacccttcctctgatcgcaccgcccctcgcagagagtgtatcatctgttttatttttgtaaaaacaaagtgctaaataatatttattacttgtttggttgcaaaaacggaataaatgactg

SEQ ID NO: 38348 - DNA, 90 bp, Homo sapiens
  misc_feature 1..90: note = chr21:34442167-34442257
  misc_feature 1..90: note = hyper
  source 1..90: mol_type = genomic DNA
gcagcctgaccagtgcgaccagtcctccttcaacagccccgcttgccttgaaaaggcgcccttactccgctcagggggcctgtcccgcgc

SEQ ID NO: 38349 - DNA, 76 bp, Homo sapiens
  misc_feature 1..76: note = chr21:34442594-34442670
  misc_feature 1..76: note = hyper
  source 1..76: mol_type = genomic DNA
gggaccatgctgcggccacagcggcccggagacttgcagctcggggcctccctctacgagctggtgggctacaggc

SEQ ID NO: 38350 - DNA, 862 bp, Homo sapiens
  misc_feature 1..862: note = chr21:34442730-34443592
  misc_feature 1..862: note = hyper
  source 1..862: mol_type = genomic DNA
cgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttgggg

SEQ ID NO: 38351 - DNA, 470 bp, Homo sapiens
  misc_feature 1..470: note = chr21:34443893-34444363
  misc_feature 1..470: note = hyper
  source 1..470: mol_type = genomic DNA
atcaaaggaggctgccggaactcaagaggcagaaaaagaccagttaggcggtgcagacggtctgggacgtggcagacggacggaccctcggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttagaaagcaacttagaactcgagattcacctttcgtttccctttccccaaaagtagcgtaaccaacatttaagcttgcttaaaaacgaaaaccaaccgccttgcatccagtgttcccgatttactaaaataggtaaccaggcgtctcacagtcgccgtcctgtcaagagcgctaatgaacgttctcattaacacgcaggagtac

SEQ ID NO: 38352 - DNA, 154 bp, Homo sapiens; identical to SEQ ID NO: 1508
  misc_feature 1..154: note = chr21:34444444-34444598
  misc_feature 1..154: note = hyper
  source 1..154: mol_type = genomic DNA

SEQ ID NO: 38353 - DNA, 326 bp, Homo sapiens
  misc_feature 1..326: note = chr21:34481940-34482266
  misc_feature 1..326: note = hyper
  source 1..326: mol_type = genomic DNA
aggacaagctgggcccgggcggattctcaccccaccaccccaactccaggcttgggtccatctgccgccagtggtgacttgggtggcgccctccgcagcagacagccgtgcgccctcggcgacccggtccctgcgctccggcgcccgcaggtcctcgctcccggcttctgcacctcccgctccgggacatctggctgagccgcgcctccctctccccgcagcctccgccggccccgcctcccctcaccacccttcccttgtttggggcggtaaggtcagaagcgttcaacaattcaacgtgggaagtctctcggaggaagtgccag

SEQ ID NO: 38354 - DNA, 30 bp, Homo sapiens
  misc_feature 1..30: note = chr21:34499655-34499685
  misc_feature 1..30: note = hyper
  source 1..30: mol_type = genomic DNA
tgctggggttgaagccgcttgtttgagttt

SEQ ID NO: 38355 - DNA, 148 bp, Homo sapiens
  misc_feature 1..148: note = chr21:35574488-35574636
  misc_feature 1..148: note = hyper
  source 1..148: mol_type = genomic DNA
tggggaagagctgagcgaaaccgccccggggtccaggcgttttgccacgagtcgccgtgcgacaagttggggtctcccttgttctcccacctctctgcaccaaaagctcttgaagcaaattaaagaaagcaggcgatgcttgtatcat

SEQ ID NO: 38356 - DNA, 96 bp, Homo sapiens; identical to SEQ ID NO: 1509
  misc_feature 1..96: note = chr21:36041933-36042029
  misc_feature 1..96: note = hyper
  source 1..96: mol_type = genomic DNA

SEQ ID NO: 38357 - DNA, 79 bp, Homo sapiens; identical to SEQ ID NO: 1510
  misc_feature 1..79: note = chr21:36042091-36042170
  misc_feature 1..79: note = hyper
  source 1..79: mol_type = genomic DNA

SEQ ID NO: 38358 - DNA, 983 bp, Homo sapiens
  misc_feature 1..983: note = chr21:36042171-36043154
  misc_feature 1..983: note = hyper
  source 1..983: mol_type = genomic DNA
cggagggcccgctgggggacaacatagaagcggagggcccggcgggcgacagcgtagaggcggagggccgggtgggggacagcgtagacgcggaaggtccggcgggggacagcgtagacgcggagggcccgctgggggacaacatacaagccgagggcccggcgggggacagcgtagacgcggagggccgggtgggggacagcgtagacgcggaaggtccggcgggggacagcgtagacgcggagggccgggtgggggacagcgtagaggcgggggacccggcgggggacggcgtagaagcgggggtcccggcgggggacagcgtagaagccgaaggcccggcgggggacagcatggacgccgagggtccggcaggaagggcgcgccgggtctcgggtgagccgcagcaatcgggggacggcagcctctcgccccaggccgaggcaattgaggtcgcagccggggagagtgcggggcgcagccccggtgagctcgcctgggacgcagcggaggaggcggaggtcccgggggtaaaggggtccgaagaagcggcccccggggacgcaagggcagacgctggcgaggacagggtaggggatgggccacagcaggagccgggggaggacgaagagagacgagagcggagcccggaggggccaagggaggaggaagcagcggggggcgaagaggaatcccccgacagcagcccacatggggaggcctccaggggcgccgcggagcctgaggcccagctcagcaaccacctggccgaggagggccccgccgagggtagcggcgaggccgcgcgcgtgaacggccgccgggaggacggagaggcgtccgagccccgggccctggggcaggagcacgacatcaccctcttcgtcaaggtaaagctcgcttccctcaattcttaggacgacccccttccattcgaggtcttggtcatctcagatcccagagggacgcgcagggaggaaccc

SEQ ID NO: 38359 - DNA, 51 bp, Homo sapiens
  misc_feature 1..51: note = chr21:38063644-38063695
  misc_feature 1..51: note = hyper
  source 1..51: mol_type = genomic DNA
cagcttttaagggatcgctgtggctacagcaggaaacgttcctgctccatg

SEQ ID NO: 38360 - DNA, 525 bp, Homo sapiens
  misc_feature 1..525: note = chr21:38064998-38065523
  misc_feature 1..525: note = hyper
  source 1..525: mol_type = genomic DNA
cgttggaccttcttccgcaatcgggaccactccaggtctccccggagaaggctgagtctccagcgcgtggattcagatcaggactctgtctaagtaggcgagagctggggataccgctgggggctttggcgaagctaagaaagcactggcttcttattctcaccagacatctcaacacccacgtgcgctgggtcccgcagtctctcgcccgccccacgcgggtcccagccctggtccttactccccgcgcgggaagaatctggggagggtgggggcggagaggcggctgatcggagagtgggagggaggatgggagatgggcagaggctgcccgcatcagggccaggacagacgtccgcgcggccccaggcactcacttgagtgtcacgcaagtcaccccaacaccgcacaagacagtggcggggtgcgcaccgaggcccctacctggggggtgtgcgcgcactgaacgaccccttctccaggtgcgcgagccgctccggcggccgtgcacactgcgcccccttc

SEQ ID NO: 38361 - DNA, 262 bp, Homo sapiens; identical to SEQ ID NO: 4877
  misc_feature 1..262: note = chr21:38065799-38066061
  misc_feature 1..262: note = hyper
  source 1..262: mol_type = genomic DNA

SEQ ID NO: 38362 - DNA, 112 bp, Homo sapiens
  misc_feature 1..112: note = chr21:38066820-38066932
  misc_feature 1..112: note = hyper
  source 1..112: mol_type = genomic DNA
ggagcgagatgaggtcgtcgctggacgctgggctcccttgtcgttgtccttttccccagaatccatggtcaggcctagggagccacccctgggtgctcgagatgagtcccca

SEQ ID NO: 38363 - DNA, 30 bp, Homo sapiens
  misc_feature 1..30: note = chr21:38067379-38067409
  misc_feature 1..30: note = hyper
  source 1..30: mol_type = genomic DNA
ccttacccccacaagcggcccaggaggtgg

SEQ ID NO: 38364 - DNA, 30 bp, Homo sapiens
  misc_feature 1..30: note = chr21:38067871-38067901
  misc_feature 1..30: note = hyper
  source 1..30: mol_type = genomic DNA
aaaggagtgaaaaatcgaggaattctttca

SEQ ID NO: 38365 - skipped

SEQ ID NO: 38366 - DNA, 93 bp, Homo sapiens
  misc_feature 1..93: note = chr21:38068646-38068739
  misc_feature 1..93: note = hyper
  source 1..93: mol_type = genomic DNA
cgcgaggctggtccgggctttctgagctgggcgttcggctttaggcccaatacctggaccaggaatttcttctccccgcgccagaagggaaag

SEQ ID NO: 38367 - DNA, 460 bp, Homo sapiens
  misc_feature 1..460: note = chr21:38069133-38069593
  misc_feature 1..460: note = hyper
  source 1..460: mol_type = genomic DNA
gatgtgcttgggggagccgagtacacaacgtctgcttgggcagctgctgggcaggcgttgggcctggaggtatctcacacccacgtatcttccagtcttcaaacacggcattgctctgcctcccgtagcgcgcttcgaacctgcctcgcggacacgtgaacagaggctgtccctgggaagataagtgcgctttcccgtaaaatccgggaaatttgccttgaggaaagtttccgttcttgttacttgtcgggtttctcccacttccacttagccatgtttctgcgatctgggtaatccctttcaagcccaggaggaattctcccgggtccataattgagggtcggaagccgtgggggtgagaaacgcattaaatcctcccgaagcccaggaggtgccagagcgggctcagggggccgcctgcggaagctgcggcaggggctgggtccgtagcctctaaccc

SEQ ID NO: 38368 - DNA, 13 bp, Homo sapiens
  misc_feature 1..13: note = chr21:38069793-38069806
  misc_feature 1..13: note = hyper
  source 1..13: mol_type = genomic DNA
tgtgcgtccggct

SEQ ID NO: 38369 - DNA, 68 bp, Homo sapiens
  misc_feature 1..68: note = chr21:38069853-38069921
  misc_feature 1..68: note = hyper
  source 1..68: mol_type = genomic DNA
cgatgtggactccgcaaggggctagggacaggcagggggagagcccgggtttgcgcacaccttccagc

SEQ ID NO: 38370 - DNA, 143 bp, Homo sapiens
  misc_feature 1..143: note = chr21:38070572-38070715
  misc_feature 1..143: note = hyper
  source 1..143: mol_type = genomic DNA
catgggccccacctgcgccacctgcgcccaccctgtgaccctggctcagcgaccttggcccttaatcgcccaacgccgattcctcaaaattccggctgcgctgaatcgggctgcttttgccgccgccccggcagttgggccct

SEQ ID NO: 38371 - DNA, 376 bp, Homo sapiens
  misc_feature 1..376: note = chr21:38072027-38072403
  misc_feature 1..376: note = hyper
  source 1..376: mol_type = genomic DNA
tgcccggagccgaggcgcgatgaaggagaagtccaagaatgcggccaagaccaggagggagaaggaaaatggcgagttttacgagcttgccaagctgctcccgctgccgtcggccatcacttcgcagctggacaaagcgtccatcatccgcctcaccacgagctacctgaagatgcgcgccgtcttccccgaaggtgaggcctcaggtgggcggccggggacgctggggagcccggcggccccggcccaggcgggaagcgcaagccagcccgcccagaggggttgccgcggcctggcgtccagagctggggcgtctgagggaggttgcgtgagggtcttcggcttcggcgctggcttggggcgaggggccagggcc

SEQ ID NO: 38372 - DNA, 265 bp, Homo sapiens
  misc_feature 1..265: note = chr21:38072905-38073170
  misc_feature 1..265: note = hyper
  source 1..265: mol_type = genomic DNA
agggtcagcttcaggcgctgcgagtcagcggggatcacggtgaggcccaagcactgcaggctgaggccacagagcgaacacttgtgctgagccgggccctctcgtgaggctggggtgcgggaagtccgggcaggagagacccgcccccgccgttgctgagctgagacccggctgaaagagaggggtccgattaattcgaaaatggcagacagagctgagcgctgccgttcttttcaggattgaaaatgtgccagtgggccagggg

SEQ ID NO: 38373 - DNA, 287 bp, Homo sapiens
  misc_feature 1..287: note = chr21:38073239-38073526
  misc_feature 1..287: note = hyper
  source 1..287: mol_type = genomic DNA
cgcccacgccggttgccgctggtgacagtggctgcccggccaggcacctccgagcagcaggtctgagcgtttttggcgtcccaagcgttccgggccgcgtcttccagagcctctgctcccagcggggtcgctgcggcctggcccgaaggatttgactctttgctgggaggcgcgctgctcagggttctggtgggtcctctgggcccaggagctgggagggctgcgccggcctctggagccccgggagccagtgccgaggtagggagacaacttccgccgcagggcgc

SEQ ID NO: 38374 - DNA, 245 bp, Homo sapiens
  misc_feature 1..245: note = chr21:38073615-38073860
  misc_feature 1..245: note = hyper
  source 1..245: mol_type = genomic DNA
cggaaagctcgaccttttgcgttcgcctctgccaagcctgttatttgtgctggccgctgggtctggagctgcgcttctcggcccctccccggtggagcgcagagggctggtctgcaagcgcggcctccagccccgcggctccccggcccaggagccaggcgcgggctgacccgggagcacccggcagcggagggggctggaagcggaccctaggcctctcctgtgccacccggccctaccgcgcg

SEQ ID NO: 38375 - DNA, 30 bp, Homo sapiens
  misc_feature 1..30: note = chr21:38075927-38075957
  misc_feature 1..30: note = hyper
  source 1..30: mol_type = genomic DNA
gaggacaggagaccacggctgactttggac

SEQ ID NO: 38376 - DNA, 35 bp, Homo sapiens; identical to SEQ ID NO: 13975
  misc_feature 1..35: note = chr21:38076386-38076421
  misc_feature 1..35: note = hyper
  source 1..35: mol_type = genomic DNA

SEQ ID NO: 38377 - DNA, 25 bp, Homo sapiens
  misc_feature 1..25: note = chr21:38077206-38077231
  misc_feature 1..25: note = hyper
  source 1..25: mol_type = genomic DNA
ggggagaacacgagggctccgacgc

SEQ ID NO: 38378 - DNA, 15 bp, Homo sapiens
  misc_feature 1..15: note = chr21:38077617-38077632
  misc_feature 1..15: note = hyper
  source 1..15: mol_type = genomic DNA
cgaagtggtttgcaa

SEQ ID NO: 38379 - DNA, 72 bp, Homo sapiens
  misc_feature 1..72: note = chr21:38078415-38078487
  misc_feature 1..72: note = hyper
  source 1..72: mol_type = genomic DNA
ccccaggaccagcttcggaagaggagggatcgcttggaggccgtgcagtgtgaggaacggcaggcagggtgt

SEQ ID NO: 38380 - DNA, 35 bp, Homo sapiens
  misc_feature 1..35: note = chr21:38078760-38078795
  misc_feature 1..35: note = hyper
  source 1..35: mol_type = genomic DNA
gggagccgctaaccccgaggcgcctagcacagact

SEQ ID NO: 38381 - DNA, 155 bp, Homo sapiens
  misc_feature 1..155: note = chr21:38079908-38080063
  misc_feature 1..155: note = hyper
  source 1..155: mol_type = genomic DNA
taggtttttagttgccgaatagggaagggtttgcgaagccgctgccctgggccgaggtgcattttacgcttccagaggtcgaggcctccagagaccgcgatgcccagggcgttcccggggaggctgagagacccagggtgctctgggtgactgca

SEQ ID NO: 38382 - DNA, 213 bp, Homo sapiens; identical to SEQ ID NO: 4879
  misc_feature 1..213: note = chr21:38080174-38080387
  misc_feature 1..213: note = hyper
  source 1..213: mol_type = genomic DNA

SEQ ID NO: 38383 - DNA, 193 bp, Homo sapiens
  misc_feature 1..193: note = chr21:38080550-38080743
  misc_feature 1..193: note = hyper
  source 1..193: mol_type = genomic DNA
ggctttcctgcttcctcggactgtgcaggggaagcctggggtctcgcggggcgcagcagtcaggtcgagggtgcagcaggaggggagtcctgacgggcaggtccctctttcccctggtgcgcaacactggttggtagcttttgcggaggtggtgaagaagggcaggaggcctgttgagcggaggagtccgggg

SEQ ID NO: 38384 - DNA, 230 bp, Homo sapiens
  misc_feature 1..230: note = chr21:38081665-38081895
  misc_feature 1..230: note = hyper
  source 1..230: mol_type = genomic DNA
gggggctggggatggggtggtccccactgcggagggatggacgcttagcatgtcggatgcggcctgcggccaaccctaccctaaccctacgtctgcccccacaccccgccgaaggccccaggactccccaggccacctgagacctacgccaggggcgcctcccgagcgtggtcaagtgctttccaatctcacttccctcagcaggttccacccagcgcttgctctgtgcc

SEQ ID NO: 38385 - DNA, 490 bp, Homo sapiens
  misc_feature 1..490: note = chr21:38082684-38083174
  misc_feature 1..490: note = hyper
  source 1..490: mol_type = genomic DNA
cgggtcggccgggtagccctgagcacagctcgccacttccaggtgggctgttggcgctggctggggacacatcccgatctttcaaatgccctttacagagcctcatcaacgacccgattcattcccccctcctgtcatttgtctctgccatcgaaaaatgcctaccgagagctgctctgcatttccgccctctattttgtgttttactttaaaataataataaaaaaaatgttggctgcaggacgccatgacttaggtcagcgagtcagccgctagctctgcatttccaaaaagcagatcttttcacaactctcttgccccaagtgccctggtgtggtttattttttaaaatgcatgcctgcggaagagaagacccggggaatattcgaaaccccgagcttttacaacataaagcgcatggtgtggccgcggcgagtaatggcgctctgggagccctgcccaggcggcctctgctcgccctcctccactt

SEQ ID NO: 38386 - DNA, 784 bp, Homo sapiens
  misc_feature 1..784: note = chr21:38119754-38120538
  misc_feature 1..784: note = hyper
  source 1..784: mol_type = genomic DNA
ttccctgctttgtaacgcggctcctggaacatttcaggtcgcgtcctgagattggacagcacggcctagactaaggcgggggagggcgacagcgaccccgcgggtgcagcgcgtgggcggccgaggggtggtggctgcgcccggggcttgggggtggggtggctgcggccgcgccccttgctgccctctaacgtgtcgcctgtccccgcagcgcccgccgccgccgtgcgcaggttcggcgaggacaccgcgcccccgagcttcccgagctgcggccactaccgcgaggagcccgcgctgggcccggccaaagccgcccgccaggccgcccgggacggggcgcggctggcgctggcccgcgcggcacccgagtgctgcgcgcccccgacccccgaggccccgggcgcgccggcgcagctgcccttcgtgctgctcaactaccaccgcgtgctggcccggcgcggaccgctggggggcgccgcacccgccgcctccggcctggcctgcgctcccggcggccccgaggcggcgaccggcgcgctgcggctccggcacccgagccccgccgccacctccccgcccggcgcgcccctgccgcactacctgggcgcctcggtcatcatcaccaacgggaggtgacccgctggccgcccgcgccaggagcctggacccggcctcccggggctgcggcgccaccgagcccggcaaatgcgcacgacctacattaatttatgcagagacagctgtttgaattggaccccgccgccgacttgcggatttccac

SEQ ID NO: 38387 - DNA, 24 bp, Homo sapiens
  misc_feature 1..24: note = chr21:38120553-38120577
  misc_feature 1..24: note = hyper
  source 1..24: mol_type = genomic DNA
cgccggtgccgagggccgaggagc

SEQ ID NO: 38388 - DNA, 89 bp, Homo sapiens
  misc_feature 1..89: note = chr21:38378464-38378553
  misc_feature 1..89: note = hyper
  source 1..89: mol_type = genomic DNA
cggggaccacagagggacggagaagccgggactcctcacatcccacatccggcaggggaagcccagcaggtgagcgcaggtccccccag

SEQ ID NO: 38389 - DNA, 56 bp, Homo sapiens
  misc_feature 1..56: note = chr21:38378983-38379039
  misc_feature 1..56: note = hyper
  source 1..56: mol_type = genomic DNA
gcgcgggtaggtgagcgcgttagcccgagtggatctaggcgcgctcgtaggccggc

SEQ ID NO: 38390 - DNA, 30 bp, Homo sapiens
  misc_feature 1..30: note = chr21:38379523-38379553
  misc_feature 1..30: note = hyper
  source 1..30: mol_type = genomic DNA
tactttctcggtagccgtttctgttgtccc

SEQ ID NO: 38391 - DNA, 271 bp, Homo sapiens
  misc_feature 1..271: note = chr21:38593435-38593706
  misc_feature 1..271: note = hyper
  source 1..271: mol_type = genomic DNA
cgcgcgaggcccgggcgcccgagcggcgattccctcccctatcaccagctccagggtggtgccccccggctgtggagcccagaccccggccgtccagcagcgtatagacgagcccatgtctgcgatgtaactgcaccgcgctggggatccacctcccgccagggtgagggcgccgtcctccagcgtatgctaggcaggcgcgccccgccctcctggtcacgtgaccacgcctacagccgaagaggatgggaaaatgcggccctgttcctga

SEQ ID NO: 38392 - DNA, 111 bp, Homo sapiens
  misc_feature 1..111: note = chr21:39047670-39047781
  misc_feature 1..111: note = hyper
  source 1..111: mol_type = genomic DNA
gccgggctgggcagccgacgcaccgctaggtggcgcacgcgctcgctgcgtctttcagggctgcaggtacggtgcgggtttctggtgcgctgaccgcgctggggatgagca

SEQ ID NO: 38393 - DNA, 238 bp, Homo sapiens
  misc_feature 1..238: note = chr21:39286637-39286875
  misc_feature 1..238: note = hyper
  source 1..238: mol_type = genomic DNA
gtgaggcttcaccctcggcgcctgggctctggccttggtgctgaatccggaacccgctgaggaaccaccacctcggcggcccccaggcaactttcgggaggtttcaggggcacccggccagctctgggcgccctctcgagcgtcgccgtcagggagttgggcacaaccgatgccctgggacccgccacagggcacgcggctggcgtattcctttgcctggagccgggaaagttttgtc

SEQ ID NO: 38394 - DNA, 37 bp, Homo sapiens; identical to SEQ ID NO: 13985
  misc_feature 1..37: note = chr21:39288011-39288048
  misc_feature 1..37: note = hyper
  source 1..37: mol_type = genomic DNA

SEQ ID NO: 38395 - DNA, 30 bp, Homo sapiens; identical to SEQ ID NO: 13986
  misc_feature 1..30: note = chr21:39288362-39288392
  misc_feature 1..30: note = hyper
  source 1..30: mol_type = genomic DNA

SEQ ID NO: 38396 - DNA, 95 bp, Homo sapiens
  misc_feature 1..95: note = chr21:39288790-39288885
  misc_feature 1..95: note = hyper
  source 1..95: mol_type = genomic DNA
cgcacagcgccggcgcggtccgggaggaaggggcgggggcgagcaggacagagccacagacccagagacgcccaccccgccgcccatgccagcta

SEQ ID NO: 38397 - DNA, 130 bp, Homo sapiens
  misc_feature 1..130: note = chr21:39289195-39289325
  misc_feature 1..130: note = hyper
  source 1..130: mol_type = genomic DNA
cgtgagaggcagccccggcgcgggagccggagcctgcaccgcccagagggggcgcagcgagcggccgggacggaggggaggggccctatccctgagctttgcttgcacctggtggcgccccagcctgctg

SEQ ID NO: 38398 - DNA, 82 bp, Homo sapiens
  misc_feature 1..82: note = chr21:40032153-40032235
  misc_feature 1..82: note = hyper
  source 1..82: mol_type = genomic DNA
aaataacctcttggtcggggccccagatgaagtccccgcggtgtgctctcctggcccttgtcaatttcggggtgccccctcc

SEQ ID NO: 38399 - DNA, 46 bp, Homo sapiens
  misc_feature 1..46: note = chr21:40032796-40032842
  misc_feature 1..46: note = hyper
  source 1..46: mol_type = genomic DNA
gggtgtgggtgtgctcgcgtgtccgtgcgcgcgccctcggggccaa

SEQ ID NO: 38400 - DNA, 105 bp, Homo sapiens
  misc_feature 1..105: note = chr21:40033106-40033211
  misc_feature 1..105: note = hyper
  source 1..105: mol_type = genomic DNA
tgtgggagggggagccgcgggggtgcgcgctcctcctaactcggggtcgcttttagcgagaagtgatatttttccagcctcattgaaaaccgttgcaaacattga

SEQ ID NO: 38401 - DNA, 30 bp, Homo sapiens
  misc_feature 1..30: note = chr21:40984793-40984823
  misc_feature 1..30: note = hyper
  source 1..30: mol_type = genomic DNA
atcagatttcctgtgcgcatcgccgcgcgc

SEQ ID NO: 38402 - DNA, 395 bp, Homo sapiens
  misc_feature 1..395: note = chr21:42688823-42689218
  misc_feature 1..395: note = hyper
  source 1..395: mol_type = genomic DNA
tggtgagtgcgcccccgcctcggggcgagggtaggggcggggaaggaggaccccaggggaagcgtcgctccccaaccctgcctgggacccgccacgcttagcaaaagcgggagggctggttcttggcgccgaggctggtcttagacctgggatcaggaatgcgggaagcgattccagagggggcgaacagcgggggtttccagcagggttccccgaccctgtttccccgcgctcgccaggcctgttcccgccgccccagccggggtgcatgggattagggaggaacctggaatgtaacactgtaacattttacttggaaagtagattggtggggagcgcaggcacagccccgcacccccaccccccacccgggctctccacgcttctccttccgg

SEQ ID NO: 38403 - DNA, 82 bp, Homo sapiens
  misc_feature 1..82: note = chr21:42878710-42878792
  misc_feature 1..82: note = hyper
  source 1..82: mol_type = genomic DNA
cttgtaactgggctgcgtagcctttgtaattttccatgattcgggaggttctcgcggctgggagctccgtgaggtcaggcat

SEQ ID NO: 38404 - DNA, 42 bp, Homo sapiens
  misc_feature 1..42: note = chr21:42880442-42880484
  misc_feature 1..42: note = hyper
  source 1..42: mol_type = genomic DNA
gtaggcggccggccccgtcttggcctccggggaacccactgt

SEQ ID NO: 38405 - DNA, 30 bp, Homo sapiens
  misc_feature 1..30: note = chr21:44073368-44073398
  misc_feature 1..30: note = hyper
  source 1..30: mol_type = genomic DNA
gcagggagagaggagcgaggggagttttcc

SEQ ID NO: 38406 - DNA, 102 bp, Homo sapiens
  misc_feature 1..102: note = chr21:44494676-44494778
  misc_feature 1..102: note = hyper
  source 1..102: mol_type = genomic DNA
cgggaagggactctccgtctggcacaggccctgtctggcctggggcgcgcatgctccgccgccgaatcttccagaaagccgtggacccgaggccccggcaga

SEQ ID NO: 38407 - DNA, 57 bp, Homo sapiens; identical to SEQ ID NO: 1513
  misc_feature 1..57: note = chr21:44494940-44494997
  misc_feature 1..57: note = hyper
  source 1..57: mol_type = genomic DNA

SEQ ID NO: 38408 - DNA, 611 bp, Homo sapiens
  misc_feature 1..611: note = chr21:44494998-44495609
  misc_feature 1..611: note = hyper
  source 1..611: mol_type = genomic DNA
ggttcagctggcatcgcctggccggttccgttcgctccttaaaccacaagacccccttggggtcacgacgttcccggggcacccctgcactcgcgcgccagcactcccggaggggcctggggaaggccacgcgcacggagagcgggaaactcctctaggtttccaggtgggagatccagaccctactgagacccggaaaccgccggccactccgcctccggaagcgacactttgggacaaagctggggacaagtaagcccagaagatcctcgggaagccgagaatttcgcgctccgctctcccacccacgctccgcctcccgcttgcatcctacagctcagctgcggtctcgcctggggctcagggaagtgaggtcccaggaaaacctccatcccccgaacgcaacctgggcagagccccgcgtccctcccccagcgggcacccacctcgcgtgccgcccgcgcaacgacagcgtttaccgccaccccacacggtccgccaaaaagggcgatttgcaaacagccatttcccatccacaatgcagcgaactcaatgctgggcaccgaaacgtgcatctcccccggattcccaccccgcgtccctgctccacg

SEQ ID NO: 38409 - DNA, 194 bp, Homo sapiens
  misc_feature 1..194: note = chr21:44495838-44496032
  misc_feature 1..194: note = hyper
  source 1..194: mol_type = genomic DNA
gtccagagaggggagcgagtctcggtggggccggatctcacctggacggatacatggaaaagaggggcgagcggctgccccgactgcggcgaggcggagacggcgaccccggggtggcggcctcgcggggacccacggcgaggggagcaggcgggcggtgattggcggagaggcgggggcggaggccggcgccg

SEQ ID NO: 38410 - DNA, 346 bp, Homo sapiens
  misc_feature 1..346: note = chr21:44496398-44496744
  misc_feature 1..346: note = hyper
  source 1..346: mol_type = genomic DNA
ctgatgagcttgaaacgtgcgtcctggtgggtggggggccctgcgcgtcctcgaggaccgaccccgagggcgtgtgtcgcgggcccgggagggggcgccgcgccggggcgggactcgatggccgcgctctgtggccgccggacgccgtgcgcagcgccccgcgtgaccgcgcccagagccgggtccgaaccccgagccgaggcgcagaacagtcgccttgcgcggctccggtgcggcccacggccaggggctgccgggcgctctcggggacggggccgactccgcgcagggtggtagcaggggcgccccgcggggctccttcgccaggtcccggaggccgcgggcg

SEQ ID NO: 38411 - DNA, 86 bp, Homo sapiens
  misc_feature 1..86: note = chr21:44847520-44847606
  misc_feature 1..86: note = hyper
  source 1..86: mol_type = genomic DNA
ggggcccgggggcctcgcgggctcgcgcgtggggctggcggcgcggatgccctggggcgctgcagaccccgagaggccgcttgccc

SEQ ID NO: 38412 - DNA, 236 bp, Homo sapiens
  misc_feature 1..236: note = chr21:44847607-44847843
  misc_feature 1..236: note = hyper
  source 1..236: mol_type = genomic DNA
cggggacgtcagccgcttttgctgttaaaatctgaaatgttcagcaagttagaaacttgaaacctaaggaagcgtgaccggccgctctggaagcccccgccgcgcggccggtcccggccccggccctcagcggcgctggcgtctgcgcgtcccggggctgcccccgcagcatgtggggctgggaccctcttcccgcgcgggccccgggcggacgctgcgggcggtgacggagccag

SEQ ID NO: 38413 - DNA, 691 bp, Homo sapiens
  misc_feature 1..691: note = chr21:45148316-45149007
  misc_feature 1..691: note = hyper
  source 1..691: mol_type = genomic DNA
tgctctcccctggaacgcctggaactagggtggtcaggctggggtggaggagctcccctggaatgttccagagcttcccccactcctgccgttctgagtcaccctgcctccccggaggaggaggaggatcagctgagccgccgcgctcacgtagtgtctggctgtctgcctgtctgcctcgctgtgagcagagtgggatgctgccgataaggcgcgcacgtgggccctgggaggagcccgaggcagccactcccgcacgtgggcaggaggagggctgctcacaccaccggccgagggaggaggactgcgggctgcgcctgggcaggggatgagcttgtgtcgcgggcggcagggggaagggagtcggagagctcctgcggtccagccggatgactgatgaggttgaaagcacttccgctgcggcccccgcaggaagttcccaggaggaagttgcgaccctttctaagccatcccactggcctggactctgctgggattattttgaccccccagggcagagtgtagccatctgactggctttctctctcggcaggagacggggcgcacgcctgcaggtgggggagccccaatacgtcacacggatgagcggggcaaagcccagccccccaccccgcacccgcccgcccgcaatcctgccccctggctgcggcctccgcggctcttcccaccc

SEQ ID NO: 38414 - DNA, 51 bp, Homo sapiens; identical to SEQ ID NO: 14000
  misc_feature 1..51: note = chr21:45875681-45875732
  misc_feature 1..51: note = hyper
  source 1..51: mol_type = genomic DNA

SEQ ID NO: 38415 - DNA, 38 bp, Homo sapiens
  misc_feature 1..38: note = chr21:46126390-46126428
  misc_feature 1..38: note = hyper
  source 1..38: mol_type = genomic DNA
cgcgtacacacccacgcgcacacaccgctgtccccagc

SEQ ID NO: 38416 - DNA, 158 bp, Homo sapiens
  misc_feature 1..158: note = chr21:46126566-46126724
  misc_feature 1..158: note = hyper
  source 1..158: mol_type = genomic DNA
cgagcagctccgggcctcaggggtcgccccgccaccgttttcctttcccagatgctgggacgggggcagggaggggctccccaggctgaacccgactaggtcaccctagaagcgaggcgagcttctcttctgtttttcttcggcgcccctgagcccct

SEQ ID NO: 38417 - DNA, 289 bp, Homo sapiens
  misc_feature 1..289: note = chr21:46127234-46127523
  misc_feature 1..289: note = hyper
  source 1..289: mol_type = genomic DNA
gagaggacacagggtcggaagggtgaggggtagtggcagaggcggaggccgaggccacgcagctgcggggcgcagggaggggcagaggaggggcgttcagatgggaacctagtccagacccgtcggggccctcgtgtgcggctcgttatcctggaaccagagaggctggagacccttggcttgtctggagcggaaccgtagtgtccaatagagtgtgtggggctcagccctaaagctaaacattctttatttcctgatgaccatgggggcggagcgggggaaaagccct

SEQ ID NO: 38418 - DNA, 28 bp, Homo sapiens
  misc_feature 1..28: note = chr21:46127878-46127906
  misc_feature 1..28: note = hyper
  source 1..28: mol_type = genomic DNA
ctagcctgtgccccccgattccccccct

SEQ ID NO: 38419 - DNA, 30 bp, Homo sapiens; identical to SEQ ID NO: 14004
  misc_feature 1..30: note = chr21:46128279-46128309
  misc_feature 1..30: note = hyper
  source 1..30: mol_type = genomic DNA

SEQ ID NO: 38420 - DNA, 212 bp, Homo sapiens
  misc_feature 1..212: note = chr21:46128884-46129096
  misc_feature 1..212: note = hyper
  source 1..212: mol_type = genomic DNA
cactgagcagggtcccgcgtgaccggtccccaccgctgacggttcctggggtaacactcaggacagggagaggcaatggaaagagacgtggccgccctcgcatcctgcagctcccgcactcccagcctcccagcctcccacccagccccccagagcccaccagtgaccccgcccactgggtcctcagatggctcccacgggatctcctgcct

SEQ ID NO: 38421 - DNA, 258 bp, Homo sapiens
  misc_feature 1..258: note = chr21:46129376-46129634
  misc_feature 1..258: note = hyper
  source 1..258: mol_type = genomic DNA
atgagtcctagaaagcgagagacgagaggggaatgagcgccgaaaatcaaagcaggttcccctcctgacaactccagagaaggcgcatgggccccgtggcagacccgaacccccagcctcgcgaccgcctgtgacctgcgggtcaaccacccgccgcggctccacgccgtgggcacagactcagggagcaggatgagaaagctgagacggcgcagccacggcccggtgccttcacgcgcacagcgacacagccccagc

SEQ ID NO: 38422 - DNA, 30 bp, Homo sapiens
  misc_feature 1..30: note = chr21:46130412-46130442
  misc_feature 1..30: note = hyper
  source 1..30: mol_type = genomic DNA
gatctgagtgccatccgagcagagagctgt

SEQ ID NO: 38423 - DNA, 30 bp, Homo sapiens
  misc_feature 1..30: note = chr21:46132288-46132318
  misc_feature 1..30: note = hyper
  source 1..30: mol_type = genomic DNA
cctctggagggaagtcggtccttaaaggga

SEQ ID NO: 38424 - DNA, 34 bp, Homo sapiens
  misc_feature 1..34: note = chr21:46143070-46143104
  misc_feature 1..34: note = hyper
  source 1..34: mol_type = genomic DNA
atcggtgcaagcattcgaccgagttttcttagct

SEQ ID NO: 38425 - DNA, 217 bp, Homo sapiens
  misc_feature 1..217: note = chr21:46351695-46351912
  misc_feature 1..217: note = hyper
  source 1..217: mol_type = genomic DNA
ggcgcaggcgacccccgacgggcagccgctcaccttctcctggccccgggcttcaggaaaactgcctggaggtggccggggtctccctagcggaggctgggcggcgggcttcgcgcctgcctcagtctcccaatccgtggcccgggggatggagcccgctgcgcgcagaggctgcggcaggtcccagccaggtgccctggaacgtggctcctccttc

SEQ ID NO: 38426 - DNA, 56 bp, Homo sapiens
  misc_feature 1..56: note = chr21:46352791-46352847
  misc_feature 1..56: note = hyper
  source 1..56: mol_type = genomic DNA
gggttcggtgcgggacggcccaggccgccaggacccccaagcgcagctcagtctgc

SEQ ID NO: 38427 - DNA, 436 bp, Homo sapiens
  misc_feature 1..436: note = chr21:46438321-46438757
  misc_feature 1..436: note = hyper
  source 1..436: mol_type = genomic DNA
gaagccccccgagggcgaggccgggcgaggccagggggccggggccagaggcggtcgcggcgggggtgggtgtcctggagcaggagcggcagcgggaaacgaagacacgcgcttcttcctactggggggatggctgggaagtaagaccggccgggccgccgagcccgctgcgaggggcttcgcgtggcggccgcacctgagcccgagcgcgcccttgagaggcggcgcccacgggggcagagacccacggtccacgcgcagacccggagaacccgcgatgtcgccgcacgcagcgccgctgtgaaggacggaggcggggcggggccctgggacagggagcgggtgggggcggggtggggggagggcccgtccgggcctgcgcgggaagccctgggttggccttggtgctctgtgatgcccacgctgggtgcaaatg

SEQ ID NO: 38428 - skipped

SEQ ID NO: 38429 - DNA, 15 bp, Homo sapiens
  misc_feature 1..15: note = chr21:46439007-46439022
  misc_feature 1..15: note = hyper
  source 1..15: mol_type = genomic DNA
cgtctgtcccaggcc

SEQ ID NO: 38430 - DNA, 134 bp, Homo sapiens
  misc_feature 1..134: note = chr21:46706841-46706975
  misc_feature 1..134: note = hyper
  source 1..134: mol_type = genomic DNA
tgcggagcgcccgcccggcactgactcccggctccgcacacccaggcctggacccgtgtcacttgcaggggcctccggagccagcccacgctcagcctgagcaacccggcccccttcctgggctcccgaggctg

SEQ ID NO: 38431 - DNA, 378 bp, Homo sapiens
  misc_feature 1..378: note = chr21:46825344-46825722
  misc_feature 1..378: note = hyper
  source 1..378: mol_type = genomic DNA
cctggtcctgctgctcggggtccgcgcggcctccgcggagccaggtaagacccgggcgggacgggaaggttcgcgccggtgcccgccggcctcgccgccctggctggggtccccgcccggctccctcacccccgccccggccgctctgggttcagccccggccctgcccacgcgcgcaggaggcgccggagccggacggagcggggcggggtggccggagtcccgcccattcattctccccgcggggtccgggccgggaggggtgcgcggtgcgagcggccggagtccccgcgcggggaccgaacctccgcggccggcggggtcgtcggtgccgggagggctcggggcggggccgcggggtctcgggagacgcggcct

SEQ ID NO: 38432 - DNA, 63 bp, Homo sapiens
  misc_feature 1..63: note = chr21:47010090-47010153
  misc_feature 1..63: note = hyper
  source 1..63: mol_type = genomic DNA
aaaaagtcctccttccgtttcccgcactggtaggaaagctggggagagagaaggagtctcacc

SEQ ID NO: 38433 - DNA, 87 bp, Homo sapiens
  misc_feature 1..87: note = chr21:47010408-47010495
  misc_feature 1..87: note = hyper
  source 1..87: mol_type = genomic DNA
gccccgggagttcgaagggtgctggggccgaggggaaggctctggtcggcggcgtcagcggcagctcccagacgacctaggactgca

SEQ ID NO: 38434 - DNA, 79 bp, Homo sapiens
  misc_feature 1..79: note = chr21:47010703-47010782
  misc_feature 1..79: note = hyper
  source 1..79: mol_type = genomic DNA
gctcctgctccagggcgaacccgggggtcctctcccatggctctgtgggggaccccggggaggtcgccctggcacggga

SEQ ID NO: 38435 - DNA, 128 bp, Homo sapiens
  misc_feature 1..128: note = chr21:47062752-47062880
  misc_feature 1..128: note = hyper
  source 1..128: mol_type = genomic DNA
gggcgctgcggccccagcctccgggccggggccaggcccacagagaacgggaagcgggcgctgcagggggaccttcggggttgcggcacggctgggaattcaacggccattcccgtcccgtcgggccc

SEQ ID NO: 38436 - DNA, 945 bp, Homo sapiens
  misc_feature 1..945: note = chr21:47063432-47064377
  misc_feature 1..945: note = hyper
  source 1..945: mol_type = genomic DNA
ttccagagaactttccgggctcggattggccgcgccggttgatgttccgccctttcattggcccgcggcgcccgctttcgcgagcctgcccttgggcgggggcggggccggcggcggcgcgcggcgctagattggttagcggcgcagaggggcgggcccgcgccgcgcgcagcgctcgggctggagcgcctgaagccgcgaccgccgcctcagccgcctcagccgcggtcgccgccgcttcggctgacttaggctccgccgccgcctcctcacccgcctcgccccgaccccgcccgggcctcccggcctctccccgccggcccgcgggctcgccgtccggcgcagggcaggtgagtgagcggtggcgggcggggtcggggtcgggcgcccttgcgggttacggggacccagtccccgacggaggccgagtgacggggcgaccccgggccgcggcaaacttcgcccgagccggggcgggcgggggtcccgggctgggtcgcgccgtccccgaccgccgccggcgcctgcggcggcccggggcagcgaggggactcgcgctccctcaaggtgcggtcgccaggcctggcccgcccgcctccgccccctccccaaattcggaagttgcggcgggaagccgagaacgtctcggatgtgggtcagaaaacgtctggactacttgaggcttcagtttcaaaacggcacaaatttcatctcttgattgagaagagatctggggaacaccccggagcggccgcggcggctggagggcggcggggcggggcgcggggcctcctccccctggacggccgccgggagagcgcggcctcacccctcggtgaccctgcggagagccgcgcgcgggcggtggggcgcgcgcaggtctctcttgttgctcgctgtgttttattttaattttgggggtggttagaacgtgtttcttattgt

SEQ ID NO: 38437 - DNA, 74 bp, Homo sapiens
  misc_feature 1..74: note = chr21:47392726-47392800
  misc_feature 1..74: note = hyper
  source 1..74: mol_type = genomic DNA
cggcaaccccacccgagggctcccactgctgcccacagacatctcagggtctcccgggccgggtcagcggcgcc

SEQ ID NO: 38438 - DNA, 30 bp, Homo sapiens
  misc_feature 1..30: note = chr21:47393095-47393125
  misc_feature 1..30: note = hyper
  source 1..30: mol_type = genomic DNA
gggaaaggcttaacccgtccagccccgcag

SEQ ID NO: 38439 - DNA, 324 bp, Homo sapiens
  misc_feature 1..324: note = chr21:47517989-47518313
  misc_feature 1..324: note = hyper
  source 1..324: mol_type = genomic DNA
ggggtataaagggggcggcgccggccgcggttccctccctgctgcttactcggcgcccgcgcctcgggccgtcgggagcggagcctcctcgggaccaggtgagcgcctcccggaccccgcaccctggaagccgctcggcccgcggggggtgaccccgagtcctgggaaggcggcggcggcggctccgtccctcgggtccccgggaagggggactccagccccagggacggcggggggctcggcgggttcggggctcctcctcgcggggctggggccgcgcctgcccctgtggctccgcgtctctgggtccgaccctcgggcgcg

SEQ ID NO: 38440 - DNA, 465 bp, Homo sapiens
  misc_feature 1..465: note = chr21:47518349-47518814
  misc_feature 1..465: note = hyper
  source 1..465: mol_type = genomic DNA
cggagccggcctgggcggggtgggggggtccctgtctgcgcccgagctcggtgctgggacccccgctcccgagacgaccccggcaccgcacgccccgccaggccccgcgtctgcgagcggttcgggtccggctccggcccgcggggaagacgccccggctggctgggacctccgggggcgcagggcctctccccgggccggacggaaggggcggcggggcggggggaggaggggctttcggtgcccgagggcgggactgggcggggaggggacgcgggtggccccgacgccccatcgctgcgcccctcccggcctggagcccaccagggccccgccaggcccaggagaagctgcagacggaggcggctccccagggcggcgggacccgggctgacagcgacccgcagcccctgccgggccgcccacacccgccctgggactccgccggggcgctggtggaaccgc

SEQ ID NO: 38441 - DNA, 121 bp, Homo sapiens
  misc_feature 1..121: note = chr21:47717212-47717333
  misc_feature 1..121: note = hyper
  source 1..121: mol_type = genomic DNA
ctcccactcccctcccgaggccccgcttattctcccggcctgtggcggttcgtgcactcgctgagctcaggttctggtgaaggtgcccggagccgggtcccgccttcggcctgagctagag

SEQ ID NO: 38442 - DNA, 300 bp, Homo sapiens
  misc_feature 1..300: note = chr21:48087199-48087499
  misc_feature 1..300: note = hyper
  source 1..300: mol_type = genomic DNA
gcgcccgggaaggtgcggccaccctcacgcggaaggcggccagcggatcccggtgcgcgcagctcccagcgctggggttccagcgccccgcctcttcctatagcaaccagcgggacctgccgtcccccggggcaccccgaggggtctgcgcccgcttctttccgaaacgggaaggcgctgggggctcggcagccagagggacgggttcagggagcgtccggtgagcctaagacgcgcctttgccggggttgccgggtgtctgcctctcacttaggtattaggaaccgtggcacaaatctg

SEQ ID NO: 38443 - DNA, 267 bp, Homo sapiens
  misc_feature 1..267: note = chr21:48087715-48087982
  misc_feature 1..267: note = hyper
  source 1..267: mol_type = genomic DNA
cctccgtgtgtccttcgagccacaaaaagcccagaccctaacccgctcctttctcccgccgcgtccatgcagaactccgccgttcctgggaggggaagcccgcgaggcgtcgggagaggcacgtcctccgtgagcaaagagctcctccgagcgcgcggcggggacgctgggccgacaggggaccgcgggggcagggcggagaggacccgccctcgagtcggcccagccctaacactcaggaccgcctccagccggaggtctgcgccc

SEQ ID NO: 38444 - DNA, 15 bp, Homo sapiens
  misc_feature 1..15: note = chr22:17081921-17081936
  misc_feature 1..15: note = hyper
  source 1..15: mol_type = genomic DNA
attccttttcctccc

SEQ ID NO: 38445 - DNA, 33 bp, Homo sapiens
  misc_feature 1..33: note = chr22:17082347-17082380
  misc_feature 1..33: note = hyper
  source 1..33: mol_type = genomic DNA
ggagcgggcgggggccgtcgaggaggcgttgtg

SEQ ID NO: 38446 - DNA, 108 bp, Homo sapiens
  misc_feature 1..108: note = chr22:17082786-17082894
  misc_feature 1..108: note = hyper
  source 1..108: mol_type = genomic DNA
cgctccatgttgccgcctctcccggtacctgctgctgctcccggggcttcgggaaatgcgagagtctgagccggggaggaggaacccgagcagcggcggcggcggccg

SEQ ID NO: 38447 - DNA, 74 bp, Homo sapiens
  misc_feature 1..74: note = chr22:17082988-17083062
  misc_feature 1..74: note = hyper
  source 1..74: mol_type = genomic DNA
cgcagccaccaccccccgaggagcctggagccccggccccgagccccccagccgcagacaaaagacctcggggc

SEQ ID NO: 38448 - DNA, 204 bp, Homo sapiens
  misc_feature 1..204: note = chr22:17083207-17083411
  misc_feature 1..204: note = hyper
  source 1..204: mol_type = genomic DNA
ggcgggatgggggcggggcgggcccgcgggcggcggcagctcccggccccggccccacgcccctcggtagccgcccgcgcccggcctcccccgctccgcgccgcccgcccgggctcccgtcggcgcccggcttcgcacactttacttttcagtcgggccttttcagtgggtcttctccgcgactcttcttttggagaaatttct

SEQ ID NO: 38449 - DNA, 29 bp, Homo sapiens
  misc_feature 1..29: note = chr22:17083524-17083553
  misc_feature 1..29: note = hyper
  source 1..29: mol_type = genomic DNA
cggagctgtcaaaacgcccgggccaggtg

SEQ ID NO: 38450 - DNA, 209 bp, Homo sapiens
  misc_feature 1..209: note = chr22:17083858-17084067
  misc_feature 1..209: note = hyper
  source 1..209: mol_type = genomic DNA
tgcagatgtaaatgtcgtttccctcgtaagtcttagctgtaaggggcttgggaatagggtcgcctgcctttgaccgaccgtactgtagggctggacaccggcttattagaggaccagaaatgtcttcttacagaacggttatttgacggctttgcttgtaaattaagacaccgttttagtgccagcgagctgctcggcttctgtggctc

SEQ ID NO: 38451 - DNA, 15 bp, Homo sapiens
  misc_feature 1..15: note = chr22:17090840-17090855
  misc_feature 1..15: note = hyper
  source 1..15: mol_type = genomic DNA
cggccaagagcggat

SEQ ID NO: 38452 - DNA, 190 bp, Homo sapiens
  misc_feature 1..190: note = chr22:17600944-17601134
  misc_feature 1..190: note = hyper
  source 1..190: mol_type = genomic DNA
agcgccatggtgagacggaagcccgtggtgccgaagggcgcgcgtagctcgatgaggtctaggatggacgtgcccaggatcagcaccaccttgggagtgaaggcgatggagtagataagccaggccaggtaggcgaaggcgaactcgcccgctgccgcggccgcccccaggccgccccccgcgccgccgg

SEQ ID NO: 38453 - DNA, 183 bp, Homo sapiens
  misc_feature 1..183: note = chr22:17601259-17601442
  misc_feature 1..183: note = hyper
  source 1..183: mol_type = genomic DNA
cgacggccccggctgttcttggcgaagaagatggcccagcccaccaccaccaccaggtcagtggcgatccaggagcaccagtacaggtcggtgacggcgatgaggtacaggtccagcaggccgccctgcgccagcagcagcaccacggacagcgcctggtagccccagcggcacctgggactg

SEQ ID NO: 38454 - DNA, 133 bp, Homo sapiens
  misc_feature 1..133: note = chr22:17602410-17602543
  misc_feature 1..133: note = hyper
  source 1..133: mol_type = genomic DNA
ggcgggggtgcagtgcgtcacagtcgggtcgggagccctgtggcctggaggaagcgggaggaggcgcgggcagccgccagggcgaggcgacccggtgcggggggactcccatggagcgcggactcctaaggaa

SEQ ID NO: 38455 - DNA, 15 bp, Homo sapiens
  misc_feature 1..15: note = chr22:17849412-17849427
  misc_feature 1..15: note = hyper
  source 1..15: mol_type = genomic DNA
ttagcagtactccac

SEQ ID NO: 38456 - DNA, 376 bp, Homo sapiens
  misc_feature 1..376: note = chr22:17849501-17849877
  misc_feature 1..376: note = hyper
  source 1..376: mol_type = genomic DNA
cggggcgtgggggtctcctcccctccgagcacagtccccggcttcccgatttcctctgccccatccccccgccttccaagcacattgtgctcactcttccaggcagctctttcagcggccgggcagtagcagggttccgagcccgtcttctccggggcggtcacacgtgtccattccctggggttggggatcgctcttcccgcttggctgctgattggtgcctccccctaccccacccttcccgccgctctccagcctccatcctacttcgttccagctcaatcagccccaccgccttcttccctcggagaaaaaagccacttcagagctccttgggcgccgttctcggctggaataaaagcgttaagaaacaggt

SEQ ID NO: 38457 - DNA, 580 bp, Homo sapiens
  misc_feature 1..580: note = chr22:17850114-17850694
  misc_feature 1..580: note = hyper
  source 1..580: mol_type = genomic DNA
caaagtcctggagggcggagggcgcctcgtgagagttctcgggggtgcggcccgcgccccctgggtcctgcggatctgggcccgggggcgcgcgccccgcccctccccctccctggcggtgcagctgtccgggcgggggtggggcgggggccggggcccgcgtgggattaactaggaccggggcgggagtcgaccgcggccggcggggagggctagccccgctctggcgggcgggcgcgtggcaggggctcccggaggccccgagctcccgggaggcgctccggccaacttcgggccggtggggaccgggcctgggcgcggggctctgaaggtgtggaaggaaagtttgggactccgttattcttccacagcgtccttcctcccgtaatatccagcctctttatcgcggggctcgggagcccttggagttgatctcgccaccattatccccccgggcgagcgcggaggacgggctggccattctggccaggccggaggtgttttccagcccggggctttgtgataactgggccgaaacccgagggtcctggagcgcggcgggtggcgggagcttgcggag

SEQ ID NO: 38458 - DNA, 78 bp, Homo sapiens
  misc_feature 1..78: note = chr22:17850953-17851031
  misc_feature 1..78: note = hyper
  source 1..78: mol_type = genomic DNA
tttggaagagcaaatcgttgttgttgcctccccagccccacggatcttactttgtgccattttcgggttgattttaac

SEQ ID NO: 38459 - DNA, 30 bp, Homo sapiens
  misc_feature 1..30: note = chr22:18986543-18986573
  misc_feature 1..30: note = hyper
  source 1..30: mol_type = genomic DNA
tcttttgaaattactcggcacccccattgt

SEQ ID NO: 38460 - DNA, 740 bp, Homo sapiens
  misc_feature 1..740: note = chr22:19016854-19017594
  misc_feature 1..740: note = hyper
  source 1..740: mol_type = genomic DNA
gagacccggccctgccggggttccctgcgccccagaccggaacccccagggctttggtcgttcccacagccgtcccgcgggccccctccacggtgcgtcgcctgggccccagcggtcgctaggctgcagcctggggctcccggccatcccgggcgctggcggcggtggaggcagcagggcggatggcggagcccggccgcccgtgggcccaggcgcgtagtgcgtacagagccagcgaggtgctgcggcgcggcacgggccgccggcgggatccggggccgcaatccaatgggccgggccaggaagacgcccgagccccgggccggatggctcgcctgcgcggccagctccgggccgaagcggcttcgcggtccgaggtgccgcggctgctgaagctggtggagcgtgcgggggccggggcggccgggcgcgggcgagaggaccggcgcgcacagccgcgggctccgtgtgctcggtatgcggggagccccgcggcggggccacctacccggcgggggtcctggaggtgagcgagcggcggctgcaggagggcctggcggcagtgcgcgaggagctgggcgccgggattgaggcgctgcgcgcggagcttcgagcggagctggatgccctgcgcgcgctgctgccgccgccgccgtccccgcctgcccgccgcgagccccgcgccgtcccccgcgccgcgccccgcggcccgaccctgccgcggacgctcggcaccgtga

SEQ ID NO: 38461 - DNA, 148 bp, Homo sapiens
  misc_feature 1..148: note = chr22:19510799-19510947
  misc_feature 1..148: note = hyper
  source 1..148: mol_type = genomic DNA
agccaagacccccagcgtcttggaggggaagcgaaatcctcagtctgacacccgctctgcctatggaaacagcgccgcgcacagaaaaggaaacttcattccgtctgttaagggcagggccgggctagtggcaggagaaggtcagctg

SEQ ID NO: 38462 - DNA, 315 bp, Homo sapiens; identical to SEQ ID NO: 1517
  misc_feature 1..315: note = chr22:19511141-19511456
  misc_feature 1..315: note = hyper
  source 1..315: mol_type = genomic DNA

SEQ ID NO: 38463 - DNA, 335 bp, Homo sapiens; identical to SEQ ID NO: 1518
  misc_feature 1..335: note = chr22:19511541-19511876
  misc_feature 1..335: note = hyper
  source 1..335: mol_type = genomic DNA

SEQ ID NO: 38464 - DNA, 67 bp, Homo sapiens; identical to SEQ ID NO: 1519
  misc_feature 1..67: note = chr22:19512252-19512319
  misc_feature 1..67: note = hyper
  source 1..67: mol_type = genomic DNA

SEQ ID NO: 38465 - DNA, 27 bp, Homo sapiens
  misc_feature 1..27: note = chr22:19512376-19512403
  misc_feature 1..27: note = hyper
  source 1..27: mol_type = genomic DNA
cgtagaggccctcgtaggggggctctc

SEQ ID NO: 38466 - DNA, 150 bp, Homo sapiens
  misc_feature 1..150: note = chr22:19706215-19706365
  misc_feature 1..150: note = hyper
  source 1..150: mol_type = genomic DNA
ggcctggggtccgagcgtgcccccgggcctgggggggtcgccgcgatggactcgctggcagcgccccaggaccgcctggtggagcagctgctgtcgccgcggacccaggcccagaggcggctcaaggtgcgtgtgtggagagggcggaac

SEQ ID NO: 38467 - DNA, 331 bp, Homo sapiens
  misc_feature 1..331: note = chr22:19706366-19706697
  misc_feature 1..331: note = hyper
  source 1..331: mol_type = genomic DNA
tgggtctgtgaccccgcgggctccgggactcggcatggggtccccgtccccgcgcgccacggcccgccagcgcctaggctcagcccttccctccgcagcggcctcgcaggtccgcggccccacggtggggcgacgtgccctgtccaggcctcacctcacgcgactccaaaacgcggcggagaatgcggccgtgggacccctccaggggccccaagggtctgcgggggctgggcgcctgggcgcgcgggcgggggaggctcggcgccgcggtctataaataggcgctgctccgccaccgccgctgccgccgcccccgcggctggatccgggc

SEQ ID NO: 38468 - DNA, 17 bp, Homo sapiens
  misc_feature 1..17: note = chr22:19711723-19711740
  misc_feature 1..17: note = hyper
  source 1..17: mol_type = genomic DNA
gcgcccccagcgctgcg

SEQ ID NO: 38469 - DNA, 145 bp, Homo sapiens; identical to SEQ ID NO: 14032
  misc_feature 1..145: note = chr22:19742613-19742758
  misc_feature 1..145: note = hyper
  source 1..145: mol_type = genomic DNA

SEQ ID NO: 38470 - DNA, 204 bp, Homo sapiens
  misc_feature 1..204: note = chr22:19742788-19742992
  misc_feature 1..204: note = hyper
  source 1..204: mol_type = genomic DNA
cgcggttcttctctcggcttggcggctggggtccgacgaaggggcagaggccacaactcagcggccccgcgggcagccccggcacgcggccccacccgcccgcctcccaggctcggggtctcggctcgtccacggccacgagggtcgcccggaatgtcgcgttcgccggtgctgtgggccaagcactttcgtgggatggaggga

SEQ ID NO: 38471 - DNA, 311 bp, Homo sapiens
  misc_feature 1..311: note = chr22:19748598-19748909
  misc_feature 1..311: note = hyper
  source 1..311: mol_type = genomic DNA
cctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggtcagggcgcccctccccacgccgcgaccctccccacgtgctgccgccagggctgcgggcctccgcctgatccgcgcgagcggggccgaaagccgggtcgggggcg

SEQ ID NO: 38472 - DNA, 32 bp, Homo sapiens
  misc_feature 1..32: note = chr22:19748960-19748992
  misc_feature 1..32: note = hyper
  source 1..32: mol_type = genomic DNA
cgccgtcccggctccggcgacagccgcccggc

SEQ ID NO: 38473 - DNA, 1439 bp, Homo sapiens
  misc_feature 1..1439: note = chr22:20790689-20792128
  misc_feature 1..1439: note = hyper
  source 1..1439: mol_type = genomic DNA
ctgcattcctggggccggggaggcccgggagtccgcggcggcggcatcgatgcgaagcagatggcgggccaggccggcccccgccccggaggcggggctcgcagcggggaggggtctgcgcgcctccggaccagagttcggaaaccccgcgctgccccctcgcagccccttgtctctggcgccgagcccctggactcggcttgccccgggtccgtggctcaggcgccccgacgcgacccagctcggagcccggcggccgcctctgcggctgccagcccgtgcggcgtctccaatccgcgccaaggcgcccccacacgcccgctcctcacccctgcgtggagatgcccttgaccttgtggcctttggccagcccaccggctcccccgaccccagctcctaactcctggcgtccggggctcacctctctgccctccgtgcaaactcccggactcgcccccccaccggccgggcctgtcgcctgcctgtcccacactggcttccccagccggcgccccacatttgcgcggccccttcttgcacccagaatccccacctggttgtcgccagggttcccacatcctccggtcccctgtgcctgtcatagtccttccgcctcccgcttctggtccacttcgagcgccggctcctcgacgctcgcctgggtcaccaccctcccacccgcgcccgctctaagacgcgaatctgtctttccaagtctggcttgctccaggacctccccggctagcaccgctcctcctcccctgaccttcctcctcactcccactcccggctccagtcggactagtgcggggctttagcacatgcagttcctttggcttgaatgcccttccccagcttttccccgtggacttcacaactcggtcaagggtccctttttccaggtctttcctgatatcccggacaacgcgtgtcatcccctgggtgcccacggcactccatcctcccctcaggtgacttctcgtccagggttccctgggatgcactgtcgtggcccatggccgaggctgggcctggaacggagccgcgctggctagggagccgaaggggcccacacttggcgtaggaaggttccggtagccccctcccaatgcccggcgccgccacaccactgcccagagcgtccctctcgccccctcccccagccaggccggctcctacccgggagcacggcacacgttgcggccgcgagggttcagttcctgaggcgccacggtgtccggcagcatccagagcagcagcagcagcagcagcgacggcagcagcggtgacggcggccccccggctccccggcgccgcgccggcccggccccccggggccctgcgccctccatgaggcgcggggcaggcgcggggcgggcacgggcgcgggtgcggccgcagcgagagcggccggaagcggagtgcgaggccgggcgggg

SEQ ID NO: 38474 - DNA, 90 bp, Homo sapiens
  misc_feature 1..90: note = chr22:20792481-20792571
  misc_feature 1..90: note = hyper
  source 1..90: mol_type = genomic DNA
cgcaagcccacccccgctcccagcgcctcggaaccggccaagggagtggggcccgcagacagcccaggtcgaggccgaaagccaactcca

SEQ ID NO: 38475 - DNA, 146 bp, Homo sapiens
  misc_feature 1..146: note = chr22:21311370-21311516
  misc_feature 1..146: note = hyper
  source 1..146: mol_type = genomic DNA
ctgtagcccatgtaccgcgtgacgtgagagcggagcccgggtctgcccgggcgcgggcccgcggccacggcgtttggatcccagatcccagcccccgcgctcagtccgggcttcctgaccggcgctctccgcgtcccttctcgcgc

SEQ ID NO: 38476 - DNA, 32 bp, Homo sapiens
  misc_feature 1..32: note = chr22:21319163-21319195
  misc_feature 1..32: note = hyper
  source 1..32: mol_type = genomic DNA
aaaaaagaccctgcccgcgccccagctgggca

SEQ ID NO: 38477 - DNA, 213 bp, Homo sapiens
  misc_feature 1..213: note = chr22:21319645-21319858
  misc_feature 1..213: note = hyper
  source 1..213: mol_type = genomic DNA
gccagaggcactggccggggtccgaagctcacctcgtccttctctcgtcccacaacggccccttcccggctcgccgcggggccccactgtgtgccagtcccccttctcgggctgcaaggtctggcgggggcaacgggacggagccggcgaggctgctggcatcggcttcccagagagagggaactgcacgtgcagaggcggggagagtggaca

SEQ ID NO: 38478 - DNA, 249 bp, Homo sapiens
  misc_feature 1..249: note = chr22:21333767-21334016
  misc_feature 1..249: note = hyper
  source 1..249: mol_type = genomic DNA
aggccggtaagaactcgctggcggcaaggctacgaactacctaaaaggacgtatggagcagggcctgggcggggttaggaggggatcctgtgacgtctcgttccctcccccggctcacgtgggtgccacccacctgcccggcccacaggctacggagaaggcttcgacgacgtcatcatccagggggatctggaggagctgaagtttgtggctttttacactaagtgagagcaccggggtgcagcttgg

SEQ ID NO: 38479 - DNA, 81 bp, Homo sapiens
  misc_feature 1..81: note = chr22:21368301-21368382
  misc_feature 1..81: note = hyper
  source 1..81: mol_type = genomic DNA
ctcccacaacccctgcgggagaagcccccaaggggaggagacgggcctggcccctgccccgagcaccttccgtctctaggt

SEQ ID NO: 38480 - DNA, 262 bp, Homo sapiens
  misc_feature 1..262: note = chr22:21368435-21368697
  misc_feature 1..262: note = hyper
  source 1..262: mol_type = genomic DNA
cgtccacaggccgccgtcgcctcttcctcctgctttttatcctccccagacctctggcaggaaccgctcatcgttacgcccctttcgcagcctcagaccctgaggcggagaccgcttggcgcctcacttagagcgcgacccggggatgtgggcggagtctgcggctgcgctgaccaatcgagtgtggcgtccatcgactggcgtctgccacggcaattagcgacgcgctcccccgcggcggtcgccccggcaacccagtgct

SEQ ID NO: 38481 - DNA, 30 bp, Homo sapiens
  misc_feature 1..30: note = chr22:21386579-21386609
  misc_feature 1..30: note = hyper
  source 1..30: mol_type = genomic DNA
acagacagacagtggcggctacatacaccc

SEQ ID NO: 38482 - DNA, 71 bp, Homo sapiens
  misc_feature 1..71: note = chr22:21386912-21386983
  misc_feature 1..71: note = hyper
  source 1..71: mol_type = genomic DNA
ccgcgcggccccacccgctgccacacacccagatatttcaccctgcccactctgcccgacctcgcaaggtc

SEQ ID NO: 38483 - DNA, 201 bp, Homo sapiens
  misc_feature 1..201: note = chr22:21400082-21400283
  misc_feature 1..201: note = hyper
  source 1..201: mol_type = genomic DNA
acaacaccgggttgccggggcgaccgccgcgggagagcgcgtcgctattggctgtggggggtgcctgttgctggacggcacattcggttggtcagcgcagccgcagactccgcccacaatcccgggccgcgctctgggcgcggggtcaagctgtctccgactcagtgtctgagactgcgagagggtcgtaaccatgagggg

SEQ ID NO: 38484 - DNA, 166 bp, Homo sapiens; identical to SEQ ID NO: 4902
  misc_feature 1..166: note = chr22:22862697-22862863
  misc_feature 1..166: note = hyper
  source 1..166: mol_type = genomic DNA

SEQ ID NO: 38485 - DNA, 88 bp, Homo sapiens; identical to SEQ ID NO: 4903
  misc_feature 1..88: note = chr22:22863219-22863307
  misc_feature 1..88: note = hyper
  source 1..88: mol_type = genomic DNA

SEQ ID NO: 38486 - DNA, 88 bp, Homo sapiens
  misc_feature 1..88: note = chr22:23908151-23908239
  misc_feature 1..88: note = hyper
  source 1..88: mol_type = genomic DNA
agtgactgggaagatcggtggtatcaacgcaaactacagcccggcagcttccaggcaaactcacttctcaggacgcctgtcctgctgt

SEQ ID NO: 38487 - DNA, 279 bp, Homo sapiens
  misc_feature 1..279: note = chr22:23908636-23908915
  misc_feature 1..279: note = hyper
  source 1..279: mol_type = genomic DNA
cgcccccctggtccccgccccgccgagcgtgcccggccgggtctgcagccgtcagcgccaagcgcggccccgcggctccgccgagagatcgataactaatttcaccgcggtagccgccccagtttttccccgataattgcgcgccggcagctgtgagcgaggcccccagcgcggcgcgaagcccctcccgcgccgatcaattgacaccgccaccgggcggcaggaaaactcatttttctttctctccccggctccgggtgggcgcgagctgagctctgc

SEQ ID NO: 38488 - DNA, 460 bp, Homo sapiens
  misc_feature 1..460: note = chr22:24180534-24180994
  misc_feature 1..460: note = hyper
  source 1..460: mol_type = genomic DNA
atacggtcataaggacgcccccgaagagaaacatgaagacgaagtcggccgtgcggccgcggaaggagccctcttccagcatgcggcagtagcggaacctacggcgtcggtataggaagtgccaccaggcggggcctcagtttccccgtcccggcctctctcccagcccggccggcctgccctccacccagcccgtgtccgcagggcgcaggatacacgaagagcatgttgaagaagaagctgaatcccaggggcccgaagaagaggaagttggtgacgagcctccagacctacgggggacgggcggtcaggtgcggggtgggtgggtcgggcccacaggtgcgcggcgcggggcggcctcacctggaacttccggaacacaaggtgcgggttgaagtagagttgaaaggggctgaggagctccagctgctgtggaaccaggggccagtcaagagctgcc

SEQ ID NO: 38489 - DNA, 625 bp, Homo sapiens
  misc_feature 1..625: note = chr22:24181054-24181679
  misc_feature 1..625: note = hyper
  source 1..625: mol_type = genomic DNA
cgacgtccggtccgcccggccgcttaccaccgcggcggtggtgaggacacaggctgcggtgtaagcccgcgtcaccgccggcacctgcaggaactcggccgctagtccctgccacgccattgaaccttctcaagcacgcgtggcccagccagcaacgcgctctttaacccgcctcccagccccgccttcggccaatccgcatccgaggcgctgcgcgccccaggctgaaaagagagcccctgagcccgacagccaatggaaggaagaagagggaaattaggggcggaaagggagagtgggcgggtagaggctggtggccaatgggcaggcgccaaggttgagcacgtggcggttgttgtggctgcggtggtggcgcgggagaacgtgtggccaatgaggaactggtcatttcgcggctttctaggagaggaccagtagcgtggacccacgacaccacgggggcggggctaagatcgtatgggttacaggagcgaagacccgagcaggcgaggcaaaactggaaagggcggggcgcgtgggcggggcgcggagtgtggcggctcagaccgtgctggctcactaactgacgacctagccacaacgttgtcctcgctgccagcccaag

SEQ ID NO: 38490 - DNA, 270 bp, Homo sapiens
  misc_feature 1..270: note = chr22:24551644-24551914
  misc_feature 1..270: note = hyper
  source 1..270: mol_type = genomic DNA
cacaactccagggggcgccattcacataggcaccgcctgcagaggggggatataaccctcacacacagttggccaatgccatcccggcctgccgcactcctggccacccctacaccatgctctctggggccccacagcttcctgcagtgagagctgcacccactttgcccggcagcggtccacagcccgccaccagcggccagtccagggaaccggagaggattggccggcaaaagtcagttgcgctcctgggcccgcttccagtagagt

SEQ ID NO: 38491 - DNA, 419 bp, Homo sapiens
  misc_feature 1..419: note = chr22:24552189-24552608
  misc_feature 1..419: note = hyper
  source 1..419: mol_type = genomic DNA
ggccgccccccgcctcggcgcaccaggcgcagcaggaagcccgtgggctgtggtttccccggcgcccccgcggaggaaatcggccggcggcggggtgctgcgcccccatgcccagggcgggctggcacccggttcagcgtcaggtgggcggccaagccggcttgggcggcggcgcgcgggggcggcaggcgctggtgaagcccgcacacgcgccagcgcatccagccctaccaagccccgggctgggagctggctcgtgggggcgtgcgctgcgcgaaagcgaaagccgcccgccagagcaactttgcggcggaaggcgccgacgaggagctgtgccgtgccgctcttggggatggtgagctggccgcccggccgggtgggcagcgcgtccgggcgcggtgcttcgctagctataaata

SEQ ID NO: 38492 - DNA, 220 bp, Homo sapiens
  misc_feature 1..220: note = chr22:24820224-24820444
  misc_feature 1..220: note = hyper
  source 1..220: mol_type = genomic DNA
tgtcccaaactgcaccggaaggcgcgcaggggtaggcggggagggaaggcaagtgcggcggccggcgcggcgcggggtgcggagccgcaggtagcgggcggggagcgtccgtccgtcagtccgtccgtccgtccatgcgccgcagaccggccccgcgcgctcgcatgaaccttcgcgagctcctccagcagggatggaccgggggcgcagaggcgcttcc

SEQ ID NO: 38493 - DNA, 369 bp, Homo sapiens
  misc_feature 1..369: note = chr22:25678246-25678615
  misc_feature 1..369: note = hyper
  source 1..369: mol_type = genomic DNA
cttcatcattacctgcggggacaggtgggacacatgcatttccggggtcatcccagacctcctggaggatgctgattgatgctgtcccgtttgagaactactgtgtccaggtagcagaggcctccccgatgccccttgagtagtgggcacggggcccagggcttctctggatgagctgggcgggcatgagaacgcatggagctgggggcaggaggtcggagcagcgaacgaggaggagaaggagtaggcggaggccgaaggagaggtgggggaggaagaagaggaggaggaggagtcccttgtggccaccccgaagggagggagggctaccgtagagacttggtcgagaggcgcgggacaagcctggcc

SEQ ID NO: 38494 - DNA, 253 bp, Homo sapiens; identical to SEQ ID NO: 4905
  misc_feature 1..253: note = chr22:25678616-25678869
  misc_feature 1..253: note = hyper
  source 1..253: mol_type = genomic DNA

SEQ ID NO: 38495 - DNA, 208 bp, Homo sapiens; identical to SEQ ID NO: 4906
  misc_feature 1..208: note = chr22:25679042-25679250
  misc_feature 1..208: note = hyper
  source 1..208: mol_type = genomic DNA

SEQ ID NO: 38496 - DNA, 198 bp, Homo sapiens; identical to SEQ ID NO: 4907
  misc_feature 1..198: note = chr22:25679267-25679465
  misc_feature 1..198: note = hyper
  source 1..198: mol_type = genomic DNA

SEQ ID NO: 38497 - DNA, 780 bp, Homo sapiens
  misc_feature 1..780: note = chr22:25816871-25817651
  misc_feature 1..780: note = hyper
  source 1..780: mol_type = genomic DNA
tcctttgtggccacccggaggggagagacttggttgggaggcgccaaccgagctggccgctgggactctgcacccaggtgcgccaacccttgggcgcacgctccccgcagaccctcgctgaaggagcggtgggcggcgcgccgcgaccctggcgggctacagattacaccgcttgcagggcgctgctggggcgcgcagagcggggctgccccagggtggctcccccaggttggggcgcggcgggcggcggccgcgggcgcgcgtcccatccgggtcccgagtaaccgccaccgccgctgccaaagctcgccaacatggtggacctggaggccgtggtggccgatgtcagttacctgatggccatggagaagagcaaggcgaccccggccgaccacgcctgcaagaggaccgtcctgcccgaacccacgtaccacctgccccggcccgcgccggtccccgacgccgccgccccctgcggccgccagcgaccccctgcgtccgggagaatcgggagctgagccgtcgctgtcccggagcgggtgacacagcggagcgggcgatgcggggccggcctcctggctccagtctctgaaatggggcatcggagggcgggtggggggcactccgggagagagcgctccaaagtgcctggcgccgcgccctgcgcgcagctagcaccccagcaaggggctggttatgacttggctggaccagttccatccctgtcgccccctcccccagccctgtcctctcctgtcccatccccgtggttctacctgt

SEQ ID NO: 38498 - DNA, 30 bp, Homo sapiens; identical to SEQ ID NO: 14049
  misc_feature 1..30: note = chr22:26564863-26564893
  misc_feature 1..30: note = hyper
  source 1..30: mol_type = genomic DNA

SEQ ID NO: 38499 - DNA, 177 bp, Homo sapiens; identical to SEQ ID NO: 14050
  misc_feature 1..177: note = chr22:26565184-26565361
  misc_feature 1..177: note = hyper
  source 1..177: mol_type = genomic DNA

SEQ ID NO: 38500 - DNA, 131 bp, Homo sapiens; identical to SEQ ID NO: 14051
  misc_feature 1..131: note = chr22:26565502-26565633
  misc_feature 1..131: note = hyper
  source 1..131: mol_type = genomic DNA

SEQ ID NO: 38501 - DNA, 64 bp, Homo sapiens
  misc_feature 1..64: note = chr22:26565935-26565999
  misc_feature 1..64: note = hyper
  source 1..64: mol_type = genomic DNA
ggcgcttccctgcttcggctgcgggctccctttcggtcttccccggctgcggggctgattctcc

SEQ ID NO: 38502 - DNA, 448 bp, Homo sapiens
  misc_feature 1..448: note = chr22:27053580-27054028
  misc_feature 1..448: note = hyper
  source 1..448: mol_type = genomic DNA
agccctctgcactagcgccgcaggaccgcggacccgaggtaagacgtcgccccatcctagaagccttccttcccaagtgtccttgtcccctaacggggaacagcctaattccccaaggctggggtcgagggtaggtcccagagtcccagggctgggttcagggatgcaacgccgcctgaagtgtcccgcattggatggatgaagaggctttacagcctgtaattctcaaacacagccaagactctggctgggatggggggtgaggtcaggcaaggggaggatgctttaggagtccagtgcgaatggggatcttgcaatcatgattatgagggggaacaaagaccctttccttccgacgacacaagacacaatttgggaggtggacccgcggaccttctcggtccaccaggttagcaattaactggccaagccacgggcagagccagag

SEQ ID NO: 38503 - DNA, 66 bp, Homo sapiens
  misc_feature 1..66: note = chr22:27069172-27069238
  misc_feature 1..66: note = hyper
  source 1..66: mol_type = genomic DNA
ggctctctgttcccacggacgtcactgcctcagccagcctcccccagagcccgccagccgctaagc

SEQ ID NO: 38504 - DNA, 30 bp, Homo sapiens
  misc_feature 1..30: note = chr22:27695238-27695268
  misc_feature 1..30: note = hyper
  source 1..30: mol_type = genomic DNA
tcagatgcgcgccctcggtccaccccctct

SEQ ID NO: 38505 - DNA, 30 bp, Homo sapiens
  misc_feature 1..30: note = chr22:28196522-28196552
  misc_feature 1..30: note = hyper
  source 1..30: mol_type = genomic DNA
cccaaacatacttggcggggggcagagggg

SEQ ID NO: 38506 - DNA, 37 bp, Homo sapiens
  misc_feature 1..37: note = chr22:28196966-28197003
  misc_feature 1..37: note = hyper
  source 1..37: mol_type = genomic DNA
ccgcccgcagcctcccggagtccgtggcagagctgct

SEQ ID NO: 38507 - DNA, 278 bp, Homo sapiens
  misc_feature 1..278: note = chr22:28197276-28197554
  misc_feature 1..278: note = hyper
  source 1..278: mol_type = genomic DNA
agggtcggggaaaggcgcggctcctctgctcggcagcgggtgcgctgcgttcggcgcgcagcttcgcggccacgtccgccgcctgccgcttctgttctccgccgttgggtgtctgagttcgccggagtctccgcgcaccgttgcaggcgcgggagggcagcgagacgaggggttgggtcgctccaaggctccggttccctgcctccgcgctgaggtgcttcgcgagtccctctcggacctgagggaggggggcgtacgcgggtcggggggccacgccg

SEQ ID NO: 38508 - DNA, 346 bp, Homo sapiens
  misc_feature 1..346: note = chr22:28198055-28198401
  misc_feature 1..346: note = hyper
  source 1..346: mol_type = genomic DNA
cacccccaactggagcgagacccaccgggtgggcagggggcggggaggtgggcggtgagcggtacggggcgctcagacaatgaggtcgccaggcaaagaccctagactcgccacggaaagtcgctaagtgtctactgcacttcggctccggggtgaacactccgttctccgctagcggcgcccaagttagccggccctgggattttcttggagggtaaagcagacggggaacctcgaagttagggttctcctcgagagacctgggcgcttgctcactcctccgtcactagggcgttcacaattgttccccttccccactgcctggggttcccggttctcaccggcc

SEQ ID NO: 38509 - DNA, 260 bp, Homo sapiens
  misc_feature 1..260: note = chr22:28838179-28838439
  misc_feature 1..260: note = hyper
  source 1..260: mol_type = genomic DNA
ccttttccccatgatcgattcacacacgctggtgcacgctgacacgcacagacacacgcccgtgcacaatggccagcgcaggcaatcgcacgggcccacgaggcctcaggagccccgcaggctgaaggcccggctatggccagccccaggcgctcaggcaggaggcctctcggcccgccgccccggaaccagctgctgggctggtgtgctggggctgctcgccccccagcggggccctggggaaacggctgccagcggct

SEQ ID NO: 38510 - DNA, 50 bp, Homo sapiens
  misc_feature 1..50: note = chr22:28838794-28838844
  misc_feature 1..50: note = hyper
  source 1..50: mol_type = genomic DNA
agacctgaaggtaaccgccccgtgttacccttccccgggttgggctttgg

SEQ ID NO: 38511 - DNA, 813 bp, Homo sapiens
  misc_feature 1..813: note = chr22:29075406-29076219
  misc_feature 1..813: note = hyper
  source 1..813: mol_type = genomic DNA
atccacacacactctcgcggaaactgagccaggcaggcggcggaccaggtcccgccgcctcacggctcgcggctgggatcgaacccggactgcgagacgccttccgcctcgcaggcgctcctctgccgctgaggcccggcccggctcccaccgccggagtttcacaaagaaagtctcccggcccgagcccctcacgcactcaccggcgccgacgccggcggcgactctggctcccgccgccttcggctccttgcgggggtcggcccttgggtcggctcgggcgccggcggcggcgactgctccatccccacggggcccgggccgcgtccgcctcgagctaacggtcccgccagctaggcgcgcgcgccggttccgcgcgccatgttcccgccgtgctgcgcgccgccgcggcgcccctcactgcccccaaaccgcgcgcgcgcccccgcgggcccacacatgcaccgcgcacgcgcgcgttcgccgcgccccctccccgcgcgccccgcctcgcgccctctggagctggccgctgttcccagtgtctcgcccacccccgccgggcccgtcggactcggcgggtgagcgcgcggttcccggctccgcaccgccgcctgcctctctgcagaccaccccggacccgacccctcggccatttccccacactgccgctttcgcttcccccacgacgcggggcctgggacgacggtctgggccaagaggaacttccccgcaagaagtgtcgagttaaggacgctactaagggggcgggatcgccatcgtggaggtgtgcaagcacgtgcctgcgtcccg

SEQ ID NO: 38512 - DNA, 64 bp, Homo sapiens
  misc_feature 1..64: note = chr22:29426589-29426653
  misc_feature 1..64: note = hyper
  source 1..64: mol_type = genomic DNA
cccggtggggaggggcgcggccggtggcgaggagggcactttcccgggtcggagaaggccggat

SEQ ID NO: 38513 - DNA, 30 bp, Homo sapiens
  misc_feature 1..30: note = chr22:29709206-29709236
  misc_feature 1..30: note = hyper
  source 1..30: mol_type = genomic DNA
gaagttgggcgatcccgtccaatccaggtc

SEQ ID NO: 38514 - DNA, 71 bp, Homo sapiens
  misc_feature 1..71: note = chr22:29875904-29875975
  misc_feature 1..71: note = hyper
  source 1..71: mol_type = genomic DNA
tcccctttcttattccgaacacactcgcaggctcttccgacgcgcacccgggggtcctcactggcccactc

SEQ ID NO: 38515 - DNA, 109 bp, Homo sapiens
  misc_feature 1..109: note = chr22:29876004-29876113
  misc_feature 1..109: note = hyper
  source 1..109: mol_type = genomic DNA
cgagggtctcctctgacgcagcgtcgattccccttccctcctcggtcccctgccccgcccctctcactgcggcggagccggtcggccggggggccgcaggggaggaggc

SEQ ID NO: 38516 - DNA, 669 bp, Homo sapiens
  misc_feature 1..669: note = chr22:29876916-29877585
  misc_feature 1..669: note = hyper
  source 1..669: mol_type = genomic DNA
gctgcaggaggagtgcggctacctgcggcgccaccaccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgaggtacgcaggcgcgcgggtggggggaggggcgcccctgctgaccccgcagcgaacttttgggctgcgtgacccaagggggcgctgccggactgcgcgtggagtggcgcgctgctcaccttccctctgcaaagtgcatgcccctagttaaatcgcagttttactctgggtctcttgtgggacgccccaactctgggttgtccttcggttccccctttccaggttctttacggctgtacttcaactctgggccccctgctgctctctaccccaagcttaggcgaccccactctgagatccctcccccgtcaagaaaaaaacaagtttcctctacaggaaaaaagtggtgcaggattctggtctgcaagcgctggagactcttagcccttctaagtagcaaggcttccccgccaatgctgccatgccctctcctacaccccgcaagaaactctat

SEQ ID NO: 38517 - DNA, 461 bp, Homo sapiens
  misc_feature 1..461: note = chr22:30115986-30116447
  misc_feature 1..461: note = hyper
  source 1..461: mol_type = genomic DNA
gcggcacagaacgagcgagcgagcgagcggagaggcggctacagcctgagcgccgggccggtagcggccgcgccggcgagcggactagcgggcggcgagcagcgcggagcgcgcggggcaccgaggagcgggcgcggcgggcaccgcgcgaggcagccggagctctcggaaaggccagagcggcgccgcccccgctgcccctgcggggccccggctgggagcccgacgagggagcgggcggcatggcccggcggcccggggcgcgggggcgctaggcccccggaggggcgtccccagcctcgccgctgccgccgccgccctccgcagccgcgcgccccgcccgctccagccgcccccggggccgccaccggcccatgagccccggcctcaaagtttgcggcgggcgggcgggcgcggagcctccaagatgccgttccacccggtgacggcggcgttgatgt

SEQ ID NO: 38518 - DNA, 412 bp, Homo sapiens
  misc_feature 1..412: note = chr22:30116727-30117139
  misc_feature 1..412: note = hyper
  source 1..412: mol_type = genomic DNA
ggcccagcccctgcccgcgtggtccccagcgctgcggaaacttgccgggccccgcagcggggtcacggggccgcgcagtcggcggtgacggtgcggcaacgcggcggactggggcgggggtccgcgctgagcccccagcgccggcccggccggagcacccgcatcctgatcccctccgcggcgcccgcccgcggctctctgctcgcattgacattccgctcgtgtcgctttaaaaattcaatctgctcgggcagcagcagaaggggagagggcgactgccctgctcttgcccgctgcggggccgcccccgtccccacctgcggccgtagccccttccctgcagccctgcggggacccccagcccggcgcgccgggaaggcggcccgggaggcggtggcgacaacaagtggcc

SEQ ID NO: 38519 - DNA, 462 bp, Homo sapiens
  misc_feature 1..462: note = chr22:30938045-30938507
  misc_feature 1..462: note = hyper
  source 1..462: mol_type = genomic DNA
gtgggcggggacgcccggctcagaccccgtccccagcctggacctgggccccaccctgcccacaccgcgaccctccccatccgtctcgcgaccctaccagaaagtccactccagcttttccttcacctcggcacggctctgaaaggatcggtcccctccggcccgcacccacccccaagaggggccttcagctttggggctcagaggcacgacctcttggggagggttaaaaggcagacacccccccacccccgcgcctccactccccgactccttcgccgcctccagcctctcgccagtgggaagcgggagtagccgcgcggccggagtccggaggcgaggggaggtcggccgcaacttccccaggccaccttaagaggacgatgtagccagctcgcagcgctgacctcagaaaaacaagtttgcgcaaagtggagcggggacccggcctctgggcagccc

SEQ ID NO: 38520 - DNA, 116 bp, Homo sapiens
  misc_feature 1..116: note = chr22:30938542-30938658
  misc_feature 1..116: note = hyper
  source 1..116: mol_type = genomic DNA
cggcgtagccgcggcccatggagcccgcgggccggtccccggccgcctcgggccgctgctctgcctgctgctccccgcgtcctgcgcctggtcaggagtggcgggtgaggaggagc

SEQ ID NO: 38521 - DNA, 30 bp, Homo sapiens
  misc_feature 1..30: note = chr22:31003156-31003186
  misc_feature 1..30: note = hyper
  source 1..30: mol_type = genomic DNA
ctctgcagacttagccgtgcattgcaggca

SEQ ID NO: 38522 - DNA, 102 bp, Homo sapiens
  misc_feature 1..102: note = chr22:31198526-31198628
  misc_feature 1..102: note = hyper
  source 1..102: mol_type = genomic DNA
cccttagtgtcgtgtcgggttccaggccacgctcgggcattttaagaggctgaggtgcgccttccgctgcccgcctgcgtcccgccacggagagctcgcctt

SEQ ID NO: 38523 - DNA, 550 bp, Homo sapiens
  misc_feature 1..550: note = chr22:31218396-31218946
  misc_feature 1..550: note = hyper
  source 1..550: mol_type = genomic DNA
cgctcaggctgggctcggctcccgcggcgcggacggggttaacgcgctcatgtaccgggtggcgggcggcagtggtgcattgtggtaacgcggcgccgggacccacgagtgtccgccgcctccgccgggcggcccaccgagctgtgcacgcgtccgtgcaagcccccgggacccggcgccatgtagcgccccgccgattggaggctgccccgccgcgggaaatgaagggacgcggctgctgggacacggcctccgtgcgctccttctgcagctccggctgcctgaataaatttaagaagggttagtgcttgccgggcttccacccggagggaggccaggctccccgcgcatgcacgcccggtgcctggctttgctgcgtgatcgatccacgggagcctctgatgtcactccctcgcggcgtggggagcgcggggagcctcggggaacccctgtccccgcaccccgccggcgtgcgctcccggcttgcttcacgcgcggggcattttggagagggggctgcggctagagacttgtccgtctaattaaccta

SEQ ID NO: 38524 - DNA, 855 bp, Homo sapiens
  misc_feature 1..855: note = chr22:31480651-31481506
  misc_feature 1..855: note = hyper
  source 1..855: mol_type = genomic DNA
tcagggttcttcagccgccacctccctctcttaagcgaggctcgggcggcgctggaaaagagttttggagagaagctggagcagtggttgaatctctgggaaaggacagatgagaacctgccccggtctcgggatcggtgcctctcgaagtctttccgaccccgggagcggctcctccagcacccggcgcccgccattactgcgccccgcgcgccggcccggcccccgctggcctcgtggcaagaacgggggcgtcccgagccgggctcctccccgcggggccgggccatataaggaaaagctaggcccgctccgcccgccctgcgccccagcgtctggccgatttggggacgcgggcagtcgcttccggccccggctcccgcacattcttgaggattgggccggggatgggaggaatggggacgcctggggacttgcacgccgcgtgcccctccaccacccgccgggacgccctctgcctcggtcccgagttcgagttcgacctccgccactcagctgggtgtcctggggaccttggtttcttccctttagatccggacactgaagcaggcggtagcgggtgtcttcctacctggctaccccttcggcgcctagcgcgaggcagggtgggcgaggcgagggcggcgccctgcgagggagggcggtcgcagaacctgcgggccttcagcgccccctggcgaggcttccctccaccgccggcgggacccccatgggcaaccgggggagctgggactgaaagcctggagagccccctccgttgtgctgttggggagactgaggcccagtgagacctcagggcctgccaggcgttcccaacagcgagggcagagagta

SEQ ID NO: 38525 - DNA, 378 bp, Homo sapiens
  misc_feature 1..378: note = chr22:32571939-32572317
  misc_feature 1..378: note = hyper
  source 1..378: mol_type = genomic DNA
cggggactagccctgcgcgcccggggagggggaggcgctggcgctgtgacggccgcggggagggccaccttcccagcacacgcacacatacgcccccggccctcagccgctccggctgccgctgcccgccgacagctgacctccaggcaccgcagcgcccgggaacagccatctgggaaccgcgaccgcgcactgacacacgcagtggccgccgccgccgccgctccgccaagcgctgcctgtagcacctgcacggtggtttggaggggaaggtctgggcaggcgaacgttccacgagggcgtcccagaggcatctgcagcctccgctctcctgttctgctctggcgcccaccagcccctgaccgagtccagagggtc

SEQ ID NO: 38526 - DNA, 97 bp, Homo sapiens
  misc_feature 1..97: note = chr22:33197642-33197739
  misc_feature 1..97: note = hyper
  source 1..97: mol_type = genomic DNA
tccccgggggcccagcgctatatcactcggccgcccaggcagcggcgcagagcgggcagcaggcaggcggcgggcgctcagacggcttctcctcctc

SEQ ID NO: 38527 - DNA, 331 bp, Homo sapiens
  misc_feature 1..331: note = chr22:33197949-33198280
  misc_feature 1..331: note = hyper
  source 1..331: mol_type = genomic DNA
ggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcggtaagcgctcctggtgccccgcccgagccccacgctgcagccaggactgcagcgctgcttagggaggcagggcgagccccactcctttcctctgccccaggagaggggcagacggggttggggcggagtggagaaactcgatgtccttgggcgggggcgctggcatagctga

SEQ ID NO: 38528 - DNA, 198 bp, Homo sapiens; identical to SEQ ID NO: 1521
  misc_feature 1..198: note = chr22:33453877-33454075
  misc_feature 1..198: note = hyper
  source 1..198: mol_type = genomic DNA

SEQ ID NO: 38529 - DNA, 66 bp, Homo sapiens; identical to SEQ ID NO: 1522
  misc_feature 1..66: note = chr22:33454193-33454259
  misc_feature 1..66: note = hyper
  source 1..66: mol_type = genomic DNA

SEQ ID NO: 38530 - DNA, 146 bp, Homo sapiens
  misc_feature 1..146: note = chr22:33454345-33454491
  misc_feature 1..146: note = hyper
  source 1..146: mol_type = genomic DNA
gggtcccgggagctcagcctctgcccctcaacgcgcgcgagcgcccccgcccggcggcccggcctccccgcgccgcggcgccccattggctcgggcaacgaggcccccggacggccccgcccacccgcgcccactccctcgcccac

SEQ ID NO: 38531 - DNA, 13 bp, Homo sapiens
  misc_feature 1..13: note = chr22:33454492-33454505
  misc_feature 1..13: note = hyper
  source 1..13: mol_type = genomic DNA
cctctccccaacg

SEQ ID NO: 38532 - DNA, 30 bp, Homo sapiens; identical to SEQ ID NO: 14075
  misc_feature 1..30: note = chr22:35420285-35420315
  misc_feature 1..30: note = hyper
  source 1..30: mol_type = genomic DNA

SEQ ID NO: 38533 - DNA, 30 bp, Homo sapiens; identical to SEQ ID NO: 14076
  misc_feature 1..30: note = chr22:36553195-36553225
  misc_feature 1..30: note = hyper
  source 1..30: mol_type = genomic DNA

SEQ ID NO: 38534 - DNA, 30 bp, Homo sapiens
  misc_feature 1..30: note = chr22:36726916-36726946
  misc_feature 1..30: note = hyper
  source 1..30: mol_type = genomic DNA
tctagccgtggtaggcgcctgaacccactg

SEQ ID NO: 38535 - DNA, 589 bp, Homo sapiens
  misc_feature 1..589: note = chr22:37099177-37099766
  misc_feature 1..589: note = hyper
  source 1..589: mol_type = genomic DNA
gggtctcggcgctttcgtttcagaccagacttcccagtattctgtaagcccttgagctcagctgcacaggtgcgggggtctcgctttccatggttttgcccgggcagcggcggcggcggcggcggcggcggcagggcgggcaggcgcggcggcggcggcggcagcaggacgagcagcggcggcggttattgttgttggtggcgggggtagtgttggcgaagtgggggagagagggggtttctcctggagaatcgaggcggatttccctccccctatctgcaaagctcctggaaacgagggagccggcgtcttgctgcagggtgggccgcgcgcctgccccccactcgctaccggctgggcgcccgcggaggcgctcccacctactgcattacgggtggtgctgaaccggacagctccctgcgccgcccgctccgcgcgctccccggctggctcccagggccgcccgccaggaggggggcgctggccagagtcctccctccccggggcagcaaggccagcgcagagcgggggccgcctttcctctttttacccctctcccaaatcctaaaatgagcgctctcctgggctc

SEQ ID NO: 38536 - DNA, 57 bp, Homo sapiens
  misc_feature 1..57: note = chr22:37212414-37212471
  misc_feature 1..57: note = hyper
  source 1..57: mol_type = genomic DNA
gcactgaggatgccccgtgcgggcttaggcagagctgtgcgccggctccagaaggtc

SEQ ID NO: 38537 - DNA, 92 bp, Homo sapiens
  misc_feature 1..92: note = chr22:37212682-37212774
  misc_feature 1..92: note = hyper
  source 1..92: mol_type = genomic DNA
tccgaccctggtcttcgcccttggtcccggaccctgagtcctcccagccaccgggccttcagcaccctcaagtttctgtaacttaggcgggg

SEQ ID NO: 38538 - DNA, 93 bp, Homo sapiens
  misc_feature 1..93: note = chr22:37212813-37212906
  misc_feature 1..93: note = hyper
  source 1..93: mol_type = genomic DNA
cggacagagtttgggaactgccaaggacgcccccgccccgacctcgccggcgcccagcgggaagtgtgggcagaagcgcgctggggaggatcc

SEQ ID NO: 38539 - DNA, 117 bp, Homo sapiens
  misc_feature 1..117: note = chr22:37213161-37213278
  misc_feature 1..117: note = hyper
  source 1..117: mol_type = genomic DNA
ccgggcctggcatggcgccaggggcccggactctgagcgcagcgggagcggctcagtccagccgcgccgctgagcagcgccggccgccggcaagaaggcgcgcggacctgctaccac

SEQ ID NO: 38540 - DNA, 209 bp, Homo sapiens
  misc_feature 1..209: note = chr22:37730661-37730870
  misc_feature 1..209: note = hyper
  source 1..209: mol_type = genomic DNA
gacgcggaggctgcccgcggcggccccgcctgggcgctccgggctggcccggacctgcggcgtcggcccaggagcatctggaaagggggcgcgggcggggatcggtaggaccgcctatgctcagggactgtcacccaccccctcccccaagccaaggagtagcggggaaggggggcgagtgcacccaggtattggggggagcatcaaat

SEQ ID NO: 38541 - DNA, 325 bp, Homo sapiens
  misc_feature 1..325: note = chr22:37730926-37731251
  misc_feature 1..325: note = hyper
  source 1..325: mol_type = genomic DNA
cgagtcacccccgccccacccccacacactatgcacccatttcacagatggcaggtcctagctcagagggttagggcaggcccagaaccgcatcgccatcgcccgttcgcaggcctgattgagaggctggaaacgaggatgggcagggagtgaggacctgtaggctctgccggagaacttgggcgtgggcggagcggggcatccaggaagaagcccccaccccagccttggatagggtagtatacgatagggggcgtaaagaagggtcatgggctccggtggtcgcaggtcccaccggcaaccgccagggcgggggcagcaggag

SEQ ID NO: 38542 - DNA, 87 bp, Homo sapiens
  misc_feature 1..87: note = chr22:37816102-37816189
  misc_feature 1..87: note = hyper
  source 1..87: mol_type = genomic DNA
agttccggaggctggcggggtgggccgcgggggacgggggcctcgaagagccgcggacggcggaggacggtgcggaggtggggagcg

SEQ ID NO: 38543 - DNA, 367 bp, Homo sapiens
  misc_feature 1..367: note = chr22:38220642-38221009
  misc_feature 1..367: note = hyper
  source 1..367: mol_type = genomic DNA
ctgggccgcagggcccgggcgcgggacgtggcgcgggcccctgcgggagggcacctgcccgccccgctgaccaggcgccctccgcaggtacctggccgtgcggcacccgctgcgctcgcgcgccctgcgcacgccgcgtaacgcccgcgccgcagtggggctggtgtggctgctggcggcgctcttctcggcgccctacctcagctactacggcaccgtgcgctacggcgcgctggagctctgcgtgcccgcctgggaggacgcgcgccgccgcgccctggacgtggccaccttcgctgccggctacctgctgcccgtggctgtggtgagcctggcctacgggcgcacgctgcgcttcctgtgggcc

SEQ ID NO: 38544 - DNA, 60 bp, Homo sapiens; identical to SEQ ID NO: 14080
  misc_feature 1..60: note = chr22:38221288-38221348
  misc_feature 1..60: note = hyper
  source 1..60: mol_type = genomic DNA

SEQ ID NO: 38545 - DNA, 175 bp, Homo sapiens
  misc_feature 1..175: note = chr22:38476957-38477132
  misc_feature 1..175: note = hyper
  source 1..175: mol_type = genomic DNA
gcgcgcccaccatgccgtaggagaggccgaaggcgacgcagaaggcgacgagggcgccgtaggagcgcgcgcgtgcgctgctcaggtctgtgagcccattggccagcagggccaggctgaacagatacgggacgtgcggccgcagacgcgccaggcccgccagggcgccgcacgc

SEQ ID NO: 38546 - DNA, 510 bp, Homo sapiens
  misc_feature 1..510: note = chr22:38477296-38477806
  misc_feature 1..510: note = hyper
  source 1..510: mol_type = genomic DNA
cggtgcacactgccaagtccagcaggcgccggcggggccggaccctgggggatgcctcgcgcagctgcagccccgcaccgtcagcctccgcctcgcccggagcgtccccggcgcggtcgccggcgctgtccctgcgcggtcgcgggcccggcccgggcggcggcctcatgacagccccgcaggcgcagcagtgcagcaggagcccgccgagcagcaggaagccgccgcgccagccgaagcgctccagcagctgctggccgagcggcgacagcgcggacaggaacacggggctgcccgccgccgccagcccgttggccagaggccgccgccgctcgaagtacagccccagcatgatgagcgacggctggaagttgagggccaggcccaggcctgcgggcgaggcggtgctgtgccggggtccccggagagcccctccctggcccccacaggagggaggggccaggcccgggaacccagcagatccgggaacccagccgagggacttcgaag

SEQ ID NO: 38547 - DNA, 35 bp, Homo sapiens
  misc_feature 1..35: note = chr22:38478441-38478476
  misc_feature 1..35: note = hyper
  source 1..35: mol_type = genomic DNA
ggggccctctgagctcgcagggcagccccctgggc

SEQ ID NO: 38548 - DNA, 288 bp, Homo sapiens
  misc_feature 1..288: note = chr22:38850818-38851106
  misc_feature 1..288: note = hyper
  source 1..288: mol_type = genomic DNA
gctcccggggagtcacgggaccgcgcgcgcggcgccgggcagccgggacccggctccggatcaggtgcggagcgggcggggccggagcggcgggcccgggacacacagacacgcacgcggcgggacaaactgacggacagcgcccggggtgggcgagcgcggcttaccgctgggcggagggtccgacgagagtccgggaggcggcgagcgggcgctacatcccaaggcgcgatccggcgggcggcgtcccgggcgcggaaaggggagtcccggcgccccctgcccgcg

SEQ ID NO: 38549 - DNA, 100 bp, Homo sapiens
  misc_feature 1..100: note = chr22:38965918-38966018
  misc_feature 1..100: note = hyper
  source 1..100: mol_type = genomic DNA
aaggtcggagcggaacgctcaaagtcactagcccagggaccccaaaaaaggagcgagaaagggaagcgcgccttctcaaaacgagcgtcccctcagagtc

SEQ ID NO: 38550 - DNA, 158 bp, Homo sapiens
  misc_feature 1..158: note = chr22:39473204-39473362
  misc_feature 1..158: note = hyper
  source 1..158: mol_type = genomic DNA
ggcctcctacaccagcgcctgagcaggaagcgggaggggccatgactacgaggccctgggaggtcactttagggagggctgtcctaaaaccagaagcttggagcagaaagtgaaaccctggtgctccagacaaagatcttagtcgggactagccggcc

SEQ ID NO: 38551 - DNA, 157 bp, Homo sapiens
  misc_feature 1..157: note = chr22:39784321-39784478
  misc_feature 1..157: note = hyper
  source 1..157: mol_type = genomic DNA
ggaggagcaagtgggcgtggcctgggcatggcccgtcggtcaaggtactggccctgcccacgcccgggagaggggcgggcgagagagatgctaagccaatcggattgcggtcatcgggggcgagcggagtctgcaagaggtccgaggagtagcgggt

SEQ ID NO: 38552 - DNA, 66 bp, Homo sapiens
  misc_feature 1..66: note = chr22:39853091-39853157
  misc_feature 1..66: note = hyper
  source 1..66: mol_type = genomic DNA
gtctgcggtgcgaggcgcccccggcccggcgcggcggcggagcccggctggcgggggaggggaggg

SEQ ID NO: 38553 - DNA, 197 bp, Homo sapiens
  misc_feature 1..197: note = chr22:39853393-39853590
  misc_feature 1..197: note = hyper
  source 1..197: mol_type = genomic DNA
gggccgcgctgcctgcgatgccgggcgcccgccgcagccgctgccgccggagcccgggatggggcgagaggctgcggcggacgccagcatctccccgccggggaccccgggggccgcggagccgccgccgccgctgctgccgccgttgctgagacccagcgggcgatgggtgagttgaccccggcgtcctggggggc

SEQ ID NO: 38554 - skipped

SEQ ID NO: 38555 - DNA, 134 bp, Homo sapiens
  misc_feature 1..134: note = chr22:39854212-39854346
  misc_feature 1..134: note = hyper
  source 1..134: mol_type = genomic DNA
agtgagttctggaaccgggagtggggaggggagtgcgcctgggtgtgtgtatggtggggttcctgagctggggtgcagcaggaagggatgccgcgcggccagacctagtggtctgaggtcggatgacccccagc

SEQ ID NO: 38556 - DNA, 30 bp, Homo sapiens; identical to SEQ ID NO: 14086
  misc_feature 1..30: note = chr22:39942115-39942145
  misc_feature 1..30: note = hyper
  source 1..30: mol_type = genomic DNA

SEQ ID NO: 38557 - DNA, 303 bp, Homo sapiens
  misc_feature 1..303: note = chr22:39953480-39953783
  misc_feature 1..303: note = hyper
  source 1..303: mol_type = genomic DNA
gcctcccccctccagcgtcccgcgcctgcagctttccccgaagacatttggtgtcagtataaggacggcttttcctcgcacgcagcgcggctcggtctcgccgccgccgcacgtccccgcaccgccaggcgctcgggctcctccgcagcccccgccgcgcgcagaccccgcgcttcgagccctgagccggaggcgcgagcagagccgaggcaggcgagagaccggcctcagccccgcgctccccgccgcgctggtctctcccgggcacttgccccgctgctcggtccccgcagcacccgcgcc

SEQ ID NO: 38558 - DNA, 137 bp, Homo sapiens; identical to SEQ ID NO: 14087
  misc_feature 1..137: note = chr22:39954439-39954576
  misc_feature 1..137: note = hyper
  source 1..137: mol_type = genomic DNA

SEQ ID NO: 38559 - DNA, 30 bp, Homo sapiens
  misc_feature 1..30: note = chr22:40060586-40060616
  misc_feature 1..30: note = hyper
  source 1..30: mol_type = genomic DNA
ccctccccttcccttcggccccgccacttg

SEQ ID NO: 38560 - DNA, 211 bp, Homo sapiens
  misc_feature 1..211: note = chr22:40081794-40082005
  misc_feature 1..211: note = hyper
  source 1..211: mol_type = genomic DNA
cagccccagcagctccgcgggcagcctgcagaccacgctcgaggacagcctgaccctgagcgacagcccccggcgtgccctggggccgcccgcgcctgctccaggaccccgggccggcctgtcccccgccgctcgccgccgcctgagcctgcgcggccggggcctcttcagcctgcgggggctgcgggcgcatcagcgcagccacagcagc

SEQ ID NO: 38561 - DNA, 349 bp, Homo sapiens
  misc_feature 1..349: note = chr22:42306171-42306520
  misc_feature 1..349: note = hyper
  source 1..349: mol_type = genomic DNA
agagtgacgccgcgccgagcacccaagctcaggactggacaaggggtcccggccggggactgggacggggaccgggccggggcgggccgggggcggggcccgctggggcgagggagccgattggccgagcggcgggcgcgcggaactgggaatttggcgcttggagctgcggccccgcgcttcgcagtccgggagctcgtgcgcccaggtgccctgacgctgcccgcacccgccactcacctgcggccttgagcgcggcggccttgaacgtggcgtacttggcgtagtctggctgcagcgtcaggctgccgccgccctgcagccgcgggccgcgcgggggccccggggc

SEQ ID NO: 38562 - DNA, 142 bp, Homo sapiens
  misc_feature 1..142: note = chr22:42307095-42307237
  misc_feature 1..142: note = hyper
  source 1..142: mol_type = genomic DNA
cgcagaggccgcggctcatttccaccggggaagcctctatgccccagccgagggaccgcctctcggcctctcacgcccctccgcgtgctccgccgccgctcagccccgcccgccaccgactcacctgcgctgttgtgggggg

SEQ ID NO: 38563 - DNA, 706 bp, Homo sapiens
  misc_feature 1..706: note = chr22:42310042-42310748
  misc_feature 1..706: note = hyper
  source 1..706: mol_type = genomic DNA
tgctgggagaaccagcgcttcgagagcggcgggaaggatcagcgggcagggagagcagtccgaggagcaggcgggggtccctgggcggcgcgtgctcacctggtcactgtgcgccgcgcgcgcgggctgtgcgccctctccagtcccaggcgcgccccgatgccggccagcaccagcagcgctgcgacgccgcacacagcgtagacggccgtatggctgcgctcgcggccggggtcccggggcgctgcggtgtcgcgggcgcgggcgggcggccggcctgtctggacccaggccggcgtgtcgtagttggaacagcggctctggtcgaggcgccgcggcccgtcgtggcagcagaagcggtagccgcacgtgccgcagcagaagctgtaggctccggagctgcagttgaagggcgggtcccactggcccatcacgtcgtagtagccgcggcagcggtcgcccccctccggggctgtcgtgccgggcgccgcgggaccctgcgcctcgggggctcccgcgcggcccgacggcggccgcgccagcagcaacgcgagccgaagcgcgagcgcgagccggaggccgggaggacggcggccgccgagcagtccccgcgccccggcccgcgccatcgggcccgcgcctcccgctactgcgcccggtgcatggccgggcgccgcggctccctccggctcggctcctccgctcc

SEQ ID NO: 38564 - DNA, 231 bp, Homo sapiens
  misc_feature 1..231: note = chr22:42311356-42311587
  misc_feature 1..231: note = hyper
  source 1..231: mol_type = genomic DNA
cctgtaccttacaggcgcggaggtcaaagcagcccggaattgccccgggacgggcagggccaccctctcacctccttcccgtcccctctgtccgttctgatcataacataaggagggccccttcccctctcggcgcctcgattttcccacctgtcaaatgggaaggacttcccctggcagcgccgcttcagagggccaaggatttaccccacggcgcgagcccagttccag

SEQ ID NO: 38565 - DNA, 65 bp, Homo sapiens
  misc_feature 1..65: note = chr22:42315616-42315681
  misc_feature 1..65: note = hyper
  source 1..65: mol_type = genomic DNA
aaagccctcagtgtacgtgcgaatccggagcggacaccgagaccttagcgcgggaaccaagagag

SEQ ID NO: 38566 - DNA, 451 bp, Homo sapiens
  misc_feature 1..451: note = chr22:42353573-42354024
  misc_feature 1..451: note = hyper
  source 1..451: mol_type = genomic DNA
gtgatgcttgggcctcgggctctgtgaagcctgaaggtctccctctgggtgggcgggacagggagcacctctgctggccctcaccacgctgtgtctccgcagccaaggccgccgcgatgccgcacttcctggactggttcgtgccggtctacttggtcatctcggtcctcattctggtgggcttcggcgcctgcatctactacttcgagccgggcctgcaggaggcgcacaagtggcgcatgcagcgccccctggtggaccgcgacctccgcaagacgctaatggtgcgcgacaacctggccttcggcggcccggaggtctgagccgacttgcaaaggggataggcgggcggcaccgggcgccctcccccagcccgccccgcccgcccagcccggagacccccaaggcagagggaggccggcctgttggccctccacgctatccctctgca

SEQ ID NO: 38567 - DNA, 75 bp, Homo sapiens; identical to SEQ ID NO: 14093
  misc_feature 1..75: note = chr22:42679405-42679480
  misc_feature 1..75: note = hyper
  source 1..75: mol_type = genomic DNA

SEQ ID NO: 38568 - DNA, 268 bp, Homo sapiens
  misc_feature 1..268: note = chr22:42679916-42680184
  misc_feature 1..268: note = hyper
  source 1..268: mol_type = genomic DNA
cgaggcgggggaggaggggaaagggaaaaaaggagaaggaaaaggaaaggggggcagtttctcggctctcagcctcctcgcggctcctcctgcccaagccggcaagtgaagtcacagggccggggcggtgacatcagctgagcctctgacatcacggcccctgccgatctcacctctgcagggtggagatggaggagcagcggggaggagggatggatggatggaggagggaggggagcacccgatcccccctcgccttcaactgcgg

SEQ ID NO: 38569 - DNA, 59 bp, Homo sapiens
  misc_feature 1..59: note = chr22:42696044-42696103
  misc_feature 1..59: note = hyper
  source 1..59: mol_type = genomic DNA
cagcctggttcctttcgttccttcgttccttcgctggtagaagccgctgggcctggggc

SEQ ID NO: 38570 - DNA, 163 bp, Homo sapiens
  misc_feature 1..163: note = chr22:42896542-42896705
  misc_feature 1..163: note = hyper
  source 1..163: mol_type = genomic DNA
gtggcctgactggggcggggcggggcggggcggaacagcctagaagcagggcctggaactgcaggatacactcccctcctgctacctaggcaggcgtgagggtgtgacggccgcgcattcgccagacgagagcgatggctgagaacgccgcaccaggtcgcct

SEQ ID NO: 38571 - DNA, 63 bp, Homo sapiens
  misc_feature 1..63: note = chr22:43116061-43116124
  misc_feature 1..63: note = hyper
  source 1..63: mol_type = genomic DNA
tgggaccaggtgccccggcagatcctctcccaagcccagttccgctcccgctcagtcctcaac

SEQ ID NO: 38572 - DNA, 85 bp, Homo sapiens
  misc_feature 1..85: note = chr22:43738565-43738650
  misc_feature 1..85: note = hyper
  source 1..85: mol_type = genomic DNA
tctctcccttatcatcggtgggaccatccctcttgattccccctgatccaccggcctcctcctccttccccgggcggtgcgggcc

SEQ ID NO: 38573 - DNA, 500 bp, Homo sapiens
  misc_feature 1..500: note = chr22:43739010-43739510
  misc_feature 1..500: note = hyper
  source 1..500: mol_type = genomic DNA
ggggagggggcgccccgggccggccctagaagttactttgcaaagaggcagggggcgcggggccgcgcggggcgagctcgggatccgcggggaagaagccctccgggaccgcgcctcggccgcccgagccccccgcgcccgccgccccccacctcggtcgggggcttacctgggagcccgctgcccccggccagccgcccgcgtgtgcccagggccagcagcacgcacaagtgccagcgcacggccgccgcgcccatgctcaatgcgggccccgctgggcgtgcgggcgtgcggggcgcggggacccgaccgaccggccgctcccgcaggcgctgctcgctgctcgccgctccgccaccgctcgggctcccgagccgcccagccagcccggctgatgagctgacagcgcgcgctcattggcccgtggcgtcggaggggcggggcgtcgcccagggccggccaatgggcgccggcctccggccctccgaggaagagggggg

SEQ ID NO: 38574 - DNA, 50 bp, Homo sapiens
  misc_feature 1..50: note = chr22:43739731-43739781
  misc_feature 1..50: note = hyper
  source 1..50: mol_type = genomic DNA
gcgaaccggggatcccgtgaggtcgcccgccatccgtgggcagtgaaacg

SEQ ID NO: 38575 - DNA, 336 bp, Homo sapiens
  misc_feature 1..336: note = chr22:43739825-43740161
  misc_feature 1..336: note = hyper
  source 1..336: mol_type = genomic DNA
cgtttcttgagcacctactggggaccgagtgcgggcgaggcagcagcgaaggaaccgggaggggaaacctcgtgaagatcacttgaaaattgacgttcaaaacaaacgaactttttagcactcgtcaaaggacagtggcccgtcagtgtgcttgtcacggggcggccgcaggacctgcgtctggaaccgggcgggcgcccgggacggacaatgccgcttggcggtcggtcccgcgggaggcccccgcacggggctaacctcggccggcgaagttcgctgcccggaatgcgaggccgaggcctccccctgtgacagaccgggcggggccaggaggag

SEQ ID NO: 38576 - DNA, 71 bp, Homo sapiens
  misc_feature 1..71: note = chr22:43808336-43808407
  misc_feature 1..71: note = hyper
  source 1..71: mol_type = genomic DNA
gccccgcctgcctagcgggcggcggcgggagggggctccgccagggcgcgggactccggctggggccgcgg

SEQ ID NO: 38577 - DNA, 234 bp, Homo sapiens; identical to SEQ ID NO: 4916
  misc_feature 1..234: note = chr22:44258285-44258519
  misc_feature 1..234: note = hyper
  source 1..234: mol_type = genomic DNA

SEQ ID NO: 38578 - DNA, 72 bp, Homo sapiens
  misc_feature 1..72: note = chr22:44263900-44263972
  misc_feature 1..72: note = hyper
  source 1..72: mol_type = genomic DNA
gtccgcggtgctgaacgcacagcttcccctttatccccctgcccttccatcctggcacgctgggtgaccaca

SEQ ID NO: 38579 - DNA, 355 bp, Homo sapiens
  misc_feature 1..355: note = chr22:44287444-44287799
  misc_feature 1..355: note = hyper
  source 1..355: mol_type = genomic DNA
taaatgaggctgtgccgggggtagagggcgcagagcacagcgccaggcaccagcgtctctgggctcgatccgctttcattaagctgtccccgccccttttcgcccccgcggtccgggactcaccgaccgacttgccgcagacgatgctgactgcgttgagcgccccagacgaggaaccgtagatgcggcgggcgccctggaggaggcgcggggctcgctggcgcaggcattcggtggcgcccacgtggtgggcgcccaggtagccggcgccggagaaggacaggttccatctgccctcctcctctaagaagcccatggcgggtggaccgggcggggtgatcgggacgaggaaggg

SEQ ID NO: 38580 - DNA, 37 bp, Homo sapiens
  misc_feature 1..37: note = chr22:44319869-44319906
  misc_feature 1..37: note = hyper
  source 1..37: mol_type = genomic DNA
cgctgcctgagcgagcacgccccgcacctcctccgcg

SEQ ID NO: 38581 - DNA, 82 bp, Homo sapiens
  misc_feature 1..82: note = chr22:44320125-44320207
  misc_feature 1..82: note = hyper
  source 1..82: mol_type = genomic DNA
ggcagatgcttcctgcgggggcgctgttcctgggcccgggaagggggcgttggaaccccgagcggtccgggccgaagcctgg

SEQ ID NO: 38582 - DNA, 193 bp, Homo sapiens
  misc_feature 1..193: note = chr22:44420487-44420680
  misc_feature 1..193: note = hyper
  source 1..193: mol_type = genomic DNA
aggacccgtaaacaacggccgggacctggcgcgtggggccgcggtggcctccggagtctgccaaacgcgcgtgcgggcgcctgcgcggcggggacctcgggccaccgtgcggggcccgcgcctgctctgcctgccgggtgttcagctcttccctgggccagcggcatagccagccgcgcggggtgaccgttca

SEQ ID NO: 38583 - DNA, 139 bp, Homo sapiens; identical to SEQ ID NO: 14101
  misc_feature 1..139: note = chr22:44726839-44726978
  misc_feature 1..139: note = hyper
  source 1..139: mol_type = genomic DNA

SEQ ID NO: 38584 - DNA, 884 bp, Homo sapiens
  misc_feature 1..884: note = chr22:44727367-44728251
  misc_feature 1..884: note = hyper
  source 1..884: mol_type = genomic DNA
agctcacctcgtgcccgccgcccgctcgttcctcgcttcgtagccgggagccggcgcccgcgggagccgcctgctggggtgcgggggctgcccacgcccccgcgatgcccctgccgccgccgcaacagttgtccgggttctgggggctgcggggacgcggggactccgggctccctgatcggcgctcggaaggcgcccgctcctaggcgcgccgggcgcggcgcggagctggggccggggccggggctggggctggggccggggctgcagctccggctcggcgtccggctcggggtccggctgggggtccggcggccggccgcatgccccgtcgccgcccgcggctactcggcggcccgcgccgcccggccgcccgccggccccgagccccgcgccgcgcccgccgccgccgccgccgcgctcatgctcgccgggccccgcgctcgccgccgccgccgccgccgccgccgctgcccacttcactctttggcgctcgctccgcgccgcgccctctgctgccccctcgcccgggctcgccgagctcccgccgccctgcccgccgcgtcctgcgccctcctctctctcccttcctctctcctcccttcctctctctctctccctctctctctcttgcgtcctcctctcattttttttttttctttcgcggtctcttttctccccctctggctctttctctctcccctcctgctgtttgcggtggcttctcactttctctctttttacttcctttccgtccgttctttcacgccttcctcctcattttccttccttctacttttcccttccctctttccgctttcctgccccgtttccttcctccctcccttcctccttccttccttcctctgcgttcttcctctctc

SEQ ID NO: 38585 - DNA, 57 bp, Homo sapiens
  misc_feature 1..57: note = chr22:45016369-45016426
  misc_feature 1..57: note = hyper
  source 1..57: mol_type = genomic DNA
tttccgacaaccacacggcgccggctgcacacgtcctgtttgcgtggttgctaggag

SEQ ID NO: 38586 - DNA, 178 bp, Homo sapiens
  misc_feature 1..178: note = chr22:45403002-45403180
  misc_feature 1..178: note = hyper
  source 1..178: mol_type = genomic DNA
actgaaaagggttagcgcatttgtcccaagccttcggtccagcccggcggcccagaccaggcgcgggccgcggcactgccatcttcctttcagcaagcccggccccccccaaaacccgccactcgcgcacgccccctcccatcactttttaactttaaagactcgacacgaacgcccg

SEQ ID NO: 38587 - DNA, 30 bp, Homo sapiens
  misc_feature 1..30: note = chr22:45403911-45403941
  misc_feature 1..30: note = hyper
  source 1..30: mol_type = genomic DNA
ttccccgggagctggcgtcaggttccaaga

SEQ ID NO: 38588 - DNA, 478 bp, Homo sapiens
  misc_feature 1..478: note = chr22:45404239-45404717
  misc_feature 1..478: note = hyper
  source 1..478: mol_type = genomic DNA
ccgcctccgagaacccggctctttctttccaggaaaggggaggggtggggaactttgagaactggagacagacccctctgggagtctgagcgtgcgtcgcccaggctggcactttttagggcgccgccaaagtgcccagccaccctcccgccccatcccagggggggccgcgatcccatcgcttacttgtttgtcgctgagcgcggcgatccgcggctgcctttcgtggagctgcttcttgaggtcgccgttctgcggaaacacggaggagcgggctcaggcaggccacccggggtcaggtgcaccccagcaccgcgggccgcggcaccccccgcccggagccccacgggcggggccggccgcagcgcaccccaagtttcccgggccgcgtcctgcacgcgcggcggccgggcagtgccgcgcggggccgcttacctgtggctgccgcctcatcggggcagctcgcggggcggggcgg

SEQ ID NO: 38589 - DNA, 17 bp, Homo sapiens
  misc_feature 1..17: note = chr22:45404994-45405011
  misc_feature 1..17: note = hyper
  source 1..17: mol_type = genomic DNA
caggttcgcccggggcg

SEQ ID NO: 38590 - DNA, 386 bp, Homo sapiens
  misc_feature 1..386: note = chr22:45405046-45405432
  misc_feature 1..386: note = hyper
  source 1..386: mol_type = genomic DNA
cgcactcccctccccgggaccggctcacgaaggggccccctccaggcaccctcccagtcatgcagaccctacatcgcttaagagaagactccaggctcgggtcccacgcgtcctcgatcccgcaaactgtgcaggacagcgccaggggcaggcggaggggagcccagaagggggtccgcgcgtgtgctcactccctcgccccccgcccccgggcaggctccagcctggaagacccagagacccggaagagaggatgctgggctcgggtcccccgaccccctcaccccgcaacacactccccggccccgggcccggcccccggccacctacctggtggcgcgcgagttccacggcgagcgcctcgggccggctctgcagctccatcc

SEQ ID NO: 38591 - DNA, 151 bp, Homo sapiens
  misc_feature 1..151: note = chr22:45405476-45405627
  misc_feature 1..151: note = hyper
  source 1..151: mol_type = genomic DNA
cgggaagttgcgcggctccgcgggggccagagcgggcgcgggcggacgcggcctccgggctgggttgggggggacacgagccccctcccccacggccgaaagggaagggggctggcgaaggggaagacaggcttccgggcgccgcggcgcc

SEQ ID NO: 38592 - DNA, 81 bp, Homo sapiens
  misc_feature 1..81: note = chr22:45405628-45405709
  misc_feature 1..81: note = hyper
  source 1..81: mol_type = genomic DNA
agccctcggctgccccaactcctcaggctgcccggcaagttgcgccgggtccccgggctgccggcgcggcccggagcatgg

SEQ ID NO: 38593 - DNA, 346 bp, Homo sapiens
  misc_feature 1..346: note = chr22:45406039-45406385
  misc_feature 1..346: note = hyper
  source 1..346: mol_type = genomic DNA
cggtcgccggctccggggactgctcgggccgggcgctcggagaggacgactgcggagtcatcctctccgtccccgggccaacccggggaacgcggcgcccccaccccctgcgccgtgtaacgccgggatcaggacactttccgctgggaggctgcgagtccgtgtttccatttctcctcaccctggtcctcggctccctcctttcccccctcctccgcctccctctgatattttatttaaattcttccgtcccctcctgtccataccagcgccgcgacttgggggattaaattagtcgcgtcgccacattcccccgccgcctgatggcctccgtgttgtttaaaca

SEQ ID NO: 38594 - DNA, 48 bp, Homo sapiens
  misc_feature 1..48: note = chr22:45680744-45680792
  misc_feature 1..48: note = hyper
  source 1..48: mol_type = genomic DNA
cgcgcgaggaggccgcggattggccagcccaggcgggggcggggcgcg

SEQ ID NO: 38595 - DNA, 76 bp, Homo sapiens
  misc_feature 1..76: note = chr22:45809534-45809610
  misc_feature 1..76: note = hyper
  source 1..76: mol_type = genomic DNA
gcgagacgcggcaagcgcggagccgttccttagcaacgagttgttgacatttccgagagagcgggagcgtctgtac

SEQ ID NO: 38596 - DNA, 34 bp, Homo sapiens
  misc_feature 1..34: note = chr22:45899024-45899058
  misc_feature 1..34: note = hyper
  source 1..34: mol_type = genomic DNA
cggggactcggagtccgtgcgttgccctgcgcgg

SEQ ID NO: 38597 - DNA, 600 bp, Homo sapiens
  misc_feature 1..600: note = chr22:46262452-46263052
  misc_feature 1..600: note = hyper
  source 1..600: mol_type = genomic DNA
ccactccctctgccccgcgcggggccgagctccacggcacgtgctttggcttggaccgggaaggcccgcagtcccacagtgcccggggaggacggtccgcgccttccacgacttcgcgccgcccgcgtggctgcagcgccgtggcccggggacgcgaggccacagcccgggagcgaggagcgcgggaggaccggcctgcctgtgcccggcaaagggggcccttccgaggcgggctcccttccccgccgctcccgtaagcgcgggagccagaggaccccagacccgccgcggcccaccccaagccccgatcaagtcctgcagcgcgggagggacccctgcaggcgcggggccagacgggcgacaaagcggcggactgcgagggccctgaggaagccggcggcgcggggtcaggagcaacctgctattcgtagggtcaggagcccacgcgtccccactgcggagggcggggtcgcagccaggcctccccgtttctagctgtgcggcctggggcgaggtgcttgacctctcggggcctcagtttccttctctatgaagcggagctgatcggccgcgtcccggggctgctgtgacagtccaagg

SEQ ID NO: 38598 - DNA, 113 bp, Homo sapiens
  misc_feature 1..113: note = chr22:46263511-46263624
  misc_feature 1..113: note = hyper
  source 1..113: mol_type = genomic DNA
cgcgtccggccaagcgccgcctccggcctctgcccgcggcccggcgcgccctcctccccagcgcgcccctatcctgcacgcatccgcggccccgggccctttccgcagcccca

SEQ ID NO: 38599 - DNA, 105 bp, Homo sapiens
  misc_feature 1..105: note = chr22:46263743-46263848
  misc_feature 1..105: note = hyper
  source 1..105: mol_type = genomic DNA
cgcgcctgtcccctccctgtcccctccttccagctctggaaacagcagcaccggaagccccctgccccagactcactgcccacccccggccgagctggctgccag

SEQ ID NO: 38600 - DNA, 58 bp, Homo sapiens
  misc_feature 1..58: note = chr22:46367066-46367124
  misc_feature 1..58: note = hyper
  source 1..58: mol_type = genomic DNA
gctgccccctctggccgcgtcaggcgaccccggacgtggcccgcgtgtaaaggagggg

SEQ ID NO: 38601 - DNA, 22 bp, Homo sapiens
  misc_feature 1..22: note = chr22:46368102-46368124
  misc_feature 1..22: note = hyper
  source 1..22: mol_type = genomic DNA
cgacagtagaagcatggtgggc

SEQ ID NO: 38602 - DNA, 30 bp, Homo sapiens
  misc_feature 1..30: note = chr22:46373796-46373826
  misc_feature 1..30: note = hyper
  source 1..30: mol_type = genomic DNA
tggcttcctctgcagcgcccagctgtgttc

SEQ ID NO: 38603 - DNA, 132 bp, Homo sapiens
  misc_feature 1..132: note = chr22:46440571-46440703
  misc_feature 1..132: note = hyper
  source 1..132: mol_type = genomic DNA
tcttcctcccctccccggcctgcttttcctccttctttccctctttgttgccaacctcggagccgcgactgaaacccagcccagcgtgtccgcgaagcccggaaacttccagctccgcgactgtgcagaaag

SEQ ID NO: 38604 - DNA, 44 bp, Homo sapiens
  misc_feature 1..44: note = chr22:46512635-46512679
  misc_feature 1..44: note = hyper
  source 1..44: mol_type = genomic DNA
ttcccgctctcctggcgtgtgtgtgtttgcgggggaggtgtggg

SEQ ID NO: 38605 - DNA, 98 bp, Homo sapiens
  misc_feature 1..98: note = chr22:46658645-46658743
  misc_feature 1..98: note = hyper
  source 1..98: mol_type = genomic DNA
tcacgcgcgcggggccgtctgtggggcactcggtgcgggccacgaagccctgctggggccgcgggcctggcgcggcggagcgcggggagacgcgggcc

SEQ ID NO: 38606 - DNA, 207 bp, Homo sapiens
  misc_feature 1..207: note = chr22:46932741-46932948
  misc_feature 1..207: note = hyper
  source 1..207: mol_type = genomic DNA
gtgcgcgcccgcaggcggcggctcagcgccgtcggggcactgcgggccaccaagcggacttgcagcggcagcgggcgccccgcgcccgagacgcgccgacgtcctgccagccgcccatcgcggcccacgtccagcagctcccgcggcgcccggggcgtgcaagcggcgcccaccgcgtaggtacagccgggccggagggcgaaggcg

SEQ ID NO: 38607 - DNA, 309 bp, Homo sapiens; identical to SEQ ID NO: 4918
  misc_feature 1..309: note = chr22:48885529-48885838
  misc_feature 1..309: note = hyper
  source 1..309: mol_type = genomic DNA

SEQ ID NO: 38608 - DNA, 115 bp, Homo sapiens
  misc_feature 1..115: note = chr22:48885907-48886022
  misc_feature 1..115: note = hyper
  source 1..115: mol_type = genomic DNA
ggagcgccctccccgtgcctcagcccgggacaaggggggaggcggcggccgagcccggagaggagctcttcaggcaggagcccagcctgggctcggaggagcagctggagcttcc

SEQ ID NO: 38609 - DNA, 756 bp, Homo sapiens
  misc_feature 1..756: note = chr22:48886204-48886960
  misc_feature 1..756: note = hyper
  source 1..756: mol_type = genomic DNA
gggcgtgagctgagggctggggtagggggtgaccgccgcgggctccctgttgcctggagtgaagggtggggggtggcctgtgcccctgccgaggctccaggcgggtggaatgaggggtggttggagtcccgggtgcagactccagcctcggcgctggggagggtgctcagcatcccggggcacgttcgcggctggtggggtaagtgggggccgctcagcgtcccgggcacaggctctggccccagatggcgcgggctggtcggcttcagctccgggagctccgggcttcttgtcttcagcgggagaataggacgggtgctggggagcacctgtcatggagaattgccatgggcgcgggaggtgatggaaaaatatggattctttacaaaaaaaaaaaaaaaaggccagcaccgaacctccctccacagacaccacctcctccagagccccgggcctccaagctcccagtccgatctgatccttccgctgtcgccaaaatgagagcacagtggcccagggagacccgggcagccgcgggatcggcctccggagtcctgggacagcccagctcgccaggatcgcaagggaaacccggggaccagagcaggaattttcctacttgcttcagcgcggttatgcatttccctagaaatgctgtggcaccgagcggggaggggtcgccaagcctgggggtctcaacccgagctgcccaggcagacgaggccaccgtgggtgcgccggcgcccctgggaactc

SEQ ID NO: 38610 - DNA, 82 bp, Homo sapiens
  misc_feature 1..82: note = chr22:48970842-48970924
  misc_feature 1..82: note = hyper
  source 1..82: mol_type = genomic DNA
tccaggcagatgtgccgttttcagaagccgcgggaccagcctcctccgagccctcccagccgctggtcgggcccggctgggg

SEQ ID NO: 38611 - DNA, 148 bp, Homo sapiens; identical to SEQ ID NO: 1524
  misc_feature 1..148: note = chr22:48971532-48971680
  misc_feature 1..148: note = hyper
  source 1..148: mol_type = genomic DNA

SEQ ID NO: 38612 - DNA, 201 bp, Homo sapiens; identical to SEQ ID NO: 1525
  misc_feature 1..201: note = chr22:48971758-48971959
  misc_feature 1..201: note = hyper
  source 1..201: mol_type = genomic DNA

SEQ ID NO: 38613 - DNA, 176 bp, Homo sapiens; identical to SEQ ID NO: 1526
  misc_feature 1..176: note = chr22:48971960-48972136
  misc_feature 1..176: note = hyper
  source 1..176: mol_type = genomic DNA

SEQ ID NO: 38614 - DNA, 79 bp, Homo sapiens
  misc_feature 1..79: note = chr22:48972387-48972466
  misc_feature 1..79: note = hyper
  source 1..79: mol_type = genomic DNA
ttgtccccgggcgcgcggaccggtcctccgcgctctgcccggctcgcggcggctccggcgcccgacccggcttccagca

SEQ ID NO: 38615 - DNA, 120 bp, Homo sapiens
  misc_feature 1..120: note = chr22:50242347-50242467
  misc_feature 1..120: note = hyper
  source 1..120: mol_type = genomic DNA
gttgacctaggaccccgcccctgcccgccctgcgccgcgcccctcccgggccggccttgaccgagcagctccacgcgggcccggggctcgtccacccgacaggagcggggggctgcagcc

SEQ ID NO: 38616 - DNA, 775 bp, Homo sapiens
  misc_feature 1..775: note = chr22:50242748-50243523
  misc_feature 1..775: note = hyper
  source 1..775: mol_type = genomic DNA
cgcccggggacagtgcgcgtcccctcgcccgcggcgcccgccctgcccgtcccaccgaggtcccccgggagcgtctgggcccacggcttcggggggtttctccgagacctgggcgctgttctgggggagcaggggcccgggccaccaaggttcgtgcggaccgtggggtgtcccacgcccaggccgggggatcccagagccccgcttccctcaagggcgccgcgccccggactgcaggtggagacggggaccggccccgcggggtcgccgacaggcgcggggcgggacagggtgggaggcggcggggcgcagagtcctccggtcgccggcgcgatccgggcaccttcctggaggcggcgggagcgcggtcgcggcgcctccggggtggggtccaggttggaggctccggggcgcaccgccctagccccaccccggccgggtccccgcgctgcctctgcggagagggaggaaggaaggaaggcagggagggaggggacggccggcaggcgtggggtccgcggcgtcagggctccttcctcccgtccgctccatcctgcaacccgtagcccgggcggggtctcgctgccccctccccgaacacagccgccttttcctccctccccaaccccgagcgcctcccttcccgaatgcgggagtccatagtgcacgggaagcctcttcccctccccaccgaggctgcccgacgccccttccaccctccgaccccccgcaaccatccctcaaatgccccggcggccagcagggctggggtggg

SEQ ID NO: 38617 - DNA, 154 bp, Homo sapiens
  misc_feature 1..154: note = chr22:50421887-50422041
  misc_feature 1..154: note = hyper
  source 1..154: mol_type = genomic DNA
gagaccttgagccctcgcgccctcgcgccctcgctccgggttcctgcgcgtggagggggcaggacgccccgcccttattcccgccgccagggggctccacggaggccgcccctcatccacagcagctgcgggtcctgcccggccctccagggcc

SEQ ID NO: 38618 - DNA, 53 bp, Homo sapiens
  misc_feature 1..53: note = chr22:50453483-50453536
  misc_feature 1..53: note = hyper
  source 1..53: mol_type = genomic DNA
ccgcgcaggtttccacggagacgcgcgtggctccgggtcgtcgtcctggtccc

SEQ ID NO: 38619 - DNA, 212 bp, Homo sapiens; identical to SEQ ID NO: 4922
  misc_feature 1..212: note = chr22:50496971-50497183
  misc_feature 1..212: note = hyper
  source 1..212: mol_type = genomic DNA

SEQ ID NO: 38620 - DNA, 86 bp, Homo sapiens
  misc_feature 1..86: note = chr22:50497213-50497299
  misc_feature 1..86: note = hyper
  source 1..86: mol_type = genomic DNA
cggggtgaccgtatcagcgccccccgtcctgcggcggaacttgggagggccttggtatccgcagaaccactcgtggggtcccacgc

SEQ ID NO: 38621 - DNA, 30 bp, Homo sapiens
  misc_feature 1..30: note = chr22:50609166-50609196
  misc_feature 1..30: note = hyper
  source 1..30: mol_type = genomic DNA
acctcctggagcagtcggcggacatggcga

SEQ ID NO: 38622 - DNA, 91 bp, Homo sapiens
  misc_feature 1..91: note = chr22:50623624-50623715
  misc_feature 1..91: note = hyper
  source 1..91: mol_type = genomic DNA
ccccctggaggcctccggacgatcggaagtgactgagcgtccgggtccgtgaggccgggggtcggcccgccctaagactcccacctggtcc

SEQ ID NO: 38623 - DNA, 137 bp, Homo sapiens
  misc_feature 1..137: note = chr22:50623741-50623878
  misc_feature 1..137: note = hyper
  source 1..137: mol_type = genomic DNA
cggggcccctggggcccgaccttcccggggtgccccaacctgcggcaaggccgaggtcccgctgaggcatgagtcccgggtcggggaccgctctgggccgacccccggaggacggactaggccgatccccagaggga

SEQ ID NO: 38624 - DNA, 44 bp, Homo sapiens
  misc_feature 1..44: note = chr22:50987052-50987096
  misc_feature 1..44: note = hyper
  source 1..44: mol_type = genomic DNA
accctcaaggggaggcgccgggggaggggggcagccctgccggc

SEQ ID NO: 38625 - DNA, 114 bp, Homo sapiens
  misc_feature 1..114: note = chr22:51042291-51042405
  misc_feature 1..114: note = hyper
  source 1..114: mol_type = genomic DNA
cacggacaccgggcccggcggggcgcagtcgccagtgcgcccgggttgcgactgcgaagggaaccggcctgcggaaccccctgcgccaggggggacttcgccctcctcagatcc

SEQ ID NO: 38626 - DNA, 109 bp, Homo sapiens; identical to SEQ ID NO: 1528
  misc_feature 1..109: note = chr22:51042457-51042566
  misc_feature 1..109: note = hyper
  source 1..109: mol_type = genomic DNA

SEQ ID NO: 38627 - DNA, 38 bp, Homo sapiens
  misc_feature 1..38: note = chr22:51111972-51112010
  misc_feature 1..38: note = hyper
  source 1..38: mol_type = genomic DNA
agctcccccctcctccgcccactcatcaccccctcccg

SEQ ID NO: 38628 - DNA, 148 bp, Homo sapiens
  misc_feature 1..148: note = chr22:51112026-51112174
  misc_feature 1..148: note = hyper
  source 1..148: mol_type = genomic DNA
cgtaaaactaaaattcacttcccagtcgcaggtggagactagtagcgccccctcccctaggcccttccccgtaggtcgcgcccccatcccgccgtcgctaaggtgacggggagggggcgacaggcgttggatccggaccggccagggg

SEQ ID NO: 38629 - DNA, 158 bp, Homo sapiens
  misc_feature 1..158: note = chrX:2846239-2846397
  misc_feature 1..158: note = hyper
  source 1..158: mol_type = genomic DNA
gtggggacatggaggcggcacaaggccaaggcgccgggggatggccagagggaagtaacggccgcgcttgtggtggagatggggacgggacagagaagtcttggggggtgaccggggtaggcacggcggtgctggggggagggcgcccaatgaagccc

SEQ ID NO: 38630 - DNA, 42 bp, Homo sapiens
  misc_feature 1..42: note = chrX:2846814-2846856
  misc_feature 1..42: note = hyper
  source 1..42: mol_type = genomic DNA
gggcagagcggggggcgcggttcggggcgggtcttagggagc

SEQ ID NO: 38631 - DNA, 53 bp, Homo sapiens
  misc_feature 1..53: note = chrX:2847143-2847196
  misc_feature 1..53: note = hyper
  source 1..53: mol_type = genomic DNA
cgccggacacaaccacgccctttacaggggcccaggctcgcccggggcgcccc

SEQ ID NO: 38632 - DNA, 289 bp, Homo sapiens
  misc_feature 1..289: note = chrX:3263410-3263699
  misc_feature 1..289: note = hyper
  source 1..289: mol_type = genomic DNA
cggagttttctctctcgccagagcccgggctttccccgcccctgcctgcgcgcctgacctcggcgctgggctggttccaagggcagccgcgccagtccccagcgtcctgtgcctgcgggcggacttggcccgggcgttccataggactcttcagccccaactccctgtccggcctcccaccccggcaccaacctcccgggagacccaggaaactcgcccccagacaaccctaatcccggggactcggggtcgggtctctccgccgcggagaaagcggcctggcgccagc

SEQ ID NO: 38633 - DNA, 45 bp, Homo sapiens
  misc_feature 1..45: note = chrX:3264124-3264169
  misc_feature 1..45: note = hyper
  source 1..45: mol_type = genomic DNA
aagaggctcctcaagcgtcctttcccccaccgattgcaagagcag

SEQ ID NO: 38634 - DNA, 238 bp, Homo sapiens
  misc_feature 1..238: note = chrX:3264775-3265013
  misc_feature 1..238: note = hyper
  source 1..238: mol_type = genomic DNA
cccaccccggggagacggggcgcgggcccgagccaagggaccctggccgcgccgctctgcgctcagccttcctctcgcgtcttcattgcgcctgggcccgggtgggcatgcctcgcccactccagctgcaagaaccgcaggcggctcggggaaggagggctctttgtcagagagaagtccaggaccccaggagggaagggcgagatgcagggagcgcggtgggagccgcagtagagtc

SEQ ID NO: 38635 - DNA, 29 bp, Homo sapiens
  misc_feature 1..29: note = chrX:3265150-3265179
  misc_feature 1..29: note = hyper
  source 1..29: mol_type = genomic DNA
cgggctggccccgccggcatcccactagc

SEQ ID NO: 38636 - DNA, 25 bp, Homo sapiens
  misc_feature 1..25: note = chrX:6143655-6143680
  misc_feature 1..25: note = hyper
  source 1..25: mol_type = genomic DNA
ctggcaattctgcttcgtcaggata

SEQ ID NO: 38637 - DNA, 145 bp, Homo sapiens
  misc_feature 1..145: note = chrX:6143800-6143945
  misc_feature 1..145: note = hyper
  source 1..145: mol_type = genomic DNA
gagatgggagctcacgcacaccaccccctttcaagaaaatataatgcaacgcgctccgatgtaaaccctacgggcaacggatgccttcaaaaagcataagataagagcaacaacaacaacaacaaaccaccgccccccccaaaaa

SEQ ID NO: 38638 - DNA, 39 bp, Homo sapiens
  misc_feature 1..39: note = chrX:6144250-6144289
  misc_feature 1..39: note = hyper
  source 1..39: mol_type = genomic DNA
ctgcaccccctcccccgccatccccgagatagcagcagc

SEQ ID NO: 38639 - DNA, 92 bp, Homo sapiens
  misc_feature 1..92: note = chrX:6144913-6145005
  misc_feature 1..92: note = hyper
  source 1..92: mol_type = genomic DNA
tccctacctcatccccgctcgcgcttccgcaggtcaggccacgcgggtgccagcgcgggctgtgggcgccccagccgcggccttggggaggg

SEQ ID NO: 38640 - DNA, 477 bp, Homo sapiens
  misc_feature 1..477: note = chrX:6145243-6145720
  misc_feature 1..477: note = hyper
  source 1..477: mol_type = genomic DNA
gggaagagggggtggcggttgcgttttccagggctgtagaggtggtgcgcctattggaaccgactcctcagcctcctcccccgtccccacctcggggactggcggaccgtgcgccccgcaggcttaacactccccccgacaccctcgctccgagaaggggtgttctcagtgggcaccgactagggctccagatcccccgagacccagaccagggctccggtagtctgtcctcgcagcttccaacttttccgctccttcggaaaagcgggcagttcagagatggttcccagggcggcagctgcaagcccccccgcgcccccctcaaaggttcagactacactcaaaggctccgaaagaagcaaaaccaccagctctaccctccttctgcggcttgcctcacccttcccacccgcctcgaaacccacacacacgggaaaggggtgcatggagcccgctccccggtttacagaagcagcc

SEQ ID NO: 38641 - DNA, 15 bp, Homo sapiens
  misc_feature 1..15: note = chrX:6145835-6145850
  misc_feature 1..15: note = hyper
  source 1..15: mol_type = genomic DNA
cgtcatcttatccga

SEQ ID NO: 38642 - DNA, 47 bp, Homo sapiens
  misc_feature 1..47: note = chrX:8698504-8698551
  misc_feature 1..47: note = hyper
  source 1..47: mol_type = genomic DNA
gccagcttcaccagccggttcaagatcatccccgagggtaaggggaa

SEQ ID NO: 38643 - DNA, 304 bp, Homo sapiens
  misc_feature 1..304: note = chrX:8698754-8699058
  misc_feature 1..304: note = hyper
  source 1..304: mol_type = genomic DNA
agagtttccctgaagcgagaaattgggaacttggaacaggtgggcacctagggatagaggcgagaagaagaaggagagaaggatgagagaagagaaaaataagcggaggatttcagagctcgcacgctcgacagggctggtacaggcagcagctgcactcgctcgcgctgagtccggaacctgctctcgtgcgcccacccgcacccggagcctcgcgcaagtcccgcgggggtccgcgccacagggcagagtcccggcaacccgctggagccaagcgcgcggctcccggagcctcccacacaag

SEQ ID NO: 38644 - DNA, 89 bp, Homo sapiens
  misc_feature 1..89: note = chrX:8699110-8699199
  misc_feature 1..89: note = hyper
  source 1..89: mol_type = genomic DNA
cggggtttgggggacggttcccccgggactcgttgaggagtatccgaatacggccccgccaaatcccctgtccccggcacttcttccct

SEQ ID NO: 38645 - DNA, 70 bp, Homo sapiens
  misc_feature 1..70: note = chrX:8699504-8699574
  misc_feature 1..70: note = hyper
  source 1..70: mol_type = genomic DNA
ctttgcgggagtcgccgcccgcccggagtctcgcgcactccaattcccgggaaaccgccacatccacaca

SEQ ID NO: 38646 - DNA, 80 bp, Homo sapiens
  misc_feature 1..80: note = chrX:8700319-8700399
  misc_feature 1..80: note = hyper
  source 1..80: mol_type = genomic DNA
gcagggcccatgggccggtctcgtcagctgcgagcccgggcgctccgggggagggcgacgccgagcggctttccacgccg

SEQ ID NO: 38647 - DNA, 80 bp, Homo sapiens
  misc_feature 1..80: note = chrX:13707316-13707396
  misc_feature 1..80: note = hyper
  source 1..80: mol_type = genomic DNA
tgctgtgcaggtccccgaccctctctctgtcctcattgcgcccagacgggccggcccagagctcccgggtcgtctttcgt

SEQ ID NO: 38648 - DNA, 114 bp, Homo sapiens
  misc_feature 1..114: note = chrX:13955908-13956022
  misc_feature 1..114: note = hyper
  source 1..114: mol_type = genomic DNA
cagattttaaccctccggagctgagccttttgccgttgctagtcgttcccccgttgcattggaacccgctcagcacaccgcctccacctgcacccgggccgcattttaatagtt

SEQ ID NO: 38649 - DNA, 241 bp, Homo sapiens
  misc_feature 1..241: note = chrX:13956288-13956529
  misc_feature 1..241: note = hyper
  source 1..241: mol_type = genomic DNA
aataaagcactagcccgggacgcgccgtctgttctctctgcaacccctcccgggtacccagctcttaggctcccgcgagccgcacgtgcgggggtgcagcctggccgcagccggagcggggaccaccccccccacaggatacaacagggaagcgcacctgggcgttccggacacctgcgccgcgcccctcccacctccagcgtcccggcttcgtcgcagaggtggccgaggaggcgccacc

SEQ ID NO: 38650 - DNA, 326 bp, Homo sapiens
  misc_feature 1..326: note = chrX:13956748-13957074
  misc_feature 1..326: note = hyper
  source 1..326: mol_type = genomic DNA
ggctgcgctgcgctgcgcggggctggccgctggctcctagctcccggccggggtgggagcgcggcgcggctccgcctgcactgggggccggccgcgcggagaggggccctgacgtcagcgccgggggctttgtgcgcccggagctagggcccgattgggggcagcgggcgcgcggagtctgcaggcaaagctcgcggcttcctctgggacccccccgggcgagcgccgagggtcgcgggaaccggaaaagccagcgagggggatgggtagagaggggagtgggcttctaggatcgcggaggcggcgatccgcgtcccagatgaaaa

SEQ ID NO: 38651 - DNA, 125 bp, Homo sapiens
  misc_feature 1..125: note = chrX:15756104-15756229
  misc_feature 1..125: note = hyper
  source 1..125: mol_type = genomic DNA
agcagggctcagaggcgtggcccaggctagagggaagagcccagggggagcgcagaggcggggctaggagggagcaggggtgaatgggggcgtggcccgggcgagaggggcgtggctgtagctaa

SEQ ID NO: 38652 - DNA, 195 bp, Homo sapiens
  misc_feature 1..195: note = chrX:16729945-16730140
  misc_feature 1..195: note = hyper
  source 1..195: mol_type = genomic DNA
cctaaccatctagtacggggaaaacgcgggggtcgttgtttaaggggtgcactgggaccggggagaggacagaaaggccatgttaccggcgctgatcaccagcctcgcagacccccgctcggggcttcacttccgccaacgccatctcagggctctcctggctcccgagggccgggagaagtggggatccgggtg

SEQ ID NO: 38653 - DNA, 161 bp, Homo sapiens
  misc_feature 1..161: note = chrX:16730152-16730313
  misc_feature 1..161: note = hyper
  source 1..161: mol_type = genomic DNA
cgggcggaggcgggaagaagcgcgtcccggggacgcgcgggacaggctccaaccgcactgggcacgggccagcgttccccagtccccgcgccacacccggcagccgaggtctgcgagcgcggggctggcggccggacccgactcagcgctgggcagggagc

SEQ ID NO: 38654 - DNA, 30 bp, Homo sapiens
  misc_feature 1..30: note = chrX:16730872-16730902
  misc_feature 1..30: note = hyper
  source 1..30: mol_type = genomic DNA
gaactccacgcttcccggggaaccccggct

SEQ ID NO: 38655 - DNA, 30 bp, Homo sapiens
  misc_feature 1..30: note = chrX:33744540-33744570
  misc_feature 1..30: note = hyper
  source 1..30: mol_type = genomic DNA
agggcacagcctctgcggagagtagcaggg

SEQ ID NO: 38656 - DNA, 33 bp, Homo sapiens
  misc_feature 1..33: note = chrX:40017591-40017624
  misc_feature 1..33: note = hyper
  source 1..33: mol_type = genomic DNA
gcccggctgcgcaggcggcgctgcccccggcgg

SEQ ID NO: 38657 - DNA, 69 bp, Homo sapiens
  misc_feature 1..69: note = chrX:40017828-40017897
  misc_feature 1..69: note = hyper
  source 1..69: mol_type = genomic DNA
acgacctctggttcccggactcccgcgatggtcaacgtgttatcgcttctcccgcgcaccccagaactc

SEQ ID NO: 38658 - DNA, 44 bp, Homo sapiens
  misc_feature 1..44: note = chrX:40031390-40031434
  misc_feature 1..44: note = hyper
  source 1..44: mol_type = genomic DNA
aggggagtcaagctgcggccaatgcaagacgagcagggtagact

SEQ ID NO: 38659 - DNA, 53 bp, Homo sapiens
  misc_feature 1..53: note = chrX:40034521-40034574
  misc_feature 1..53: note = hyper
  source 1..53: mol_type = genomic DNA
ggctggccccgcgcgcgtaagcgcggcactcagcagctcgacgcaaagccagg

SEQ ID NO: 38660 - DNA, 176 bp, Homo sapiens
  misc_feature 1..176: note = chrX:91035629-91035805
  misc_feature 1..176: note = hyper
  source 1..176: mol_type = genomic DNA
ttctttttcttaaagcgcgtagcgataaaacggctcttttttttcgagaaaagtaatgtaccttttaaaagaggttcatcggaaaatgtgactttttaaaagcgagcagccgcaaacgggtgtattttttagactttagaagagcggagcggcagtccgcccgggttgcggctggg

SEQ ID NO: 38661 - DNA, 136 bp, Homo sapiens
  misc_feature 1..136: note = chrX:91037072-91037208
  misc_feature 1..136: note = hyper
  source 1..136: mol_type = genomic DNA
gcggcgagtccgacccgcaagcacgagcagccctgccccgcgcgctccctgcgcgcagccgccctcgtgtcccttcggcctctcctgggtcccggctcgcagccccccccttccagtccctcgctcctcagaggcg

SEQ ID NO: 38662 - DNA, 37 bp, Homo sapiens
  misc_feature 1..37: note = chrX:103087260-103087297
  misc_feature 1..37: note = hyper
  source 1..37: mol_type = genomic DNA
gggacccggtgtagccgcctcccgccctccatgtggc

SEQ ID NO: 38663 - DNA, 30 bp, Homo sapiens
  misc_feature 1..30: note = chrY:4869647-4869677
  misc_feature 1..30: note = hyper
  source 1..30: mol_type = genomic DNA
ttaaaagaggttcatcggaaaatgtgactt

SEQ ID NO: 38664 - DNA, 80 bp, Homo sapiens
  misc_feature 1..80: note = AC211950.2_11234-25326:40-120
  misc_feature 1..80: note = hyper
  source 1..80: mol_type = genomic DNA
cggtgattggaataacgttcgcctttaaacttctcaagagatttagggtgggttttagtaagcggggccggttagctcag

SEQ ID NO: 38665 - DNA, 18 bp, Homo sapiens
  misc_feature 1..18: note = AC211950.2_11234-25326:180-198
  misc_feature 1..18: note = hyper
  source 1..18: mol_type = genomic DNA
aagcggcttttttttaat

SEQ ID NO: 38666 - DNA, 373 bp, Homo sapiens
  misc_feature 1..373: note = AC211950.2_11234-25326:13516-13889
  misc_feature 1..373: note = hyper
  source 1..373: mol_type = genomic DNA
ttatcaggagcctgccggtactttgggccgccaaatccctggcaggacaagattgagggcggagcttctcagatactgccttgggcaaacttctacgagcctgagagtgtgaagaatacggatttccaaaataggtcatgagggagacctctctcctcacttcccaatttcgccttcttcatctctcggaattagagagcacgttccagttggagaagcaccacctggaactgcctggcttgcgggcacagctattccagcccgctctagagttgtgatcctcacctgctccctgcaggcaaggccacccggaagtagcggggcagcttctcccagccccagaacttcacgccatacgcgcctcatcttcaat

SEQ ID NO: 38667 - DNA, 60 bp, Homo sapiens
  misc_feature 1..60: note = AC231386.2_19255-24791:4032-4092
  misc_feature 1..60: note = hyper
  source 1..60: mol_type = genomic DNA
gaccgggggcgaaggcgacaggggtctgtggaagagacctgtcggcggagagcggtccac

SEQ ID NO: 38668 - DNA, 200 bp, Homo sapiens
  misc_feature 1..200: note = AC241442.1_28021-33880:358-558
  misc_feature 1..200: note = hyper
  source 1..200: mol_type = genomic DNA
gccgctgggcctgagcgtgcagtcggtcgggtgggcgagggcgccgccctggtggcggaagcgcctcctccagggctcccccgaacggcggcgccgggaccccgctctccttgggctctttgcctcagaccccacgtggcgatgacccggcctcggtgtgcgcgtcggtgcggaggccggcccttcgagctgggtcccga

SEQ ID NO: 38669 - DNA, 420 bp, Homo sapiens
  misc_feature 1..420: note = AC241851.2_88-34049:15124-15544
  misc_feature 1..420: note = hyper
  source 1..420: mol_type = genomic DNA
cggcttcttgcccccaccgcccgggctttttgcgccgcggctttttgctgctatttgtccctgccaccgcggcgttttgcccccgcagccgcggctccttgccccctacgcggcttcctgcctccgccaccgtggctttttatcaccccagccgctttttgaaccccccgccgcgggtttttgccgccgcggcttcttgcccccctcgccgcggctttttacccccacagcggcggctttctgcccctgcctctgagggtttttgcggctttatgtccccgctgtcgtggctttttgccgccgcggcttttggccccctccgccgcggctttttgcggcttttggcacccaacgccgcggctttttggggcttttggtccccgccaccggggcttttttcccccaccgccgcaggttttt

SEQ ID NO: 38670 - DNA, 35 bp, Homo sapiens
  misc_feature 1..35: note = AC241851.2_88-34049:15844-15879
  misc_feature 1..35: note = hyper
  source 1..35: mol_type = genomic DNA
ttgcctagacgctggcgccccgggctctgctcctg

SEQ ID NO: 38671 - DNA, 123 bp, Homo sapiens
  misc_feature 1..123: note = AEKP01168736.1_1-4752:1196-1319
  misc_feature 1..123: note = hyper
  source 1..123: mol_type = genomic DNA
tcagagggtcagctgcgccccggccagagcaggagctgcgggaagaccctggagagcagggctgggagtggggatctggcagtgtggggccaagaaaaagggctggggcggaaatccagagac

SEQ ID NO: 38672 - DNA, 141 bp, Homo sapiens
  misc_feature 1..141: note = AEKP01168736.1_1-4752:1629-1770
  misc_feature 1..141: note = hyper
  source 1..141: mol_type = genomic DNA
ggggcgcgtgcaggtcggagccggcaggtgaggagccagggtctaagctagggcccggggtccaaaggaaaggctttcagatctgagctccgcggctctggcggcggtggagctgggagcccgcggtggccggctggggac

SEQ ID NO: 38673 - DNA, 801 bp, Homo sapiens
  misc_feature 1..801: note = AEKP01168736.1_1-4752:1830-2631
  misc_feature 1..801: note = hyper
  source 1..801: mol_type = genomic DNA
ctcggcgatgcgggtgcacctgggcgggctggccggcgcggctgcgctgaccggggcgctcagctttgtgctcctggcggccgccatcggcacggacttctggtatatcattgacaccgagcggctggagaggactggcccgggggcgcaggacctgctggggtccatcaatcgcagccagcccgagcctctgagctcccactccggcctctggcggacctgccggggtaagggtgcaccccgtggctgggagctgtggctgcgaacgccccctgcgcggtgccctgctcccttgggacctgttgcttggcgcgcactcctcccccaagtccctaaaatacaatgtctagggactcggggggaaggtgagcagaaggccgggactgcgaaaacccttccgagaggcacccggctgcgatcccaactgctctagctctccccgcgccctccccgggtggggcacttagggtgagcatgggggcaaagccgcagacgagggtgctgcacagaactccggggtcctgcacccatggattcctccgtcctatccagtgcagagcccgtgcacaccgctgatgaaccccttcaggctggagaacgtgacagtcagcgaatcgagccggcaacttctcagtgagtccggggagggtgaggatggagggagcgccccggtcctagccgtgagttctggagcctttcccaaaacagccgggcttcggggcctgcggagagggcggctggggtggcctctgacagcccagcctgagaatggagtgggcttaagaccggggggcagggtct

SEQ ID NO: 38674 - DNA, 30 bp, Homo sapiens
  misc_feature 1..30: note = AEKP01171767.1_199-12179:11068-11098
  misc_feature 1..30: note = hyper
  source 1..30: mol_type = genomic DNA
cacaccgcgctgaaccgtggtggcctcaat

SEQ ID NO: 38675 - DNA, 86 bp, Homo sapiens
  misc_feature 1..86: note = AEKP01197830.1_1-1408:113-199
  misc_feature 1..86: note = hyper
  source 1..86: mol_type = genomic DNA
cccggcccgacaccccgcggctttgggctcccacggggccgcgcgcctcttcccagccgggccccccatcccggggcagagggccc

SEQ ID NO: 38676 - DNA, 43 bp, Homo sapiens
  misc_feature 1..43: note = AEKP01197830.1_1-1408:476-519
  misc_feature 1..43: note = hyper
  source 1..43: mol_type = genomic DNA
tcagaaaagctggagcggggccgcagcccggccctgccccccg

SEQ ID NO: 38677 - DNA, 32 bp, Homo sapiens
  misc_feature 1..32: note = GL000258.1:893217-893249
  misc_feature 1..32: note = hyper
  source 1..32: mol_type = genomic DNA
agattaacctggacccgcgtggaggattcagc

SEQ ID NO: 38678 - DNA, 82 bp, Homo sapiens; identical to SEQ ID NO: 14151
  misc_feature 1..82: note = JH159140.1:144237-144319
  misc_feature 1..82: note = hyper
  source 1..82: mol_type = genomic DNA

SEQ ID NO: 38679 - DNA, 170 bp, Homo sapiens
  misc_feature 1..170: note = JH636052.4:1361659-1361829
  misc_feature 1..170: note = hyper
  source 1..170: mol_type = genomic DNA
ccgtgttgacaaagtcgctggaaatcactgtcagagatgtagcttttaggatagtattgtccaggatctgctaggctctatccactgcaggccttggtggggggggagggggggcctgcgaagcacaggaaaacttgtcttttcgttgtaacttccgcttcgttactaca

SEQ ID NO: 38680 - DNA, 24 bp, Homo sapiens
  misc_feature 1..24: note = JH636052.4:1362108-1362132
  misc_feature 1..24: note = hyper
  source 1..24: mol_type = genomic DNA
gacttgctcctacagcgcgggaaa

SEQ ID NO: 38681 - DNA, 24 bp, Homo sapiens
  misc_feature 1..24: note = JH636052.4:1362192-1362216
  misc_feature 1..24: note = hyper
  source 1..24: mol_type = genomic DNA
tgatgtcaccgacagtgcctttcc

SEQ ID NO: 38682 - DNA, 30 bp, Homo sapiens
  misc_feature 1..30: note = JH636052.4:2280989-2281019
  misc_feature 1..30: note = hyper
  source 1..30: mol_type = genomic DNA
aagaataacccttgccgtctattttttcat

SEQ ID NO: 38683 - DNA, 76 bp, Homo sapiens
  misc_feature 1..76: note = JH636052.4:2302666-2302742
  misc_feature 1..76: note = hyper
  source 1..76: mol_type = genomic DNA
aggaaacgccctcgtccgcgacccgagccgccgcctcgaggctcaggggaagctgaacgctcggtgggctcctggg

SEQ ID NO: 38684 - DNA, 211 bp, Homo sapiens
  misc_feature 1..211: note = JH636052.4:5118718-5118929
  misc_feature 1..211: note = hyper
  source 1..211: mol_type = genomic DNA
ctgcgagggtcaggacggggcgaaggccattccgctgcccttccagcttcggaatcacccaatgcacgggtttcaaccgtagccagcaagatgcgcctctcaggttttccgaggctttggagcctgcacaattgttctacaaaaggcagtagctccgccgaacgttggatcgtcccttggtctggtgataccagaacgagagttgactgtg

SEQ ID NO: 38685 - DNA, 218 bp, Homo sapiens
  misc_feature 1..218: note = JH636058.1:413209-413427
  misc_feature 1..218: note = hyper
  source 1..218: mol_type = genomic DNA
tggacaccaggcactcggcggcgaagtagtccaggcacgccacggcggccgacatgctgggaccgcccggccgccggcgagcgccgtccgaacgcggccggccgcgggcgacggagttcccgggagcgtccgtcccgcagcctcggagcgagaagcaggaggccgggtgctcgccgcctgccgcctgctgccgccgccgccgccgcagccgccgctgc

SEQ ID NO: 38686 - DNA, 169 bp, Homo sapiens
  misc_feature 1..169: note = NW_001838403.1_1-2251:175-344
  misc_feature 1..169: note = hyper
  source 1..169: mol_type = genomic DNA
agaggcctggggagccgcgcgaagccggcgagcaaacagctggaaattattaccagttaatgcgctccgtgtggccgcagccgcctgttggccccggaaggcgggccctggcgctcctgcccgtcccggaggagaggcctgtcctcgggggctccgcaggcgcgggtca

SEQ ID NO: 38687 - DNA, 30 bp, Homo sapiens
  misc_feature 1..30: note = chr1:865434-865464
  misc_feature 1..30: note = hypo
  source 1..30: mol_type = genomic DNA
ccccgggagatggaacggcccggtccagcc

SEQ ID NO: 38688 - DNA, 48 bp, Homo sapiens
  misc_feature 1..48: note = chr1:898728-898776
  misc_feature 1..48: note = hypo
  source 1..48: mol_type = genomic DNA
ctcagacctggctaccgtggagtcctacgaccccgtgactaacacgtg

SEQ ID NO: 38689 - DNA, 572 bp, Homo sapiens; identical to SEQ ID NO: 14155
  misc_feature 1..572: note = chr1:913532-914104
  misc_feature 1..572: note = hypo
  source 1..572: mol_type = genomic DNA

SEQ ID NO: 38690 - DNA, 90 bp, Homo sapiens
  misc_feature 1..90: note = chr1:918405-918495
  misc_feature 1..90: note = hypo
  source 1..90: mol_type = genomic DNA
catgagggccgcgggcgactgcccgggcgggtgaggctgtcctgtgtgaacgtgccacgcggctgtgccgtttcccgtgggtggcgatgt

SEQ ID NO: 38691 - DNA, 47 bp, Homo sapiens
  misc_feature 1..47: note = chr1:942338-942385
  misc_feature 1..47: note = hypo
  source 1..47: mol_type = genomic DNA
gccctgcacctggcccgggcctcggaccccgacggggctcacccacc

SEQ ID NO: 38692 - DNA, 30 bp, Homo sapiens
  misc_feature 1..30: note = chr1:957607-957637
  misc_feature 1..30: note = hypo
  source 1..30: mol_type = genomic DNA
aaagacctggtggcccgggagagcctgctg

SEQ ID NO: 38693 - DNA, 356 bp, Homo sapiens
  misc_feature 1..356: note = chr1:986529-986885
  misc_feature 1..356: note = hypo
  source 1..356: mol_type = genomic DNA
tagataggcaatgggcgggtggggcgggtgcgtgcaggtgcctgggccctgggtctgcaccgtgggtgggctctgcacagccacttacctggcgtccccgcaggttccgcacaccgtcctcaacctgaaggagccgctctacgtagggggcgctcccgacttcagcaagctggcccgtgctgctgccgtgtcctctggcttcgacggtgccatccagctggtatgtgggggcggggcgtcccagcagggcctccggggcgggcggggtggcaggcgggacaaggccctcaccctgccctgcaggtctccctcggaggccgccagctgctgaccccggagcacgtgctgcggcaggt

SEQ ID NO: 38694 - DNA, 30 bp, Homo sapiens
  misc_feature 1..30: note = chr1:1045970-1046000
  misc_feature 1..30: note = hypo
  source 1..30: mol_type = genomic DNA
cggcactcagcctctcggctgtggggacac

SEQ ID NO: 38695 - DNA, 70 bp, Homo sapiens
  misc_feature 1..70: note = chr1:1050115-1050185
  misc_feature 1..70: note = hypo
  source 1..70: mol_type = genomic DNA
actgaacatcccaggcggccgcccctaccctggggctcaaaaccggctccctctgcgagggtttcccagg

SEQ ID NO: 38696 - DNA, 160 bp, Homo sapiens
  misc_feature 1..160: note = chr1:1067634-1067794
  misc_feature 1..160: note = hypo
  source 1..160: mol_type = genomic DNA
ctcctgcctgagacccgccgccatcgccgccgcgagccctgcgttgggcattggggccaggcacctgccaggagggcctcttccgaggtggggtgtcacctgggatgtgtccgctggcaaatgggagaaacaccagggcggctgccggggaggtcgatgt

SEQ ID NO: 38697 - DNA, 30 bp, Homo sapiens
  misc_feature 1..30: note = chr1:1080521-1080551
  misc_feature 1..30: note = hypo
  source 1..30: mol_type = genomic DNA
cctcctggctgacaccgtggcccctcctgg

SEQ ID NO: 38698 - DNA, 144 bp, Homo sapiens
  misc_feature 1..144: note = chr1:1080794-1080938
  misc_feature 1..144: note = hypo
  source 1..144: mol_type = genomic DNA
acctgacctcatggccgacctgacctgaccgcacggctgacccaaccccatctcatgactgaccccacctgactttatggctcaccccagtgaccccatggccaaccccacctgacctcatggccgacccgatctgacctcatg

SEQ ID NO: 38699 - DNA, 30 bp, Homo sapiens
  misc_feature 1..30: note = chr1:1083645-1083675
  misc_feature 1..30: note = hypo
  source 1..30: mol_type = genomic DNA
gcgtccctgggttgccgcacgtatatccct

SEQ ID NO: 38700 - DNA, 30 bp, Homo sapiens
  misc_feature 1..30: note = chr1:1102634-1102664
  misc_feature 1..30: note = hypo
  source 1..30: mol_type = genomic DNA
ccctcccacacagcccgctcaccggacccc

SEQ ID NO: 38701 - DNA, 159 bp, Homo sapiens
  misc_feature 1..159: note = chr1:1145553-1145712
  misc_feature 1..159: note = hypo
  source 1..159: mol_type = genomic DNA
ctgacaccatggaggcgaacaggcacctccgcctcccgagggacacagatgtcgcttagacgcccggggtgtcttccctgcgggaagcctgcagggctgctcccgccttgttcccgagctgtggcctcgggcgtgactggcgctcgggagcaggctctg

SEQ ID NO: 38702 - DNA, 164 bp, Homo sapiens
  misc_feature 1..164: note = chr1:1146693-1146857
  misc_feature 1..164: note = hypo
  source 1..164: mol_type = genomic DNA
tgcagcccacagtgccggtcggagactcccgtctgccaaggtttttattgtggtcccgcggggcaggaggtatgcatggcatacgtaagcagagagccggaggcagccatcggcacctagaacggtgcagagttggcccaggagcgtggcggggcaggcggcct

SEQ ID NO: 38703 - DNA, 126 bp, Homo sapiens
  misc_feature 1..126: note = chr1:1168843-1168969
  misc_feature 1..126: note = hypo
  source 1..126: mol_type = genomic DNA
gttcctggacctcagcgagcctgagccgggcccggccgcacgctgacccccgtgctgtccccgaccggctcacggggctgggctccgatcttccgtgtctcttatcagtggcgtttctcacgtctg

SEQ ID NO: 38704 - DNA, 33 bp, Homo sapiens
  misc_feature 1..33: note = chr1:1173925-1173958
  misc_feature 1..33: note = hypo
  source 1..33: mol_type = genomic DNA
ggccccaggacgcggcgccgagctctgccccca

SEQ ID NO: 38705 - DNA, 18 bp, Homo sapiens
  misc_feature 1..18: note = chr1:1218784-1218802
  misc_feature 1..18: note = hypo
  source 1..18: mol_type = genomic DNA
atggggcttctgggccgg

SEQ ID NO: 38706 - DNA, 42 bp, Homo sapiens
  misc_feature 1..42: note = chr1:1234718-1234760
  misc_feature 1..42: note = hypo
  source 1..42: mol_type = genomic DNA
acttacctgcagcagcgtctggagggccggagcaggaggggg

SEQ ID NO: 38707 - DNA, 103 bp, Homo sapiens
  misc_feature 1..103: note = chr1:1235178-1235281
  misc_feature 1..103: note = hypo
  source 1..103: mol_type = genomic DNA
tggtgtgcagggagccggctgcgcggcctcacccgctgctggatggcggcgtgctttcgctccatctcacgcttttccaccgcagagtcgatcaccagctggt

SEQ ID NO: 38708 - DNA, 177 bp, Homo sapiens
  misc_feature 1..177: note = chr1:1235901-1236078
  misc_feature 1..177: note = hypo
  source 1..177: mol_type = genomic DNA
tccagtgccaggtggcggaagcacttcctggtgagggtgagggccccggtggcttcctccacctcgtggggccggtgcctcggggcctgggcgttcctcaccagggacagctccaggtcctcccgcaccttgtcaaactgcttctttgtctccttgaacttccgcacatccctggag

SEQ ID NO: 38709 - DNA, 205 bp, Homo sapiens
  misc_feature 1..205: note = chr1:1238277-1238482
  misc_feature 1..205: note = hypo
  source 1..205: mol_type = genomic DNA
aggtggcagggaggccgcgctcaccatgtggtagttcaccacctcctgtaggctgtcagcgaacctctgcagacattcctggaggagcagatgggaacccgtgctgagatggcaaatccgggcccaggtcacccagccacgccctctgagcccctgggcggtgcagacaccggcctgcttctggcctggacgccctcaaggggct

SEQ ID NO: 38710 - DNA, 292 bp, Homo sapiens
  misc_feature 1..292: note = chr1:1245060-1245352
  misc_feature 1..292: note = hypo
  source 1..292: mol_type = genomic DNA
ctgcctggatatggtcgccatgcaggaagccgcccagcacctcctcggcacacacgacttcagcgccttccagtccgctggcagcccggtgccgagccccgtgcgaacgctgcgccgggtctccgtttccccaggccaagccagccccttggtcacccccgaggagagcaggtgaggaagggcccctgggctgtggccctgccctcaagtcacgtgctgattttagctccagcacctcccccagttttaaggcaaggtgaggcgggaggcaggcagccgggagtcctcagga

SEQ ID NO: 38711 - DNA, 22 bp, Homo sapiens
  misc_feature 1..22: note = chr1:1253533-1253555
  misc_feature 1..22: note = hypo
  source 1..22: mol_type = genomic DNA
gccaccgcgcctggccaaggca

SEQ ID NO: 38712 - DNA, 1115 bp, Homo sapiens
  misc_feature 1..1115: note = chr1:1267070-1268185
  misc_feature 1..1115: note = hypo
  source 1..1115: mol_type = genomic DNA
agatcaacaacaagtcggatctgctgcccgggctgcgcctgggctacgacctctttgatacgtgctcggagcctgtggtggccatgaagcccagcctcatgttcctggccaaggcaggcagccgcgacatcgccgcctactgcaactacacgcagtaccagccccgtgtgctggctgtcatcgggccccactcgtcagagctcgccatggtcaccggcaagttcttcagcttcttcctcatgccccaggtgggcgccccccaccatcacccacccccacccagccctgcccgtgggagcccctgtgtcaggagatgcctcttggcccttgcaggtcagctacggtgctagcatggagctgctgagcgcccgggagaccttcccctccttcttccgcaccgtgcccagcgaccgtgtgcagctgacggccgccgcggagctgctgcaggagttcggctggaactgggtggccgccctgggcagcgacgacgagtacggccggcagggcctgagcatcttctcggccctggccgcggcacgcggcatctgcatcgcgcacgagggcctggtgccgctgccccgtgccgatgactcgcggctggggaaggtgcaggacgtcctgcaccaggtgaaccagagcagcgtgcaggtggtgctgctgttcgcctccgtgcacgccgcccacgccctcttcaactacagcatcagcagcaggctctcgcccaaggtgtgggtggccagcgaggcctggctgacctctgacctggtcatggggctgcccggcatggcccagatgggcacggtgcttggcttcctccagaggggtgcccagctgcacgagttcccccagtacgtgaagacgcacctggccctggccaccgacccggccttctgctctgccctgggcgagagggagcagggtctggaggaggacgtggtgggccagcgctgcccgcagtgtgactgcatcacgctgcagaacgtgagcgcagggctaaatcaccaccagacgttctctgtctacgcagctgtgtatagcgtggcccaggccctgcacaacactcttcagtgcaacgcctcaggctgccccgcgcaggaccccgtgaagccctggca

SEQ ID NO: 38713 - DNA, 88 bp, Homo sapiens
  misc_feature 1..88: note = chr1:1309067-1309155
  misc_feature 1..88: note = hypo
  source 1..88: mol_type = genomic DNA
gagagacctcacacccggcaaatggagctccagacccgcaggaaaggctgagtcctctgagaatttattactacggatcacagcagca

SEQ ID NO: 38714 - DNA, 84 bp, Homo sapiens
  misc_feature 1..84: note = chr1:1341728-1341812
  misc_feature 1..84: note = hypo
  source 1..84: mol_type = genomic DNA
cggggtaagaaaaaaaaaccggggtacgttagatgctaggttcatgaggctgagacgggagtggtgaggcgcagtaatgaggcg

SEQ ID NO: 38715 - DNA, 46 bp, Homo sapiens
  misc_feature 1..46: note = chr1:1363856-1363902
  misc_feature 1..46: note = hypo
  source 1..46: mol_type = genomic DNA
ccttggtctcaccagcgcgtcctagctgtgccgagctcacacccac

SEQ ID NO: 38716 - DNA, 30 bp, Homo sapiens
  misc_feature 1..30: note = chr1:1483034-1483064
  misc_feature 1..30: note = hypo
  source 1..30: mol_type = genomic DNA
aggctcagagcaaggcgagaggacaggagc

SEQ ID NO: 38717 - DNA, 89 bp, Homo sapiens
  misc_feature 1..89: note = chr1:1563170-1563259
  misc_feature 1..89: note = hypo
  source 1..89: mol_type = genomic DNA
cgggccctgtgtgagcgcggctgtgacgtcaacctgcccgtgagtgctgctccctggcctgggtgccccctgcccgtgagtgcttgtcc

SEQ ID NO: 38718 - DNA, 103 bp, Homo sapiens
  misc_feature 1..103: note = chr1:1563663-1563766
  misc_feature 1..103: note = hypo
  source 1..103: mol_type = genomic DNA
agattctggctcgggcgcggcagctggtggacgccaagaaggaggacggcttcacggcgctgcatctggctgccctcaacaaccaccgcgaggtggcccagat

SEQ ID NO: 38719 - DNA, 62 bp, Homo sapiens
  misc_feature 1..62: note = chr1:1625749-1625811
  misc_feature 1..62: note = hypo
  source 1..62: mol_type = genomic DNA
taaatattacttttacgttttgttaaacttccacttgtttttgtttccgttgcatgaacctt

SEQ ID NO: 38720 - DNA, 24 bp, Homo sapiens
  misc_feature 1..24: note = chr1:1671766-1671790
  misc_feature 1..24: note = hypo
  source 1..24: mol_type = genomic DNA
tctttttttttgagacgggagtct

SEQ ID NO: 38721 - DNA, 20 bp, Homo sapiens
  misc_feature 1..20: note = chr1:1839158-1839178
  misc_feature 1..20: note = hypo
  source 1..20: mol_type = genomic DNA
ttttgttttttgagacggag

SEQ ID NO: 38722 - DNA, 140 bp, Homo sapiens
  misc_feature 1..140: note = chr1:1856211-1856351
  misc_feature 1..140: note = hypo
  source 1..140: mol_type = genomic DNA
acctgtcctccagggcgcctgagtctcgctcaggcccagcttagctgaacccacgtccccacctgtgtcctccctgccctcaccccctctccttagagcaccctttctccatgcaacgcccgtctcgggctctgcctcca

SEQ ID NO: 38723 - DNA, 30 bp, Homo sapiens
  misc_feature 1..30: note = chr1:1861852-1861882
  misc_feature 1..30: note = hypo
  source 1..30: mol_type = genomic DNA
gtggaggacaagccccggggggggctcaca

SEQ ID NO: 38724 - DNA, 30 bp, Homo sapiens; identical to SEQ ID NO: 14168
  misc_feature 1..30: note = chr1:1874744-1874774
  misc_feature 1..30: note = hypo
  source 1..30: mol_type = genomic DNA

SEQ ID NO: 38725 - DNA, 410 bp, Homo sapiens
  misc_feature 1..410: note = chr1:1914707-1915117
  misc_feature 1..410: note = hypo
  source 1..410: mol_type = genomic DNA
gtgtgaaaggggacacggagcgggatttcccagcctcaaagcttctgcccacaagctacgcatcagtttccaagggaacggtgtcgctgcactgaagaagccagcggccccacagtggggctggcagccatcacgtgtcccatgagaggacacccgagggactggtcatcacccccaggggcatcgagcacgggcgctgtgcgggacagcccctggcctgcaatcctcagaaccgcaacgtccgcctgtcacagaagaaccgaggctccttctgactgggggaggcgaggggccaccctcgacacaacgccacatgggcttcaggcacggctctgggatgcggggccgaggggcacagggggtcttgctgccattctgcagctcttctgtaagttcggaattgtttcaaa

SEQ ID NO: 38726 - DNA, 69 bp, Homo sapiens
  misc_feature 1..69: note = chr1:1974645-1974714
  misc_feature 1..69: note = hypo
  source 1..69: mol_type = genomic DNA
cattgccatggtgaccgtggttctggtgctgcctcctcagacgcaccagcctcgcgccgcgtctgaaat

SEQ ID NO: 38727 - DNA, 30 bp, Homo sapiens
  misc_feature 1..30: note = chr1:1986234-1986264
  misc_feature 1..30: note = hypo
  source 1..30: mol_type = genomic DNA
ttgggtgaacttgaacgagtgcccgaccag

SEQ ID NO: 38728 - DNA, 177 bp, Homo sapiens
  misc_feature 1..177: note = chr1:2013405-2013582
  misc_feature 1..177: note = hypo
  source 1..177: mol_type = genomic DNA
gcagtcctcttttttcggaaatgtgttcagttctcttgcattgcataatttgttcatattaaagcaggcttgatccgggctgccgtggttccgatcgactccgaataggacaccacacagtcgtgccaagaaggcgcctaagtgtctttccacacggccatccgagggcggacgtgg

SEQ ID NO: 38729 - DNA, 327 bp, Homo sapiens
  misc_feature 1..327: note = chr1:2066352-2066679
  misc_feature 1..327: note = hypo
  source 1..327: mol_type = genomic DNA
caggcaggggacagacggacccggcctgcgttggcctggggtgacttcacggctccactgtcagcaagcggccgtcccgtggtggatcctgtccgccctgcgaggacacctggctccatccacacctgggcctctgtctccagccgccgaggccgtgacaccatgaggatcatgtgaggaggggcagagagaggcctccgggaggccgtcattccagccctgccttccctgcctgggaggacgctgcggccgccaccacctggacgggagtggcctgtcgcagctgcaccctgcgtgggctcgtggctgccacgctgtttctttaca

SEQ ID NO: 38730 - DNA, 299 bp, Homo sapiens
  misc_feature 1..299: note = chr1:2125216-2125515
  misc_feature 1..299: note = hypo
  source 1..299: mol_type = genomic DNA
ggtgccctcctgccccgtgaagcagccggtaggaacggcccgggccccacaggtccggcggaaagggtgtccaggaaaaggtcttgggtccgacagtgaagacttcagtgggctccgggccgcacctgggctcctgcaacacagagttgttgggccttgcccagcgatggctcccgccctggaaaccccttcatcgctaagatgggcccagtgggcacacctgtcctgggaaggcgggcagtgaaggcacctcgtgatccaggatcagctccgggctcaccgtgcgcagtagctcggcc

SEQ ID NO: 38731 - DNA, 88 bp, Homo sapiens
  misc_feature 1..88: note = chr1:2141596-2141684
  misc_feature 1..88: note = hypo
  source 1..88: mol_type = genomic DNA
tcgtgcccagacctgcgagtgtgcctgcccgtgtcagacagaggcgagttgggacttcacacctgaaatcaagcgggagggtaggaat

SEQ ID NO: 38732 - DNA, 36 bp, Homo sapiens
  misc_feature 1..36: note = chr1:2170934-2170970
  misc_feature 1..36: note = hypo
  source 1..36: mol_type = genomic DNA
ccatgtgggtgtagccgttggcggcacctttgtacg

SEQ ID NO: 38733 - DNA, 228 bp, Homo sapiens
  misc_feature 1..228: note = chr1:2263131-2263359
  misc_feature 1..228: note = hypo
  source 1..228: mol_type = genomic DNA
gggaacagtcaaagacgactttgcaggatcctgcctgagagttgtaacaaaggcgcgcgtttctcccgcatgcgccgtccttcttatgtaaccactgccgctcctctcccgcggctgcgcctctcccgccgctgcgcctctccctcgtgcggctctcccgcccctgcgcctctccctcgtgcgcctctcccgcccctgcgcctctccctcgtgcgcctctcccgcccc

SEQ ID NO: 38734 - DNA, 575 bp, Homo sapiens
  misc_feature 1..575: note = chr1:2267155-2267730
  misc_feature 1..575: note = hypo
  source 1..575: mol_type = genomic DNA
gtgctggtcactctgcgagcaacccagcagctcctccacagtgtgcggggccaggcgagggctggtgggacgggtccccagggcacatcagcgggggcctcctcgcctccatagcccagcccagcccagcgcgcagctgcccccaatttgtagacagagtcccgatttgaggtggcagctgttgctggactccgagccccgagccccagcttcctcctggtagaaccggccggttacggccctgcatgtgctgtgcccgtagcactgccaggcccaggatggtgagatgtgacggccacaaaccccccacggtgtccccgcctgcacgtgccgcggtgtgcacctggtcccactcctgtcctccagctcacagagtcccctcaagccactgccctgaaccctggccaccagccgtcttcctctgagaggccccgcacccctcctgcctctctgcttctgcatgcccacagcctggtccgcccggcgggtctgggagttgtggtgatcgaagcagatggaccggctccagctccacccacttcatgccagcccaggcaagtcgcagggcagctgtt

SEQ ID NO: 38735 - DNA, 30 bp, Homo sapiens
  misc_feature 1..30: note = chr1:2268713-2268743
  misc_feature 1..30: note = hypo
  source 1..30: mol_type = genomic DNA
atggttctgccccagcggcccatcaagatg

SEQ ID NO: 38736 - DNA, 154 bp, Homo sapiens
  misc_feature 1..154: note = chr1:2275666-2275820
  misc_feature 1..154: note = hypo
  source 1..154: mol_type = genomic DNA
cacctgagggctgggcgtggccaggcacaaggggctggcgggcctgggagggatctgcagggcaggttgagacatggttctgaagccaggcagctgctccccagaagctccggtgagcacactcgacaaggtggtgcggcgagctggctccgag

SEQ ID NO: 38737 - DNA, 111 bp, Homo sapiens
  misc_feature 1..111: note = chr1:2276089-2276200
  misc_feature 1..111: note = hypo
  source 1..111: mol_type = genomic DNA
cttccctgggggcctcgtccctgcgctgcacagatggggcccggccgccccagtgggaagggaaagggggagcgctgtgccaactcacaggctctacgagccacaacagct

SEQ ID NO: 38738 - DNA, 62 bp, Homo sapiens
  misc_feature 1..62: note = chr1:2304327-2304389
  misc_feature 1..62: note = hypo
  source 1..62: mol_type = genomic DNA
ttgggttttcctgcccgtggaatgttcccgcacgtcttcccgctggtcgggatttaggccct

SEQ ID NO: 38739 - DNA, 49 bp, Homo sapiens; identical to SEQ ID NO: 14177
  misc_feature 1..49: note = chr1:2307845-2307894
  misc_feature 1..49: note = hypo
  source 1..49: mol_type = genomic DNA

SEQ ID NO: 38740 - DNA, 553 bp, Homo sapiens
  misc_feature 1..553: note = chr1:2308105-2308658
  misc_feature 1..553: note = hypo
  source 1..553: mol_type = genomic DNA
ccccctccctgggtgcgcagcaatcaggtcagggcttggcatcctcggtacccaccgctggtgtccgggtgggagggctgagccaggcaagctttcatgcagcacttggtcagtccaagcacatttgagtgatcaattcaactgatccaatagcccggtcttgtctaattcacgttatcaatcacacctttgacaattcggctgtttctgtttcatgtaccccaagcaggaacgagcaagagcttattaaatagggtgcaggggaggctcctgatcctcctgctgacggcacagactgggacactgagagtcctggagcagctgcctcccacccgggcctcagggagcacccaggcacagtccaggccgatgcccagcgtggagagttacgtgcggggcctcagccacacacaggctgggaccgaggaatgggcattttgccacctgctcaccctcctcctccctgctgggccactgcctggcacccaggtgagcacaggtgtgcggtacgggacacgggaaggtggtggtggtcacacgacctttggggaag

SEQ ID NO: 38741 - DNA, 30 bp, Homo sapiens
  misc_feature 1..30: note = chr1:2309850-2309880
  misc_feature 1..30: note = hypo
  source 1..30: mol_type = genomic DNA
ggcagtaggcccaaacgtggaggctatagg

SEQ ID NO: 38742 - DNA, 30 bp, Homo sapiens
  misc_feature 1..30: note = chr1:2310214-2310244
  misc_feature 1..30: note = hypo
  source 1..30: mol_type = genomic DNA
cgggtcctgggaggtcgagcagtaagctgt

SEQ ID NO: 38743 - DNA, 33 bp, Homo sapiens
  misc_feature 1..33: note = chr1:2331363-2331396
  misc_feature 1..33: note = hypo
  source 1..33: mol_type = genomic DNA
gtggtgcacagagaccgccgggactctaatgcc

SEQ ID NO: 38744 - DNA, 30 bp, Homo sapiens
  misc_feature 1..30: note = chr1:2336335-2336365
  misc_feature 1..30: note = hypo
  source 1..30: mol_type = genomic DNA
aacatcaaatggaggcgggaaataggctgg

SEQ ID NO: 38745 - DNA, 174 bp, Homo sapiens
  misc_feature 1..174: note = chr1:2338063-2338237
  misc_feature 1..174: note = hypo
  source 1..174: mol_type = genomic DNA
gaaggtggggcagagcgtcaaggtgggtgcaccttacaggtccttgtgaagtgcccaggacacccccagcccccatgtgtggcccccgcacgcacctgcggtgagacaggccgcggtgcagcctccactccttcctggctcgctgccgctgcctgaaaccgtacagctgcagcc

SEQ ID NO: 38746 - DNA, 348 bp, Homo sapiens; identical to SEQ ID NO: 14181
  misc_feature 1..348: note = chr1:2359972-2360320
  misc_feature 1..348: note = hypo
  source 1..348: mol_type = genomic DNA

SEQ ID NO: 38747 - DNA, 62 bp, Homo sapiens
  misc_feature 1..62: note = chr1:2382732-2382794
  misc_feature 1..62: note = hypo
  source 1..62: mol_type = genomic DNA
atgtgtgtgcctccccggcccccgaagatcatacgcagtagcgtctccgagggatgccacta

SEQ ID NO: 38748 - DNA, 195 bp, Homo sapiens
  misc_feature 1..195: note = chr1:2396998-2397193
  misc_feature 1..195: note = hypo
  source 1..195: mol_type = genomic DNA
tcctcacctgctgcccgccgcctgccgcccgccacctgccacccgccgggccaaatgctctcaaagacagaattctgcttaaatgcccagaaaagagatttaggagatcagaatcttaagcaaattaacatgtgcagcgggcggcttttaatcaccgcctttaatcgcaggccgcggtgacggaaatcatctcct

SEQ ID NO: 38749 - DNA, 187 bp, Homo sapiens
  misc_feature 1..187: note = chr1:2428198-2428385
  misc_feature 1..187: note = hypo
  source 1..187: mol_type = genomic DNA
tgctatgctgctgggcgccgggcgaggtcgaggactggcagtctgatgcccggtcaccggcgccacagcggcgtccagctggcaggtgtcgtccttcagcgagaccaaggcccaccagattctgcagcagaagccggcgcagtacctacgcttcaaccagcagcagctctcccgcatctacccctcc

SEQ ID NO: 38750 - DNA, 30 bp, Homo sapiens
  misc_feature 1..30: note = chr1:2430463-2430493
  misc_feature 1..30: note = hypo
  source 1..30: mol_type = genomic DNA
ggagcggtgctgggccgggccctccccatg

SEQ ID NO: 38751 - DNA, 30 bp, Homo sapiens
  misc_feature 1..30: note = chr1:2437269-2437299
  misc_feature 1..30: note = hypo
  source 1..30: mol_type = genomic DNA
ttaccaggtgcccgtcggagcctgcgccag

SEQ ID NO: 38752 - DNA, 136 bp, Homo sapiens
  misc_feature 1..136: note = chr1:2468656-2468792
  misc_feature 1..136: note = hypo
  source 1..136: mol_type = genomic DNA
tgcatgtgcccaggaatgctcacgcctgctcagatgtcctcagctgggccacccgtccccaccctgccccgctgccctaactcccagagtacccgcattggccgagcactgctctgtgccacgtgagccctgggcc

SEQ ID NO: 38753 - DNA, 30 bp, Homo sapiens; identical to SEQ ID NO: 14185
  misc_feature 1..30: note = chr1:2507045-2507075
  misc_feature 1..30: note = hypo
  source 1..30: mol_type = genomic DNA

SEQ ID NO: 38754 - DNA, 81 bp, Homo sapiens
  misc_feature 1..81: note = chr1:2519808-2519889
  misc_feature 1..81: note = hypo
  source 1..81: mol_type = genomic DNA
gcgacctggtgtcttcgcaggtacaacagcctgagcatcctcccagcagctctggggaagcccgtgcgtgatgtggctgcc

SEQ ID NO: 38755 - DNA, 51 bp, Homo sapiens
  misc_feature 1..51: note = chr1:2527420-2527471
  misc_feature 1..51: note = hypo
  source 1..51: mol_type = genomic DNA
ctgccctgacctctgcgagccacataccttctcctgcgccttcttcttgga

SEQ ID NO: 38756 - DNA, 66 bp, Homo sapiens; identical to SEQ ID NO: 14186
  misc_feature 1..66: note = chr1:2537084-2537150
  misc_feature 1..66: note = hypo
  source 1..66: mol_type = genomic DNA

SEQ ID NO: 38757 - DNA, 125 bp, Homo sapiens
  misc_feature 1..125: note = chr1:2537758-2537883
  misc_feature 1..125: note = hypo
  source 1..125: mol_type = genomic DNA
ctgtgagttcatcagcgccagctgccgctccagctcccactcgagtcctggggagacagtgccccgcactggagactggcgggccctggggccccagcccggccccttgtcggtgaatctggcct

SEQ ID NO: 38758 - DNA, 47 bp, Homo sapiens
  misc_feature 1..47: note = chr1:2702425-2702472
  misc_feature 1..47: note = hypo
  source 1..47: mol_type = genomic DNA
tggtgtgaaccctgccgtcggccccgcctggccgtgcccgcaggatg

SEQ ID NO: 38759 - DNA, 113 bp, Homo sapiens; identical to SEQ ID NO: 14188
  misc_feature 1..113: note = chr1:2708372-2708485
  misc_feature 1..113: note = hypo
  source 1..113: mol_type = genomic DNA

SEQ ID NO: 38760 - DNA, 503 bp, Homo sapiens
  misc_feature 1..503: note = chr1:2716736-2717239
  misc_feature 1..503: note = hypo
  source 1..503: mol_type = genomic DNA
agagccgccaggagtcgctggccaccggtctcctgctggccggcactgtgcccagcctccgggtgccccgagaggtagtcctggagggcactgagcagcgcggggaggtggggccgctggtgggtgcgaatgaaagctaccgtccggtcggcgctggaggcgaaggcctggagataggcggccacaccatccgctgcctgcaccccggacaggacccaggcgagggcgcgggtcagccgcagctccaggacttgctgtgcatgagagtccagcagggcgctgcagcgttgcaccacttcttcgtgacgcccgcgggccagcagacctgccagcaggtgcaggatggcggcggggtggtccgggcagagggcgccgaggaaggcagaggccagcgaccctgtcagggagaccactgccatgccgtcccagtggatggcggggatctggctgtccccgcggcaccaggactccagggtggccaccaccgccgccccccgagcctg

SEQ ID NO: 38761 - DNA, 163 bp, Homo sapiens
  misc_feature 1..163: note = chr1:2725529-2725692
  misc_feature 1..163: note = hypo
  source 1..163: mol_type = genomic DNA
aggagctggggctgccggcctcgcaggtgtggttggggtgggtggggctgccgtgggcctggctccatggctctgtgcaggtggcagccggcgccgcgtgtcgccacccacacaggaaaggcgagattggtggcagaggccgtgtccgcgtcatcatgggagc

SEQ ID NO: 38762 - DNA, 92 bp, Homo sapiens
  misc_feature 1..92: note = chr1:2725899-2725991
  misc_feature 1..92: note = hypo
  source 1..92: mol_type = genomic DNA
gggctggccctggcccgcttagcctggactcaggtgcctgtggccggctgctcgtgccttcccatcctggggcaacccggggagtggcagtg

SEQ ID NO: 38763 - DNA, 30 bp, Homo sapiens
  misc_feature 1..30: note = chr1:2733570-2733600
  misc_feature 1..30: note = hypo
  source 1..30: mol_type = genomic DNA
cagtgcccacggctgcggcatttactgaga

SEQ ID NO: 38764 - DNA, 90 bp, Homo sapiens
  misc_feature 1..90: note = chr1:2733660-2733750
  misc_feature 1..90: note = hypo
  source 1..90: mol_type = genomic DNA
ctttggaaacaaaagccatcattctattattttgtttttagtcatggtatttccatttacaaatatagtaactttcgatcgctgcaaaaa

SEQ ID NO: 38765 - DNA, 30 bp, Homo sapiens
  misc_feature 1..30: note = chr1:2770901-2770931
  misc_feature 1..30: note = hypo
  source 1..30: mol_type = genomic DNA
gaggaggaggggcagcgtcctaatgcgccg

SEQ ID NO: 38766 - DNA, 36 bp, Homo sapiens
  misc_feature 1..36: note = chr1:2826189-2826225
  misc_feature 1..36: note = hypo
  source 1..36: mol_type = genomic DNA
gggccctggatcctgcggagccggaagccagctgta

SEQ ID NO: 38767 - DNA, 36 bp, Homo sapiens
  misc_feature 1..36: note = chr1:2827849-2827885
  misc_feature 1..36: note = hypo
  source 1..36: mol_type = genomic DNA
gccaacacagataggcggtccactgtcccagtggga

SEQ ID NO: 38768 - DNA, 30 bp, Homo sapiens
  misc_feature 1..30: note = chr1:2830021-2830051
  misc_feature 1..30: note = hypo
  source 1..30: mol_type = genomic DNA
agaaaaaatgaccctcggcaatgtcccgtt

SEQ ID NO: 38769 - DNA, 161 bp, Homo sapiens
  misc_feature 1..161: note = chr1:2833818-2833979
  misc_feature 1..161: note = hypo
  source 1..161: mol_type = genomic DNA
ccctaaataataaatcgacgtcgtgtgtcgtggttctcgtacctgcgtgaatatttaaaacatgcaaacatgtgggagatgcatttgctgggaacaaaaggaacacacatatttaacccctgaaataaataaataaggcgaaggtgcgcagctggagacag

SEQ ID NO: 38770 - DNA, 30 bp, Homo sapiens
  misc_feature 1..30: note = chr1:2836432-2836462
  misc_feature 1..30: note = hypo
  source 1..30: mol_type = genomic DNA
gggaggtctttgcagcggcccgtcctgtcc

SEQ ID NO: 38771 - DNA, 34 bp, Homo sapiens
  misc_feature 1..34: note = chr1:2840699-2840733
  misc_feature 1..34: note = hypo
  source 1..34: mol_type = genomic DNA
cacaggaggatgagacggacggaagccaccacgc

SEQ ID NO: 38772 - DNA, 30 bp, Homo sapiens
  misc_feature 1..30: note = chr1:2846793-2846823
  misc_feature 1..30: note = hypo
  source 1..30: mol_type = genomic DNA
gcgcacacatgtgcacgcaggtcccagcat

SEQ ID NO: 38773 - DNA, 43 bp, Homo sapiens
  misc_feature 1..43: note = chr1:2889049-2889092
  misc_feature 1..43: note = hypo
  source 1..43: mol_type = genomic DNA
gggccccaagagactcggggtctgggaccgacattcataggaa

SEQ ID NO: 38774 - DNA, 30 bp, Homo sapiens
  misc_feature 1..30: note = chr1:2918482-2918512
  misc_feature 1..30: note = hypo
  source 1..30: mol_type = genomic DNA
caaactaaaggacagcgcccaccttctcgg

SEQ ID NO: 38775 - DNA, 30 bp, Homo sapiens
  misc_feature 1..30: note = chr1:2939161-2939191
  misc_feature 1..30: note = hypo
  source 1..30: mol_type = genomic DNA
cactaccctgttccacgggctggatgaccg

SEQ ID NO: 38776 - DNA, 45 bp, Homo sapiens
  misc_feature 1..45: note = chr1:3015491-3015536
  misc_feature 1..45: note = hypo
  source 1..45: mol_type = genomic DNA
ctgcttctcagtgcccgttgagtggctgagcggcctcactgagga

SEQ ID NO: 38777 - DNA, 141 bp, Homo sapiens
  misc_feature 1..141: note = chr1:3035035-3035176
  misc_feature 1..141: note = hypo
  source 1..141: mol_type = genomic DNA
gaagtggttggattccgggtagtgtggccaggggccttccccggcatgatggcatccgcccccagctcatggcccaggtctccatgaagatgaacaaaacaccaccaggagagggggaggcaaagccgggaaagaaccagg

SEQ ID NO: 38778 - DNA, 30 bp, Homo sapiens
  misc_feature 1..30: note = chr1:3063272-3063302
  misc_feature 1..30: note = hypo
  source 1..30: mol_type = genomic DNA
ctgcacatgtgtgctcggtgtgggttgtgt

SEQ ID NO: 38779 - DNA, 30 bp, Homo sapiens
  misc_feature 1..30: note = chr1:3070343-3070373
  misc_feature 1..30: note = hypo
  source 1..30: mol_type = genomic DNA
ttgagaagcgtggaacgcaaagtaatatag

SEQ ID NO: 38780 - DNA, 121 bp, Homo sapiens
  misc_feature 1..121: note = chr1:3078720-3078841
  misc_feature 1..121: note = hypo
  source 1..121: mol_type = genomic DNA
ggcgttcaatatgcccgggccactgcggaaccatcacccctctctgtgcccaggattttcccgtcaccccccaggaaaaccccgtgcccggtaaatagtgactctgcgtccctcctcccga

SEQ ID NO: 38781 - DNA, 160 bp, Homo sapiens
  misc_feature 1..160: note = chr1:3102636-3102796
  misc_feature 1..160: note = hypo
  source 1..160: mol_type = genomic DNA
acactgggtggggcacgtgctgcagaggttgacgctgcgttgtctcctttaggtgacggtgacgttgtaaataatatgtatgagcccaaccgggacctgctggccagccacagcgcggaggacgaggccgaggacagtgccatgtcgcccatccccgtgg

SEQ ID NO: 38782 - DNA, 136 bp, Homo sapiens
  misc_feature 1..136: note = chr1:3111327-3111463
  misc_feature 1..136: note = hypo
  source 1..136: mol_type = genomic DNA
gtattctcagtcccacgttttatcatctaaacgccaaaactcgttcctggcctgccctttctctccaaggttcccagatgcacgctccactgcccacaccacccccacggttgagtgggctcggccccgggacgtg

SEQ ID NO: 38783 - DNA, 35 bp, Homo sapiens
  misc_feature 1..35: note = chr1:3129231-3129266
  misc_feature 1..35: note = hypo
  source 1..35: mol_type = genomic DNA
tcctcccggccccctcgctgcggtcctctctgcca

SEQ ID NO: 38784 - DNA, 30 bp, Homo sapiens
  misc_feature 1..30: note = chr1:3179577-3179607
  misc_feature 1..30: note = hypo
  source 1..30: mol_type = genomic DNA
cggcggatgaggcatcgcaggggcaccagc

SEQ ID NO: 38785 - DNA, 70 bp, Homo sapiens
  misc_feature 1..70: note = chr1:3183016-3183086
  misc_feature 1..70: note = hypo
  source 1..70: mol_type = genomic DNA
gagactggggaggaccgagcggttcgcatttgcaaagctcttaatcagtgaactgcgttggaggcattgc

SEQ ID NO: 38786 - DNA, 60 bp, Homo sapiens
  misc_feature 1..60: note = chr1:3184625-3184685
  misc_feature 1..60: note = hypo
  source 1..60: mol_type = genomic DNA
tcaaaccatgacccccgaatctaacagggtgcccgtttgcacacacgtgggagcgtacgg

SEQ ID NO: 38787 - DNA, 172 bp, Homo sapiens
  misc_feature 1..172: note = chr1:3217156-3217328
  misc_feature 1..172: note = hypo
  source 1..172: mol_type = genomic DNA
ctggagcctcggaaccgcggtgcaactggggtgcgtttgtgccagggaaaatggattctgccggtgtctgactctaccaagatccacgcatcattgttagcatttcctttcatttctctttgttattatttgtcttttccaccttgtaccatccccccgaaccccatttatg

SEQ ID NO: 38788 - DNA, 30 bp, Homo sapiens
  misc_feature 1..30: note = chr1:3294711-3294741
  misc_feature 1..30: note = hypo
  source 1..30: mol_type = genomic DNA
aggtgcacatggctgcgaccttggacacca

SEQ ID NO: 38789 - DNA, 172 bp, Homo sapiens
  misc_feature 1..172: note = chr1:3321998-3322170
  misc_feature 1..172: note = hypo
  source 1..172: mol_type = genomic DNA
agaaccaggccaaggcgggtgtccaggcagggcacgcgccaacggcatccgtctccccaggtgttcacggaccccagcaaccttcagcggcacatccgctcgcagcacgtgggcgctcgggcccacgcctgccccgactgcgggaagaccttcgccacgtcctccggcctca

SEQ ID NO: 38790 - DNA, 186 bp, Homo sapiens
  misc_feature 1..186: note = chr1:3325403-3325589
  misc_feature 1..186: note = hypo
  source 1..186: mol_type = genomic DNA
gaggatgtgagagcacgagggtgggcacgtgagctggtgcgtgtgtgtgtgagagcgcatgagggtgggcgtgtgagccagtgcttgtgttggcacgcatgagagtgaggggcgtgtgagccagtgcatgtgttggcacgtgtgagagcatgtgagggttggcgtgtgagccggggcatgtcagtg

SEQ ID NO: 38791 - DNA, 30 bp, Homo sapiens
  misc_feature 1..30: note = chr1:3327976-3328006
  misc_feature 1..30: note = hypo
  source 1..30: mol_type = genomic DNA
ttctccaacctgtgccggcacaagcggatg

SEQ ID NO: 38792 - DNA, 146 bp, Homo sapiens
  misc_feature 1..146: note = chr1:3342175-3342321
  misc_feature 1..146: note = hypo
  source 1..146: mol_type = genomic DNA
tcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccaggtgggcc

SEQ ID NO: 38793 - DNA, 30 bp, Homo sapiens
  misc_feature 1..30: note = chr1:3350102-3350132
  misc_feature 1..30: note = hypo
  source 1..30: mol_type = genomic DNA
cccgccctgcccacgcgctcacctgcctgt

SEQ ID NO: 38794 - DNA, 33 bp, Homo sapiens
  misc_feature 1..33: note = chr1:3372809-3372842
  misc_feature 1..33: note = hypo
  source 1..33: mol_type = genomic DNA
tgaagcagtgagaagcggcgtgccagggtcccc

SEQ ID NO: 38795 - DNA, 36 bp, Homo sapiens
  misc_feature 1..36: note = chr1:3408534-3408570
  misc_feature 1..36: note = hypo
  source 1..36: mol_type = genomic DNA
atgcatgcactattgcgcagacgcactggctacatt

SEQ ID NO: 38796 - DNA, 255 bp, Homo sapiens
  misc_feature 1..255: note = chr1:3411032-3411287
  misc_feature 1..255: note = hypo
  source 1..255: mol_type = genomic DNA
caggcggctccgtagcgcccagggggacaggctggggacagggcagggtgggcagtccttcggcaccagccttgcccagccctatggcagcccagggcacctccctgaggggatgctggggtcccgctggccccgcacactcacccagctcgcagtgccgccccgtccagcccaggccacaggagcagctgccgttgctggcgtggcacaggcccccatttctgcaggagcaggtgtgctcgcagcccacgccaa

SEQ ID NO: 38797 - DNA, 30 bp, Homo sapiens
  misc_feature 1..30: note = chr1:3417138-3417168
  misc_feature 1..30: note = hypo
  source 1..30: mol_type = genomic DNA
atatgtgtgcgtgtgcgcactcaggagggt

SEQ ID NO: 38798 - DNA, 109 bp, Homo sapiens
  misc_feature 1..109: note = chr1:3463596-3463705
  misc_feature 1..109: note = hypo
  source 1..109: mol_type = genomic DNA
ctgggggggggccagcggcagtagaagccccccacggtgtcccggcaccgacccgcacagcccccgttggcgttggcacactcacccacatctgcgaggggagaagcag

SEQ ID NO: 38799 - DNA, 69 bp, Homo sapiens
  misc_feature 1..69: note = chr1:3466914-3466983
  misc_feature 1..69: note = hypo
  source 1..69: mol_type = genomic DNA
gaaaggagcccatctcgagaggtcacacagtgtaggatagggcgtaccagctggcgggtctggggtctc

SEQ ID NO: 38800 - DNA, 346 bp, Homo sapiens
  misc_feature 1..346: note = chr1:3467198-3467544
  misc_feature 1..346: note = hypo
  source 1..346: mol_type = genomic DNA
gcctccggggtgctccgtgccggatctggccccatgccaggggcctaactcagcagcagtgactgcaatgtcacaagtgcccagcagccacccaaccggggcagggctccgaagacccagcccttgcagccgatccagcaagcacaggctgcagagtgagaacccgaggggagcaagagggggcccacacccccaccgcccgtgcactcaccctgggggagccagtgtcccccgtgtgctagtccattggcaggagaccctaacgggtgtgacagtggggctctcagatcagccgccaggtgtggacagggccaggatccgaggctccagccggccagggctgggc

SEQ ID NO: 38801 - DNA, 30 bp, Homo sapiens
  misc_feature 1..30: note = chr1:3470143-3470173
  misc_feature 1..30: note = hypo
  source 1..30: mol_type = genomic DNA
caggagcaggatttacgaggccctgcctgc

SEQ ID NO: 38802 - DNA, 30 bp, Homo sapiens
  misc_feature 1..30: note = chr1:3601838-3601868
  misc_feature 1..30: note = hypo
  source 1..30: mol_type = genomic DNA
ccctgagctccatatcggggtctggtccga

SEQ ID NO: 38803 - DNA, 94 bp, Homo sapiens
  misc_feature 1..94: note = chr1:3607472-3607566
  misc_feature 1..94: note = hypo
  source 1..94: mol_type = genomic DNA
ctgtacgtcggtgaccccgcacggcacctcgccacggtaggtgtgacgcgccattcataggatctcttcggggactttgcgggggattttgctg

SEQ ID NO: 38804 - DNA, 57 bp, Homo sapiens
  misc_feature 1..57: note = chr1:3644717-3644774
  misc_feature 1..57: note = hypo
  source 1..57: mol_type = genomic DNA
ccccgcccttggtgccggtgtgaagaagcggcggcatggagacgaggacacgtacta

SEQ ID NO: 38805 - DNA, 15 bp, Homo sapiens
  misc_feature 1..15: note = chr1:3659628-3659643
  misc_feature 1..15: note = hypo
  source 1..15: mol_type = genomic DNA
tctctttagggaagc

SEQ ID NO: 38806 - DNA, 30 bp, Homo sapiens
  misc_feature 1..30: note = chr1:3661766-3661796
  misc_feature 1..30: note = hypo
  source 1..30: mol_type = genomic DNA
tcaccccattcactccgttcctgccagcag

SEQ ID NO: 38807 - DNA, 30 bp, Homo sapiens
  misc_feature 1..30: note = chr1:3678034-3678064
  misc_feature 1..30: note = hypo
  source 1..30: mol_type = genomic DNA
cggttgttttcaaagcgtccaaagctgcta

SEQ ID NO: 38808 - DNA, 68 bp, Homo sapiens
  misc_feature 1..68: note = chr1:3680032-3680100
  misc_feature 1..68: note = hypo
  source 1..68: mol_type = genomic DNA
caacaggtagggcctcggcggggggcactgggctttggccactcagtggttcccggcccaggagctgg

SEQ ID NO: 38809 - DNA, 30 bp, Homo sapiens
  misc_feature 1..30: note = chr1:3680304-3680334
  misc_feature 1..30: note = hypo
  source 1..30: mol_type = genomic DNA
caagaaacccagctgcgaaagatcaatacg

SEQ ID NO: 38810 - DNA, 149 bp, Homo sapiens
  misc_feature 1..149: note = chr1:3683695-3683844
  misc_feature 1..149: note = hypo
  source 1..149: mol_type = genomic DNA
cctggccgccggccatcttttaggaaaaagtggatgggtgccacacatactcaggttgggcgaaatgaccccacctcttttttctccccggctgtccccagcaagtgtcggaactggagagaaagctcaccaagcgggactgtgtcatc

SEQ ID NO: 38811 - DNA, 85 bp, Homo sapiens
  misc_feature 1..85: note = chr1:3684064-3684149
  misc_feature 1..85: note = hypo
  source 1..85: mol_type = genomic DNA
caggcctctgcccaccgcccaccgaggtagaaccggggtctgtgtacgctggggctcgggctggttctgccgtgtacaccagcat

SEQ ID NO: 38812 - DNA, 30 bp, Homo sapiens
  misc_feature 1..30: note = chr1:3786550-3786580
  misc_feature 1..30: note = hypo
  source 1..30: mol_type = genomic DNA
gagggctgcagggcccgccccagggcttgt

SEQ ID NO: 38813 - DNA, 193 bp, Homo sapiens
  misc_feature 1..193: note = chr1:4082814-4083007
  misc_feature 1..193: note = hypo
  source 1..193: mol_type = genomic DNA
gtttttggccccaaacgtcagtggcgctgagcagagcaaccctgatttagcgactccttgttggtcctggctcccagtgtgttggggacgtgatgcgggtgactctgctgtgggctcacaggctctgctggttccatggacagaaataaagtggaacttcatgctgctggaactcgggcggttgtgctgcgtt

SEQ ID NO: 38814 - DNA, 151 bp, Homo sapiens; identical to SEQ ID NO: 14198
  misc_feature 1..151: note = chr1:4111083-4111234
  misc_feature 1..151: note = hypo
  source 1..151: mol_type = genomic DNA

SEQ ID NO: 38815 - DNA, 175 bp, Homo sapiens
  misc_feature 1..175: note = chr1:4212772-4212947
  misc_feature 1..175: note = hypo
  source 1..175: mol_type = genomic DNA
gtgtttcagaatggacgcagaaccagagacagaaaatctctcctctgagctgcttggtgtcattcccccaggatgccaggaaagcctgagcccagtgctccagtgacaggccccctccccaatccaggagcgatagcagacacgaggggtgatggggatgcgacagcccgtggca

SEQ ID NO: 38816 - DNA, 30 bp, Homo sapiens
  misc_feature 1..30: note = chr1:4279385-4279415
  misc_feature 1..30: note = hypo
  source 1..30: mol_type = genomic DNA
ggaggcagggtggatcgtgccttcctgtgt

SEQ ID NO: 38817 - DNA, 152 bp, Homo sapiens
  misc_feature 1..152: note = chr1:4402113-4402265
  misc_feature 1..152: note = hypo
  source 1..152: mol_type = genomic DNA
actgctgtgtgtccccgcggattcaggcggctctgatcccacctgataggtagacaagaacgcacttggcaactagtagccactcacctggtacccgggccatgtggacctgccctagtgtggcctcgcttactgcccgccagggactctca

SEQ ID NO: 38818 - DNA, 30 bp, Homo sapiens
  misc_feature 1..30: note = chr1:4426176-4426206
  misc_feature 1..30: note = hypo
  source 1..30: mol_type = genomic DNA
ccagatgccacacatcggcctgcaccttga

SEQ ID NO: 38819 - DNA, 51 bp, Homo sapiens
  misc_feature 1..51: note = chr1:4486515-4486566
  misc_feature 1..51: note = hypo
  source 1..51: mol_type = genomic DNA
gtttgcggaatgaaacgactttgccaaagccatggccgcagacatacgatg

SEQ ID NO: 38820 - DNA, 41 bp, Homo sapiens
  misc_feature 1..41: note = chr1:4542688-4542729
  misc_feature 1..41: note = hypo
  source 1..41: mol_type = genomic DNA
ccgaacgctgtcctgcgtggccaccacgtgctcctccctgc

SEQ ID NO: 38821 - DNA, 68 bp, Homo sapiens
  misc_feature 1..68: note = chr1:4652230-4652298
  misc_feature 1..68: note = hypo
  source 1..68: mol_type = genomic DNA
cttgagtaaatcctccgaaaacggggagcagtagaggtggggccaacgcgtgacgatgggcctgaaat

SEQ ID NO: 38822 - DNA, 30 bp, Homo sapiens
  misc_feature 1..30: note = chr1:4659583-4659613
  misc_feature 1..30: note = hypo
  source 1..30: mol_type = genomic DNA
tagaaagggctgcctcgggcagggggctgc

SEQ ID NO: 38823 - DNA, 124 bp, Homo sapiens
  misc_feature 1..124: note = chr1:4677050-4677174
  misc_feature 1..124: note = hypo
  source 1..124: mol_type = genomic DNA
tcacagtggacaggccgaccgcccttgaactcgtgacgggccccgctgaggctagaggtccccccctcacagtggacatgccgaccacccttgaacttgcgacaggccccgctgaggctagagg

SEQ ID NO: 38824 - DNA, 23 bp, Homo sapiens
  misc_feature 1..23: note = chr1:4711648-4711671
  misc_feature 1..23: note = hypo
  source 1..23: mol_type = genomic DNA
taataataagctgggcgcggtgg

SEQ ID NO: 38825 - DNA, 235 bp, Homo sapiens
  misc_feature 1..235: note = chr1:4726593-4726828
  misc_feature 1..235: note = hypo
  source 1..235: mol_type = genomic DNA
atcacgggaggggtgcggagaggggcccgtgaatcacgggaggggtgcggagaggggcccgtgaatcacgggaggggtgcggagaggtgcctgtgaatcatgggaggggtgcggagagcgggcctgtgattcaccagagggttgcagagagaggcccaagaatcgcgggaggggtgcggagaggggcctgtgaatcacgggaggggtgcggagaggggcccgtgaatcacgggag

SEQ ID NO: 38826 - DNA, 148 bp, Homo sapiens
  misc_feature 1..148: note = chr1:4772507-4772655
  misc_feature 1..148: note = hypo
  source 1..148: mol_type = genomic DNA
agtccaacacatttccgggcgtttacggccccaccacggtctccatcctacaaacacggaagacaactgtggccgccaccaccaccaccaccaccacggccacccccatgacgctgcagactaaggggttcaccgagtccttggatcc

SEQ ID NO: 38827 - DNA, 143 bp, Homo sapiens
  misc_feature 1..143: note = chr1:4782357-4782500
  misc_feature 1..143: note = hypo
  source 1..143: mol_type = genomic DNA
ggtgcaagttcacagcgcagaggcgatccgtggtttgcacacttgtcctgtgcacggcaggacctgtggcgtccatacctgcctcattctgtgactgttatgaatctctgctctagtcctagacattccgaaagcagccgttc

SEQ ID NO: 38828 - DNA, 43 bp, Homo sapiens
  misc_feature 1..43: note = chr1:5893925-5893968
  misc_feature 1..43: note = hypo
  source 1..43: mol_type = genomic DNA
aatgccttctgccaacgtcactcaggagcgttcccatgggagt

SEQ ID NO: 38829 - DNA, 38 bp, Homo sapiens
  misc_feature 1..38: note = chr1:5894998-5895036
  misc_feature 1..38: note = hypo
  source 1..38: mol_type = genomic DNA
cagatgatgagtgcacgtgggtgcgatgctgctgcggg

SEQ ID NO: 38830 - DNA, 30 bp, Homo sapiens
  misc_feature 1..30: note = chr1:6046247-6046277
  misc_feature 1..30: note = hypo
  source 1..30: mol_type = genomic DNA
gacacactggaatgccgtggattccttcca

SEQ ID NO: 38831 - DNA, 148 bp, Homo sapiens
  misc_feature 1..148: note = chr1:6071300-6071448
  misc_feature 1..148: note = hypo
  source 1..148: mol_type = genomic DNA
caagtgtgcaggaggcgaggcaggcagctgtgcccagggccaggtgtgcgggagacaggcaggcggctgtgcccagggccaagtgtgcgggagacaggcaggcggctgtgcccagggccaggtgtgcgggaggcgaggcaggcagctg

SEQ ID NO: 38832 - DNA, 30 bp, Homo sapiens
  misc_feature 1..30: note = chr1:6131731-6131761
  misc_feature 1..30: note = hypo
  source 1..30: mol_type = genomic DNA
cgtagggctctgctgcgtaggactcctgcc

SEQ ID NO: 38833 - DNA, 154 bp, Homo sapiens
  misc_feature 1..154: note = chr1:6166315-6166469
  misc_feature 1..154: note = hypo
  source 1..154: mol_type = genomic DNA
aacacagggaagtctcgaggacggctagatatctgtcaaaaaaagaggagagccgggcttgcctgacgttggcagcagcaggcaggccgggcccggcgggcacccgtgtgcatgctgcccggagcggacgggcacctaccggtcacatagggcc

SEQ ID NO: 38834 - DNA, 171 bp, Homo sapiens
  misc_feature 1..171: note = chr1:6171763-6171934
  misc_feature 1..171: note = hypo
  source 1..171: mol_type = genomic DNA
tcagagggctctccccgaggtccacggaggaacgggcaagtccctgcccagcccggcctggccaaggatacgtcacgatgcccgccagcagccagtagtcatggcgccggtgccagatgtcgtagattttcccagaggatacagcagcccgctcctcgttctgccacagcg

SEQ ID NO: 38835 - DNA, 54 bp, Homo sapiens
  misc_feature 1..54: note = chr1:6280243-6280297
  misc_feature 1..54: note = hypo
  source 1..54: mol_type = genomic DNA
agttttgattttccccgtgtttgcatggcatgaagtcttcgtccttgtcacagt

SEQ ID NO: 38836 - DNA, 30 bp, Homo sapiens; identical to SEQ ID NO: 14204
  misc_feature 1..30: note = chr1:6360980-6361010
  misc_feature 1..30: note = hypo
  source 1..30: mol_type = genomic DNA

SEQ ID NO: 38837 - DNA, 111 bp, Homo sapiens
  misc_feature 1..111: note = chr1:6391430-6391541
  misc_feature 1..111: note = hypo
  source 1..111: mol_type = genomic DNA
cagaagcttcagtgacgcagcctcagccaagggacgcctggagccacccggcgctggagacgccaggagggatcctcgcctggggccaatggagggcgcagggccttgccc

SEQ ID NO: 38838 - DNA, 222 bp, Homo sapiens
  misc_feature 1..222: note = chr1:6446131-6446353
  misc_feature 1..222: note = hypo
  source 1..222: mol_type = genomic DNA
tgagttccacctgggcggagttccacctgggcagagaggtcttggctcacaggcaccgggagagctggaaggctgcggggaagccgaggaaggccaacacaccgcacaacacggcaggtgcctggccctcctctgacagtggccctcaagctccaggagggccgaggaaaatgcagattcctgggcctacccctccctgaccttccccgcccctggagttag

SEQ ID NO: 38839 - DNA, 30 bp, Homo sapiens
  misc_feature 1..30: note = chr1:6635034-6635064
  misc_feature 1..30: note = hypo
  source 1..30: mol_type = genomic DNA
ggtgtttttcgagtccgtggtgctgaccaa

SEQ ID NO: 38840 - DNA, 30 bp, Homo sapiens
  misc_feature 1..30: note = chr1:6801549-6801579
  misc_feature 1..30: note = hypo
  source 1..30: mol_type = genomic DNA
aatgaaggcattggccgagctgtgttcctg

SEQ ID NO: 38841 - DNA, 195 bp, Homo sapiens
  misc_feature 1..195: note = chr1:6984148-6984343
  misc_feature 1..195: note = hypo
  source 1..195: mol_type = genomic DNA
gcctggctggccacacggcatgactttgttcatgtcatgaatatttattgaacacctgccacatgccaggcactgttcccgggactgggtgtgaatagtgcacaagagggaagcctccctgctctcttggcgcttaccttctagctggggagactggaaacataaagatggtgcaaaggccgagtggagaaaaac

SEQ ID NO: 38842 - DNA, 30 bp, Homo sapiens
  misc_feature 1..30: note = chr1:7067759-7067789
  misc_feature 1..30: note = hypo
  source 1..30: mol_type = genomic DNA
gtggggctcccggggcgtcgcttctgcctc

SEQ ID NO: 38843 - DNA, 30 bp, Homo sapiens
  misc_feature 1..30: note = chr1:7162881-7162911
  misc_feature 1..30: note = hypo
  source 1..30: mol_type = genomic DNA
tccctgggttatgagcgagcccttttattc

SEQ ID NO: 38844 - DNA, 30 bp, Homo sapiens
  misc_feature 1..30: note = chr1:7729014-7729044
  misc_feature 1..30: note = hypo
  source 1..30: mol_type = genomic DNA
gctccacctgtccgccggcactcttctcag

SEQ ID NO: 38845 - DNA, 39 bp, Homo sapiens
  misc_feature 1..39: note = chr1:10103760-10103799
  misc_feature 1..39: note = hypo
  source 1..39: mol_type = genomic DNA
caggcgtgatccaacgcgctgggccgggatgcttcttat

SEQ ID NO: 38846 - DNA, 30 bp, Homo sapiens
  misc_feature 1..30: note = chr1:10166597-10166627
  misc_feature 1..30: note = hypo
  source 1..30: mol_type = genomic DNA
agtgccacgagcagacgcccctcctccctg

SEQ ID NO: 38847 - DNA, 18 bp, Homo sapiens
  misc_feature 1..18: note = chr1:10959337-10959355
  misc_feature 1..18: note = hypo
  source 1..18: mol_type = genomic DNA
taccctgtagggggccgg

SEQ ID NO: 38848 - DNA, 101 bp, Homo sapiens
  misc_feature 1..101: note = chr1:11036267-11036368
  misc_feature 1..101: note = hypo
  source 1..101: mol_type = genomic DNA
gctccatgggaacaccgtgggctgaacacaggcaagccagacggccctgcgggagaggagggaagggggtggggacatgcaccgcccagctgctgcctcat

SEQ ID NO: 38849 - DNA, 80 bp, Homo sapiens
  misc_feature 1..80: note = chr1:11073881-11073961
  misc_feature 1..80: note = hypo
  source 1..80: mol_type = genomic DNA
cccagtttccaggggcgtgtgggcttcgctacaggaatccagtgtctcagtgtatgagaggtgtccggctggtagaagga

SEQ ID NO: 38850 - DNA, 38 bp, Homo sapiens
  misc_feature 1..38: note = chr1:11131698-11131736
  misc_feature 1..38: note = hypo
  source 1..38: mol_type = genomic DNA
cagagtaaaaggcagcgtcatcccgtgggcctctgctg

SEQ ID NO: 38851 - DNA, 30 bp, Homo sapiens
  misc_feature 1..30: note = chr1:11139771-11139801
  misc_feature 1..30: note = hypo
  source 1..30: mol_type = genomic DNA
agcaggggcatctctcgggcctgctggatt

SEQ ID NO: 38852 - DNA, 30 bp, Homo sapiens
  misc_feature 1..30: note = chr1:11417987-11418017
  misc_feature 1..30: note = hypo
  source 1..30: mol_type = genomic DNA
ctgcggaaagcagggcgcatgcaggcggag

SEQ ID NO: 38853 - DNA, 75 bp, Homo sapiens
  misc_feature 1..75: note = chr1:11596484-11596559
  misc_feature 1..75: note = hypo
  source 1..75: mol_type = genomic DNA
cttcttctgcatcatcgccccatttgccaagttcggcaagattgtggcactcaacacgggcgtgtccatcctcta

SEQ ID NO: 38854 - DNA, 76 bp, Homo sapiens
  misc_feature 1..76: note = chr1:11792825-11792901
  misc_feature 1..76: note = hypo
  source 1..76: mol_type = genomic DNA
agcccctccttctcccgtgaggcagtcacagaacaagaattcctcctttggcaggggatgaggtgactcaagtctg

SEQ ID NO: 38855 - DNA, 83 bp, Homo sapiens
  misc_feature 1..83: note = chr1:11854720-11854803
  misc_feature 1..83: note = hypo
  source 1..83: mol_type = genomic DNA
cttcttctgccctcccgctcccaagaacaaagatgtatttgcaaggaaggtctgcaggccctcaccagcggccgttagggaac

SEQ ID NO: 38856 - DNA, 85 bp, Homo sapiens
  misc_feature 1..85: note = chr1:11936694-11936779
  misc_feature 1..85: note = hypo
  source 1..85: mol_type = genomic DNA
gatgtgaagtagcttcgggcagaactccaaaccttagagagatcatttgaaaataccatttgggctgggcgcagtggctcatgcc

SEQ ID NO: 38857 - DNA, 76 bp, Homo sapiens
  misc_feature 1..76: note = chr1:12078805-12078881
  misc_feature 1..76: note = hypo
  source 1..76: mol_type = genomic DNA
gtccttatcttctggcgcaaagcgggcactcgctaaaaacctgaatgaaagtataaagcaggccgggcgcagtggc

SEQ ID NO: 38858 - DNA, 543 bp, Homo sapiens
  misc_feature 1..543: note = chr1:12251415-12251958
  misc_feature 1..543: note = hypo
  source 1..543: mol_type = genomic DNA
cgaggagcaggactgcggggaggagcgaaactgctgggaagagcgggactgcggggaagagcgggacttcggggaggagcggcactgcggggaggagcaggactgcagggaggagcgggactgtggggaggagcgggacttcggggaggagcgggactgcgggggacgagcgcgactgcgggggacgagcaggactgcggagagtagcgggactgcggagagtagcgggactgcggagagtagcaggactgccggtcctgcccctggactctggccggtgttgtgtgtgccccatgctgaggcggtccgccagcctcctggagatccgctgtctgagagtgctgggctgtctgggagggcagcgtgggtgtggcggaggcaggcgtgaccgtttgccgccctctcgctgctctagaccaggtggaaactcaagcctgcactcgggaacagaaccgcatctgcacctgcaggcccggctggtactgcgcgctgagcaagcaggaggggtgccggctgtgcgcgccgctgcgcaagtgccgcccg

SEQ ID NO: 38859 - DNA, 17 bp, Homo sapiens
  misc_feature 1..17: note = chr1:12805063-12805080
  misc_feature 1..17: note = hypo
  source 1..17: mol_type = genomic DNA
aacgcatgcctcctctg

SEQ ID NO: 38860 - DNA, 194 bp, Homo sapiens
  misc_feature 1..194: note = chr1:14139406-14139600
  misc_feature 1..194: note = hypo
  source 1..194: mol_type = genomic DNA
tacagagggggaaaccgaggctccgaggccgagcgacagggagtggcttaccctgggccatacagtcaatgagaatgaggattattagaggccacccccaggtctccagcggccatactgcatcctcctggggtgatgacttctccatatgagtccaccaaccgcaactgctgcagtcacgacactgtgctgat

SEQ ID NO: 38861 - DNA, 60 bp, Homo sapiens; identical to SEQ ID NO: 14211
  misc_feature 1..60: note = chr1:14730412-14730472
  misc_feature 1..60: note = hypo
  source 1..60: mol_type = genomic DNA

SEQ ID NO: 38862 - DNA, 30 bp, Homo sapiens
  misc_feature 1..30: note = chr1:15651124-15651154
  misc_feature 1..30: note = hypo
  source 1..30: mol_type = genomic DNA
ggtgagagaggaggacgcccaaggtagaaa

SEQ ID NO: 38863 - DNA, 30 bp, Homo sapiens
  misc_feature 1..30: note = chr1:15928989-15929019
  misc_feature 1..30: note = hypo
  source 1..30: mol_type = genomic DNA
tgactataatttctccggtcatgtttcctt

SEQ ID NO: 38864 - DNA, 88 bp, Homo sapiens
  misc_feature 1..88: note = chr1:16059358-16059446
  misc_feature 1..88: note = hypo
  source 1..88: mol_type = genomic DNA
ctcctgcctcagccccgggggtgagtgcctgctgctcttaaaacaaacccagaagagtcctcactgtccttgccgtctcttgctgcgc

SEQ ID NO: 38865 - DNA, 213 bp, Homo sapiens
  misc_feature 1..213: note = chr1:16475124-16475337
  misc_feature 1..213: note = hypo
  source 1..213: mol_type = genomic DNA
gcgccacacaggcaccgatatcctggaaggccaggtagaagcctttgcgggtgagcggccccacggagcgctcctccacgttcagcttcacgtggcgtgcctcgaagtcgctgctgacggtgatctcatcgggcgcaatggtgtcaatcttggtgaacaggcgcttctggaagttggtgccgtagtccaggtccgactcggcatagtagaggt

SEQ ID NO: 38866 - DNA, 243 bp, Homo sapiens
  misc_feature 1..243: note = chr1:16534520-16534763
  misc_feature 1..243: note = hypo
  source 1..243: mol_type = genomic DNA
ccgggtcatcagctccgatgccgagaagcgcctccgctcaggaccttcgaggctcactcgggtggacccagacaactccaccctgggctcctctgtgctcagggcctgctcttgcactacctggccaggctctaggaagacagcgtgggcctcggggcagccggggacctcttcacgctggtacacccgcatcttgcgccctagggttgggggcaaggagtgagagcacgggctggggtctcc

SEQ ID NO: 38867 - DNA, 67 bp, Homo sapiens
  misc_feature 1..67: note = chr1:16535138-16535205
  misc_feature 1..67: note = hypo
  source 1..67: mol_type = genomic DNA
ggcagacttcttctccgagccgtggctggcccggcgctgtggctgtgtgtgtcggggactccagggt

SEQ ID NO: 38868 - DNA, 30 bp, Homo sapiens
  misc_feature 1..30: note = chr1:16736310-16736340
  misc_feature 1..30: note = hypo
  source 1..30: mol_type = genomic DNA
agctgaggtgggcaccggggtcagggtcct

SEQ ID NO: 38869 - DNA, 30 bp, Homo sapiens
  misc_feature 1..30: note = chr1:17757538-17757568
  misc_feature 1..30: note = hypo
  source 1..30: mol_type = genomic DNA
tatttgttggccaggcgcggtggctcacac

SEQ ID NO: 38870 - DNA, 20 bp, Homo sapiens
  misc_feature 1..20: note = chr1:17787462-17787482
  misc_feature 1..20: note = hypo
  source 1..20: mol_type = genomic DNA
tggctcacgccggatcgcct

SEQ ID NO: 38871 - DNA, 16 bp, Homo sapiens
  misc_feature 1..16: note = chr1:18058862-18058878
  misc_feature 1..16: note = hypo
  source 1..16: mol_type = genomic DNA
tcgtctaaaaaaaaaa

SEQ ID NO: 38872 - DNA, 63 bp, Homo sapiens
  misc_feature 1..63: note = chr1:18703385-18703448
  misc_feature 1..63: note = hypo
  source 1..63: mol_type = genomic DNA
gctggagcgggttcccgccgagctcaatggctccatgtatcgctgcaccgcccagaacccact

SEQ ID NO: 38873 - DNA, 30 bp, Homo sapiens
  misc_feature 1..30: note = chr1:18818951-18818981
  misc_feature 1..30: note = hypo
  source 1..30: mol_type = genomic DNA
tcatggagtaagaatcgcttcaaggttgtt

SEQ ID NO: 38874 - DNA, 68 bp, Homo sapiens
  misc_feature 1..68: note = chr1:19213653-19213721
  misc_feature 1..68: note = hypo
  source 1..68: mol_type = genomic DNA
ggtgttggtccaaaccgcaccattttgtcagctccccgctattttgcagacctcgggccaagtgaaac

SEQ ID NO: 38875 - DNA, 103 bp, Homo sapiens
  misc_feature 1..103: note = chr1:19676719-19676822
  misc_feature 1..103: note = hypo
  source 1..103: mol_type = genomic DNA
ccggcgctgaggccccgcagctcctgtgctgcagcccgagaggaaagggcctgggcttgtctaggcctccatgtctttgccttcacctcgcactaaataaaca

SEQ ID NO: 38876 - DNA, 35 bp, Homo sapiens
  misc_feature 1..35: note = chr1:20492304-20492339
  misc_feature 1..35: note = hypo
  source 1..35: mol_type = genomic DNA
tgtgtgtgtgtgtgcgcgcgcgcatgtgtgtttag

SEQ ID NO: 38877 - DNA, 25 bp, Homo sapiens
  misc_feature 1..25: note = chr1:20534656-20534681
  misc_feature 1..25: note = hypo
  source 1..25: mol_type = genomic DNA
agtgagaccccgcatccaaaagaaa

SEQ ID NO: 38878 - DNA, 317 bp, Homo sapiens
  misc_feature 1..317: note = chr1:21042770-21043087
  misc_feature 1..317: note = hypo
  source 1..317: mol_type = genomic DNA
taagagcagcacctgcggggctctcacagggtgcatacagggcttctttcgtgcatgggcacaggaagcactgccatacacaggtgatggcccaatgtctgcctgcaatgcagggagctggacacgtacaggtgattctcgtggcgggctatggggcggggcacacagcgacaagagtccaggcagccagccggcagggacagggagtacaaagaagcgaaaacaggatggcacaggaagaacgaagcacagctttccaggcggcaaagacagggagaactgggggagctgggagtggggctcgtactttgccaggt

SEQ ID NO: 38879 - DNA, 30 bp, Homo sapiens
  misc_feature 1..30: note = chr1:21523157-21523187
  misc_feature 1..30: note = hypo
  source 1..30: mol_type = genomic DNA
acccgtaggatgcagcgaatggcccctgcc

SEQ ID NO: 38880 - DNA, 30 bp, Homo sapiens
  misc_feature 1..30: note = chr1:21568339-21568369
  misc_feature 1..30: note = hypo
  source 1..30: mol_type = genomic DNA
gagcgagggtctgatcgatctgaccggtca

SEQ ID NO: 38881 - DNA, 17 bp, Homo sapiens
  misc_feature 1..17: note = chr1:21573345-21573362
  misc_feature 1..17: note = hypo
  source 1..17: mol_type = genomic DNA
ctcgccatgttgcccag

SEQ ID NO: 38882 - DNA, 30 bp, Homo sapiens
  misc_feature 1..30: note = chr1:21574092-21574122
  misc_feature 1..30: note = hypo
  source 1..30: mol_type = genomic DNA
agatgcagcagctgccgctaccattcagca

SEQ ID NO: 38883 - DNA, 30 bp, Homo sapiens
  misc_feature 1..30: note = chr1:21611198-21611228
  misc_feature 1..30: note = hypo
  source 1..30: mol_type = genomic DNA
gctgcctggggcccacgagacaagccggga

SEQ ID NO: 38884 - DNA, 120 bp, Homo sapiens
  misc_feature 1..120: note = chr1:22092109-22092229
  misc_feature 1..120: note = hypo
  source 1..120: mol_type = genomic DNA
aaaaaaaaagggggggacagcccgaagctgaacaaggcatgagacgttccgaagctaaacaaggtgtgagacataactaacaatttttctagtggaagatgaggtcttaaaaagccaatt

SEQ ID NO: 38885 - DNA, 25 bp, Homo sapiens
  misc_feature 1..25: note = chr1:22378609-22378634
  misc_feature 1..25: note = hypo
  source 1..25: mol_type = genomic DNA
gaactggtagtgggccgggcgcggt

SEQ ID NO: 38886 - DNA, 119 bp, Homo sapiens
  misc_feature 1..119: note = chr1:22447958-22448077
  misc_feature 1..119: note = hypo
  source 1..119: mol_type = genomic DNA
ctgtcctgtcacagccgcacttctccagctccccactgctgcacgcccgcgtcactgcaaaggccacacctgccgaagagatggcgtacacgaaggccgcctcccgagtccctgtggga

SEQ ID NO: 38887 - DNA, 184 bp, Homo sapiens
  misc_feature 1..184: note = chr1:22777513-22777697
  misc_feature 1..184: note = hypo
  source 1..184: mol_type = genomic DNA
agggtggcaaggggacgcttcaacagggaacgcatagtgtgtgagaaggaaaatgagcaaaagaaaagctaggactaaatcccaaagcccctaaatcccaaaattgggaggtgcgagaggcaggatcaggatgcctccaggatgccttcagcccactgcgccccaccagcgccaagcctgtccc

SEQ ID NO: 38888 - DNA, 30 bp, Homo sapiens
  misc_feature 1..30: note = chr1:22900903-22900933
  misc_feature 1..30: note = hypo
  source 1..30: mol_type = genomic DNA
ccactgccagaactccgttcatcctgcaaa

SEQ ID NO: 38889 - DNA, 179 bp, Homo sapiens
  misc_feature 1..179: note = chr1:22927402-22927581
  misc_feature 1..179: note = hypo
  source 1..179: mol_type = genomic DNA
gtggaggaggggtaccgcctgcccgcacccatgggctgcccccacgccctgcaccagctcatgctcgactgttggcacaaggaccgggcgcagcggcctcgcttctcccagattgtcagtgtcctcgatgcgctcatccgcagccctgagagtctcagggccaccgccacagtcagcag

SEQ ID NO: 38890 - DNA, 33 bp, Homo sapiens
  misc_feature 1..33: note = chr1:23694078-23694111
  misc_feature 1..33: note = hypo
  source 1..33: mol_type = genomic DNA
agatagacttaatcacgccgacttcttgggagt

SEQ ID NO: 38891 - DNA, 40 bp, Homo sapiens
  misc_feature 1..40: note = chr1:23704242-23704282
  misc_feature 1..40: note = hypo
  source 1..40: mol_type = genomic DNA
tcacccaaggttggccggacgcagtggcttacgcctgtaa

SEQ ID NO: 38892 - DNA, 30 bp, Homo sapiens
  misc_feature 1..30: note = chr1:23833122-23833152
  misc_feature 1..30: note = hypo
  source 1..30: mol_type = genomic DNA
agcaggctggccaggcgtgtggccaccatg

SEQ ID NO: 38893 - DNA, 30 bp, Homo sapiens
  misc_feature 1..30: note = chr1:23859450-23859480
  misc_feature 1..30: note = hypo
  source 1..30: mol_type = genomic DNA
gtgagtcaccgctcccggtcacatctctga

SEQ ID NO: 38894 - DNA, 35 bp, Homo sapiens
  misc_feature 1..35: note = chr1:24017587-24017622
  misc_feature 1..35: note = hypo
  source 1..35: mol_type = genomic DNA
accaccactcctttccgtttgtataaattctattt

SEQ ID NO: 38895 - DNA, 127 bp, Homo sapiens
  misc_feature 1..127: note = chr1:24119136-24119263
  misc_feature 1..127: note = hypo
  source 1..127: mol_type = genomic DNA
atgtatgcaggcccccgccgtggagccgtgtggtgtatgtgtggtaacaccatgtctgtgcccctgctcaccgatgctgccaccgtgtctggagctgagcgggaaacggccgcggtaagggtcccct

SEQ ID NO: 38896 - DNA, 30 bp, Homo sapiens
  misc_feature 1..30: note = chr1:24435099-24435129
  misc_feature 1..30: note = hypo
  source 1..30: mol_type = genomic DNA
acctcccaagctgtgcggcagagtcatggt

SEQ ID NO: 38897 - DNA, 180 bp, Homo sapiens
  misc_feature 1..180: note = chr1:24740813-24740993
  misc_feature 1..180: note = hypo
  source 1..180: mol_type = genomic DNA
gcgtgagccaccacgcccggccccaagccctgtttctaacagaagaaaaaaaaaaaaattgacatgggcgactatacaagggcagccacttagtattccaggagcccctcttcacacgcttcagggcagggcggtctcagcgaccttgtcactcccctgcttaaagtcctccaatggctc

SEQ ID NO: 38898 - DNA, 46 bp, Homo sapiens
  misc_feature 1..46: note = chr1:25220516-25220562
  misc_feature 1..46: note = hypo
  source 1..46: mol_type = genomic DNA
tttcctaatttcaggcgtcagtgatttaggacggagttgttttcat

SEQ ID NO: 38899 - DNA, 30 bp, Homo sapiens
  misc_feature 1..30: note = chr1:26337225-26337255
  misc_feature 1..30: note = hypo
  source 1..30: mol_type = genomic DNA
cggggatggtgtcagcgaggtaatggtatg

SEQ ID NO: 38900 - DNA, 43 bp, Homo sapiens
  misc_feature 1..43: note = chr1:26969603-26969646
  misc_feature 1..43: note = hypo
  source 1..43: mol_type = genomic DNA
ttcttcactgctagccgtttgttcatctaccaaacatttgcca

SEQ ID NO: 38901 - DNA, 139 bp, Homo sapiens
  misc_feature 1..139: note = chr1:27190175-27190314
  misc_feature 1..139: note = hypo
  source 1..139: mol_type = genomic DNA
gcaagaaggagatgccgcccaccaaccccatccgcctgggcctggccctgaacttttccgtcttccactacgagatcgccaacagccccgaggaggccatctctctggccaagaccactttcgacgaggccatggctga

SEQ ID NO: 38902 - DNA, 30 bp, Homo sapiens
  misc_feature 1..30: note = chr1:27628242-27628272
  misc_feature 1..30: note = hypo
  source 1..30: mol_type = genomic DNA
gctcagtcaggctcccgctaggcattcaca

SEQ ID NO: 38903 - DNA, 76 bp, Homo sapiens
  misc_feature 1..76: note = chr1:27844518-27844594
  misc_feature 1..76: note = hypo
  source 1..76: mol_type = genomic DNA
ggagagcctggctgtcggggagcagatctgagcacgctcctcaccagccctagctcaggctcggacctctctgact

SEQ ID NO: 38904 - DNA, 21 bp, Homo sapiens
  misc_feature 1..21: note = chr1:27868425-27868446
  misc_feature 1..21: note = hypo
  source 1..21: mol_type = genomic DNA
ccaccgcgcctggcaaggagg

SEQ ID NO: 38905 - DNA, 217 bp, Homo sapiens
  misc_feature 1..217: note = chr1:27876116-27876333
  misc_feature 1..217: note = hypo
  source 1..217: mol_type = genomic DNA
gtgaagaggttttggcgctcctggctgagctcggtctggcctgagggtgcacccgtgctgtagtagctgccacggcctgaggctccactctccagcccagtggaggcaaaggcccgggcctcggtcccctgaaacccacagtttcggccagcttgtccgcctgggtgcccatggtgaggggcccagccaccacccttatccccggcccactcagcac

SEQ ID NO: 38906 - DNA, 72 bp, Homo sapiens
  misc_feature 1..72: note = chr1:28293332-28293404
  misc_feature 1..72: note = hypo
  source 1..72: mol_type = genomic DNA
tttctcctggttcaacgtggctgagggccgcacccgaggccgggccatcatccacttcgccttcctcctgag

SEQ ID NO: 38907 - DNA, 82 bp, Homo sapiens
  misc_feature 1..82: note = chr1:28853681-28853763
  misc_feature 1..82: note = hypo
  source 1..82: mol_type = genomic DNA
atggcactcacatgccgggcaactgatgctcagagtaaccttcccacagcagccgcgatcttcagtgcatgtgtgtttttgt

SEQ ID NO: 38908 - DNA, 41 bp, Homo sapiens
  misc_feature 1..41: note = chr1:28865194-28865235
  misc_feature 1..41: note = hypo
  source 1..41: mol_type = genomic DNA
ttcacctgcagccaacggcctggaatcgcaaagagacacca

SEQ ID NO: 38909 - DNA, 23 bp, Homo sapiens
  misc_feature 1..23: note = chr1:28926140-28926163
  misc_feature 1..23: note = hypo
  source 1..23: mol_type = genomic DNA
atggcacgcgcctgtggtgccac

SEQ ID NO: 38910 - DNA, 29 bp, Homo sapiens
  misc_feature 1..29: note = chr1:29047659-29047688
  misc_feature 1..29: note = hypo
  source 1..29: mol_type = genomic DNA
tttttttttgtgaggcggagtctgactcc

SEQ ID NO: 38911 - DNA, 30 bp, Homo sapiens; identical to SEQ ID NO: 14220
  misc_feature 1..30: note = chr1:29074253-29074283
  misc_feature 1..30: note = hypo
  source 1..30: mol_type = genomic DNA

SEQ ID NO: 38912 - DNA, 26 bp, Homo sapiens
  misc_feature 1..26: note = chr1:29462593-29462619
  misc_feature 1..26: note = hypo
  source 1..26: mol_type = genomic DNA
gggcgcggtggctgacgcctgtaatc

SEQ ID NO: 38913 - DNA, 17 bp, Homo sapiens
  misc_feature 1..17: note = chr1:29463615-29463632
  misc_feature 1..17: note = hypo
  source 1..17: mol_type = genomic DNA
ttgaatgttcagggccg

SEQ ID NO: 38914 - DNA, 40 bp, Homo sapiens
  misc_feature 1..40: note = chr1:29516596-29516636
  misc_feature 1..40: note = hypo
  source 1..40: mol_type = genomic DNA
atagtcaaggccgggcgcggtggctcacgcctgtaatccc

SEQ ID NO: 38915 - DNA, 188 bp, Homo sapiens
  misc_feature 1..188: note = chr1:30351554-30351742
  misc_feature 1..188: note = hypo
  source 1..188: mol_type = genomic DNA
taaatagaggtgtgccgagagtaacgcggacggagatcacatgcaggtggctctcgaggagtccataaatctacactgatgaattacctgggcaggtggctctgccaccagccttccagctcagtacaggagcggcgtaattacctgtctggcagtggttgtctggagagagccggtccatttttctc

SEQ ID NO: 38916 - DNA, 30 bp, Homo sapiens
  misc_feature 1..30: note = chr1:30723094-30723124
  misc_feature 1..30: note = hypo
  source 1..30: mol_type = genomic DNA
aatagcaggagccaccgctcattgactgga

SEQ ID NO: 38917 - DNA, 174 bp, Homo sapiens
  misc_feature 1..174: note = chr1:31208078-31208252
  misc_feature 1..174: note = hypo
  source 1..174: mol_type = genomic DNA
tgtagcaccgccacacgcacttgaacatgtagacctggaaaaaggcccaggtcaggctgtgctttgctgagcgtccttctcacgctccagcaggcctaggacatatgccaggcaggagccaccactctctccagaagccagcatccagctgctcctgctcggacctctcattct

SEQ ID NO: 38918 - DNA, 64 bp, Homo sapiens
  misc_feature 1..64: note = chr1:32705509-32705573
  misc_feature 1..64: note = hypo
  source 1..64: mol_type = genomic DNA
tggtctctgtgcctccgccagtcacgcgggcttgtttcgcggcctgggccgagagcgtgtccat

SEQ ID NO: 38919 - DNA, 33 bp, Homo sapiens
  misc_feature 1..33: note = chr1:32741468-32741501
  misc_feature 1..33: note = hypo
  source 1..33: mol_type = genomic DNA
ctcactgcgttctttcgtcgctttgtccatcca

SEQ ID NO: 38920 - DNA, 30 bp, Homo sapiens
  misc_feature 1..30: note = chr1:33220942-33220972
  misc_feature 1..30: note = hypo
  source 1..30: mol_type = genomic DNA
tggtgggagaatctacgggtgtattcccag

SEQ ID NO: 38921 - DNA, 149 bp, Homo sapiens
  misc_feature 1..149: note = chr1:33441493-33441642
  misc_feature 1..149: note = hypo
  source 1..149: mol_type = genomic DNA
ttttaaagaggtttttttttttgagcgggagggtttcaatagattctgccccgcaagcttcccagccacctttctcatacctacagctcatggtgtgtcgccctgccttaaaccccacactggctccccgtgcccgatgagagagcatt

SEQ ID NO: 38922 - DNA, 143 bp, Homo sapiens; identical to SEQ ID NO: 14223
  misc_feature 1..143: note = chr1:33473115-33473258
  misc_feature 1..143: note = hypo
  source 1..143: mol_type = genomic DNA

SEQ ID NO: 38923 - DNA, 50 bp, Homo sapiens
  misc_feature 1..50: note = chr1:33631092-33631142
  misc_feature 1..50: note = hypo
  source 1..50: mol_type = genomic DNA
cttgagcagctgcagcgcttcggtgtgttcccgctcgctgtcttgaaggg

SEQ ID NO: 38924 - DNA, 32 bp, Homo sapiens
  misc_feature 1..32: note = chr1:33798865-33798897
  misc_feature 1..32: note = hypo
  source 1..32: mol_type = genomic DNA
cagttaatcaagctccgcgtcttctgcagact

SEQ ID NO: 38925 - DNA, 30 bp, Homo sapiens
  misc_feature 1..30: note = chr1:33981589-33981619
  misc_feature 1..30: note = hypo
  source 1..30: mol_type = genomic DNA
ggtaatccttgctgccgctgtgcagatggg

SEQ ID NO: 38926 - DNA, 28 bp, Homo sapiens
  misc_feature 1..28: note = chr1:34130113-34130141
  misc_feature 1..28: note = hypo
  source 1..28: mol_type = genomic DNA
attttaggccaggagcggtggctcatgc

SEQ ID NO: 38927 - DNA, 41 bp, Homo sapiens
  misc_feature 1..41: note = chr1:34180223-34180264
  misc_feature 1..41: note = hypo
  source 1..41: mol_type = genomic DNA
tctgccccccaggcacgtgatgcgggcggtgccctccagac

SEQ ID NO: 38928 - DNA, 27 bp, Homo sapiens
  misc_feature 1..27: note = chr1:34979405-34979432
  misc_feature 1..27: note = hypo
  source 1..27: mol_type = genomic DNA
aagaagagggctgggcgcagtggctca

SEQ ID NO: 38929 - DNA, 23 bp, Homo sapiens
  misc_feature 1..23: note = chr1:35660562-35660585
  misc_feature 1..23: note = hypo
  source 1..23: mol_type = genomic DNA
aggcgggaccgggtgcggtggct

SEQ ID NO: 38930 - DNA, 136 bp, Homo sapiens
  misc_feature 1..136: note = chr1:35664720-35664856
  misc_feature 1..136: note = hypo
  source 1..136: mol_type = genomic DNA
tgagccaccggcgctagctattcttaagatttatcaagttactttacctgtatgttttgcctcagggcatttgcacttgctctttactcagcctgcagtgttctccccactcgccccgccccggctctttgcacag

SEQ ID NO: 38931 - DNA, 66 bp, Homo sapiens
  misc_feature 1..66: note = chr1:36056253-36056319
  misc_feature 1..66: note = hypo
  source 1..66: mol_type = genomic DNA
ccgagacttcggttacgtctgtgagacggagttcccagccaaggcagctgccgagtacctgtgccg

SEQ ID NO: 38932 - DNA, 120 bp, Homo sapiens
  misc_feature 1..120: note = chr1:36271442-36271562
  misc_feature 1..120: note = hypo
  source 1..120: mol_type = genomic DNA
gcacccaagcctgggcgacagagcgagactccgggtcaaaaaaaataaaagaatatagggtatggtatcagtagacaagaatgtaggcactagattaaaagtcccagttccggccgggcg

SEQ ID NO: 38933 - DNA, 252 bp, Homo sapiens
  misc_feature 1..252: note = chr1:36563342-36563594
  misc_feature 1..252: note = hypo
  source 1..252: mol_type = genomic DNA
tataggtggccggcacgttgttcttgtacagggccacccacacgttggtgcccttgacgtgcacatggtaagcaaagtagtagacgccgcccacagggcaggtgaagatgccagtggctgggttgtagccgctgtggccattgtagagagtccggtcaaatttcacgggcatgcccgaggcggggaagggcgaggtgagcaccgcagtgaaggccggtgtggcatgggcagacagctcgcccagcccaaact

SEQ ID NO: 38934 - DNA, 180 bp, Homo sapiens
  misc_feature 1..180: note = chr1:37148125-37148305
  misc_feature 1..180: note = hypo
  source 1..180: mol_type = genomic DNA
gacctgtgatgtgcacgtagcatgcaacaagcttctatcgttttaagccacagttagtgggaatatttgttatcagagcaaaaccaagtctctcctaactaatataataatatcctttaaaatgaagcatccggaaaacaaagacaaacctctaatattgttttccgatgatatccaagg

SEQ ID NO: 38935 - DNA, 30 bp, Homo sapiens
  misc_feature 1..30: note = chr1:37227648-37227678
  misc_feature 1..30: note = hypo
  source 1..30: mol_type = genomic DNA
tatattatccctgggcggtggaggcaggtg

SEQ ID NO: 38936 - DNA, 30 bp, Homo sapiens
  misc_feature 1..30: note = chr1:38207058-38207088
  misc_feature 1..30: note = hypo
  source 1..30: mol_type = genomic DNA
gcaagaaagtggaaacggagtaggtggctc

SEQ ID NO: 38937 - DNA, 87 bp, Homo sapiens
  misc_feature 1..87: note = chr1:38398355-38398442
  misc_feature 1..87: note = hypo
  source 1..87: mol_type = genomic DNA
atacaaggcaaccaagttcagagaggttaagtctgaggtcgcagagtgactagcagagtggaggattcaaaccgatgccagagggtt

SEQ ID NO: 38938 - DNA, 30 bp, Homo sapiens
  misc_feature 1..30: note = chr1:39075313-39075343
  misc_feature 1..30: note = hypo
  source 1..30: mol_type = genomic DNA
tgctcaccgctcagccgcttgtatcctcaa

SEQ ID NO: 38939 - DNA, 28 bp, Homo sapiens
  misc_feature 1..28: note = chr1:39345389-39345417
  misc_feature 1..28: note = hypo
  source 1..28: mol_type = genomic DNA
tctgttttttttgttcgtttgttttctg

SEQ ID NO: 38940 - DNA, 146 bp, Homo sapiens
  misc_feature 1..146: note = chr1:39416821-39416967
  misc_feature 1..146: note = hypo
  source 1..146: mol_type = genomic DNA
tgctgtatatcataacgctgccttataaaatcacagcacatgtcagcgtcatgaagtctctaaccttctaagaagtccttcaacaaacaagtctgttcaatgttgcttcacctagcacttcccaaacttgtctgacttcttttctt

SEQ ID NO: 38941 - DNA, 24 bp, Homo sapiens
  misc_feature 1..24: note = chr1:40025751-40025775
  misc_feature 1..24: note = hypo
  source 1..24: mol_type = genomic DNA
gtgcccagccgaggtgacaccaga

SEQ ID NO: 38942 - DNA, 36 bp, Homo sapiens
  misc_feature 1..36: note = chr1:40349626-40349662
  misc_feature 1..36: note = hypo
  source 1..36: mol_type = genomic DNA
ccactgcgccagaccacctgccgtcttaaatggtag

SEQ ID NO: 38943 - DNA, 30 bp, Homo sapiens
  misc_feature 1..30: note = chr1:40409694-40409724
  misc_feature 1..30: note = hypo
  source 1..30: mol_type = genomic DNA
accaggcaatataggcgtattcattctgtt

SEQ ID NO: 38944 - DNA, 24 bp, Homo sapiens
  misc_feature 1..24: note = chr1:40625371-40625395
  misc_feature 1..24: note = hypo
  source 1..24: mol_type = genomic DNA
gtttgttttttgagacggagtctt

SEQ ID NO: 38945 - DNA, 138 bp, Homo sapiens
  misc_feature 1..138: note = chr1:40905029-40905167
  misc_feature 1..138: note = hypo
  source 1..138: mol_type = genomic DNA
taccctttgtaacagcgcatgcctaactggcactggctatatcacgtgaacaatctcaattcagtcctgcaaggcaaggtttaaaccagttttccacttgagagatcaagtgccttaaattaccgtgttgtgtaactg

SEQ ID NO: 38946 - DNA, 30 bp, Homo sapiens
  misc_feature 1..30: note = chr1:41117178-41117208
  misc_feature 1..30: note = hypo
  source 1..30: mol_type = genomic DNA
ccaccctgtttgtggcgctttattgcagct

SEQ ID NO: 38947 - DNA, 46 bp, Homo sapiens
  misc_feature 1..46: note = chr1:41288701-41288747
  misc_feature 1..46: note = hypo
  source 1..46: mol_type = genomic DNA
ccatggagcccagctcggtcccacgggcaggcgggcatcaagcttg

SEQ ID NO: 38948 - DNA, 30 bp, Homo sapiens
  misc_feature 1..30: note = chr1:41486134-41486164
  misc_feature 1..30: note = hypo
  source 1..30: mol_type = genomic DNA
caggcaggcaagcaccggcactgagaactg

SEQ ID NO: 38949 - DNA, 30 bp, Homo sapiens
  misc_feature 1..30: note = chr1:41967243-41967273
  misc_feature 1..30: note = hypo
  source 1..30: mol_type = genomic DNA
atcaccctggaccctcgccaggatcaccat

SEQ ID NO: 38950 - DNA, 145 bp, Homo sapiens; identical to SEQ ID NO: 4938
  misc_feature 1..145: note = chr1:41991640-41991785
  misc_feature 1..145: note = hypo
  source 1..145: mol_type = genomic DNA

SEQ ID NO: 38951 - DNA, 30 bp, Homo sapiens
  misc_feature 1..30: note = chr1:42802631-42802661
  misc_feature 1..30: note = hypo
  source 1..30: mol_type = genomic DNA
aaaatgactttaaatcggagacctgaaaga

SEQ ID NO: 38952 - DNA, 30 bp, Homo sapiens
  misc_feature 1..30: note = chr1:43209127-43209157
  misc_feature 1..30: note = hypo
  source 1..30: mol_type = genomic DNA
tgtggccacccccaacgattctgcctgccc

SEQ ID NO: 38953 - DNA, 92 bp, Homo sapiens
  misc_feature 1..92: note = chr1:43826882-43826974
  misc_feature 1..92: note = hypo
  source 1..92: mol_type = genomic DNA
ggcctgtctgagtgccgtggatgcccattcccaggtaatcttttgcctgttcctgcctctcccacatgcattcttaccgggcaactacattc

SEQ ID NO: 38954 - DNA, 91 bp, Homo sapiens
  misc_feature 1..91: note = chr1:43834716-43834807
  misc_feature 1..91: note = hypo
  source 1..91: mol_type = genomic DNA
aatttctacctccagcggcccctggaacagtagcacacaacgatctaacaactgcttgtatgattggatggtgtaagtgcggacagaatta

SEQ ID NO: 38955 - DNA, 57 bp, Homo sapiens
  misc_feature 1..57: note = chr1:43991727-43991784
  misc_feature 1..57: note = hypo
  source 1..57: mol_type = genomic DNA
agagggtgcagtggacggggaatagagagcaaagcctggaggcgccggagcaccctg

SEQ ID NO: 38956 - DNA, 30 bp, Homo sapiens
  misc_feature 1..30: note = chr1:44000506-44000536
  misc_feature 1..30: note = hypo
  source 1..30: mol_type = genomic DNA
tctgtttactagcagcgtgactttaagcaa

SEQ ID NO: 38957 - DNA, 30 bp, Homo sapiens
  misc_feature 1..30: note = chr1:44016696-44016726
  misc_feature 1..30: note = hypo
  source 1..30: mol_type = genomic DNA
gtttggagagtgattcggcaggtctttgga

SEQ ID NO: 38958 - DNA, 36 bp, Homo sapiens
  misc_feature 1..36: note = chr1:44043751-44043787
  misc_feature 1..36: note = hypo
  source 1..36: mol_type = genomic DNA
tggctcctgtctgtccgtctgcggccagagcagccc

SEQ ID NO: 38959 - DNA, 34 bp, Homo sapiens
  misc_feature 1..34: note = chr1:44068855-44068889
  misc_feature 1..34: note = hypo
  source 1..34: mol_type = genomic DNA
gctgtctgccccaggcgtgcggctcctgggatgg

SEQ ID NO: 38960 - DNA, 43 bp, Homo sapiens; identical to SEQ ID NO: 14234
  misc_feature 1..43: note = chr1:44351190-44351233
  misc_feature 1..43: note = hypo
  source 1..43: mol_type = genomic DNA

SEQ ID NO: 38961 - DNA, 45 bp, Homo sapiens
  misc_feature 1..45: note = chr1:44463208-44463253
  misc_feature 1..45: note = hypo
  source 1..45: mol_type = genomic DNA
agctgtgctcatatccgggagtcctggaggcggctggagccatta

SEQ ID NO: 38962 - DNA, 126 bp, Homo sapiens
  misc_feature 1..126: note = chr1:44463851-44463977
  misc_feature 1..126: note = hypo
  source 1..126: mol_type = genomic DNA
agaagcaggcagggccgggggccggagcgcggtgagtgggaaggctctgcggaagggagaagtctgtctttgccacagtcctgaactggccaagcacagtagagctgctgccgcctttggaatcag

SEQ ID NO: 38963 - DNA, 150 bp, Homo sapiens
  misc_feature 1..150: note = chr1:44497521-44497671
  misc_feature 1..150: note = hypo
  source 1..150: mol_type = genomic DNA
gcccctggccttctgcgcctgcgtttcccctagagagaagtcagagcaaattccattccctttggagcagagccgctagagactgtgggcattgctgggtaaggcctaggtcctactccttggaactggagggctcggggtagccctttc

SEQ ID NO: 38964 - DNA, 52 bp, Homo sapiens
  misc_feature 1..52: note = chr1:44584408-44584460
  misc_feature 1..52: note = hypo
  source 1..52: mol_type = genomic DNA
gagggcggcgcagggcgggacgggtggggcctgaccccgccccttggcgcag

SEQ ID NO: 38965 - DNA, 54 bp, Homo sapiens
  misc_feature 1..54: note = chr1:44718072-44718126
  misc_feature 1..54: note = hypo
  source 1..54: mol_type = genomic DNA
ctgcgacgggcctgccgcatagccctgctgtaggtgcggcgggtggccccctgt

SEQ ID NO: 38966 - DNA, 341 bp, Homo sapiens
  misc_feature 1..341: note = chr1:44726927-44727268
  misc_feature 1..341: note = hypo
  source 1..341: mol_type = genomic DNA
cgtggcacgccccagcgggcagggcgcacagcgcggaggaaggcgcgagtcagtctggagtgctccccatttatcaagctcacgcaggccgccagccgagcgagtctttctatcattacacctctcaaaatccgattcataccactaatcctgccttcattctcccagattaataacatctctttcaaccttcacagtgtgataaatagacaaagagagaacaaaaggagagacagaagagagagaaagagctggagcaagtccccataatagagagagctgagaaagaggagagggaaaaaaggagagcgaacgagagcaggcagcggccagagactgca

SEQ ID NO: 38967 - DNA, 30 bp, Homo sapiens
  misc_feature 1..30: note = chr1:44794138-44794168
  misc_feature 1..30: note = hypo
  source 1..30: mol_type = genomic DNA
tccaggtgactctgacgctcgctgaagtct

SEQ ID NO: 38968 - DNA, 62 bp, Homo sapiens
  misc_feature 1..62: note = chr1:45103094-45103156
  misc_feature 1..62: note = hypo
  source 1..62: mol_type = genomic DNA
gagcagcagggctgacgactgtcccatgagttggacacatgggtgtccgatggcagccacac

SEQ ID NO: 38969 - DNA, 30 bp, Homo sapiens
  misc_feature 1..30: note = chr1:45106646-45106676
  misc_feature 1..30: note = hypo
  source 1..30: mol_type = genomic DNA
actgcccccagtaaacgggcatctccagtt

SEQ ID NO: 38970 - DNA, 42 bp, Homo sapiens
  misc_feature 1..42: note = chr1:45156636-45156678
  misc_feature 1..42: note = hypo
  source 1..42: mol_type = genomic DNA
aaggttgttgaggggcggggcgcggtgactcacgcctgtaat

SEQ ID NO: 38971 - DNA, 100 bp, Homo sapiens
  misc_feature 1..100: note = chr1:45280516-45280616
  misc_feature 1..100: note = hypo
  source 1..100: mol_type = genomic DNA
tgcccggcctcagctccttctttcattccagacctgcccccctggagatcgctccctgaatgcccctcagacaccacaggctcggcgagaaattgatctc

SEQ ID NO: 38972 - DNA, 73 bp, Homo sapiens
  misc_feature 1..73: note = chr1:45293244-45293317
  misc_feature 1..73: note = hypo
  source 1..73: mol_type = genomic DNA
agtacctgagctgggcgctcaggaaggcatgctccttggtgccccgaggcaccacatccgtcagggccaggcc

SEQ ID NO: 38973 - DNA, 81 bp, Homo sapiens
  misc_feature 1..81: note = chr1:45308234-45308315
  misc_feature 1..81: note = hypo
  source 1..81: mol_type = genomic DNA
caccgcgcccggccggcataggcccattttctgagagcaggatacatatgtacacacacctgtcgtcgggtggacacagag

SEQ ID NO: 38974 - DNA, 16 bp, Homo sapiens
  misc_feature 1..16: note = chr1:45466077-45466093
  misc_feature 1..16: note = hypo
  source 1..16: mol_type = genomic DNA
acgctgtataaataat

SEQ ID NO: 38975 - DNA, 16 bp, Homo sapiens
  misc_feature 1..16: note = chr1:45645619-45645635
  misc_feature 1..16: note = hypo
  source 1..16: mol_type = genomic DNA
aggagccaagatggcc

SEQ ID NO: 38976 - DNA, 38 bp, Homo sapiens; identical to SEQ ID NO: 14239
  misc_feature 1..38: note = chr1:46079131-46079169
  misc_feature 1..38: note = hypo
  source 1..38: mol_type = genomic DNA

SEQ ID NO: 38977 - DNA, 95 bp, Homo sapiens
  misc_feature 1..95: note = chr1:46921772-46921867
  misc_feature 1..95: note = hypo
  source 1..95: mol_type = genomic DNA
tattcatcaccagctcgtggcgccggcgccgacgctgatacaatattagtgttgccccccctttcggagcccgctccgcccggctccccgatggc

SEQ ID NO: 38978 - DNA, 26 bp, Homo sapiens
  misc_feature 1..26: note = chr1:47749558-47749584
  misc_feature 1..26: note = hypo
  source 1..26: mol_type = genomic DNA
tagcttttttttttgcgggggggtgg

SEQ ID NO: 38979 - DNA, 30 bp, Homo sapiens
  misc_feature 1..30: note = chr1:50918985-50919015
  misc_feature 1..30: note = hypo
  source 1..30: mol_type = genomic DNA
ccaagcagggccatgcgagctggtgtgtgc

SEQ ID NO: 38980 - DNA, 200 bp, Homo sapiens
  misc_feature 1..200: note = chr1:51099269-51099469
  misc_feature 1..200: note = hypo
  source 1..200: mol_type = genomic DNA
tgagctctgtcactacggcaaccagcagggaataagtatctgtgggtctatgaatttcagaatcccataaaagccagggctaaaaaggcatgtgcagcctctcagagattgactgcattaatacattagcaaatactgtgaaacactggataaatgtcagcaattatggaaaaagcgtctaataacgatattcgttgcct

SEQ ID NO: 38981 - DNA, 20 bp, Homo sapiens
  misc_feature 1..20: note = chr1:51176289-51176309
  misc_feature 1..20: note = hypo
  source 1..20: mol_type = genomic DNA
ttcgagacagagtctcgctc

SEQ ID NO: 38982 - DNA, 19 bp, Homo sapiens
  misc_feature 1..19: note = chr1:51727596-51727615
  misc_feature 1..19: note = hypo
  source 1..19: mol_type = genomic DNA
gctcactgcaacctccgtc

SEQ ID NO: 38983 - DNA, 78 bp, Homo sapiens
  misc_feature 1..78: note = chr1:51761832-51761910
  misc_feature 1..78: note = hypo
  source 1..78: mol_type = genomic DNA
tgtaggtggcctgtgcgagacagagcaacagccaggtgtgagcagccctcctccagccccagccgggctggaatctgc

SEQ ID NO: 38984 - DNA, 93 bp, Homo sapiens
  misc_feature 1..93: note = chr1:51763252-51763345
  misc_feature 1..93: note = hypo
  source 1..93: mol_type = genomic DNA
ggagacaccaagtcccggtgactttacctcccgtctcactctaggatcctgctggccttgccctacggctctcattatcggactgccaccatc

SEQ ID NO: 38985 - DNA, 213 bp, Homo sapiens
  misc_feature 1..213: note = chr1:51795524-51795737
  misc_feature 1..213: note = hypo
  source 1..213: mol_type = genomic DNA
tgggcaggagagccacgttgaaggtgacaacacccactttttactacccaggttcctgctgcacccaatgggcccggctggcccataccttagctgtttaagttcccctaatgtccctgaagatgatggggtggggggatctgacaacagacagaactgagttcaaatcccacccgcaactcttacctcctgggtgaccgatgacaagtcact

SEQ ID NO: 38986 - DNA, 128 bp, Homo sapiens
  misc_feature 1..128: note = chr1:52455042-52455170
  misc_feature 1..128: note = hypo
  source 1..128: mol_type = genomic DNA
gactttttctgtccacgattctcttattttctgtgatccccggtgcccgtgtaacaaggtccagtgcctgggtcccctccttggactcctgagtggccgagacaccgctagtgcgtggacaccactcc

SEQ ID NO: 38987 - DNA, 22 bp, Homo sapiens
  misc_feature 1..22: note = chr1:52832687-52832709
  misc_feature 1..22: note = hypo
  source 1..22: mol_type = genomic DNA
ttgagctcaggagtccgagacc

SEQ ID NO: 38988 - DNA, 23 bp, Homo sapiens
  misc_feature 1..23: note = chr1:53129138-53129161
  misc_feature 1..23: note = hypo
  source 1..23: mol_type = genomic DNA
atcagaacatgtggccgggcgcg

SEQ ID NO: 38989 - DNA, 41 bp, Homo sapiens
  misc_feature 1..41: note = chr1:53703048-53703089
  misc_feature 1..41: note = hypo
  source 1..41: mol_type = genomic DNA
aaaaccttccaagcccggccgggcgcggtggctcacacctg

SEQ ID NO: 38990 - DNA, 27 bp, Homo sapiens
  misc_feature 1..27: note = chr1:53705674-53705701
  misc_feature 1..27: note = hypo
  source 1..27: mol_type = genomic DNA
tcagtcttaacacggagtccttttctc

SEQ ID NO: 38991 - DNA, 75 bp, Homo sapiens
  misc_feature 1..75: note = chr1:53990562-53990637
  misc_feature 1..75: note = hypo
  source 1..75: mol_type = genomic DNA
gtaacatggggggcacgggtggggtgagtgaggcccatccctacgggacacgcgcctccgcgtgacctgctgtgg

SEQ ID NO: 38992 - DNA, 407 bp, Homo sapiens; identical to SEQ ID NO: 14242
  misc_feature 1..407: note = chr1:54586590-54586997
  misc_feature 1..407: note = hypo
  source 1..407: mol_type = genomic DNA

SEQ ID NO: 38993 - DNA, 30 bp, Homo sapiens
  misc_feature 1..30: note = chr1:54722666-54722696
  misc_feature 1..30: note = hypo
  source 1..30: mol_type = genomic DNA
gtaagctaccagccacgttaaacctgcccc

SEQ ID NO: 38994 - DNA, 30 bp, Homo sapiens
  misc_feature 1..30: note = chr1:54766254-54766284
  misc_feature 1..30: note = hypo
  source 1..30: mol_type = genomic DNA
aaggattatttctgccggagggtggggctt

SEQ ID NO: 38995 - DNA, 33 bp, Homo sapiens
  misc_feature 1..33: note = chr1:54839900-54839933
  misc_feature 1..33: note = hypo
  source 1..33: mol_type = genomic DNA
gtggccggcagcccacggcgtgttggggatcca

SEQ ID NO: 38996 - DNA, 17 bp, Homo sapiens
  misc_feature 1..17: note = chr1:54880702-54880719
  misc_feature 1..17: note = hypo
  source 1..17: mol_type = genomic DNA
cccggccacgtagagca

SEQ ID NO: 38997 - DNA, 23 bp, Homo sapiens
  misc_feature 1..23: note = chr1:55231044-55231067
  misc_feature 1..23: note = hypo
  source 1..23: mol_type = genomic DNA
tttgtttttttgagacggagttt

SEQ ID NO: 38998 - DNA, 70 bp, Homo sapiens
  misc_feature 1..70: note = chr1:55529166-55529236
  misc_feature 1..70: note = hypo
  source 1..70: mol_type = genomic DNA
tacaggcagcaccagcgaaggggccgtgacagccgttgccatctgctgccggagccggcacctggcgcag

SEQ ID NO: 38999 - DNA, 30 bp, Homo sapiens
  misc_feature 1..30: note = chr1:62189867-62189897
  misc_feature 1..30: note = hypo
  source 1..30: mol_type = genomic DNA
gagggggatgcggatcgcttgagaccagga

SEQ ID NO: 39000 - DNA, 30 bp, Homo sapiens
  misc_feature 1..30: note = chr1:62657668-62657698
  misc_feature 1..30: note = hypo
  source 1..30: mol_type = genomic DNA
attctttttctttttcgagacggagtctcg

SEQ ID NO: 39001 - DNA, 18 bp, Homo sapiens
  misc_feature 1..18: note = chr1:70599151-70599169
  misc_feature 1..18: note = hypo
  source 1..18: mol_type = genomic DNA
cctcggcctcccaaagtg

SEQ ID NO: 39002 - DNA, 34 bp, Homo sapiens
  misc_feature 1..34: note = chr1:70672893-70672927
  misc_feature 1..34: note = hypo
  source 1..34: mol_type = genomic DNA
accgtagcagcttttgcaacgttattaatgaggt

SEQ ID NO: 39003 - DNA, 79 bp, Homo sapiens
  misc_feature 1..79: note = chr1:72383504-72383583
  misc_feature 1..79: note = hypo
  source 1..79: mol_type = genomic DNA
cggccaaattgaacagcaaaccactcttcaaaaagcacaaattgagttaggttgcctttaagaacgacctcactgctgt

SEQ ID NO: 39004 - DNA, 30 bp, Homo sapiens
  misc_feature 1..30: note = chr1:76259201-76259231
  misc_feature 1..30: note = hypo
  source 1..30: mol_type = genomic DNA
ggccgtggggagcaccgggacctgcacttg

SEQ ID NO: 39005 - DNA, 24 bp, Homo sapiens
  misc_feature 1..24: note = chr1:76354586-76354610
  misc_feature 1..24: note = hypo
  source 1..24: mol_type = genomic DNA
tttttttttttgagacggagtctc

SEQ ID NO: 39006 - DNA, 30 bp, Homo sapiens; identical to SEQ ID NO: 14245
  misc_feature 1..30: note = chr1:78244815-78244845
  misc_feature 1..30: note = hypo
  source 1..30: mol_type = genomic DNA

SEQ ID NO: 39007 - DNA, 140 bp, Homo sapiens
  misc_feature 1..140: note = chr1:86860809-86860949
  misc_feature 1..140: note = hypo
  source 1..140: mol_type = genomic DNA
gccaccgcgcccggcccggtttgtttctttaaccttaactcagttgcacttaaaactccaagaacctcattcattcaaaaacacttgaaaccgtactatgcgttgcgtgatgaggaaactgtcttcgaaatagattttat

SEQ ID NO: 39008 - DNA, 30 bp, Homo sapiens
  misc_feature 1..30: note = chr1:90292117-90292147
  misc_feature 1..30: note = hypo
  source 1..30: mol_type = genomic DNA
aattttatagttgagcgtatccaggcacag

SEQ ID NO: 39009 - DNA, 33 bp, Homo sapiens
  misc_feature 1..33: note = chr1:92494939-92494972
  misc_feature 1..33: note = hypo
  source 1..33: mol_type = genomic DNA
cggcttccagcccttcgacgaactctcaggtgt

SEQ ID NO: 39010 - DNA, 156 bp, Homo sapiens
  misc_feature 1..156: note = chr1:93222691-93222847
  misc_feature 1..156: note = hypo
  source 1..156: mol_type = genomic DNA
aaacaaacactttgacggtgcgtgtgtcaaatttagttacaacaaatccgtgtatgacaaaaatgctcacgtcctggctaatagttcaaatatttcaaaaatattcaatacaacagaaaatttggacagactccaatttgccgttttgagatttga

SEQ ID NO: 39011 - DNA, 30 bp, Homo sapiens
  misc_feature 1..30: note = chr1:94048058-94048088
  misc_feature 1..30: note = hypo
  source 1..30: mol_type = genomic DNA
ctccatctgagctgccgcaggttcccaagg

SEQ ID NO: 39012 - DNA, 30 bp, Homo sapiens
  misc_feature 1..30: note = chr1:94048424-94048454
  misc_feature 1..30: note = hypo
  source 1..30: mol_type = genomic DNA
ggcaggctcgcttcccgtcctgaacacagg

SEQ ID NO: 39013 - DNA, 25 bp, Homo sapiens
  misc_feature 1..25: note = chr1:94343568-94343593
  misc_feature 1..25: note = hypo
  source 1..25: mol_type = genomic DNA
aaatcaaaatttggccgggcgcggt

SEQ ID NO: 39014 - DNA, 30 bp, Homo sapiens
  misc_feature 1..30: note = chr1:97185220-97185250
  misc_feature 1..30: note = hypo
  source 1..30: mol_type = genomic DNA
tcaatcaatatcgatcgagcgaatgtgggg

SEQ ID NO: 39015 - DNA, 98 bp, Homo sapiens; identical to SEQ ID NO: 14249
  misc_feature 1..98: note = chr1:99611990-99612088
  misc_feature 1..98: note = hypo
  source 1..98: mol_type = genomic DNA

SEQ ID NO: 39016 - DNA, 38 bp, Homo sapiens; identical to SEQ ID NO: 14250
  misc_feature 1..38: note = chr1:99612148-99612186
  misc_feature 1..38: note = hypo
  source 1..38: mol_type = genomic DNA

SEQ ID NO: 39017 - DNA, 197 bp, Homo sapiens
  misc_feature 1..197: note = chr1:100436557-100436754
  misc_feature 1..197: note = hypo
  source 1..197: mol_type = genomic DNA
tctgctaaatatgctcgtctttcctcttcttacttgcactatagcaataacttccaaactggacttgtcctcagcctggcacccttccagtcacttgcctccatattacttttaaagccaaagatcttatgactttctttttttggttattccttcctcagaaatacgcagtgactctcgatcggcttcagaataaa

SEQ ID NO: 39018 - DNA, 86 bp, Homo sapiens; identical to SEQ ID NO: 4943
  misc_feature 1..86: note = chr1:100437183-100437269
  misc_feature 1..86: note = hypo
  source 1..86: mol_type = genomic DNA

SEQ ID NO: 39019 - DNA, 34 bp, Homo sapiens
  misc_feature 1..34: note = chr1:100814764-100814798
  misc_feature 1..34: note = hypo
  source 1..34: mol_type = genomic DNA
aaggcgttgttttcaaactcgacactttttacac

SEQ ID NO: 39020 - DNA, 30 bp, Homo sapiens
  misc_feature 1..30: note = chr1:100928393-100928423
  misc_feature 1..30: note = hypo
  source 1..30: mol_type = genomic DNA
catctgtgagaacaccgaaggggccatcgc

SEQ ID NO: 39021 - DNA, 30 bp, Homo sapiens
  misc_feature 1..30: note = chr1:109076927-109076957
  misc_feature 1..30: note = hypo
  source 1..30: mol_type = genomic DNA
tagccaggatggtctcgatctcctcaccct

SEQ ID NO: 39022 - DNA, 30 bp, Homo sapiens
  misc_feature 1..30: note = chr1:109370476-109370506
  misc_feature 1..30: note = hypo
  source 1..30: mol_type = genomic DNA
aatgttttgttctgccgaggttaatatcta

SEQ ID NO: 39023 - DNA, 140 bp, Homo sapiens
  misc_feature 1..140: note = chr1:109585374-109585514
  misc_feature 1..140: note = hypo
  source 1..140: mol_type = genomic DNA
tattccacaaatatacgtgatgttcaaccgagcttaattaagcatccaggaagtataaccataaggaagaatacaattacacaaacctgtaagaacatcattctcggccaggcgcggtggctcacgcctgcaattccagc

SEQ ID NO: 39024 - DNA, 19 bp, Homo sapiens
  misc_feature 1..19: note = chr1:109585754-109585773
  misc_feature 1..19: note = hypo
  source 1..19: mol_type = genomic DNA
actccgtctcacagaaaaa

SEQ ID NO: 39025 - DNA, 28 bp, Homo sapiens
  misc_feature 1..28: note = chr1:109593505-109593533
  misc_feature 1..28: note = hypo
  source 1..28: mol_type = genomic DNA
tcaagggccaggcaccgcggctcacgcc

SEQ ID NO: 39026 - DNA, 36 bp, Homo sapiens
  misc_feature 1..36: note = chr1:109631646-109631682
  misc_feature 1..36: note = hypo
  source 1..36: mol_type = genomic DNA
attacaggcgtgagccgcgcccggccagctgctgct

SEQ ID NO: 39027 - DNA, 103 bp, Homo sapiens
  misc_feature 1..103: note = chr1:109644233-109644336
  misc_feature 1..103: note = hypo
  source 1..103: mol_type = genomic DNA
gtgagctacggcgcccggccggcttgacattttttgtatgctaccaacacttgtatccccagggctaacggcatggtacagcatctgccgctaagggttatac

SEQ ID NO: 39028 - DNA, 30 bp, Homo sapiens
  misc_feature 1..30: note = chr1:109701309-109701339
  misc_feature 1..30: note = hypo
  source 1..30: mol_type = genomic DNA
gatgtatatactgaacgtgtttatgtgctc

SEQ ID NO: 39029 - DNA, 30 bp, Homo sapiens
  misc_feature 1..30: note = chr1:109941519-109941549
  misc_feature 1..30: note = hypo
  source 1..30: mol_type = genomic DNA
acaacttctacaacacgtagcacaggtaaa

SEQ ID NO: 39030 - DNA, 30 bp, Homo sapiens
  misc_feature 1..30: note = chr1:110305575-110305605
  misc_feature 1..30: note = hypo
  source 1..30: mol_type = genomic DNA
tggtgttagtctgtgcgggtcaagggtatg

SEQ ID NO: 39031 - DNA, 99 bp, Homo sapiens
  misc_feature 1..99: note = chr1:110726670-110726769
  misc_feature 1..99: note = hypo
  source 1..99: mol_type = genomic DNA
acatctctgaaagcacgctgtttccgacgatcagtgaggcaattatacaagcctgttttttctgtttttgttggttttttttgacggagtctcgctctg

SEQ ID NO: 39032 - DNA, 309 bp, Homo sapiens
  misc_feature 1..309: note = chr1:110883605-110883914
  misc_feature 1..309: note = hypo
  source 1..309: mol_type = genomic DNA
gccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttacgagccactggatagcctagatcgcaggcgggatggttggtccttggaccgggacagaggtgat

SEQ ID NO: 39033 - DNA, 60 bp, Homo sapiens
  misc_feature 1..60: note = chr1:110884160-110884220
  misc_feature 1..60: note = hypo
  source 1..60: mol_type = genomic DNA
agccagggtgacaagcgagaccgtaaaaactctgcatcagctgaacgagataggaagcac

SEQ ID NO: 39034 - DNA, 31 bp, Homo sapiens
  misc_feature 1..31: note = chr1:111544898-111544929
  misc_feature 1..31: note = hypo
  source 1..31: mol_type = genomic DNA
gttctgggtttacaggcgtgagccaccgtgt

SEQ ID NO: 39035 - DNA, 199 bp, Homo sapiens
  misc_feature 1..199: note = chr1:112084890-112085089
  misc_feature 1..199: note = hypo
  source 1..199: mol_type = genomic DNA
caggatcagacctgccggttcgaacacacgcgacaagagcaaagaagttaaaagagaagtgtctgtgtggctccttccacgtgggtgaaggactgtgccagctgagaggtggtagagcaggaagctgcctgaggacctccatttatttggtgaaaaactgggctccgcccttaagagagcaagtcgagggccgtgtagg

SEQ ID NO: 39036 - DNA, 16 bp, Homo sapiens
  misc_feature 1..16: note = chr1:112192214-112192230
  misc_feature 1..16: note = hypo
  source 1..16: mol_type = genomic DNA
acgaccagaatattag

SEQ ID NO: 39037 - DNA, 152 bp, Homo sapiens
  misc_feature 1..152: note = chr1:112784462-112784614
  misc_feature 1..152: note = hypo
  source 1..152: mol_type = genomic DNA
cagagaaataatgggcgtgactgggaggcgcattatacctttggccacatagaaagggaaatgggttgtcactgaagagtttgaggcagagaaatgacatgacctgacatgcattttaaaaagctcacaatagacgtggcacggtggctcac

SEQ ID NO: 39038 - DNA, 86 bp, Homo sapiens
  misc_feature 1..86: note = chr1:113751201-113751287
  misc_feature 1..86: note = hypo
  source 1..86: mol_type = genomic DNA
cacgcccggccaaccatagcagtttacatgtgggtttggtttgggactgagagtcaagatccactgaggggcgtggcctctcttcc

SEQ ID NO: 39039 - DNA, 80 bp, Homo sapiens
  misc_feature 1..80: note = chr1:115055238-115055318
  misc_feature 1..80: note = hypo
  source 1..80: mol_type = genomic DNA
gcaattacctgggaccgtagatgcacgccaccatgacttagctgatcttttttttccctttgcctcgaagaggctggggt

SEQ ID NO: 39040 - DNA, 115 bp, Homo sapiens
  misc_feature 1..115: note = chr1:116213930-116214045
  misc_feature 1..115: note = hypo
  source 1..115: mol_type = genomic DNA
gtgaaagtggaggggcgcgagcactcaggtgggtgaacagcctgcggcctcctttccctggctgcaaagccgccactcaactctgctccagcccaggtttcggggagccgggatc

SEQ ID NO: 39041 - DNA, 155 bp, Homo sapiens
  misc_feature 1..155: note = chr1:116214288-116214443
  misc_feature 1..155: note = hypo
  source 1..155: mol_type = genomic DNA
cccaggcaggggaggcgcagtgcaggttggactgtgtaaggaaatggcagcatggcgaggtttgtgccgcggcctacaagcagggctgcatgctccccaggcagactgtggcagagccaagcccctcacttgtagggaagcgtgtctcctaggtg

SEQ ID NO: 39042 - DNA, 45 bp, Homo sapiens
  misc_feature 1..45: note = chr1:116214942-116214987
  misc_feature 1..45: note = hypo
  source 1..45: mol_type = genomic DNA
accaaaagccaggtacgctttccagccttccgatattggttcaaa

SEQ ID NO: 39043 - DNA, 61 bp, Homo sapiens
  misc_feature 1..61: note = chr1:116574202-116574263
  misc_feature 1..61: note = hypo
  source 1..61: mol_type = genomic DNA
gtaattatactaaggcgtgttctgttgctctttaactaaggttgctcgagcttctcttgat

SEQ ID NO: 39044 - DNA, 124 bp, Homo sapiens
  misc_feature 1..124: note = chr1:150602992-150603116
  misc_feature 1..124: note = hypo
  source 1..124: mol_type = genomic DNA
aacatttggtaaatacggttaatactagttaacctatccagaattacagtttaacatttcctgggcgtctgtctgtatgtggatggtactgtgttagttggggggggtacgtgtatagtaaggc

SEQ ID NO: 39045 - DNA, 30 bp, Homo sapiens; identical to SEQ ID NO: 14264
  misc_feature 1..30: note = chr1:150850705-150850735
  misc_feature 1..30: note = hypo
  source 1..30: mol_type = genomic DNA

SEQ ID NO: 39046 - DNA, 16 bp, Homo sapiens
  misc_feature 1..16: note = chr1:151169624-151169640
  misc_feature 1..16: note = hypo
  source 1..16: mol_type = genomic DNA
acggcgcccggcctgc

SEQ ID NO: 39047 - DNA, 141 bp, Homo sapiens
  misc_feature 1..141: note = chr1:151170065-151170206
  misc_feature 1..141: note = hypo
  source 1..141: mol_type = genomic DNA
tttaatggagttatttcatgggccatgagtttgagaggatctatctgaccgactcttaccccgaatgttttaccattcctctttatttattcattccacagataattatggagcccctactatgtacgaagtcactggagg

SEQ ID NO: 39048 - DNA, 102 bp, Homo sapiens; identical to SEQ ID NO: 1538
  misc_feature 1..102: note = chr1:151252684-151252786
  misc_feature 1..102: note = hypo
  source 1..102: mol_type = genomic DNA

SEQ ID NO: 39049 - DNA, 84 bp, Homo sapiens
  misc_feature 1..84: note = chr1:151300852-151300936
  misc_feature 1..84: note = hypo
  source 1..84: mol_type = genomic DNA
ttcttccaaacaaaacgaaaccatattaggccaaacaaataaacaaaaacacgccatgcaaatgggcctctggtgttgcttttg

SEQ ID NO: 39050 - DNA, 30 bp, Homo sapiens
  misc_feature 1..30: note = chr1:151345799-151345829
  misc_feature 1..30: note = hypo
  source 1..30: mol_type = genomic DNA
gtgtgtgaatttccacgtgtgtgaatgtgc

SEQ ID NO: 39051 - DNA, 30 bp, Homo sapiens
  misc_feature 1..30: note = chr1:151481617-151481647
  misc_feature 1..30: note = hypo
  source 1..30: mol_type = genomic DNA
cttatccttgtaattcgtgttcatggtgct

SEQ ID NO: 39052 - DNA, 32 bp, Homo sapiens
  misc_feature 1..32: note = chr1:151678615-151678647
  misc_feature 1..32: note = hypo
  source 1..32: mol_type = genomic DNA
aagagctgggctcagcgcggggtgacagggag

SEQ ID NO: 39053 - DNA, 40 bp, Homo sapiens
  misc_feature 1..40: note = chr1:152276060-152276100
  misc_feature 1..40: note = hypo
  source 1..40: mol_type = genomic DNA
tcctctccttgaccccgggtgtccacgaatggtgtcctga

SEQ ID NO: 39054 - DNA, 51 bp, Homo sapiens
  misc_feature 1..51: note = chr1:152286249-152286300
  misc_feature 1..51: note = hypo
  source 1..51: mol_type = genomic DNA
gatgcagtctgtccacgagaggaagtctctgcgtgacgagtgcctgattgt

SEQ ID NO: 39055 - DNA, 16 bp, Homo sapiens
  misc_feature 1..16: note = chr1:152696808-152696824
  misc_feature 1..16: note = hypo
  source 1..16: mol_type = genomic DNA
ggagtcttgctctgtc

SEQ ID NO: 39056 - DNA, 109 bp, Homo sapiens; identical to SEQ ID NO: 14268
  misc_feature 1..109: note = chr1:153539476-153539585
  misc_feature 1..109: note = hypo
  source 1..109: mol_type = genomic DNA

SEQ ID NO: 39057 - DNA, 219 bp, Homo sapiens
  misc_feature 1..219: note = chr1:153540023-153540242
  misc_feature 1..219: note = hypo
  source 1..219: mol_type = genomic DNA
agcctggcagtgaggcgctccagactcggcctgctgctgcgtgtcccttaaacacaccggcacatgcaactagtgtggccaagaccctcggcttgcgctgacccctctgttcagaacgtgcccacacatgcccatgccctctatcctgctgaaatccaacccccccttcaaaggccactgcagggagccttcccagggcccaaccggattcagtgtcta

SEQ ID NO: 39058 - DNA, 150 bp, Homo sapiens
  misc_feature 1..150: note = chr1:153608334-153608484
  misc_feature 1..150: note = hypo
  source 1..150: mol_type = genomic DNA
tagattggcttctgccgtttttgagaaattcccgggtattttgtgggccttgaagtttgtttgtttgtttggggttatttgtttgttttaaagagatggggtctcaggccagagtgcagtggcatgatcacggctctttgcagcctccaa

SEQ ID NO: 39059 - DNA, 43 bp, Homo sapiens
  misc_feature 1..43: note = chr1:153645007-153645050
  misc_feature 1..43: note = hypo
  source 1..43: mol_type = genomic DNA
caggccacaccactccgagctaattttatttttttttttgaga

SEQ ID NO: 39060 - DNA, 102 bp, Homo sapiens
  misc_feature 1..102: note = chr1:153937070-153937172
  misc_feature 1..102: note = hypo
  source 1..102: mol_type = genomic DNA
acaaggctccagaaacgaagcccagtaattccttaagtaaaagaggaatgtgaagacttcttaaggggccgggcgcggtggttcacgcctgtaatccaagca

SEQ ID NO: 39061 - DNA, 22 bp, Homo sapiens
  misc_feature 1..22: note = chr1:154098531-154098553
  misc_feature 1..22: note = hypo
  source 1..22: mol_type = genomic DNA
ccgcgcccggccaagaaatgtt

SEQ ID NO: 39062 - DNA, 22 bp, Homo sapiens
  misc_feature 1..22: note = chr1:154107501-154107523
  misc_feature 1..22: note = hypo
  source 1..22: mol_type = genomic DNA
ccacgcccggcctctgtgtacc

SEQ ID NO: 39063 - DNA, 23 bp, Homo sapiens
  misc_feature 1..23: note = chr1:154156755-154156778
  misc_feature 1..23: note = hypo
  source 1..23: mol_type = genomic DNA
gccggcctcggcctcccaaagtg

SEQ ID NO: 39064 - DNA, 30 bp, Homo sapiens
  misc_feature 1..30: note = chr1:154305492-154305522
  misc_feature 1..30: note = hypo
  source 1..30: mol_type = genomic DNA
aaagtgaatagaggtcggtaccatggctca

SEQ ID NO: 39065 - DNA, 54 bp, Homo sapiens
  misc_feature 1..54: note = chr1:154499777-154499831
  misc_feature 1..54: note = hypo
  source 1..54: mol_type = genomic DNA
ccaataaaatataatcgagaactcaaaaagaggctcattcgtacacagaaacta

SEQ ID NO: 39066 - DNA, 35 bp, Homo sapiens
  misc_feature 1..35: note = chr1:154516810-154516845
  misc_feature 1..35: note = hypo
  source 1..35: mol_type = genomic DNA
tgcaggcagtggggccgttgcgttttgcaccccac

SEQ ID NO: 39067 - DNA, 46 bp, Homo sapiens
  misc_feature 1..46: note = chr1:154682497-154682543
  misc_feature 1..46: note = hypo
  source 1..46: mol_type = genomic DNA
agatatcatcttattcgatcacctgagcctccgatggtaggaatta

SEQ ID NO: 39068 - DNA, 30 bp, Homo sapiens
  misc_feature 1..30: note = chr1:154808785-154808815
  misc_feature 1..30: note = hypo
  source 1..30: mol_type = genomic DNA
accccacctgatactcgactggccttaatt

SEQ ID NO: 39069 - DNA, 30 bp, Homo sapiens
  misc_feature 1..30: note = chr1:154851806-154851836
  misc_feature 1..30: note = hypo
  source 1..30: mol_type = genomic DNA
ggttgctatggacaccgcagtcgggctctc

SEQ ID NO: 39070 - DNA, 98 bp, Homo sapiens; identical to SEQ ID NO: 14271
  misc_feature 1..98: note = chr1:155160925-155161023
  misc_feature 1..98: note = hypo
  source 1..98: mol_type = genomic DNA

SEQ ID NO: 39071 - DNA, 30 bp, Homo sapiens
  misc_feature 1..30: note = chr1:155311790-155311820
  misc_feature 1..30: note = hypo
  source 1..30: mol_type = genomic DNA
acaggatagcggttccggtggatcttgtaa

SEQ ID NO: 39072 - DNA, 21 bp, Homo sapiens
  misc_feature 1..21: note = chr1:155563460-155563481
  misc_feature 1..21: note = hypo
  source 1..21: mol_type = genomic DNA
aataaaattgccattcgggcc

SEQ ID NO: 39073 - DNA, 26 bp, Homo sapiens
  misc_feature 1..26: note = chr1:155578901-155578927
  misc_feature 1..26: note = hypo
  source 1..26: mol_type = genomic DNA
actaccgcacccggcccttgccttgt

SEQ ID NO: 39074 - DNA, 59 bp, Homo sapiens
  misc_feature 1..59: note = chr1:155668700-155668759
  misc_feature 1..59: note = hypo
  source 1..59: mol_type = genomic DNA
gtcctccatttcacacgcttgagcatgccttcactggattctttcgggcctcatgttgg

SEQ ID NO: 39075 - DNA, 34 bp, Homo sapiens
  misc_feature 1..34: note = chr1:155826302-155826336
  misc_feature 1..34: note = hypo
  source 1..34: mol_type = genomic DNA
aggcgtgagccaccgcgcccgacctacagttagt

SEQ ID NO: 39076 - DNA, 17 bp, Homo sapiens
  misc_feature 1..17: note = chr1:155892702-155892719
  misc_feature 1..17: note = hypo
  source 1..17: mol_type = genomic DNA
aaagacagtcctggccg

SEQ ID NO: 39077 - DNA, 31 bp, Homo sapiens
  misc_feature 1..31: note = chr1:155905287-155905318
  misc_feature 1..31: note = hypo
  source 1..31: mol_type = genomic DNA
gtggtaggattacaggcgtgagccaccgcgc

SEQ ID NO: 39078 - DNA, 30 bp, Homo sapiens
  misc_feature 1..30: note = chr1:155911924-155911954
  misc_feature 1..30: note = hypo
  source 1..30: mol_type = genomic DNA
tggtggccatggctgcggggccaggcaccc

SEQ ID NO: 39079 - DNA, 30 bp, Homo sapiens
  misc_feature 1..30: note = chr1:155912603-155912633
  misc_feature 1..30: note = hypo
  source 1..30: mol_type = genomic DNA
ggacagagggacacccgggtgaagggcgca

SEQ ID NO: 39080 - DNA, 53 bp, Homo sapiens
  misc_feature 1..53: note = chr1:155954259-155954312
  misc_feature 1..53: note = hypo
  source 1..53: mol_type = genomic DNA
aaagccagacaaaggcgcccagggcttcctcccccacccgcttcacctagatc

SEQ ID NO: 39081 - DNA, 42 bp, Homo sapiens
  misc_feature 1..42: note = chr1:156030121-156030163
  misc_feature 1..42: note = hypo
  source 1..42: mol_type = genomic DNA
ccttcaggatggtctcgatctcctgaccttgtgatccgcccg

SEQ ID NO: 39082 - DNA, 105 bp, Homo sapiens
  misc_feature 1..105: note = chr1:156031479-156031584
  misc_feature 1..105: note = hypo
  source 1..105: mol_type = genomic DNA
taggctcctctgccccgttcctaatagaaacccaaatccctggtgtcagccagtgcagcacaagagatggaggtcagacttcagaaaggacttccctcttttatt

SEQ ID NO: 39083 - DNA, 206 bp, Homo sapiens
  misc_feature 1..206: note = chr1:156253833-156254039
  misc_feature 1..206: note = hypo
  source 1..206: mol_type = genomic DNA
tatcccagcctactccgagcaccctttgttgcacaaatccacttttctccctctgctttcctgagctgggagttcttacgcattccaggtgcctagaatgtgaacttacccctttgcccagctgcatcccaactttcagaaaggatgacatcctcctctgatgcttttttttgtcggcagattcagcagggcggggcctgcccctt

SEQ ID NO: 39084 - DNA, 102 bp, Homo sapiens
  misc_feature 1..102: note = chr1:156271344-156271446
  misc_feature 1..102: note = hypo
  source 1..102: mol_type = genomic DNA
gcctttgttttagctttttttttttttcttttgcatacactcaaaccaatctgcacacacacacccattttgagcccatcaaagccccggacccagccacaa

SEQ ID NO: 39085 - DNA, 47 bp, Homo sapiens; identical to SEQ ID NO: 14276
  misc_feature 1..47: note = chr1:156433495-156433542
  misc_feature 1..47: note = hypo
  source 1..47: mol_type = genomic DNA

SEQ ID NO: 39086 - DNA, 18 bp, Homo sapiens
  misc_feature 1..18: note = chr1:156441212-156441230
  misc_feature 1..18: note = hypo
  source 1..18: mol_type = genomic DNA
gcccggccagaatcaact

SEQ ID NO: 39087 - DNA, 34 bp, Homo sapiens
  misc_feature 1..34: note = chr1:156690386-156690420
  misc_feature 1..34: note = hypo
  source 1..34: mol_type = genomic DNA
cattacaggcgtgagccaccgtgccaggcagaat

SEQ ID NO: 39088 - DNA, 153 bp, Homo sapiens
  misc_feature 1..153: note = chr1:156838167-156838320
  misc_feature 1..153: note = hypo
  source 1..153: mol_type = genomic DNA
tgcctggggtgacatcgcctgggctccaggtcattgaggagggtgggggaaggagcagccccgcagtagagttctggggccactcccagctctaacaccccttggccctcgggcgtcctgggtggccaggtgtgcccacgctgaaggtccagg

SEQ ID NO: 39089 - DNA, 154 bp, Homo sapiens
  misc_feature 1..154: note = chr1:156843312-156843466
  misc_feature 1..154: note = hypo
  source 1..154: mol_type = genomic DNA
cctgccctttgatttcgggttctactcgctttgcccgtggacttgtcgggtgtgtgccaggctccctccagctgcgccctgacctcctgctgttgctctttctggcccacagtcccggccagtgtgcagctgcacacggcggtggagatgcacc

SEQ ID NO: 39090 - DNA, 247 bp, Homo sapiens
  misc_feature 1..247: note = chr1:156849725-156849972
  misc_feature 1..247: note = hypo
  source 1..247: mol_type = genomic DNA
taggctgtgccttgacgggctgtcccaggcgcccctggaattgatgcagtgtccgcccgtggcaggtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggtcagccccggcccatggtcacc

SEQ ID NO: 39091 - DNA, 37 bp, Homo sapiens
  misc_feature 1..37: note = chr1:156866362-156866399
  misc_feature 1..37: note = hypo
  source 1..37: mol_type = genomic DNA
gagtgggccctggggcgtagcccgctcactgctggtg

SEQ ID NO: 39092 - DNA, 30 bp, Homo sapiens
  misc_feature 1..30: note = chr1:157086435-157086465
  misc_feature 1..30: note = hypo
  source 1..30: mol_type = genomic DNA
gtctctgtctctgggcgttgaggttgttcc

SEQ ID NO: 39093 - DNA, 146 bp, Homo sapiens
  misc_feature 1..146: note = chr1:157247317-157247463
  misc_feature 1..146: note = hypo
  source 1..146: mol_type = genomic DNA
gcttacctgggtatgggcattgtctgggccagtggcctttatgaccgcatttgaaacgggagtcaggtggaggtggattattaggaggcttccatgtagagccgcggcccagtggcctgcagggcctctgacggcagaggcaagca

SEQ ID NO: 39094 - DNA, 162 bp, Homo sapiens
  misc_feature 1..162: note = chr1:157458773-157458935
  misc_feature 1..162: note = hypo
  source 1..162: mol_type = genomic DNA
gacttggcaaccagccggacactgattccattcctgcttctaccgctaagctctgtcatccagcagatcctcaatggcctcatctggaaaatgggataatacttcctctgcagggttgctgggaggactaaatagatagaagaaagccccacgcggacgggc

SEQ ID NO: 39095 - DNA, 38 bp, Homo sapiens
  misc_feature 1..38: note = chr1:157490582-157490620
  misc_feature 1..38: note = hypo
  source 1..38: mol_type = genomic DNA
ctctaaagtcagtggcgctcttgcgcccagcccgccaa

SEQ ID NO: 39096 - DNA, 191 bp, Homo sapiens
  misc_feature 1..191: note = chr1:157527405-157527596
  misc_feature 1..191: note = hypo
  source 1..191: mol_type = genomic DNA
agttattttatgaagcgcttacacatttagaattgttacctcttcctgataatttgacacactcgccattattaaatatctctctttatctctgtttcttgcctgaaagccacactgggagagtctcatctacatttggacttgattcagttgattggatgctatacttaaaaacccgaatctgatgctgt

SEQ ID NO: 39097 - DNA, 87 bp, Homo sapiens
  misc_feature 1..87: note = chr1:157543012-157543099
  misc_feature 1..87: note = hypo
  source 1..87: mol_type = genomic DNA
cagtgcagaaggcagcgcttcctcagtgaagtgctaaggggaagaatggcagaagactggaggcaatgggagcgatcaggtggaggc

SEQ ID NO: 39098 - DNA, 36 bp, Homo sapiens
  misc_feature 1..36: note = chr1:157791984-157792020
  misc_feature 1..36: note = hypo
  source 1..36: mol_type = genomic DNA
aacttgaacataaggcgggcggatcacgaggtcagg

SEQ ID NO: 39099 - DNA, 321 bp, Homo sapiens
  misc_feature 1..321: note = chr1:157895211-157895532
  misc_feature 1..321: note = hypo
  source 1..321: mol_type = genomic DNA
gatgctccaaggtgacgacaagaaacagggcgtgaggagggtaagaggccctatgggcactgtagtcttgtgatgggggaggtggtggcagcggcagcggtggcagagagctagaggagggtgagaaggtggacgcggggccatgtatcccgagctcttcaccagagcccagcacagctctgccggaagcacccctgcagggttagaccagcaggtgcgaggtgcgacgtgggaaagagtccagggccggcggggtgctatgaggcgaggacttcctgagccgaggaccgggtgggttgtgagttgcgaccagcctcgctg

SEQ ID NO: 39100 - DNA, 141 bp, Homo sapiens; identical to SEQ ID NO: 14282
  misc_feature 1..141: note = chr1:158169208-158169349
  misc_feature 1..141: note = hypo
  source 1..141: mol_type = genomic DNA

SEQ ID NO: 39101 - DNA, 60 bp, Homo sapiens
  misc_feature 1..60: note = chr1:158237112-158237172
  misc_feature 1..60: note = hypo
  source 1..60: mol_type = genomic DNA
cccggtggtgcagaacgtgtgtgccaggtgcctgcggccgctgcacgtaagagccctggt

SEQ ID NO: 39102 - DNA, 20 bp, Homo sapiens
  misc_feature 1..20: note = chr1:158366698-158366718
  misc_feature 1..20: note = hypo
  source 1..20: mol_type = genomic DNA
tattttggccaggggcggtg

SEQ ID NO: 39103 - DNA, 30 bp, Homo sapiens
  misc_feature 1..30: note = chr1:158578092-158578122
  misc_feature 1..30: note = hypo
  source 1..30: mol_type = genomic DNA
ggttatatatagcggcggacattattagag

SEQ ID NO: 39104 - DNA, 16 bp, Homo sapiens
  misc_feature 1..16: note = chr1:158591676-158591692
  misc_feature 1..16: note = hypo
  source 1..16: mol_type = genomic DNA
ggagtcttgctctgtc

SEQ ID NO: 39105 - DNA, 15 bp, Homo sapiens
  misc_feature 1..15: note = chr1:158591932-158591947
  misc_feature 1..15: note = hypo
  source 1..15: mol_type = genomic DNA
cgtgagccactgcac

SEQ ID NO: 39106 - DNA, 30 bp, Homo sapiens; identical to SEQ ID NO: 14287
  misc_feature 1..30: note = chr1:158639324-158639354
  misc_feature 1..30: note = hypo
  source 1..30: mol_type = genomic DNA

SEQ ID NO: 39107 - DNA, 178 bp, Homo sapiens
  misc_feature 1..178: note = chr1:158669704-158669882
  misc_feature 1..178: note = hypo
  source 1..178: mol_type = genomic DNA
gaagtgagagacacacgtggaaaatgctgtgcggcggcctccagctgaatgaatacgtagaattacagccacaataccatcgtaggacatgaagatgagcatcacagctgtaataatctccactgcatgaatgacatccactacctgaatcatgacgatggctcgtgtgtctgtgcag

SEQ ID NO: 39108 - DNA, 44 bp, Homo sapiens
  misc_feature 1..44: note = chr1:158672331-158672375
  misc_feature 1..44: note = hypo
  source 1..44: mol_type = genomic DNA
gattacaggcatgagccaccgtgcctggccgtgacctccacatt

SEQ ID NO: 39109 - DNA, 107 bp, Homo sapiens
  misc_feature 1..107: note = chr1:158723718-158723825
  misc_feature 1..107: note = hypo
  source 1..107: mol_type = genomic DNA
tagcagaagatcaatcgatatatgagtgttagttgaataaatgtaccgatgatgaataatgatgcagctttactactgagaagggccccgtgcgtacagcaacaaag

SEQ ID NO: 39110 - DNA, 17 bp, Homo sapiens
  misc_feature 1..17: note = chr1:158730575-158730592
  misc_feature 1..17: note = hypo
  source 1..17: mol_type = genomic DNA
ctgggtgcagtggctcg

SEQ ID NO: 39111 - DNA, 33 bp, Homo sapiens
  misc_feature 1..33: note = chr1:158748784-158748817
  misc_feature 1..33: note = hypo
  source 1..33: mol_type = genomic DNA
ggcgacagtgcgagactgcgtctcaaaaaaaaa

SEQ ID NO: 39112 - DNA, 42 bp, Homo sapiens
  misc_feature 1..42: note = chr1:158815297-158815339
  misc_feature 1..42: note = hypo
  source 1..42: mol_type = genomic DNA
aggattacaggcgtgagccaccgcgcccggcctcctgctcaa

SEQ ID NO: 39113 - DNA, 23 bp, Homo sapiens
  misc_feature 1..23: note = chr1:159448019-159448042
  misc_feature 1..23: note = hypo
  source 1..23: mol_type = genomic DNA
tttttttttttgagacggagtct

SEQ ID NO: 39114 - DNA, 41 bp, Homo sapiens
  misc_feature 1..41: note = chr1:159650169-159650210
  misc_feature 1..41: note = hypo
  source 1..41: mol_type = genomic DNA
ggattacaggcgtgagccaccacgcccggcccacttttttt

SEQ ID NO: 39115 - DNA, 20 bp, Homo sapiens
  misc_feature 1..20: note = chr1:159679189-159679209
  misc_feature 1..20: note = hypo
  source 1..20: mol_type = genomic DNA
aagagcgagactccgtctcg

SEQ ID NO: 39116 - DNA, 30 bp, Homo sapiens
  misc_feature 1..30: note = chr1:159683905-159683935
  misc_feature 1..30: note = hypo
  source 1..30: mol_type = genomic DNA
cacaaaagccttcctcgacatgtctgtgag

SEQ ID NO: 39117 - DNA, 169 bp, Homo sapiens; identical to SEQ ID NO: 14290
  misc_feature 1..169: note = chr1:159883486-159883655
  misc_feature 1..169: note = hypo
  source 1..169: mol_type = genomic DNA

SEQ ID NO: 39118 - DNA, 19 bp, Homo sapiens
  misc_feature 1..19: note = chr1:159930262-159930281
  misc_feature 1..19: note = hypo
  source 1..19: mol_type = genomic DNA
ttttttcctttgagacgga

SEQ ID NO: 39119 - DNA, 30 bp, Homo sapiens; identical to SEQ ID NO: 14291
  misc_feature 1..30: note = chr1:159932029-159932059
  misc_feature 1..30: note = hypo
  source 1..30: mol_type = genomic DNA

SEQ ID NO: 39120 - DNA, 71 bp, Homo sapiens
  misc_feature 1..71: note = chr1:160025702-160025773
  misc_feature 1..71: note = hypo
  source 1..71: mol_type = genomic DNA
gtacttacaggctcccgctacctggagcattccaattttaacatgttcagactcagcgtcctgtctcctca

SEQ ID NO: 39121 - DNA, 36 bp, Homo sapiens
  misc_feature 1..36: note = chr1:160451199-160451235
  misc_feature 1..36: note = hypo
  source 1..36: mol_type = genomic DNA
tagactggagctgttcctattcggccatcttggctg

SEQ ID NO: 39122 - DNA, 85 bp, Homo sapiens
  misc_feature 1..85: note = chr1:160693873-160693958
  misc_feature 1..85: note = hypo
  source 1..85: mol_type = genomic DNA
tcacccgtggtaacccgagccctggtattatacacataggtcctgtcctcctgaaaacgggtcaggactggccaggcgcagtggc

SEQ ID NO: 39123 - DNA, 143 bp, Homo sapiens
  misc_feature 1..143: note = chr1:160787406-160787549
  misc_feature 1..143: note = hypo
  source 1..143: mol_type = genomic DNA
tttttgcacaatcttcgcaacaatcctacagagtagatattctcgtttttcccctttatatggataaagaaactgaggctcagaaaagataagggacttatccaaggtcacaccataaaagctggtttcgaaccctgagctct

SEQ ID NO: 39124 - DNA, 30 bp, Homo sapiens
  misc_feature 1..30: note = chr1:160820959-160820989
  misc_feature 1..30: note = hypo
  source 1..30: mol_type = genomic DNA
ttgaccactggccatcggtgatcaacttaa

SEQ ID NO: 39125 - DNA, 30 bp, Homo sapiens; identical to SEQ ID NO: 14294
  misc_feature 1..30: note = chr1:160853373-160853403
  misc_feature 1..30: note = hypo
  source 1..30: mol_type = genomic DNA

SEQ ID NO: 39126 - DNA, 94 bp, Homo sapiens
  misc_feature 1..94: note = chr1:160880601-160880695
  misc_feature 1..94: note = hypo
  source 1..94: mol_type = genomic DNA
gggagagagtgaaggcgcacctacaaggggcttatcaggaccacttatcctctcaaatttctactcttgagtgcgagttaaagaaacaacttaa

SEQ ID NO: 39127 - DNA, 146 bp, Homo sapiens
  misc_feature 1..146: note = chr1:160953007-160953153
  misc_feature 1..146: note = hypo
  source 1..146: mol_type = genomic DNA
aaaaataaaaaagaacggcctcgaatctactcgcagggacctcaggtatggaagtttcttctgtcttttgggaatccagccaggtcaggcctgagtcccagatcccaaagacacccacaaccctggggtaccggggacagtctcaa

SEQ ID NO: 39128 - DNA, 27 bp, Homo sapiens
  misc_feature 1..27: note = chr1:160992336-160992363
  misc_feature 1..27: note = hypo
  source 1..27: mol_type = genomic DNA
cttaatagtcttggccgggtgcgtggc

SEQ ID NO: 39129 - DNA, 57 bp, Homo sapiens; identical to SEQ ID NO: 14297
  misc_feature 1..57: note = chr1:161007705-161007762
  misc_feature 1..57: note = hypo
  source 1..57: mol_type = genomic DNA

SEQ ID NO: 39130 - DNA, 30 bp, Homo sapiens
  misc_feature 1..30: note = chr1:161044643-161044673
  misc_feature 1..30: note = hypo
  source 1..30: mol_type = genomic DNA
gacgtcacccagagccgcaggctgttccca

SEQ ID NO: 39131 - DNA, 181 bp, Homo sapiens
  misc_feature 1..181: note = chr1:161056643-161056824
  misc_feature 1..181: note = hypo
  source 1..181: mol_type = genomic DNA
accctctgagagatgcgaccagaacgctttcctcctcctatctccacagccagacccagtgacccttccaacaccccagcaccccacttcagccaggcctggaccatcacagagtcatcgtatttcagagctggaaggtcaatagagatcatctggtcctagctctcggtctactgaagtc

SEQ ID NO: 39132 - DNA, 33 bp, Homo sapiens
  misc_feature 1..33: note = chr1:161358973-161359006
  misc_feature 1..33: note = hypo
  source 1..33: mol_type = genomic DNA
atgtaaagcaggccacgcacggtggtggctcac

SEQ ID NO: 39133 - DNA, 360 bp, Homo sapiens
  misc_feature 1..360: note = chr1:161367772-161368132
  misc_feature 1..360: note = hypo
  source 1..360: mol_type = genomic DNA
gaaacaccgcgcctggccaaaaaatgttttattttaaattcaaaatgctgtaatggaggctgggtgcagtggctttttttactcagcatacttgagattcatgttgttgtatatgtgagcagttccgtcctttttttggctgagtaacattccattgtatggatcggtctttcacttgttgattgacatttggatagtctacagtttggggctattacaaatagagctgctatgaatgtttgtgtacaggcgtttgtatgggcatatgctctatttactcttggtaaatacctaggagtggaatggctgagtcatattgtagtagtttaacgcttttaaaaacccccaaactgttttcca

SEQ ID NO: 39134 - DNA, 169 bp, Homo sapiens
  misc_feature 1..169: note = chr1:161442404-161442573
  misc_feature 1..169: note = hypo
  source 1..169: mol_type = genomic DNA
ttcccctggagaccccggcgggcagtctctcgaccctgggcggcagagaaagcgcaagatgggacgagtcgacctctctccctccgctctccctccgcgcccaacctcagttgcctggatgtgaggagagcctccccttctgccctcctcatcgcgccagcctgtcttg

SEQ ID NO: 39135 - DNA, 29 bp, Homo sapiens
  misc_feature 1..29: note = chr1:161471750-161471779
  misc_feature 1..29: note = hypo
  source 1..29: mol_type = genomic DNA
ccaccgcacctggccggttctcttgaatc

SEQ ID NO: 39136 - DNA, 30 bp, Homo sapiens
  misc_feature 1..30: note = chr1:161493414-161493444
  misc_feature 1..30: note = hypo
  source 1..30: mol_type = genomic DNA
ctttcccaggtgttgcgttctctcttgggc

SEQ ID NO: 39137 - DNA, 30 bp, Homo sapiens
  misc_feature 1..30: note = chr1:161577640-161577670
  misc_feature 1..30: note = hypo
  source 1..30: mol_type = genomic DNA
tgaagccgagcagtacggggctgaggatga

SEQ ID NO: 39138 - DNA, 45 bp, Homo sapiens
  misc_feature 1..45: note = chr1:161879452-161879497
  misc_feature 1..45: note = hypo
  source 1..45: mol_type = genomic DNA
gtgaacagtaagggccggtcacagaggctcacacctgtaatccca

SEQ ID NO: 39139 - DNA, 30 bp, Homo sapiens; identical to SEQ ID NO: 14301
  misc_feature 1..30: note = chr1:161913509-161913539
  misc_feature 1..30: note = hypo
  source 1..30: mol_type = genomic DNA

SEQ ID NO: 39140 - DNA, 30 bp, Homo sapiens
  misc_feature 1..30: note = chr1:163363352-163363382
  misc_feature 1..30: note = hypo
  source 1..30: mol_type = genomic DNA
tccaggaaaaaaaaccggaaatggatgttg

SEQ ID NO: 39141 - DNA, 39 bp, Homo sapiens
  misc_feature 1..39: note = chr1:165664200-165664239
  misc_feature 1..39: note = hypo
  source 1..39: mol_type = genomic DNA
aaaaaaataaaaataaaaaaaggacgatgagctataaag

SEQ ID NO: 39142 - DNA, 36 bp, Homo sapiens
  misc_feature 1..36: note = chr1:165809083-165809119
  misc_feature 1..36: note = hypo
  source 1..36: mol_type = genomic DNA
gggccggtcacttgccggtaccgtgattcatgttct

SEQ ID NO: 39143 - DNA, 30 bp, Homo sapiens
  misc_feature 1..30: note = chr1:167505794-167505824
  misc_feature 1..30: note = hypo
  source 1..30: mol_type = genomic DNA
ataattaactcacttcgaaatcccttgctt

SEQ ID NO: 39144 - DNA, 38 bp, Homo sapiens
  misc_feature 1..38: note = chr1:167789113-167789151
  misc_feature 1..38: note = hypo
  source 1..38: mol_type = genomic DNA
tagccaaatatttaaagccaaatcggatcaacagtagg

SEQ ID NO: 39145 - DNA, 95 bp, Homo sapiens; identical to SEQ ID NO: 14303
  misc_feature 1..95: note = chr1:167823347-167823442
  misc_feature 1..95: note = hypo
  source 1..95: mol_type = genomic DNA

SEQ ID NO: 39146 - DNA, 30 bp, Homo sapiens
  misc_feature 1..30: note = chr1:168058977-168059007
  misc_feature 1..30: note = hypo
  source 1..30: mol_type = genomic DNA
ctgcctctgcccatgcgcctctgcccaggg

SEQ ID NO: 39147 - DNA, 29 bp, Homo sapiens
  misc_feature 1..29: note = chr1:168116130-168116159
  misc_feature 1..29: note = hypo
  source 1..29: mol_type = genomic DNA
actacacgtagaagccgggtgcggtggct

SEQ ID NO: 39148 - DNA, 30 bp, Homo sapiens; identical to SEQ ID NO: 14304
  misc_feature 1..30: note = chr1:168150766-168150796
  misc_feature 1..30: note = hypo
  source 1..30: mol_type = genomic DNA

SEQ ID NO: 39149 - DNA, 120 bp, Homo sapiens
  misc_feature 1..120: note = chr1:171452999-171453119
  misc_feature 1..120: note = hypo
  source 1..120: mol_type = genomic DNA
gccatacgtgtcagtcttatgaccttggttaatgtaatttcatctgattgctgaagttgttctccattgctcaagacagatgatttggctgggcgtggtggctcatgccggtaattccgg

SEQ ID NO: 39150 - DNA, 30 bp, Homo sapiens
  misc_feature 1..30: note = chr1:171555031-171555061
  misc_feature 1..30: note = hypo
  source 1..30: mol_type = genomic DNA
tgaggtgtcttggggcgaggggcctgtcta

SEQ ID NO: 39151 - DNA, 18 bp, Homo sapiens
  misc_feature 1..18: note = chr1:171625525-171625543
  misc_feature 1..18: note = hypo
  source 1..18: mol_type = genomic DNA
acactgacccttggccgg

SEQ ID NO: 39152 - DNA, 17 bp, Homo sapiens
  misc_feature 1..17: note = chr1:172902655-172902672
  misc_feature 1..17: note = hypo
  source 1..17: mol_type = genomic DNA
atagcagacttgggccg

SEQ ID NO: 39153 - DNA, 30 bp, Homo sapiens
  misc_feature 1..30: note = chr1:173090762-173090792
  misc_feature 1..30: note = hypo
  source 1..30: mol_type = genomic DNA
gaaagaaaaattttccgtctgtcatccata

SEQ ID NO: 39154 - DNA, 61 bp, Homo sapiens
  misc_feature 1..61: note = chr1:173477004-173477065
  misc_feature 1..61: note = hypo
  source 1..61: mol_type = genomic DNA
tttctggtttttttacgccacccagtttgtggtactttgttacagccgtgcttgcaaacta

SEQ ID NO: 39155 - DNA, 30 bp, Homo sapiens
  misc_feature 1..30: note = chr1:173794930-173794960
  misc_feature 1..30: note = hypo
  source 1..30: mol_type = genomic DNA
ccttatgtgtagaagcgaaattcactctca

SEQ ID NO: 39156 - DNA, 30 bp, Homo sapiens
  misc_feature 1..30: note = chr1:173897621-173897651
  misc_feature 1..30: note = hypo
  source 1..30: mol_type = genomic DNA
gaaagagccaagctccgtctcgaggaaaaa

SEQ ID NO: 39157 - DNA, 77 bp, Homo sapiens
  misc_feature 1..77: note = chr1:173993036-173993113
  misc_feature 1..77: note = hypo
  source 1..77: mol_type = genomic DNA
gcagtatgatttttacgttgtttatttttatctcgtcaatatttcaattaaaaatacgttaaaggacagatagatgc

SEQ ID NO: 39158 - DNA, 30 bp, Homo sapiens
  misc_feature 1..30: note = chr1:174421982-174422012
  misc_feature 1..30: note = hypo
  source 1..30: mol_type = genomic DNA
gccactgcacccagccggtagctgctgttt

SEQ ID NO: 39159 - DNA, 30 bp, Homo sapiens
  misc_feature 1..30: note = chr1:175346485-175346515
  misc_feature 1..30: note = hypo
  source 1..30: mol_type = genomic DNA
tgaacagttagccatcgattttatataact

SEQ ID NO: 39160 - DNA, 348 bp, Homo sapiens
  misc_feature 1..348: note = chr1:175355017-175355365
  misc_feature 1..348: note = hypo
  source 1..348: mol_type = genomic DNA
ctcttgcttccttctcgcggtgtctatgacaaggccaatgctctgacacaccttgcctcattcctaatactcctcttgctgtgatgacaccaccggttggctccacccctctttccctccttgtgcgtctctcccccaccgcagccttacctgttgtgaactgagtggtggcagaatcgctctcgttggtccctcggacggcactgactgacacctcgtatcgggagccaggccgcagggcctgcactgagtattggctcaggggaggctgcagccggaaggtggtcctcccaccttccccgcccaccaggccatatttcaaaagaatgaaatcgactttggctcgag

SEQ ID NO: 39161 - DNA, 229 bp, Homo sapiens
  misc_feature 1..229: note = chr1:175365646-175365875
  misc_feature 1..229: note = hypo
  source 1..229: mol_type = genomic DNA
aaaaatgaagcaggacggggaaatggtacgtacgggtggccaccttggcagtgatgggaaggctgaggatgttgctaatgacagcgtagacgctgatgttgtaggtgagacctggctccagctccgtgatggtgacaccactccaatctccaggcacccgctgctggagctggaggccccccagggccgtcggctggtaagagatcacatattccgtcactgccatcgg

SEQ ID NO: 39162 - DNA, 78 bp, Homo sapiens; identical to SEQ ID NO: 14308
  misc_feature 1..78: note = chr1:175372494-175372572
  misc_feature 1..78: note = hypo
  source 1..78: mol_type = genomic DNA

SEQ ID NO: 39163 - DNA, 35 bp, Homo sapiens
  misc_feature 1..35: note = chr1:175375411-175375446
  misc_feature 1..35: note = hypo
  source 1..35: mol_type = genomic DNA
ccctctccagcatctcgatccggctcagcagctcc

SEQ ID NO: 39164 - DNA, 30 bp, Homo sapiens
  misc_feature 1..30: note = chr1:175388670-175388700
  misc_feature 1..30: note = hypo
  source 1..30: mol_type = genomic DNA
tctgtggcacgatctcggctcactgcaacc

SEQ ID NO: 39165 - DNA, 102 bp, Homo sapiens
  misc_feature 1..102: note = chr1:175472249-175472351
  misc_feature 1..102: note = hypo
  source 1..102: mol_type = genomic DNA
tgaacagccagtacacgttgctgaggatgactgggagaccagaggacccatggctgagggaagagaagcctccctaagatgagaaggcgcagctgaatgggc

SEQ ID NO: 39166 - DNA, 32 bp, Homo sapiens
  misc_feature 1..32: note = chr1:178531766-178531798
  misc_feature 1..32: note = hypo
  source 1..32: mol_type = genomic DNA
accgtaaacccttgtcgcgggggaaaagctag

SEQ ID NO: 39167 - DNA, 30 bp, Homo sapiens
  misc_feature 1..30: note = chr1:178857986-178858016
  misc_feature 1..30: note = hypo
  source 1..30: mol_type = genomic DNA
tctcagaaccctgcccgtaaaaaagagttt

SEQ ID NO: 39168 - DNA, 30 bp, Homo sapiens
  misc_feature 1..30: note = chr1:178994064-178994094
  misc_feature 1..30: note = hypo
  source 1..30: mol_type = genomic DNA
gaattctgttcagtacgccttactgattaa

SEQ ID NO: 39169 - DNA, 26 bp, Homo sapiens
  misc_feature 1..26: note = chr1:179262298-179262324
  misc_feature 1..26: note = hypo
  source 1..26: mol_type = genomic DNA
gcgtgagccaccgcacctggcctcaa

SEQ ID NO: 39170 - DNA, 30 bp, Homo sapiens
  misc_feature 1..30: note = chr1:179781741-179781771
  misc_feature 1..30: note = hypo
  source 1..30: mol_type = genomic DNA
cgcagccaaattattcgcagccccgttcag

SEQ ID NO: 39171 - DNA, 30 bp, Homo sapiens; identical to SEQ ID NO: 14309
  misc_feature 1..30: note = chr1:179849955-179849985
  misc_feature 1..30: note = hypo
  source 1..30: mol_type = genomic DNA

SEQ ID NO: 39172 - DNA, 30 bp, Homo sapiens
  misc_feature 1..30: note = chr1:180096076-180096106
  misc_feature 1..30: note = hypo
  source 1..30: mol_type = genomic DNA
gtggtggagctggatcggaaaccatttgtc

SEQ ID NO: 39173 - DNA, 30 bp, Homo sapiens
  misc_feature 1..30: note = chr1:180137119-180137149
  misc_feature 1..30: note = hypo
  source 1..30: mol_type = genomic DNA
ccagtgagcatgagccgcaggggtgcagcc

SEQ ID NO: 39174 - DNA, 57 bp, Homo sapiens
  misc_feature 1..57: note = chr1:180235667-180235724
  misc_feature 1..57: note = hypo
  source 1..57: mol_type = genomic DNA
ctacctcatggaggacgggcggctggtgtgcaaggaagactacgagacagccaagca

SEQ ID NO: 39175 - DNA, 30 bp, Homo sapiens
  misc_feature 1..30: note = chr1:180910386-180910416
  misc_feature 1..30: note = hypo
  source 1..30: mol_type = genomic DNA
agtccagggccccatcgttacaatccctgc

SEQ ID NO: 39176 - DNA, 99 bp, Homo sapiens
  misc_feature 1..99: note = chr1:180925089-180925188
  misc_feature 1..99: note = hypo
  source 1..99: mol_type = genomic DNA
agactagttctggagcgactcaaaaggccctgctgcacctgcatgaacaggccttcccctttctccctccctcccccacatatccgcagagaagtttcc

SEQ ID NO: 39177 - DNA, 30 bp, Homo sapiens
  misc_feature 1..30: note = chr1:181727256-181727286
  misc_feature 1..30: note = hypo
  source 1..30: mol_type = genomic DNA
gagaggcacaagagccgactgagccccagc

SEQ ID NO: 39178 - DNA, 91 bp, Homo sapiens
  misc_feature 1..91: note = chr1:181922685-181922776
  misc_feature 1..91: note = hypo
  source 1..91: mol_type = genomic DNA
gcatgtactatgtatcggacatcatgccaggccgtaggggactaaagaaatgagaaagacatggtccttgcatcagcggagtttttcgggg

SEQ ID NO: 39179 - DNA, 21 bp, Homo sapiens
  misc_feature 1..21: note = chr1:182815386-182815407
  misc_feature 1..21: note = hypo
  source 1..21: mol_type = genomic DNA
tttgagatggagtttcgcttt

SEQ ID NO: 39180 - DNA, 158 bp, Homo sapiens
  misc_feature 1..158: note = chr1:183129382-183129540
  misc_feature 1..158: note = hypo
  source 1..158: mol_type = genomic DNA
caaaggaagaaagagcgcctgaagcatgtgttcaccgggcaactatgaatggcttgactgggtggagccttcagtatctttttagttaagccttttagtctcaaaaatggaagaggcaaagctcaattcttaaagatcacttcttttttttttttgag

SEQ ID NO: 39181 - DNA, 37 bp, Homo sapiens
  misc_feature 1..37: note = chr1:183462987-183463024
  misc_feature 1..37: note = hypo
  source 1..37: mol_type = genomic DNA
tacaggcgtgagtcatagcacccggccactttactgg

SEQ ID NO: 39182 - DNA, 30 bp, Homo sapiens
  misc_feature 1..30: note = chr1:185073818-185073848
  misc_feature 1..30: note = hypo
  source 1..30: mol_type = genomic DNA
ttttaaactgtacaccgttctgagtagcct

SEQ ID NO: 39183 - DNA, 30 bp, Homo sapiens
  misc_feature 1..30: note = chr1:191565747-191565777
  misc_feature 1..30: note = hypo
  source 1..30: mol_type = genomic DNA
cacacctagccaggtcgtcacagtgcatgg

SEQ ID NO: 39184 - DNA, 150 bp, Homo sapiens
  misc_feature 1..150: note = chr1:191763150-191763300
  misc_feature 1..150: note = hypo
  source 1..150: mol_type = genomic DNA
tttttaatttttttgtttgtttgttttaactctccaaagtgacaatggaaacttctacttttctaaaaaaaaattaaggatatgctcccaactccgcattttggctcttgctttttgatataagatagatattctcgcattttgcagtac

SEQ ID NO: 39185 - DNA, 217 bp, Homo sapiens
  misc_feature 1..217: note = chr1:195732322-195732539
  misc_feature 1..217: note = hypo
  source 1..217: mol_type = genomic DNA
tgagattttggtggccgcggaaagtaggaacgagagagctggagcacgccccctacctctttggcctctgtggttgctggcgtctcactcaggtttttgggtgccactgtgttcccctcatccagaccctggtacttgcagcggaagccgcctgtggtacacctggtccagctgcagcctcgcaaggagctggtgccggtgccggttcctggagctg

SEQ ID NO: 39186 - DNA, 30 bp, Homo sapiens
  misc_feature 1..30: note = chr1:197771436-197771466
  misc_feature 1..30: note = hypo
  source 1..30: mol_type = genomic DNA
attaaaaattaatgtcggaattcgagggga

SEQ ID NO: 39187 - DNA, 160 bp, Homo sapiens
  misc_feature 1..160: note = chr1:200505065-200505225
  misc_feature 1..160: note = hypo
  source 1..160: mol_type = genomic DNA
tttattgacagatatcgagttatttctcattttgcctgcacaatagaaaataagctgcaaaaacctatgtataggtcattcctaccccagaccaattataaatcaaaatctctgagagtcagggttgttttttttttttttgagacggagtctcactctg

SEQ ID NO: 39188 - DNA, 30 bp, Homo sapiens; identical to SEQ ID NO: 14313
  misc_feature 1..30: note = chr1:200519350-200519380
  misc_feature 1..30: note = hypo
  source 1..30: mol_type = genomic DNA

SEQ ID NO: 39189 - DNA, 30 bp, Homo sapiens; identical to SEQ ID NO: 14314
  misc_feature 1..30: note = chr1:200864028-200864058
  misc_feature 1..30: note = hypo
  source 1..30: mol_type = genomic DNA

SEQ ID NO: 39190 - DNA, 49 bp, Homo sapiens
  misc_feature 1..49: note = chr1:200941620-200941669
  misc_feature 1..49: note = hypo
  source 1..49: mol_type = genomic DNA
ccgccttcccgggggcgctgggcacaagacctcgcgagtgagaagacac

SEQ ID NO: 39191 - DNA, 30 bp, Homo sapiens; identical to SEQ ID NO: 14315
  misc_feature 1..30: note = chr1:201244396-201244426
  misc_feature 1..30: note = hypo
  source 1..30: mol_type = genomic DNA

SEQ ID NO: 39192 - DNA, 196 bp, Homo sapiens
  misc_feature 1..196: note = chr1:201445702-201445898
  misc_feature 1..196: note = hypo
  source 1..196: mol_type = genomic DNA
ctgacctgctcgcaccgctttgatgtacagccctttgttccaggactttggggtttcctcggatctctgtttttctaaagggaaacagaaggaaaaaccctaccaaggtttcaagtctctgatgacttgggttttatgggcaccattgcgacagacttcaagtgggcagcaactctgcagccgacccgcccaggct

SEQ ID NO: 39193 - DNA, 39 bp, Homo sapiens
  misc_feature 1..39: note = chr1:201797433-201797472
  misc_feature 1..39: note = hypo
  source 1..39: mol_type = genomic DNA
ttagaggcgtgagccactgcgcctcgccacaccctgcat

SEQ ID NO: 39194 - DNA, 30 bp, Homo sapiens
  misc_feature 1..30: note = chr1:201851118-201851148
  misc_feature 1..30: note = hypo
  source 1..30: mol_type = genomic DNA
atcaatccaagtgctcgatcagaggctaga

SEQ ID NO: 39195 - DNA, 101 bp, Homo sapiens
  misc_feature 1..101: note = chr1:201977862-201977963
  misc_feature 1..101: note = hypo
  source 1..101: mol_type = genomic DNA
tttttttttttgagacgcagtgattacaggtgtgagccaccggatcctacatttcaaatgcataaaaatctagatatgggctgggcgcagtagctcatgcc

SEQ ID NO: 39196 - DNA, 30 bp, Homo sapiens
  misc_feature 1..30: note = chr1:201981114-201981144
  misc_feature 1..30: note = hypo
  source 1..30: mol_type = genomic DNA
agttctggtcgaagacgcaggttctggact

SEQ ID NO: 39197 - DNA, 42 bp, Homo sapiens; identical to SEQ ID NO: 14317
  misc_feature 1..42: note = chr1:201982442-201982484
  misc_feature 1..42: note = hypo
  source 1..42: mol_type = genomic DNA

SEQ ID NO: 39198 - DNA, 105 bp, Homo sapiens
  misc_feature 1..105: note = chr1:201983126-201983231
  misc_feature 1..105: note = hypo
  source 1..105: mol_type = genomic DNA
tacgagaagctgagccgggccatgaggtgagctggcggccaggaccctcacgatacagccggacatggggacaggcgctcacactcccaccgccctctttctggc

SEQ ID NO: 39199 - DNA, 98 bp, Homo sapiens
  misc_feature 1..98: note = chr1:201984047-201984145
  misc_feature 1..98: note = hypo
  source 1..98: mol_type = genomic DNA
aagtcatgtaatttaatgatcagaccccagtcacagccataggatacaaagaagcaaaggcaaagagccctgtgtcctgggcacggttacaggccagt

SEQ ID NO: 39200 - DNA, 159 bp, Homo sapiens
  misc_feature 1..159: note = chr1:201986490-201986649
  misc_feature 1..159: note = hypo
  source 1..159: mol_type = genomic DNA
tagacaaaggggatgcgggccagggcgtaggtctagcctcagaagctggggaagctttcacagctacttagtctaaaaatgaccccatttcttggaaattatgcattagactctggtctagtttccctagccacaatatctcggggtccttgcaccctt

SEQ ID NO: 39201 - DNA, 16 bp, Homo sapiens
  misc_feature 1..16: note = chr1:202081788-202081804
  misc_feature 1..16: note = hypo
  source 1..16: mol_type = genomic DNA
ccgtctcaaaaaaaaa

SEQ ID NO: 39202 - DNA, 30 bp, Homo sapiens
  misc_feature 1..30: note = chr1:202101759-202101789
  misc_feature 1..30: note = hypo
  source 1..30: mol_type = genomic DNA
gggtgaaggagaggccgagggaggtggagc

SEQ ID NO: 39203 - DNA, 139 bp, Homo sapiens
  misc_feature 1..139: note = chr1:202311995-202312134
  misc_feature 1..139: note = hypo
  source 1..139: mol_type = genomic DNA
tgacttttaaaccatcttccaacgctagatgcatggtactttctgaacaaggaagaacctgtttatagttaagccaaccttaacttctcagagctgcctctgccagaggccaatgcttcatgagcgctgaaagatggca

SEQ ID NO: 39204 - DNA, 30 bp, Homo sapiens
  misc_feature 1..30: note = chr1:202856302-202856332
  misc_feature 1..30: note = hypo
  source 1..30: mol_type = genomic DNA
tatgggctatatactcggcacagtgctaag

SEQ ID NO: 39205 - DNA, 37 bp, Homo sapiens
  misc_feature 1..37: note = chr1:202898225-202898262
  misc_feature 1..37: note = hypo
  source 1..37: mol_type = genomic DNA
ggattacaggcgtcagccacagcgcctagccctttga

SEQ ID NO: 39206 - DNA, 33 bp, Homo sapiens
  misc_feature 1..33: note = chr1:202933730-202933763
  misc_feature 1..33: note = hypo
  source 1..33: mol_type = genomic DNA
gtaatgcacctgtcccgccggcaatcattccca

SEQ ID NO: 39207 - DNA, 79 bp, Homo sapiens
  misc_feature 1..79: note = chr1:202995301-202995380
  misc_feature 1..79: note = hypo
  source 1..79: mol_type = genomic DNA
tgacaattacaaggccgagactaaggccaatttagggaacgggctgttagactaggaacaagggcgagttcagagggag

SEQ ID NO: 39208 - DNA, 30 bp, Homo sapiens
  misc_feature 1..30: note = chr1:203257678-203257708
  misc_feature 1..30: note = hypo
  source 1..30: mol_type = genomic DNA
gtaccagagcaacctcgaagaaagctgaga

SEQ ID NO: 39209 - DNA, 33 bp, Homo sapiens
  misc_feature 1..33: note = chr1:203298181-203298214
  misc_feature 1..33: note = hypo
  source 1..33: mol_type = genomic DNA
ttcagtgacgcctgacggcgaggtcagggaaga

SEQ ID NO: 39210 - DNA, 85 bp, Homo sapiens
  misc_feature 1..85: note = chr1:203429564-203429649
  misc_feature 1..85: note = hypo
  source 1..85: mol_type = genomic DNA
atggctactaagtaacgtctacagtgtgggtatgctggacaaagggcggattcatatcgccagcaggatgaagcgggagagtgca

SEQ ID NO: 39211 - DNA, 22 bp, Homo sapiens
  misc_feature 1..22: note = chr1:203911836-203911858
  misc_feature 1..22: note = hypo
  source 1..22: mol_type = genomic DNA
gattcaggacagggccgggcgt

SEQ ID NO: 39212 - DNA, 30 bp, Homo sapiens
  misc_feature 1..30: note = chr1:204333529-204333559
  misc_feature 1..30: note = hypo
  source 1..30: mol_type = genomic DNA
atgaggccgccttcccgcttgctttctatt

SEQ ID NO: 39213 - DNA, 30 bp, Homo sapiens
  misc_feature 1..30: note = chr1:204535867-204535897
  misc_feature 1..30: note = hypo
  source 1..30: mol_type = genomic DNA
aaggaaatacagcctcgggctagctttcac

SEQ ID NO: 39214 - DNA, 30 bp, Homo sapiens
  misc_feature 1..30: note = chr1:204536295-204536325
  misc_feature 1..30: note = hypo
  source 1..30: mol_type = genomic DNA
ggatgaccaggactccggaaatctagtaca

SEQ ID NO: 39215 - DNA, 122 bp, Homo sapiens
  misc_feature 1..122: note = chr1:204587578-204587700
  misc_feature 1..122: note = hypo
  source 1..122: mol_type = genomic DNA
cacaaccacactaaccgtcttagtgtcagcccccaccaggttctgggccacacaggtgtatagccctgcctcttctgctgtcaccctccgcagctccagggtcccctcggggtacacccggt

SEQ ID NO: 39216 - DNA, 112 bp, Homo sapiens
  misc_feature 1..112: note = chr1:204588271-204588383
  misc_feature 1..112: note = hypo
  source 1..112: mol_type = genomic DNA
gttggcaaagtcccccggccctacccgctggagcgggttcttgttgaggtctaggaacttgagcccgggcacctgttccagtgcccgcctgggcacccgggccagctggttg

SEQ ID NO: 39217 - DNA, 27 bp, Homo sapiens
  misc_feature 1..27: note = chr1:204721236-204721263
  misc_feature 1..27: note = hypo
  source 1..27: mol_type = genomic DNA
gctacagacccacgcctcctgctgtat

SEQ ID NO: 39218 - DNA, 145 bp, Homo sapiens
  misc_feature 1..145: note = chr1:205310661-205310806
  misc_feature 1..145: note = hypo
  source 1..145: mol_type = genomic DNA
tcagacccatctgggcgtccctgaactacaagcctgggtcgacagcaccggctcagtgccttctgttaccctattccatcaccctaattgccacctgttactgaataatctttgtttctttttctttttttttttgatacggagt

SEQ ID NO: 39219 - DNA, 24 bp, Homo sapiens
  misc_feature 1..24: note = chr1:205311046-205311070
  misc_feature 1..24: note = hypo
  source 1..24: mol_type = genomic DNA
gattacaggcgtgagccaccgcgc

SEQ ID NO: 39220 - DNA, 30 bp, Homo sapiens
  misc_feature 1..30: note = chr1:205548923-205548953
  misc_feature 1..30: note = hypo
  source 1..30: mol_type = genomic DNA
ctccctggtgtttgccgtcatccccttctg

SEQ ID NO: 39221 - DNA, 61 bp, Homo sapiens
  misc_feature 1..61: note = chr1:207200870-207200931
  misc_feature 1..61: note = hypo
  source 1..61: mol_type = genomic DNA
tgctgtcacagctgccgacacgggtcacgggttctgagccagtccccgctggccacagctc

SEQ ID NO: 39222 - DNA, 27 bp, Homo sapiens
  misc_feature 1..27: note = chr1:207227190-207227217
  misc_feature 1..27: note = hypo
  source 1..27: mol_type = genomic DNA
ttcgagattttcccacgtccctcactt

SEQ ID NO: 39223 - DNA, 25 bp, Homo sapiens
  misc_feature 1..25: note = chr1:207598909-207598934
  misc_feature 1..25: note = hypo
  source 1..25: mol_type = genomic DNA
ccaaactcaccgagtcatgcaggct

SEQ ID NO: 39224 - DNA, 30 bp, Homo sapiens; identical to SEQ ID NO: 14325
  misc_feature 1..30: note = chr1:207656486-207656516
  misc_feature 1..30: note = hypo
  source 1..30: mol_type = genomic DNA

SEQ ID NO: 39225 - DNA, 137 bp, Homo sapiens
  misc_feature 1..137: note = chr1:207787630-207787767
  misc_feature 1..137: note = hypo
  source 1..137: mol_type = genomic DNA
gacctaaatgatagtcgaggaggaaatggtagtgaggaagctgagcatctattagcgaagaaatcaagggagagatgggaattgctcacacatttgctaccactttttttttctttaggttccgattaaaaggcagg

SEQ ID NO: 39226 - DNA, 30 bp, Homo sapiens
  misc_feature 1..30: note = chr1:207857205-207857235
  misc_feature 1..30: note = hypo
  source 1..30: mol_type = genomic DNA
tttgcctctagataccgactcattggttcc

SEQ ID NO: 39227 - DNA, 129 bp, Homo sapiens
  misc_feature 1..129: note = chr1:207911135-207911264
  misc_feature 1..129: note = hypo
  source 1..129: mol_type = genomic DNA
gaggaatctggtggccgtaataaccggggaacagatgagctggaggcctcatcaggaggggtgtcccttggtggaaggacaccattcccggccttaaaaggagaggctccagcacggctggggaagcat

SEQ ID NO: 39228 - DNA, 116 bp, Homo sapiens
  misc_feature 1..116: note = chr1:207991495-207991611
  misc_feature 1..116: note = hypo
  source 1..116: mol_type = genomic DNA
tgtccctctgccccacgctccagcagagggggtagagaagagaaaggggaggacggtttgtccgcattcagtggcagtggaggtgcatcttctctctcggtcgcaagaaggtgggg

SEQ ID NO: 39229 - DNA, 30 bp, Homo sapiens
  misc_feature 1..30: note = chr1:207992298-207992328
  misc_feature 1..30: note = hypo
  source 1..30: mol_type = genomic DNA
tgagttacctggtgtcgctcccatcctgat

SEQ ID NO: 39230 - DNA, 115 bp, Homo sapiens
  misc_feature 1..115: note = chr1:208951412-208951527
  misc_feature 1..115: note = hypo
  source 1..115: mol_type = genomic DNA
actaagaatctcttgcgtttatatattgcttttactttctaagtgcattcgcatctgttctgtcattttcttattccaatacccttaggaatgatggatccgtcagaggcaatgc

SEQ ID NO: 39231 - DNA, 137 bp, Homo sapiens
  misc_feature 1..137: note = chr1:209306205-209306342
  misc_feature 1..137: note = hypo
  source 1..137: mol_type = genomic DNA
tgctacacaagcaagcgagtgcgggaactggagtgagtgaatactggaaccgggggtcacttctctctggtgagaacaggctctgtgtgggccccgcagcagcctccgagcccctgccctctcggcacctgagttct

SEQ ID NO: 39232 - DNA, 185 bp, Homo sapiens
  misc_feature 1..185: note = chr1:209601396-209601581
  misc_feature 1..185: note = hypo
  source 1..185: mol_type = genomic DNA
gcggagcccaagttgcgcatggaagcgggggtggggtaaaataatcaagtttatagaccgccctctttaaagttactaatgagcttgccttctctttccttaatttcccctcgcagtgtggtcttttccccacccccagacatgaaagggaagcaggtcacaaagcctttcggattataaaagaa

SEQ ID NO: 39233 - DNA, 191 bp, Homo sapiens
  misc_feature 1..191: note = chr1:209999773-209999964
  misc_feature 1..191: note = hypo
  source 1..191: mol_type = genomic DNA
agaactgacaagaatcgcattctaatggttttattacaacttctatggtgtgacacagtatcagggaaaacccaaatttcccacagtagcactccaatagcagagctattattttgcttctcatttctctcattttggacgctcctgttttaccgtaaatattcaagtgaattctgcggcttatgatttaa

SEQ ID NO: 39234 - DNA, 33 bp, Homo sapiens
  misc_feature 1..33: note = chr1:211430421-211430454
  misc_feature 1..33: note = hypo
  source 1..33: mol_type = genomic DNA
aagtgccaggattacaggcgtgggccaccgcgc

SEQ ID NO: 39235 - DNA, 31 bp, Homo sapiens; identical to SEQ ID NO: 4957
  misc_feature 1..31: note = chr1:212963970-212964001
  misc_feature 1..31: note = hypo
  source 1..31: mol_type = genomic DNA

SEQ ID NO: 39236 - DNA, 180 bp, Homo sapiens
  misc_feature 1..180: note = chr1:213189664-213189844
  misc_feature 1..180: note = hypo
  source 1..180: mol_type = genomic DNA
gtgaaaatttttaattgcccaaagtgcagattcccagctgaggctgaacaacgcatcctctgggtgcccatggaactgaggtaccacagaattttgcaattaatgttgcggaagcacagccatagctctcactttaaaatgtacgtgtatgggccgggcgcggtggctcacgcctgtaat

SEQ ID NO: 39237 - DNA, 101 bp, Homo sapiens
  misc_feature 1..101: note = chr1:213190144-213190245
  misc_feature 1..101: note = hypo
  source 1..101: mol_type = genomic DNA
acctttattaaatgtattataggactgtagattgttgaaagacattatttaagtggagaccctgcaagaaacaggaagagagaaaccgagaaagaataaag

SEQ ID NO: 39238 - DNA, 41 bp, Homo sapiens
  misc_feature 1..41: note = chr1:215745246-215745287
  misc_feature 1..41: note = hypo
  source 1..41: mol_type = genomic DNA
tacaggcgtgagccaccgcgcctagccgagataaactttta

SEQ ID NO: 39239 - DNA, 30 bp, Homo sapiens
  misc_feature 1..30: note = chr1:217805039-217805069
  misc_feature 1..30: note = hypo
  source 1..30: mol_type = genomic DNA
agtgctttttttcttcgacatcaccactct

SEQ ID NO: 39240 - DNA, 30 bp, Homo sapiens
  misc_feature 1..30: note = chr1:219253291-219253321
  misc_feature 1..30: note = hypo
  source 1..30: mol_type = genomic DNA
taactacactattgccgtttactctgtgaa

SEQ ID NO: 39241 - DNA, 39 bp, Homo sapiens
  misc_feature 1..39: note = chr1:220552763-220552802
  misc_feature 1..39: note = hypo
  source 1..39: mol_type = genomic DNA
caaactcctctttgttccaccagtcgatggcctgccagc

SEQ ID NO: 39242 - DNA, 96 bp, Homo sapiens
  misc_feature 1..96: note = chr1:220636414-220636510
  misc_feature 1..96: note = hypo
  source 1..96: mol_type = genomic DNA
acaggtaggatctgccctcccaggtgtcgctgcagctgcagcacctgtggctgcagacttgggcctccggcttcaggaagtcggtagaagcaggga

SEQ ID NO: 39243 - DNA, 30 bp, Homo sapiens
  misc_feature 1..30: note = chr1:221706708-221706738
  misc_feature 1..30: note = hypo
  source 1..30: mol_type = genomic DNA
aaggcaaatgcctggcggatagggatttgg

SEQ ID NO: 39244 - DNA, 30 bp, Homo sapiens
  misc_feature 1..30: note = chr1:222391027-222391057
  misc_feature 1..30: note = hypo
  source 1..30: mol_type = genomic DNA
aacagcagaaaccagcgtgccagaggctaa

SEQ ID NO: 39245 - DNA, 165 bp, Homo sapiens
  misc_feature 1..165: note = chr1:222987570-222987735
  misc_feature 1..165: note = hypo
  source 1..165: mol_type = genomic DNA
ctcctggccagctaccggtacaagccaagctctcactccataacgtccttcttctctgcatgcccttctccactgtgcctgtcctttaactcttattcatcatttatttcagtctcaattgaagagtcattatttctagaaagccttctccgcccagctctctac

SEQ ID NO: 39246 - DNA, 30 bp, Homo sapiens
  misc_feature 1..30: note = chr1:223841897-223841927
  misc_feature 1..30: note = hypo
  source 1..30: mol_type = genomic DNA
aaacacaaacccagacggacacatcaggta

SEQ ID NO: 39247 - DNA, 189 bp, Homo sapiens
  misc_feature 1..189: note = chr1:223907491-223907680
  misc_feature 1..189: note = hypo
  source 1..189: mol_type = genomic DNA
tctcaggggtgtgtgcgtgtgtgtgtgtgtgtgtgtgtgtgtgcgcgcgcgcgcgtataatgcagtattggtcattttgttctttcagccttttattttggaggactctagttagatcacaatctgtgaaatgtggtatactgtactctcaccctgattctggcacctggccagcgggtgctgatgggg

SEQ ID NO: 39248 - DNA, 30 bp, Homo sapiens
  misc_feature 1..30: note = chr1:224232559-224232589
  misc_feature 1..30: note = hypo
  source 1..30: mol_type = genomic DNA
gatcaaggtaccatacggaggtacacttaa

SEQ ID NO: 39249 - DNA, 24 bp, Homo sapiens
  misc_feature 1..24: note = chr1:224251284-224251308
  misc_feature 1..24: note = hypo
  source 1..24: mol_type = genomic DNA
gattacaggcgtgagccaccacgc

SEQ ID NO: 39250 - DNA, 30 bp, Homo sapiens; identical to SEQ ID NO: 14332
  misc_feature 1..30: note = chr1:224267844-224267874
  misc_feature 1..30: note = hypo
  source 1..30: mol_type = genomic DNA

SEQ ID NO: 39251 - DNA, 32 bp, Homo sapiens
  misc_feature 1..32: note = chr1:224300912-224300944
  misc_feature 1..32: note = hypo
  source 1..32: mol_type = genomic DNA
aagtgctggattacaggcgtgagtcaacacgc

SEQ ID NO: 39252 - DNA, 16 bp, Homo sapiens
  misc_feature 1..16: note = chr1:224361275-224361291
  misc_feature 1..16: note = hypo
  source 1..16: mol_type = genomic DNA
acgtagagtgagattc

SEQ ID NO: 39253 - DNA, 121 bp, Homo sapiens; identical to SEQ ID NO: 14333
  misc_feature 1..121: note = chr1:226062878-226062999
  misc_feature 1..121: note = hypo
  source 1..121: mol_type = genomic DNA

SEQ ID NO: 39254 - DNA, 86 bp, Homo sapiens
  misc_feature 1..86: note = chr1:226163129-226163215
  misc_feature 1..86: note = hypo
  source 1..86: mol_type = genomic DNA
taaagacatggttgtatacacagacactgaaattcctctagcggaaaacaacagcaaatgattaaagataacgttgtttgttgagg

SEQ ID NO: 39255 - DNA, 30 bp, Homo sapiens
  misc_feature 1..30: note = chr1:226284013-226284043
  misc_feature 1..30: note = hypo
  source 1..30: mol_type = genomic DNA
gctcagagctcccctcggaggaaaggctgg

SEQ ID NO: 39256 - DNA, 127 bp, Homo sapiens
  misc_feature 1..127: note = chr1:226303892-226304019
  misc_feature 1..127: note = hypo
  source 1..127: mol_type = genomic DNA
cacgatgttctcctccgcatgtgtgggtagctagggccctctctggtctctcttgagtgtgatgcaaactttcgcatgcctgcagccttccagaccactgagggtgtgaggccgcttacccactaat

SEQ ID NO: 39257 - DNA, 49 bp, Homo sapiens
  misc_feature 1..49: note = chr1:226314981-226315030
  misc_feature 1..49: note = hypo
  source 1..49: mol_type = genomic DNA
gagttcgaggccctgcggagctgcttcgccgccgcggccaagaagacgc

SEQ ID NO: 39258 - DNA, 43 bp, Homo sapiens
  misc_feature 1..43: note = chr1:226620644-226620687
  misc_feature 1..43: note = hypo
  source 1..43: mol_type = genomic DNA
gaatttctctggactcgtagggtgaactcgacccaacatcttc

SEQ ID NO: 39259 - DNA, 30 bp, Homo sapiens
  misc_feature 1..30: note = chr1:226725373-226725403
  misc_feature 1..30: note = hypo
  source 1..30: mol_type = genomic DNA
acctttaactctccccggtaatcactgtca

SEQ ID NO: 39260 - DNA, 20 bp, Homo sapiens
  misc_feature 1..20: note = chr1:226816426-226816446
  misc_feature 1..20: note = hypo
  source 1..20: mol_type = genomic DNA
gtctccgtgacaactacaca

SEQ ID NO: 39261 - DNA, 30 bp, Homo sapiens
  misc_feature 1..30: note = chr1:226846375-226846405
  misc_feature 1..30: note = hypo
  source 1..30: mol_type = genomic DNA
caggctggatggcaccgaacatcctccaca

SEQ ID NO: 39262 - DNA, 87 bp, Homo sapiens
  misc_feature 1..87: note = chr1:226908374-226908461
  misc_feature 1..87: note = hypo
  source 1..87: mol_type = genomic DNA
agtattttttacagccgtaccacctgttaattcatattgaactggtagtaaaattataactcccagtgaatttcaaaagaaatattg

SEQ ID NO: 39263 - DNA, 38 bp, Homo sapiens
  misc_feature 1..38: note = chr1:226954853-226954891
  misc_feature 1..38: note = hypo
  source 1..38: mol_type = genomic DNA
actctaggctgggcacgatggctcaagcctgtaattct

SEQ ID NO: 39264 - DNA, 35 bp, Homo sapiens
  misc_feature 1..35: note = chr1:227174055-227174090
  misc_feature 1..35: note = hypo
  source 1..35: mol_type = genomic DNA
tgaatgagaactcagcgccccgggcactgtgggag

SEQ ID NO: 39265 - DNA, 42 bp, Homo sapiens; identical to SEQ ID NO: 14335
  misc_feature 1..42: note = chr1:227750829-227750871
  misc_feature 1..42: note = hypo
  source 1..42: mol_type = genomic DNA

SEQ ID NO: 39266 - DNA, 30 bp, Homo sapiens; identical to SEQ ID NO: 14336
  misc_feature 1..30: note = chr1:227921541-227921571
  misc_feature 1..30: note = hypo
  source 1..30: mol_type = genomic DNA

SEQ ID NO: 39267 - DNA, 30 bp, Homo sapiens
  misc_feature 1..30: note = chr1:227921780-227921810
  misc_feature 1..30: note = hypo
  source 1..30: mol_type = genomic DNA
gagactagggcagcacgagtggggcaactg

SEQ ID NO: 39268 - DNA, 61 bp, Homo sapiens
  misc_feature 1..61: note = chr1:227926624-227926685
  misc_feature 1..61: note = hypo
  source 1..61: mol_type = genomic DNA
gggagatggagctctcgttcttgagatggaactctgtggtttagttcgctggtccgcaggg

SEQ ID NO: 39269 - DNA, 30 bp, Homo sapiens
  misc_feature 1..30: note = chr1:227955886-227955916
  misc_feature 1..30: note = hypo
  source 1..30: mol_type = genomic DNA
ccacagggtatgtggcgcacatgcagtctc

SEQ ID NO: 39270 - DNA, 221 bp, Homo sapiens
  misc_feature 1..221: note = chr1:228083399-228083620
  misc_feature 1..221: note = hypo
  source 1..221: mol_type = genomic DNA
catcagacacaactacggaagtgcaaaggtcagtcctggaggcggcgagttggcagtagcctgagggtaggacttgcgtctccctgtgtacctgccgcctccaagttcagatgcactggccgttctcgctggggccatgagccaggcagcacccggggcccggcaccccaggcctggactcctgggcctctgctcgctccagtttccggcacctttcccag

SEQ ID NO: 39271 - DNA, 30 bp, Homo sapiens
  misc_feature 1..30: note = chr1:228117865-228117895
  misc_feature 1..30: note = hypo
  source 1..30: mol_type = genomic DNA
aacgtcggatccacacgctctgtggcgtgt

SEQ ID NO: 39272 - DNA, 49 bp, Homo sapiens
  misc_feature 1..49: note = chr1:228201221-228201270
  misc_feature 1..49: note = hypo
  source 1..49: mol_type = genomic DNA
taatcccagctgggccggcgggcaggaggaggtgcgggttgggagagct

SEQ ID NO: 39273 - DNA, 37 bp, Homo sapiens
  misc_feature 1..37: note = chr1:228238537-228238574
  misc_feature 1..37: note = hypo
  source 1..37: mol_type = genomic DNA
gtctcgggagttcgccgacgcccgggagaaccggcca

SEQ ID NO: 39274 - DNA, 30 bp, Homo sapiens
  misc_feature 1..30: note = chr1:228342820-228342850
  misc_feature 1..30: note = hypo
  source 1..30: mol_type = genomic DNA
tagcagcatggaaggcggtgacacagcgac

SEQ ID NO: 39275 - DNA, 30 bp, Homo sapiens
  misc_feature 1..30: note = chr1:228466507-228466537
  misc_feature 1..30: note = hypo
  source 1..30: mol_type = genomic DNA
tcaggagctgcagcccgggcccaagtacga

SEQ ID NO: 39276 - DNA, 164 bp, Homo sapiens
  misc_feature 1..164: note = chr1:228495832-228495996
  misc_feature 1..164: note = hypo
  source 1..164: mol_type = genomic DNA
gggggctggttgatgcggaggtgacggccgatgaggatgttgagttcagctgtgaggtgtccagggctggagccacaggcgtgcagtggtgcctacagggcctgccactgcaaagcaatgaggtgacagaggtggctgtgcgggatggccgcatccacaccctg

SEQ ID NO: 39277 - DNA, 38 bp, Homo sapiens
  misc_feature 1..38: note = chr1:228504430-228504468
  misc_feature 1..38: note = hypo
  source 1..38: mol_type = genomic DNA
agcctctgaaaaacgcggcggtccgggccggcgcacag

SEQ ID NO: 39278 - DNA, 332 bp, Homo sapiens
  misc_feature 1..332: note = chr1:228528840-228529172
  misc_feature 1..332: note = hypo
  source 1..332: mol_type = genomic DNA
tggaagggccacaaccgtcacgtgttcctcttccgcaaccacctggtaatctgcaagccccggcgagactcccgcaccgataccgtcagctacgtgttccggaacatgatgaaggtctgcaggctctgggctgctgggcggggctccctgtccctcagcgccggggtggatgccagtggccacacctgcagccgctggtccagggtggcctgaatgtttcctcgtcgggtcccacatctgttgaggatggtcagcccgtgtccccctccctgtgctgacaccctcccccacccacagctgagcagcatcgacctgaacgaccaggtggaggg

SEQ ID NO: 39279 - DNA, 30 bp, Homo sapiens; identical to SEQ ID NO: 14338
  misc_feature 1..30: note = chr1:228536492-228536522
  misc_feature 1..30: note = hypo
  source 1..30: mol_type = genomic DNA

SEQ ID NO: 39280 - DNA, 30 bp, Homo sapiens; identical to SEQ ID NO: 14339
  misc_feature 1..30: note = chr1:228552593-228552623
  misc_feature 1..30: note = hypo
  source 1..30: mol_type = genomic DNA

SEQ ID NO: 39281 - DNA, 163 bp, Homo sapiens
  misc_feature 1..163: note = chr1:228554806-228554969
  misc_feature 1..163: note = hypo
  source 1..163: mol_type = genomic DNA
gccacccgctggtcacggggctgctggaccagtttgagacccgcaagaccctcatcctcatcctggagctgtatcctgccctcagcccctgagacggcttgaggaggggcaggcagggccaggccggggctcagaggagccatgtgcacggtgtcccctgcct

SEQ ID NO: 39282 - DNA, 636 bp, Homo sapiens
  misc_feature 1..636: note = chr1:228558699-228559335
  misc_feature 1..636: note = hypo
  source 1..636: mol_type = genomic DNA
ctgctgccccccatgcggttccagcgttccctgatgagctacaagtccatcctggtgatgcgctccatccctgagctgctgcggggcccacccgacagcccctccctcggcgtagcccggcacctctgcagggacactggtggctcctccagttcctcctcctcctctgacaacgagctcgccccatttgcccgggctaagtcactgccaccctccccggtgacacactcaccactgctgcacccccggggcttcctgcggccctcggccagcctgcctgaggaagccgaggccagtgagcgctccaccgaggccccagctccgcctgcatctcccgagggtgccgggccaccggccgcccagggctgcgtgccccggcacagcgtcatccgcagcctgttctaccaccaggcgggtgagagccctgagcacggggccctggccccggggagcaggcggcacccggcccggcggcggcacctgctgaagggcgggtacattgcgggggcgctgccaggcctgcgcgagccactgatggagcaccgcgtgctggaggaggaggccgccagggaggagcaggccaccctcctggccaaagccccctcattcgagactgccctccggctgcctgcctct

SEQ ID NO: 39283 - DNA, 46 bp, Homo sapiens
  misc_feature 1..46: note = chr1:228919370-228919416
  misc_feature 1..46: note = hypo
  source 1..46: mol_type = genomic DNA
ccactgcacacagaccgggtgctgggtattgcgggaaccaaggagc

SEQ ID NO: 39284 - DNA, 28 bp, Homo sapiens
  misc_feature 1..28: note = chr1:229705999-229706027
  misc_feature 1..28: note = hypo
  source 1..28: mol_type = genomic DNA
ttgctattacaggcgtaaaccaccgcac

SEQ ID NO: 39285 - DNA, 64 bp, Homo sapiens
  misc_feature 1..64: note = chr1:230107209-230107273
  misc_feature 1..64: note = hypo
  source 1..64: mol_type = genomic DNA
ccatctcctggctcccggctggcgttccaggaacagcaccggctttccccgtcctcctctcctg

SEQ ID NO: 39286 - DNA, 65 bp, Homo sapiens
  misc_feature 1..65: note = chr1:230404233-230404298
  misc_feature 1..65: note = hypo
  source 1..65: mol_type = genomic DNA
gcctctgctggaaagcgacacaccttacgctacagcacattaaacagaagcgtgtgctcaggccc

SEQ ID NO: 39287 - DNA, 72 bp, Homo sapiens
  misc_feature 1..72: note = chr1:230423782-230423854
  misc_feature 1..72: note = hypo
  source 1..72: mol_type = genomic DNA
acaaggaagttggtccgatgccagcaggtgaggagcatcctcctcatgtgaggaacacggggctggagcagg

SEQ ID NO: 39288 - DNA, 30 bp, Homo sapiens
  misc_feature 1..30: note = chr1:230424489-230424519
  misc_feature 1..30: note = hypo
  source 1..30: mol_type = genomic DNA
gcatccggggctgtgcgttgtgcaagcccc

SEQ ID NO: 39289 - DNA, 30 bp, Homo sapiens
  misc_feature 1..30: note = chr1:230453332-230453362
  misc_feature 1..30: note = hypo
  source 1..30: mol_type = genomic DNA
tggggaggggagggccgaggctgatttatc

SEQ ID NO: 39290 - DNA, 53 bp, Homo sapiens; identical to SEQ ID NO: 14343
  misc_feature 1..53: note = chr1:230453632-230453685
  misc_feature 1..53: note = hypo
  source 1..53: mol_type = genomic DNA

SEQ ID NO: 39291 - DNA, 30 bp, Homo sapiens
  misc_feature 1..30: note = chr1:230458365-230458395
  misc_feature 1..30: note = hypo
  source 1..30: mol_type = genomic DNA
gatcatgcaaagagccgtgactgaggccgg

SEQ ID NO: 39292 - DNA, 128 bp, Homo sapiens
  misc_feature 1..128: note = chr1:230992827-230992955
  misc_feature 1..128: note = hypo
  source 1..128: mol_type = genomic DNA
cgttctctgtgcagacgcctcctaacatgaacagccagtgggaggtcagtctttgaactcaaataacgaaggcatgccagggtctgggcagctgaaggcctattcccaagaagcggggacagggaagg

SEQ ID NO: 39293 - DNA, 53 bp, Homo sapiens
  misc_feature 1..53: note = chr1:231163086-231163139
  misc_feature 1..53: note = hypo
  source 1..53: mol_type = genomic DNA
gaaaggaatcctgaccgcctaggaatacagcgcagccccgcacacacctatta

SEQ ID NO: 39294 - DNA, 96 bp, Homo sapiens
  misc_feature 1..96: note = chr1:231663293-231663389
  misc_feature 1..96: note = hypo
  source 1..96: mol_type = genomic DNA
gagtttctctctagacggtgctgaattgccatctagttacctattctgacaccaggaacatgattcttcaacaaacattgacggaagcttacatgg

SEQ ID NO: 39295 - DNA, 120 bp, Homo sapiens
  misc_feature 1..120: note = chr1:231738873-231738993
  misc_feature 1..120: note = hypo
  source 1..120: mol_type = genomic DNA
ttatttttcttatttaaacattttcttcctttgacttgtttgcttgtgtttgttctcagtttttagaatcattaaacattttggccatatagaaaaatatacagaagcctggccgggcgt

SEQ ID NO: 39296 - DNA, 30 bp, Homo sapiens
  misc_feature 1..30: note = chr1:232761388-232761418
  misc_feature 1..30: note = hypo
  source 1..30: mol_type = genomic DNA
cacaggtcatgttcacgggtcacgttacac

SEQ ID NO: 39297 - DNA, 30 bp, Homo sapiens
  misc_feature 1..30: note = chr1:234445373-234445403
  misc_feature 1..30: note = hypo
  source 1..30: mol_type = genomic DNA
tctgcgtgctcaccccgtctctcatgggcg

SEQ ID NO: 39298 - DNA, 278 bp, Homo sapiens
  misc_feature 1..278: note = chr1:234621065-234621343
  misc_feature 1..278: note = hypo
  source 1..278: mol_type = genomic DNA
tagatgaattagggtcgtgactgttattttaacatcaaaagcaggtgtactatggatgagtgtctgagttttcctccctttaaagtagtagagtttagttacttcagtctagctcacgtatcccttacaccaggggtccctaacccctgggccatgaaccgctacccctccgtgacctgttaggaaccaggctgcacaggagaaggtgagctgcaggcgagtgggcattatcacctgagctccgcctcctatcaaatcagcagcggccttagattgtc

SEQ ID NO: 39299 - DNA, 30 bp, Homo sapiens
  misc_feature 1..30: note = chr1:234625024-234625054
  misc_feature 1..30: note = hypo
  source 1..30: mol_type = genomic DNA
gaagtctagagaaagcgcttccaagcacgt

SEQ ID NO: 39300 - DNA, 30 bp, Homo sapiens
  misc_feature 1..30: note = chr1:234724806-234724836
  misc_feature 1..30: note = hypo
  source 1..30: mol_type = genomic DNA
ctgttttttttttctcgtggtctttctcaa

SEQ ID NO: 39301 - DNA, 30 bp, Homo sapiens
  misc_feature 1..30: note = chr1:234795478-234795508
  misc_feature 1..30: note = hypo
  source 1..30: mol_type = genomic DNA
tgagaatgagtcacccgctcaggcctcttt

SEQ ID NO: 39302 - DNA, 30 bp, Homo sapiens
  misc_feature 1..30: note = chr1:234845113-234845143
  misc_feature 1..30: note = hypo
  source 1..30: mol_type = genomic DNA
agtctgaagggtacccgggagtttgacagg

SEQ ID NO: 39303 - DNA, 169 bp, Homo sapiens
  misc_feature 1..169: note = chr1:234882410-234882579
  misc_feature 1..169: note = hypo
  source 1..169: mol_type = genomic DNA
cttgggaatcatgtgcgcacaaaagcaaacaaactttttgggagattccaaattaggcagttgggtcttggaaagaggccccccatgtgggaagctcgagccccctccagaaggctcttcagaagctgtgttagaacagtgtgtttctcatggtcggtccctgactcat

SEQ ID NO: 39304 - DNA, 30 bp, Homo sapiens; identical to SEQ ID NO: 14348
  misc_feature 1..30: note = chr1:234959409-234959439
  misc_feature 1..30: note = hypo
  source 1..30: mol_type = genomic DNA

SEQ ID NO: 39305 - DNA, 76 bp, Homo sapiens
  misc_feature 1..76: note = chr1:235003807-235003883
  misc_feature 1..76: note = hypo
  source 1..76: mol_type = genomic DNA
tctaaaaaaaaaaaaaaaaaaatttaattttaatccactcggattttaaaatagcatatcacgatggaaaaagcct

SEQ ID NO: 39306 - DNA, 39 bp, Homo sapiens
  misc_feature 1..39: note = chr1:235005711-235005750
  misc_feature 1..39: note = hypo
  source 1..39: mol_type = genomic DNA
tccaccccaaccctccgttccacacgcacctcccactgc

SEQ ID NO: 39307 - DNA, 152 bp, Homo sapiens
  misc_feature 1..152: note = chr1:235267072-235267224
  misc_feature 1..152: note = hypo
  source 1..152: mol_type = genomic DNA
ctcaaaaaaaggaaaaaaaaaaaaaaagaagatattctcatgccctttggaaatgaggcacctaagcctcagagaagttaagtgccccagtacgctgcacatttagaactcaaacccaagcccctgcttctaaaaaccgtgttcgttccgcc

SEQ ID NO: 39308 - DNA, 76 bp, Homo sapiens
  misc_feature 1..76: note = chr1:235292638-235292714
  misc_feature 1..76: note = hypo
  source 1..76: mol_type = genomic DNA
agaaaaaatagaaaacgtgaattgttttatagccacacgaaaacatacacatgatcaggccaggcgcggtggctca

SEQ ID NO: 39309 - DNA, 120 bp, Homo sapiens
  misc_feature 1..120: note = chr1:235325361-235325481
  misc_feature 1..120: note = hypo
  source 1..120: mol_type = genomic DNA
gtgaggactaggagtttgaaccagcctggtcgatctagcgagacttattctctacagaaaagaaattagacgggcaccttcgcgctcggcgcctgtagtcccagcactttgagaggctcg

SEQ ID NO: 39310 - DNA, 31 bp, Homo sapiens
  misc_feature 1..31: note = chr1:235325541-235325572
  misc_feature 1..31: note = hypo
  source 1..31: mol_type = genomic DNA
tacactccagcctaagcggcagaccctggct

SEQ ID NO: 39311 - DNA, 30 bp, Homo sapiens
  misc_feature 1..30: note = chr1:235793720-235793750
  misc_feature 1..30: note = hypo
  source 1..30: mol_type = genomic DNA
agcctgatgatgccacgctctcatcactta

SEQ ID NO: 39312 - DNA, 20 bp, Homo sapiens
  misc_feature 1..20: note = chr1:236044137-236044157
  misc_feature 1..20: note = hypo
  source 1..20: mol_type = genomic DNA
tttagcggccgggcacggtg

SEQ ID NO: 39313 - DNA, 30 bp, Homo sapiens
  misc_feature 1..30: note = chr1:236081438-236081468
  misc_feature 1..30: note = hypo
  source 1..30: mol_type = genomic DNA
cgcccccatgcccaacgctgaggaggacac

SEQ ID NO: 39314 - DNA, 24 bp, Homo sapiens
  misc_feature 1..24: note = chr1:236252519-236252543
  misc_feature 1..24: note = hypo
  source 1..24: mol_type = genomic DNA
gcttaccaggccaggcgtggtggc

SEQ ID NO: 39315 - DNA, 111 bp, Homo sapiens
  misc_feature 1..111: note = chr1:236768713-236768824
  misc_feature 1..111: note = hypo
  source 1..111: mol_type = genomic DNA
caatggttacacccacgtcagtggaagagtttgatgacttttagcaaatgcatgtataggtgtaatgacctccccagtcaaaatgacagtttccatcgcccctaaaaattg

SEQ ID NO: 39316 - DNA, 40 bp, Homo sapiens
  misc_feature 1..40: note = chr1:236771396-236771436
  misc_feature 1..40: note = hypo
  source 1..40: mol_type = genomic DNA
tctccctatgctcttaggcagcgtccggaaacagtacaat

SEQ ID NO: 39317 - DNA, 30 bp, Homo sapiens
  misc_feature 1..30: note = chr1:236811244-236811274
  misc_feature 1..30: note = hypo
  source 1..30: mol_type = genomic DNA
gatcccctcagctatcgctcttgctttctt

SEQ ID NO: 39318 - DNA, 30 bp, Homo sapiens
  misc_feature 1..30: note = chr1:236907863-236907893
  misc_feature 1..30: note = hypo
  source 1..30: mol_type = genomic DNA
ctggcatgaggaagccgctgtgccctcagc

SEQ ID NO: 39319 - DNA, 30 bp, Homo sapiens
  misc_feature 1..30: note = chr1:237753724-237753754
  misc_feature 1..30: note = hypo
  source 1..30: mol_type = genomic DNA
tataagataaatttccgaaaccgtctttag

SEQ ID NO: 39320 - DNA, 32 bp, Homo sapiens
  misc_feature 1..32: note = chr1:238235533-238235565
  misc_feature 1..32: note = hypo
  source 1..32: mol_type = genomic DNA
aaaatgggccgggcacggtggctcacgcctgt

SEQ ID NO: 39321 - DNA, 19 bp, Homo sapiens
  misc_feature 1..19: note = chr1:239516662-239516681
  misc_feature 1..19: note = hypo
  source 1..19: mol_type = genomic DNA
agagcgatactctgattaa

SEQ ID NO: 39322 - DNA, 192 bp, Homo sapiens
  misc_feature 1..192: note = chr1:239523114-239523306
  misc_feature 1..192: note = hypo
  source 1..192: mol_type = genomic DNA
gtacaagaacacatgcgaacaaaaactgtacagtaagtagtttaaaatgtacagggaattgtgtagggggagatgagagatggaaggggggacatggatgtatcaacaaatataaacaagaaacaaagaacaaaacaggattggacttttcagagatcactgataattacgttctttcgtgatgatgagtat

SEQ ID NO: 39323 - DNA, 42 bp, Homo sapiens
  misc_feature 1..42: note = chr1:239987383-239987425
  misc_feature 1..42: note = hypo
  source 1..42: mol_type = genomic DNA
cggtgccctctgtctcgttggtgaggccgcatttcactccag

SEQ ID NO: 39324 - DNA, 250 bp, Homo sapiens
  misc_feature 1..250: note = chr1:240118753-240119003
  misc_feature 1..250: note = hypo
  source 1..250: mol_type = genomic DNA
ccctgacacttcacccgcgagcctggataaaaaggctcccatgacctctctctttagccaaccccgctgggtgcaatattcagaagtgctccccgaggtttccaattacccgctgtgccccacctgtggcagagtaaacctacttcctccagactcgcatggcagggactgaccaagaaggaaagcggccctcactccagggttccgtggtgatacctgcatcagcacaccagcccgggggtctgcactc

SEQ ID NO: 39325 - DNA, 30 bp, Homo sapiens
  misc_feature 1..30: note = chr1:240308662-240308692
  misc_feature 1..30: note = hypo
  source 1..30: mol_type = genomic DNA
tccctcctccatctccgctgccactgccct

SEQ ID NO: 39326 - DNA, 120 bp, Homo sapiens
  misc_feature 1..120: note = chr1:240372821-240372941
  misc_feature 1..120: note = hypo
  source 1..120: mol_type = genomic DNA
gggatgacaggcgtgagccaccgggcacggccgcaaatcaaattcttaggtaaactgactctggagcatgatttagtgcacactttaaaatgcacagccctgtccgggtgcggtggctca

SEQ ID NO: 39327 - DNA, 169 bp, Homo sapiens; identical to SEQ ID NO: 14351
  misc_feature 1..169: note = chr1:240463082-240463251
  misc_feature 1..169: note = hypo
  source 1..169: mol_type = genomic DNA

SEQ ID NO: 39328 - DNA, 20 bp, Homo sapiens
  misc_feature 1..20: note = chr1:240893174-240893194
  misc_feature 1..20: note = hypo
  source 1..20: mol_type = genomic DNA
gactccgtctcaaaaaaaaa

SEQ ID NO: 39329 - DNA, 55 bp, Homo sapiens
  misc_feature 1..55: note = chr1:241052144-241052199
  misc_feature 1..55: note = hypo
  source 1..55: mol_type = genomic DNA
ctggaggttagggaacgcggaggcagagagagggaagcagcgggtgcaaagggca

SEQ ID NO: 39330 - DNA, 39 bp, Homo sapiens
  misc_feature 1..39: note = chr1:241096456-241096495
  misc_feature 1..39: note = hypo
  source 1..39: mol_type = genomic DNA
caggtgtgagccaccgcgcccggccggtgttactttctg

SEQ ID NO: 39331 - DNA, 30 bp, Homo sapiens
  misc_feature 1..30: note = chr1:241753208-241753238
  misc_feature 1..30: note = hypo
  source 1..30: mol_type = genomic DNA
ttgtgtttggcattgcgatgagtgggaatg

SEQ ID NO: 39332 - DNA, 30 bp, Homo sapiens
  misc_feature 1..30: note = chr1:241913315-241913345
  misc_feature 1..30: note = hypo
  source 1..30: mol_type = genomic DNA
ctgacatgctttatacgctcatatgggaat

SEQ ID NO: 39333 - DNA, 30 bp, Homo sapiens
  misc_feature 1..30: note = chr1:242087568-242087598
  misc_feature 1..30: note = hypo
  source 1..30: mol_type = genomic DNA
atgagccacaatttacgtcatccaccttaa

SEQ ID NO: 39334 - DNA, 19 bp, Homo sapiens
  misc_feature 1..19: note = chr1:242122940-242122959
  misc_feature 1..19: note = hypo
  source 1..19: mol_type = genomic DNA
attacgggcatgagccacc

SEQ ID NO: 39335 - DNA, 177 bp, Homo sapiens; identical to SEQ ID NO: 14352
  misc_feature 1..177: note = chr1:242286750-242286927
  misc_feature 1..177: note = hypo
  source 1..177: mol_type = genomic DNA

SEQ ID NO: 39336 - DNA, 28 bp, Homo sapiens
  misc_feature 1..28: note = chr1:242633355-242633383
  misc_feature 1..28: note = hypo
  source 1..28: mol_type = genomic DNA
aggggctgccgggtgcggtggctcatgc

SEQ ID NO: 39337 - DNA, 147 bp, Homo sapiens
  misc_feature 1..147: note = chr1:242973101-242973248
  misc_feature 1..147: note = hypo
  source 1..147: mol_type = genomic DNA
tgctaggattacaggcgtgagcaaccgcacccggccagataaagaatgttttaacaagaaagatgacctcattcccttagtaccgtattttagttcagtcaaattttgactggtgccattctcctcagctgccgtgatttccaattt

SEQ ID NO: 39338 - DNA, 30 bp, Homo sapiens; identical to SEQ ID NO: 14353
  misc_feature 1..30: note = chr1:243057075-243057105
  misc_feature 1..30: note = hypo
  source 1..30: mol_type = genomic DNA

SEQ ID NO: 39339 - DNA, 33 bp, Homo sapiens
  misc_feature 1..33: note = chr1:243145074-243145107
  misc_feature 1..33: note = hypo
  source 1..33: mol_type = genomic DNA
ttttatagttactcttatcgtgagtcgtaagta

SEQ ID NO: 39340 - DNA, 36 bp, Homo sapiens
  misc_feature 1..36: note = chr1:244115683-244115719
  misc_feature 1..36: note = hypo
  source 1..36: mol_type = genomic DNA
tggatgacgaggacacgctgacgaaagcaatgaaag

SEQ ID NO: 39341 - DNA, 30 bp, Homo sapiens
  misc_feature 1..30: note = chr1:244139857-244139887
  misc_feature 1..30: note = hypo
  source 1..30: mol_type = genomic DNA
caaagaacagggaatcggaagacctggact

SEQ ID NO: 39342 - DNA, 98 bp, Homo sapiens
  misc_feature 1..98: note = chr1:244142970-244143068
  misc_feature 1..98: note = hypo
  source 1..98: mol_type = genomic DNA
gacggaaggtacccacgagggtggcgtgtggggccatcggccaggagtgggggggatgggacggaaggtacccacgagggtggcgggtggggcagatg

SEQ ID NO: 39343 - DNA, 105 bp, Homo sapiens
  misc_feature 1..105: note = chr1:244200765-244200870
  misc_feature 1..105: note = hypo
  source 1..105: mol_type = genomic DNA
ggtagagggtggctgcgtccccaaacagcagggcccagcaagagggaaaagccacacaccttctctgaggggccccccaaaaaatgatcgcggtagcagtagctt

SEQ ID NO: 39344 - DNA, 132 bp, Homo sapiens
  misc_feature 1..132: note = chr1:244243999-244244131
  misc_feature 1..132: note = hypo
  source 1..132: mol_type = genomic DNA
aagaggcagagaagacgtgagtttcttgccaattccacctggtggagagcctgccaggcctcctgacttgtggtcctgtctctgaccggcacggtggctgcttttcctaggcaagtgcggcataatgtccct

SEQ ID NO: 39345 - DNA, 30 bp, Homo sapiens
  misc_feature 1..30: note = chr1:244319117-244319147
  misc_feature 1..30: note = hypo
  source 1..30: mol_type = genomic DNA
catcacaggcggctgcgtgcttattacccc

SEQ ID NO: 39346 - DNA, 30 bp, Homo sapiens
  misc_feature 1..30: note = chr1:244914578-244914608
  misc_feature 1..30: note = hypo
  source 1..30: mol_type = genomic DNA
acgaagcaagtgctccgtcattgtggctgc

SEQ ID NO: 39347 - DNA, 180 bp, Homo sapiens
  misc_feature 1..180: note = chr1:245060866-245061046
  misc_feature 1..180: note = hypo
  source 1..180: mol_type = genomic DNA
attagcttctggactcgtgccggcagggcgggggcagggtggaggggaggagtgttcacctggctatgtggagaggtggagggaacatgatgggaactcttccacaggtttggaaccagtttccctgtttccagccccacttggcagaacctgtctctcgcagtccgagcctttaacggt

SEQ ID NO: 39348 - DNA, 143 bp, Homo sapiens; identical to SEQ ID NO: 4959
  misc_feature 1..143: note = chr1:245135719-245135862
  misc_feature 1..143: note = hypo
  source 1..143: mol_type = genomic DNA

SEQ ID NO: 39349 - DNA, 30 bp, Homo sapiens
  misc_feature 1..30: note = chr1:245376976-245377006
  misc_feature 1..30: note = hypo
  source 1..30: mol_type = genomic DNA
atcatcatcagaaggcgttgtgcgtggtgt

SEQ ID NO: 39350 - DNA, 151 bp, Homo sapiens
  misc_feature 1..151: note = chr1:245461494-245461645
  misc_feature 1..151: note = hypo
  source 1..151: mol_type = genomic DNA
ttctaactcataaggaaattttaccttcattcactacgagtaggctcatactatacaaatattagtttctagagtccattgatggatgaagagataaacaaaatgtggtctatgcatacaatggcatattcttcagcgtggagaaagaatg

SEQ ID NO: 39351 - DNA, 43 bp, Homo sapiens
  misc_feature 1..43: note = chr1:245499703-245499746
  misc_feature 1..43: note = hypo
  source 1..43: mol_type = genomic DNA
gtatgcgggtgcctccgactggcggctgcgtggtggatctggc

SEQ ID NO: 39352 - DNA, 26 bp, Homo sapiens
  misc_feature 1..26: note = chr1:245627605-245627631
  misc_feature 1..26: note = hypo
  source 1..26: mol_type = genomic DNA
aggtaatgtgtgtcccgtcccccgac

SEQ ID NO: 39353 - DNA, 30 bp, Homo sapiens
  misc_feature 1..30: note = chr1:245750646-245750676
  misc_feature 1..30: note = hypo
  source 1..30: mol_type = genomic DNA
ttgaagacagcaactcgtttttaagctctt

SEQ ID NO: 39354 - DNA, 33 bp, Homo sapiens
  misc_feature 1..33: note = chr1:245753467-245753500
  misc_feature 1..33: note = hypo
  source 1..33: mol_type = genomic DNA
aaggggaggccgaggcgccggtggaagcacaaa

SEQ ID NO: 39355 - DNA, 197 bp, Homo sapiens; identical to SEQ ID NO: 14356
  misc_feature 1..197: note = chr1:245772643-245772840
  misc_feature 1..197: note = hypo
  source 1..197: mol_type = genomic DNA

SEQ ID NO: 39356 - DNA, 154 bp, Homo sapiens
  misc_feature 1..154: note = chr1:245986642-245986796
  misc_feature 1..154: note = hypo
  source 1..154: mol_type = genomic DNA
gtgcttgctcgctctcgctctctctctctcttttctaaggctccaggcatccgtccctggagaagtgcaccttgggaaggcgatgaaatgaaagaagggcacatcctcctttaaccccaaacatctgaagtcagcgccgcgcactactgcgatt

SEQ ID NO: 39357 - DNA, 109 bp, Homo sapiens
  misc_feature 1..109: note = chr1:246172251-246172360
  misc_feature 1..109: note = hypo
  source 1..109: mol_type = genomic DNA
agttcaagtgccagccgtaccgcttgctagcagcgtggccttgggcaagtcacttggcttcggtttcctcctcttagctgcaaaatatgaaaaacgggcctgctatgaa

SEQ ID NO: 39358 - DNA, 30 bp, Homo sapiens
  misc_feature 1..30: note = chr1:246330476-246330506
  misc_feature 1..30: note = hypo
  source 1..30: mol_type = genomic DNA
tcattcaactaacaacgagcattttggctg

SEQ ID NO: 39359 - DNA, 30 bp, Homo sapiens
  misc_feature 1..30: note = chr1:246363735-246363765
  misc_feature 1..30: note = hypo
  source 1..30: mol_type = genomic DNA
gaagatggagaacagcgtagatgctgagca

SEQ ID NO: 39360 - DNA, 132 bp, Homo sapiens
  misc_feature 1..132: note = chr1:246488175-246488307
  misc_feature 1..132: note = hypo
  source 1..132: mol_type = genomic DNA
tgcaccatcacacaccgtcaacattctgggctcagtgactcatccctgaaagctgcaggatctatttaggttaatttaggatctttcatgaacaaggaaggagaaggagtcagggggcgggaaggagggaga

SEQ ID NO: 39361 - DNA, 30 bp, Homo sapiens
  misc_feature 1..30: note = chr1:246991095-246991125
  misc_feature 1..30: note = hypo
  source 1..30: mol_type = genomic DNA
tcttcagtgtcggctcgagtactatttttt

SEQ ID NO: 39362 - DNA, 163 bp, Homo sapiens
  misc_feature 1..163: note = chr1:247185348-247185511
  misc_feature 1..163: note = hypo
  source 1..163: mol_type = genomic DNA
tacgaaaaatgttagcgtattccaccttgctcaaggtcctaggtagcagacggtaatactgtactattgggtaatacatgccaatcatctctagcaatccttattcccagtggcattacactccagagagtgtggagaatattgatcccgtatgttatatttt

SEQ ID NO: 39363 - DNA, 245 bp, Homo sapiens
  misc_feature 1..245: note = chr1:247589856-247590101
  misc_feature 1..245: note = hypo
  source 1..245: mol_type = genomic DNA
tcagctttcttgatccgttgacattaccatgaccaggaccaccttcctagtcatggtttggccatgaaggactgactgcccacagggccgcagtggtggtgaagacccaggtcctggtcacagggacttgaggtctggctgtgggacagtccggaaacaagtgcagatgtcggggagggggtcatgggctctgacaaggaaacttgcagagtatccaaagcacaaggggacgaacctgttcacca

SEQ ID NO: 39364 - DNA, 30 bp, Homo sapiens
  misc_feature 1..30: note = chr1:247615881-247615911
  misc_feature 1..30: note = hypo
  source 1..30: mol_type = genomic DNA
attcatgctgatctccgctgtcatgaccac

SEQ ID NO: 39365 - DNA, 30 bp, Homo sapiens
  misc_feature 1..30: note = chr1:247694897-247694927
  misc_feature 1..30: note = hypo
  source 1..30: mol_type = genomic DNA
ccatgtgccggagggcgctcttcacctccg

SEQ ID NO: 39366 - DNA, 172 bp, Homo sapiens; identical to SEQ ID NO: 14360
  misc_feature 1..172: note = chr1:247709336-247709508
  misc_feature 1..172: note = hypo
  source 1..172: mol_type = genomic DNA

SEQ ID NO: 39367 - DNA, 180 bp, Homo sapiens; identical to SEQ ID NO: 14361
  misc_feature 1..180: note = chr1:247752018-247752198
  misc_feature 1..180: note = hypo
  source 1..180: mol_type = genomic DNA

SEQ ID NO: 39368 - DNA, 32 bp, Homo sapiens
  misc_feature 1..32: note = chr1:248002278-248002310
  misc_feature 1..32: note = hypo
  source 1..32: mol_type = genomic DNA
ttgactcagacttgtcgtcctgtgttcatgct

SEQ ID NO: 39369 - DNA, 94 bp, Homo sapiens
  misc_feature 1..94: note = chr1:248026872-248026966
  misc_feature 1..94: note = hypo
  source 1..94: mol_type = genomic DNA
acttcacctacaaggccgtataacaatgtaacaaaactgcatttgtaccccatgaatatatacaaaaaataaaataaatcgataaaacaggaca

SEQ ID NO: 39370 - DNA, 294 bp, Homo sapiens
  misc_feature 1..294: note = chr1:248027965-248028259
  misc_feature 1..294: note = hypo
  source 1..294: mol_type = genomic DNA
gaggccaagcactgacgatgtgatccacggtgtcacctcaggagaaagtggaaatgcagaggcagcgcttcagattggagtttgagaagcatcgtggctttctggcccaggaggagcaacggcagctgaggcggctggaggcggaggagcgagcgacgctgcagagactgcgggagagcaagagccggctggtccagcagagcaaggccctgaaggagctggcggatgagctgcaggagaggtgccagcgcccggccctgggtctgctggaggtgaggccgggtgccagaaaag

SEQ ID NO: 39371 - DNA, 197 bp, Homo sapiens
  misc_feature 1..197: note = chr1:248034262-248034459
  misc_feature 1..197: note = hypo
  source 1..197: mol_type = genomic DNA
agtatattcatgagccgtatcagagtcacggccacccatagagcctgcaccaccacgcccagaagaacgaggattagtatattcatgagcagtatcagagtcacggccacccatagagtctacatttggttagactatgggcttaaaactgtaggtcatctcttattagctgatatgagtaacgttacttccagtaa

SEQ ID NO: 39372 - DNA, 45 bp, Homo sapiens
  misc_feature 1..45: note = chr1:248047093-248047138
  misc_feature 1..45: note = hypo
  source 1..45: mol_type = genomic DNA
taaattatgacaggccgggcgtggcggctcacgactgtaatccca

SEQ ID NO: 39373 - DNA, 30 bp, Homo sapiens
  misc_feature 1..30: note = chr1:248047898-248047928
  misc_feature 1..30: note = hypo
  source 1..30: mol_type = genomic DNA
agggtctcactctgtcgcccaggctgaggt

SEQ ID NO: 39374 - DNA, 30 bp, Homo sapiens
  misc_feature 1..30: note = chr1:248074318-248074348
  misc_feature 1..30: note = hypo
  source 1..30: mol_type = genomic DNA
ccctcttgtatcgttcgtaatatccagcag

SEQ ID NO: 39375 - DNA, 63 bp, Homo sapiens
  misc_feature 1..63: note = chr1:248074864-248074927
  misc_feature 1..63: note = hypo
  source 1..63: mol_type = genomic DNA
tattagtcccaatgtcgcagagggtgtacaccgcctctgtaatatccacgggggaaaaggatg

SEQ ID NO: 39376 - DNA, 36 bp, Homo sapiens
  misc_feature 1..36: note = chr1:248098787-248098823
  misc_feature 1..36: note = hypo
  source 1..36: mol_type = genomic DNA
aatgtatgggccaggcgcggtggatcacgcctgtaa

SEQ ID NO: 39377 - DNA, 30 bp, Homo sapiens
  misc_feature 1..30: note = chr1:248099290-248099320
  misc_feature 1..30: note = hypo
  source 1..30: mol_type = genomic DNA
tcatgcagtgtcctgcgtctgtcatctgct

SEQ ID NO: 39378 - DNA, 282 bp, Homo sapiens
  misc_feature 1..282: note = chr1:248099765-248100047
  misc_feature 1..282: note = hypo
  source 1..282: mol_type = genomic DNA
ccgtggtcaccatggcgatgtggtgcccacggtcagaggtggcattggggaagtcagccactcggacgctggtgctcctcactgacttctcatcgctcctgtgctcgctgtagacggtgtttaactcagaatccacatgcaggatgttctcggttttcaggtgtgcgtgggtcagccggttctcgtgcagaaatctaagggtgtggcagagctggtgggccatgtgccagacatgtgggaggggaatggctggatgttattctccttcgggaactcaagggt

SEQ ID NO: 39379 - DNA, 203 bp, Homo sapiens
  misc_feature 1..203: note = chr1:248328673-248328876
  misc_feature 1..203: note = hypo
  source 1..203: mol_type = genomic DNA
cacccgtgactcgccaggctccgtctgagacccgtgctaggctcgctctgtccctgcgttccctcgcctctctctccagttgtttttcccattctcacaccagcactgcaccaaggtgagaggagccccgctggaaaggaaacattcggactccggtttcagcacctcctccagaagcacaggatgtgcgaccttcagccttt

SEQ ID NO: 39380 - DNA, 30 bp, Homo sapiens
  misc_feature 1..30: note = chr1:248329246-248329276
  misc_feature 1..30: note = hypo
  source 1..30: mol_type = genomic DNA
catttgtgaagttcacgcttggtgaaataa

SEQ ID NO: 39381 - DNA, 24 bp, Homo sapiens
  misc_feature 1..24: note = chr1:249121618-249121642
  misc_feature 1..24: note = hypo
  source 1..24: mol_type = genomic DNA
gagccaccacgcccagcctagctt

SEQ ID NO: 39382 - DNA, 233 bp, Homo sapiens
  misc_feature 1..233: note = chr2:314488-314721
  misc_feature 1..233: note = hypo
  source 1..233: mol_type = genomic DNA
actcaaaatttggagcggatgaggggcaggagcagctcactgattgggccccgactttcccaggtgtctacactgctagagctacgctcacagctgcggacgtgcacgcgctgccagcaactgcaccgagcactcagcgcacacctgctcccacgcgccacgcactcgtgcaggtgccgggagctccgtcgtcagcagccagaggaaagccctgttctcgtggaacctccatc

SEQ ID NO: 39383 - DNA, 70 bp, Homo sapiens
  misc_feature 1..70: note = chr2:484928-484998
  misc_feature 1..70: note = hypo
  source 1..70: mol_type = genomic DNA
tgctgagactgcaggcgcttcatggcgcgtgtcctgggggttcacagtgcgaacccgaagggtggtttcc

SEQ ID NO: 39384 - DNA, 157 bp, Homo sapiens
  misc_feature 1..157: note = chr2:496214-496371
  misc_feature 1..157: note = hypo
  source 1..157: mol_type = genomic DNA
gaagctacaggaggccgagcggctgttgacgcccaggaccgtgggcagcaccttgcagggggaaaccggcttcctccggtctcccagaagaagagttcaggccttctctcctctctccaggcctccagctcttccccatccccgctctcagcggagg

SEQ ID NO: 39385 - DNA, 69 bp, Homo sapiens
  misc_feature 1..69: note = chr2:503076-503145
  misc_feature 1..69: note = hypo
  source 1..69: mol_type = genomic DNA
gggacgcaggaatcacgggacgcgggaatcacgggacgcgggaatcacgggacgcgggaatcacgggac

SEQ ID NO: 39386 - DNA, 142 bp, Homo sapiens
  misc_feature 1..142: note = chr2:503859-504001
  misc_feature 1..142: note = hypo
  source 1..142: mol_type = genomic DNA
tttgctggggtactgcggtggccacaactcgcatggagcgccgcctgggaaagggaggagaggacgcatgagatcagaaacactggctgccgtaaacacttacaatgaaaataacgtaacaaataagcgaaaggtaaaatgt

SEQ ID NO: 39387 - DNA, 64 bp, Homo sapiens
  misc_feature 1..64: note = chr2:522014-522078
  misc_feature 1..64: note = hypo
  source 1..64: mol_type = genomic DNA
ggaacccacggaacccgatggcatggaaccagaaccgatggcaccgaaccggaacctgacggca

SEQ ID NO: 39388 - DNA, 49 bp, Homo sapiens
  misc_feature 1..49: note = chr2:647861-647910
  misc_feature 1..49: note = hypo
  source 1..49: mol_type = genomic DNA
gctcccggcctgggtcggggtcagtcgctggcaccgaggtttctatacg

SEQ ID NO: 39389 - DNA, 61 bp, Homo sapiens; identical to SEQ ID NO: 14369
  misc_feature 1..61: note = chr2:720836-720897
  misc_feature 1..61: note = hypo
  source 1..61: mol_type = genomic DNA

SEQ ID NO: 39390 - DNA, 30 bp, Homo sapiens
  misc_feature 1..30: note = chr2:925888-925918
  misc_feature 1..30: note = hypo
  source 1..30: mol_type = genomic DNA
caagctggtggcagacggcccacatggcct

SEQ ID NO: 39391 - DNA, 30 bp, Homo sapiens
  misc_feature 1..30: note = chr2:951526-951556
  misc_feature 1..30: note = hypo
  source 1..30: mol_type = genomic DNA
aacagggaggcctcccgtagtctggggtcc

SEQ ID NO: 39392 - DNA, 49 bp, Homo sapiens
  misc_feature 1..49: note = chr2:973406-973455
  misc_feature 1..49: note = hypo
  source 1..49: mol_type = genomic DNA
ttaactagaccttaccgagatcaggacctgcctgcgttgccaacgtcac

SEQ ID NO: 39393 - DNA, 156 bp, Homo sapiens
  misc_feature 1..156: note = chr2:1019358-1019514
  misc_feature 1..156: note = hypo
  source 1..156: mol_type = genomic DNA
gcccagccctggctccgtcactgtgccactgtcagcacatctgcaccccgcgtagtctggggacatttagacagccttaggctcaatgtcaagtggatccagaacctcggcagtctgcaaggagagttgtgtgtgtgccatcgatgtccgcttaca

SEQ ID NO: 39394 - DNA, 108 bp, Homo sapiens
  misc_feature 1..108: note = chr2:1204810-1204918
  misc_feature 1..108: note = hypo
  source 1..108: mol_type = genomic DNA
ccatagctaaggacccgaggtatgagaagcgctggctggacaccttgtccgtgcctctgtccatggctcgcatctcaaggtacaaagccggaacggaaaaattaaggt

SEQ ID NO: 39395 - DNA, 62 bp, Homo sapiens
  misc_feature 1..62: note = chr2:1424987-1425049
  misc_feature 1..62: note = hypo
  source 1..62: mol_type = genomic DNA
ccctggaccaaaagccgtgcaaacctctctgtaaaaccatcctaagacgtaactctgtgcac

SEQ ID NO: 39396 - DNA, 30 bp, Homo sapiens
  misc_feature 1..30: note = chr2:1635811-1635841
  misc_feature 1..30: note = hypo
  source 1..30: mol_type = genomic DNA
ctgttacagcgatcccgcacagtggctgct

SEQ ID NO: 39397 - DNA, 30 bp, Homo sapiens
  misc_feature 1..30: note = chr2:1637034-1637064
  misc_feature 1..30: note = hypo
  source 1..30: mol_type = genomic DNA
ggctcttgttcaggacgtggacgcaaccag

SEQ ID NO: 39398 - DNA, 33 bp, Homo sapiens
  misc_feature 1..33: note = chr2:1689084-1689117
  misc_feature 1..33: note = hypo
  source 1..33: mol_type = genomic DNA
gaagacaaggaaaaccgccgtgggcgagcatga

SEQ ID NO: 39399 - DNA, 41 bp, Homo sapiens
  misc_feature 1..41: note = chr2:1893020-1893061
  misc_feature 1..41: note = hypo
  source 1..41: mol_type = genomic DNA
ctttggactcgtcctcgtctatcctccggggtttcattttg

SEQ ID NO: 39400 - DNA, 30 bp, Homo sapiens
  misc_feature 1..30: note = chr2:1950712-1950742
  misc_feature 1..30: note = hypo
  source 1..30: mol_type = genomic DNA
agatgcagctgtgcacggatggctcctcca

SEQ ID NO: 39401 - DNA, 156 bp, Homo sapiens
  misc_feature 1..156: note = chr2:1972852-1973008
  misc_feature 1..156: note = hypo
  source 1..156: mol_type = genomic DNA
agctacatcagtccacggtatgaacagaagtgaaacagaagtccctgattagaaatcaccctccagcaccactggctttttctcaccctgtgaaggcactggaagcaggactacagtgatgctgggccccggcgggggatgcgggcaggtgggagg

SEQ ID NO: 39402 - DNA, 30 bp, Homo sapiens
  misc_feature 1..30: note = chr2:2030884-2030914
  misc_feature 1..30: note = hypo
  source 1..30: mol_type = genomic DNA
ccccatcgccgctgccgccacagactgagc

SEQ ID NO: 39403 - DNA, 30 bp, Homo sapiens
  misc_feature 1..30: note = chr2:2190112-2190142
  misc_feature 1..30: note = hypo
  source 1..30: mol_type = genomic DNA
gcagccgggccttcccgagtcctgcggtcc

SEQ ID NO: 39404 - DNA, 106 bp, Homo sapiens
  misc_feature 1..106: note = chr2:2402544-2402650
  misc_feature 1..106: note = hypo
  source 1..106: mol_type = genomic DNA
ggctcttccttttgacgtaaggccacccacccaccccctttcttgcgtcacatttccagtaattgactccgtaactggacattttttctcccgccgtatctccctg

SEQ ID NO: 39405 - DNA, 189 bp, Homo sapiens; identical to SEQ ID NO: 14371
  misc_feature 1..189: note = chr2:2522670-2522859
  misc_feature 1..189: note = hypo
  source 1..189: mol_type = genomic DNA

SEQ ID NO: 39406 - DNA, 50 bp, Homo sapiens
  misc_feature 1..50: note = chr2:2575682-2575732
  misc_feature 1..50: note = hypo
  source 1..50: mol_type = genomic DNA
gagctttcttcctggcggggttgctttgtcctgcgcgacagcaggagttg

SEQ ID NO: 39407 - DNA, 83 bp, Homo sapiens
  misc_feature 1..83: note = chr2:2665528-2665611
  misc_feature 1..83: note = hypo
  source 1..83: mol_type = genomic DNA
ggcagccaggcgctgcggctgggtccagtgagggcacgcactctgctgattttggtttttttttttcttgaggcggagtctcg

SEQ ID NO: 39408 - DNA, 447 bp, Homo sapiens
  misc_feature 1..447: note = chr2:2725048-2725495
  misc_feature 1..447: note = hypo
  source 1..447: mol_type = genomic DNA
tgcatctccacaccccggccatgccatcggcacctgcacctccacaccccggccacgccaccagcacctgcacctccacaccccagccacaccgcccgtacctatgtctccacaccccagccatgccatcagcacctgcacctccacaccccggccacaccaccagcatctgcacctccacaccccagccacagcactggcacctatgtctccacaccccggccatgccacccgcacctgggtctccacaccctggccatgctgccggcacctgcacctccacaccccggccacgccaccagcacctgcacctccactccccagccacacctccagcacctatgtctccacaccccagccatgccatcggcacctgcacctccacaccccggccacaccaccagcacctgcacctccacaccccagccacaccgccggcacctatgt

SEQ ID NO: 39409 - DNA, 92 bp, Homo sapiens
  misc_feature 1..92: note = chr2:2730695-2730787
  misc_feature 1..92: note = hypo
  source 1..92: mol_type = genomic DNA
ataagtccttaatgacgcacctaaaggaaaagcaaacagttgttttgaaatgagggaaggggctaggaaagggatcgcgtccacactgtctg

SEQ ID NO: 39410 - DNA, 30 bp, Homo sapiens
  misc_feature 1..30: note = chr2:2753113-2753143
  misc_feature 1..30: note = hypo
  source 1..30: mol_type = genomic DNA
gtgaccacagtcaggcggctacaggccagg

SEQ ID NO: 39411 - DNA, 40 bp, Homo sapiens
  misc_feature 1..40: note = chr2:2799315-2799355
  misc_feature 1..40: note = hypo
  source 1..40: mol_type = genomic DNA
cggctcctgacaccccgggatggtgcgggcggctcctgac

SEQ ID NO: 39412 - DNA, 30 bp, Homo sapiens
  misc_feature 1..30: note = chr2:2844886-2844916
  misc_feature 1..30: note = hypo
  source 1..30: mol_type = genomic DNA
taaaaccagtattgccgattctgaaatccc

SEQ ID NO: 39413 - DNA, 110 bp, Homo sapiens
  misc_feature 1..110: note = chr2:2854353-2854463
  misc_feature 1..110: note = hypo
  source 1..110: mol_type = genomic DNA
ctgcgtgtcagggaacggctcctctgctgctcctgatgcctggccacccgtcccggtccacccctcgcgaggaaggccaggcctccgctcctctgcggagcctttcagga

SEQ ID NO: 39414 - DNA, 30 bp, Homo sapiens
  misc_feature 1..30: note = chr2:2939589-2939619
  misc_feature 1..30: note = hypo
  source 1..30: mol_type = genomic DNA
ggtcaaaaataaaaccgtttcctggccccg

SEQ ID NO: 39415 - DNA, 92 bp, Homo sapiens
  misc_feature 1..92: note = chr2:2941866-2941958
  misc_feature 1..92: note = hypo
  source 1..92: mol_type = genomic DNA
gggattacaggtgtgagccaccgtgcccagccccttttgtgtctgatgcccatgactgaattcatttctctttctctcgcatgttcacgtca

SEQ ID NO: 39416 - DNA, 105 bp, Homo sapiens
  misc_feature 1..105: note = chr2:3050299-3050404
  misc_feature 1..105: note = hypo
  source 1..105: mol_type = genomic DNA
gtatgtgcatatgtgcgtaagggccacgccgggagcctgctttgggtcagacccagctcctcatcctgcagccgcagctatgatgacggtcgtcagctcccagga

SEQ ID NO: 39417 - DNA, 30 bp, Homo sapiens
  misc_feature 1..30: note = chr2:3176032-3176062
  misc_feature 1..30: note = hypo
  source 1..30: mol_type = genomic DNA
ttgtgttatgacacacgatataaaaggctc

SEQ ID NO: 39418 - DNA, 30 bp, Homo sapiens
  misc_feature 1..30: note = chr2:3285842-3285872
  misc_feature 1..30: note = hypo
  source 1..30: mol_type = genomic DNA
gccagttggtgcagccgtcaagtgaaggag

SEQ ID NO: 39419 - DNA, 30 bp, Homo sapiens; identical to SEQ ID NO: 14373
  misc_feature 1..30: note = chr2:3331786-3331816
  misc_feature 1..30: note = hypo
  source 1..30: mol_type = genomic DNA

SEQ ID NO: 39420 - DNA, 33 bp, Homo sapiens
  misc_feature 1..33: note = chr2:3352677-3352710
  misc_feature 1..33: note = hypo
  source 1..33: mol_type = genomic DNA
ccagtggagccttcccggcgtctctcctggtct

SEQ ID NO: 39421 - DNA, 181 bp, Homo sapiens
  misc_feature 1..181: note = chr2:3833780-3833961
  misc_feature 1..181: note = hypo
  source 1..181: mol_type = genomic DNA
catgcagatgtgtcccgcttgtgcacagggcctctcgtgtgggtgtgtcccgcctgtgcacggaacctctgatgtggatgtttcccgcccccgccctccacgtgcagtgaacctctcgtgcagatgtgtcccgcctgtgcacggagcctccggtgtgcgtgtgtcccgcctgtgcacggag

SEQ ID NO: 39422 - DNA, 129 bp, Homo sapiens
  misc_feature 1..129: note = chr2:3990793-3990922
  misc_feature 1..129: note = hypo
  source 1..129: mol_type = genomic DNA
agagcttcctgaggtcggccggggccagggattgccctaattacacttcttcctctgcccagtctctccctgctacctgcaccgatactgacaccaaatgaagttctcgcaccccggactccctctctg

SEQ ID NO: 39423 - DNA, 30 bp, Homo sapiens
  misc_feature 1..30: note = chr2:4130725-4130755
  misc_feature 1..30: note = hypo
  source 1..30: mol_type = genomic DNA
agtgtcagatggtctcgaaagagggacaca

SEQ ID NO: 39424 - DNA, 57 bp, Homo sapiens; identical to SEQ ID NO: 14375
  misc_feature 1..57: note = chr2:5704308-5704365
  misc_feature 1..57: note = hypo
  source 1..57: mol_type = genomic DNA

SEQ ID NO: 39425 - DNA, 34 bp, Homo sapiens
  misc_feature 1..34: note = chr2:6024520-6024554
  misc_feature 1..34: note = hypo
  source 1..34: mol_type = genomic DNA
tttgagatggagtctcgctctgtcgcccaggctg

SEQ ID NO: 39426 - DNA, 30 bp, Homo sapiens
  misc_feature 1..30: note = chr2:6809103-6809133
  misc_feature 1..30: note = hypo
  source 1..30: mol_type = genomic DNA
agctgctgccgtgctcgggcccagcaagtg

SEQ ID NO: 39427 - DNA, 30 bp, Homo sapiens
  misc_feature 1..30: note = chr2:6989494-6989524
  misc_feature 1..30: note = hypo
  source 1..30: mol_type = genomic DNA
ctgagggagatgcagcgagcccatcatgac

SEQ ID NO: 39428 - DNA, 30 bp, Homo sapiens; identical to SEQ ID NO: 14376
  misc_feature 1..30: note = chr2:7036178-7036208
  misc_feature 1..30: note = hypo
  source 1..30: mol_type = genomic DNA

SEQ ID NO: 39429 - DNA, 89 bp, Homo sapiens
  misc_feature 1..89: note = chr2:7164511-7164600
  misc_feature 1..89: note = hypo
  source 1..89: mol_type = genomic DNA
aatggaagaagatgacgcgcccatcaagcgctgccccaagtgcaaagtctacatcgagcgagacgaaggctgcgcgcagatgatgtgca

SEQ ID NO: 39430 - DNA, 387 bp, Homo sapiens
  misc_feature 1..387: note = chr2:7172412-7172799
  misc_feature 1..387: note = hypo
  source 1..387: mol_type = genomic DNA
agctctgctggaatccgcgccccttgcagctctgctggaatccgcgccccttgcagctctgctggaatccgcgccccttgcagctctgctcgaatccgcgccccttgcagctctgctctggctgctgtgacaaagcgctgcagactgggtggctcagaacagcagaaatgtattggctcagtcctggagctcagaattctgaaatcgaggtgtcagcagggccctgcctgctctgaaacctgtaggagagtccctccggccttgtccagcttctgtggttcgccagccatctgcggcattcctggacagatcgatgcgtcactgcaatcctccgtcttcctccggctgcctcttccctgtgcgtctccacctcgtcttccatcattg

SEQ ID NO: 39431 - DNA, 17 bp, Homo sapiens
  misc_feature 1..17: note = chr2:7237246-7237263
  misc_feature 1..17: note = hypo
  source 1..17: mol_type = genomic DNA
cccgcccctcatggtgg

SEQ ID NO: 39432 - DNA, 24 bp, Homo sapiens
  misc_feature 1..24: note = chr2:7605198-7605222
  misc_feature 1..24: note = hypo
  source 1..24: mol_type = genomic DNA
aaaatgtaccgagttgtttctacc

SEQ ID NO: 39433 - DNA, 30 bp, Homo sapiens
  misc_feature 1..30: note = chr2:8768562-8768592
  misc_feature 1..30: note = hypo
  source 1..30: mol_type = genomic DNA
cccgaggcagacgcccgggagtcatgcact

SEQ ID NO: 39434 - DNA, 171 bp, Homo sapiens; identical to SEQ ID NO: 14378
  misc_feature 1..171: note = chr2:8833973-8834144
  misc_feature 1..171: note = hypo
  source 1..171: mol_type = genomic DNA

SEQ ID NO: 39435 - DNA, 24 bp, Homo sapiens
  misc_feature 1..24: note = chr2:8834789-8834813
  misc_feature 1..24: note = hypo
  source 1..24: mol_type = genomic DNA
atcgctttgcagcaacggaaatta

SEQ ID NO: 39436 - DNA, 23 bp, Homo sapiens
  misc_feature 1..23: note = chr2:8834873-8834896
  misc_feature 1..23: note = hypo
  source 1..23: mol_type = genomic DNA
gcaaacgccgcaaataattttgc

SEQ ID NO: 39437 - DNA, 28 bp, Homo sapiens
  misc_feature 1..28: note = chr2:8835589-8835617
  misc_feature 1..28: note = hypo
  source 1..28: mol_type = genomic DNA
gaccccctgcgcccggcctgaccacaca

SEQ ID NO: 39438 - DNA, 30 bp, Homo sapiens
  misc_feature 1..30: note = chr2:8860441-8860471
  misc_feature 1..30: note = hypo
  source 1..30: mol_type = genomic DNA
gaggatggtgtagcccgacaggaattttga

SEQ ID NO: 39439 - DNA, 30 bp, Homo sapiens
  misc_feature 1..30: note = chr2:8870364-8870394
  misc_feature 1..30: note = hypo
  source 1..30: mol_type = genomic DNA
agcctctccctgtagcgtcacaggctgtgc

SEQ ID NO: 39440 - DNA, 92 bp, Homo sapiens; identical to SEQ ID NO: 14381
  misc_feature 1..92: note = chr2:8978147-8978239
  misc_feature 1..92: note = hypo
  source 1..92: mol_type = genomic DNA

SEQ ID NO: 39441 - DNA, 199 bp, Homo sapiens
  misc_feature 1..199: note = chr2:9134235-9134434
  misc_feature 1..199: note = hypo
  source 1..199: mol_type = genomic DNA
atcacaccagccctgcggactctaaacatgctccgtgccaagaatggtcctaggcagacgggacacaaagatgagtaagtggaggtccttattcttaaggaatttagtttgggagggagacttgtaaagcaaacaaaaaaaaaatcaatgctccaggtgttatcagagtagaatacagtgaaagcggggcatgatggga

SEQ ID NO: 39442 - DNA, 180 bp, Homo sapiens; identical to SEQ ID NO: 14383
  misc_feature 1..180: note = chr2:9352635-9352815
  misc_feature 1..180: note = hypo
  source 1..180: mol_type = genomic DNA

SEQ ID NO: 39443 - DNA, 242 bp, Homo sapiens
  misc_feature 1..242: note = chr2:9960219-9960461
  misc_feature 1..242: note = hypo
  source 1..242: mol_type = genomic DNA
ggtgtcggcagtcaccgtgggcctctcttctctcttcatacaccaggaaccaacccagccaggttaaaggacttgcccaaggtcacgcggaggaaagctggttggtgccaagtggttaggagagaaagggtgaggtcatgagagcaaacctaagagggctgctaccgactcccaggatgaaatcacagatgaagtcacagaatcggaatgctggctttgggagagaccgccctgctccttca

SEQ ID NO: 39444 - DNA, 57 bp, Homo sapiens
  misc_feature 1..57: note = chr2:9960734-9960791
  misc_feature 1..57: note = hypo
  source 1..57: mol_type = genomic DNA
tggcatttcagggagcggcaagccagttgctgccaacccgcccgatgactgtgtcta

SEQ ID NO: 39445 - DNA, 16 bp, Homo sapiens
  misc_feature 1..16: note = chr2:10115730-10115746
  misc_feature 1..16: note = hypo
  source 1..16: mol_type = genomic DNA
cgcggtggctcttgcc

SEQ ID NO: 39446 - DNA, 120 bp, Homo sapiens
  misc_feature 1..120: note = chr2:10151717-10151837
  misc_feature 1..120: note = hypo
  source 1..120: mol_type = genomic DNA
gtgcgtacgggcgggtcagatggacaggatcgcgtacgggcgggtcaggtggacagtattggcgtgcatacgggcaggtcagatggacaggatcgcgtacaggcgggtcaggtggacagg

SEQ ID NO: 39447 - DNA, 120 bp, Homo sapiens
  misc_feature 1..120: note = chr2:10151897-10152017
  misc_feature 1..120: note = hypo
  source 1..120: mol_type = genomic DNA
tgcgtacaggcgggtcaggtgggcaggcatgtgtgtgggagagtcaggtggacaggattgagtacgggccggtcaggtggacaggattgcgtacgggcgggtcaggtgagcaggcgtgcg

SEQ ID NO: 39448 - DNA, 420 bp, Homo sapiens
  misc_feature 1..420: note = chr2:10153019-10153439
  misc_feature 1..420: note = hypo
  source 1..420: mol_type = genomic DNA
gcgtatggtcgggtcatgtgggcaggcgtgcttatgggcaggtcaggtgggcaggtgtgcatgtgggagagtcaggtggacaggattgaatatgggcgggtcaggtgcgcagacatgcgtatggccgggtcacgtgggcaggcgtgcgtttgggcgggtcaggtgggcaggggtgcatatgggcgggtcaggtggacaggcgcacgtatgggtgagtaagatggacaggcatgtgtgtgggagagtcaggtgaacaggattgcttatgggctagtcaggtggacaggtgtgcgtatgggtgtgcctatgggagagtcaggtggacaggattgcgtatagccggatcaggtgggcaggcatgcgtatgagcgagtcaggtgggcagacatgcgtatgggcgggtcaggtggacaggcgtgt

SEQ ID NO: 39449 - DNA, 120 bp, Homo sapiens
  misc_feature 1..120: note = chr2:10154039-10154159
  misc_feature 1..120: note = hypo
  source 1..120: mol_type = genomic DNA
ggtggacaggattgcgtatgggagagtcaggtggacagccctgcgtatgagcgagtcaggtggacaggattgcttatgggcaagtcaggtggacaggcgtgcgtatgagcgagtcaggtg

SEQ ID NO: 39450 - DNA, 322 bp, Homo sapiens
  misc_feature 1..322: note = chr2:10156308-10156630
  misc_feature 1..322: note = hypo
  source 1..322: mol_type = genomic DNA
tggacaggcgtgtgtatgggtgagtcaggtggaccactgtgtgtacgggcgagtcaggtggaccggcgtgcatatgggcaggtcaggtgggtaggcgtgtgtatggatgtgcatatgggcgggtcaggtggacaggtgtgtatatgggtgtacatgtgtgcacaggtgctactttactctgtgttcaacacgtgttcgtggacgtgctccaggcccaaggcgaaggaataggatgtagcaggggcagggtctccgccccatactcagagtccttgggctccgggaagacacaaccgataagtggttacggggatgcctggga

SEQ ID NO: 39451 - DNA, 30 bp, Homo sapiens
  misc_feature 1..30: note = chr2:10238076-10238106
  misc_feature 1..30: note = hypo
  source 1..30: mol_type = genomic DNA
agcacctgttatgtgcgaggattgcgctct

SEQ ID NO: 39452 - DNA, 30 bp, Homo sapiens
  misc_feature 1..30: note = chr2:10278078-10278108
  misc_feature 1..30: note = hypo
  source 1..30: mol_type = genomic DNA
tgttagtgcaggggccgctgcagcaaaggg

SEQ ID NO: 39453 - DNA, 51 bp, Homo sapiens
  misc_feature 1..51: note = chr2:10281143-10281194
  misc_feature 1..51: note = hypo
  source 1..51: mol_type = genomic DNA
gctggggctgcatctcgcccacgtcgctgtcatgtgcggggcccacgttgt

SEQ ID NO: 39454 - DNA, 77 bp, Homo sapiens; identical to SEQ ID NO: 14389
  misc_feature 1..77: note = chr2:10344641-10344718
  misc_feature 1..77: note = hypo
  source 1..77: mol_type = genomic DNA

SEQ ID NO: 39455 - DNA, 30 bp, Homo sapiens
  misc_feature 1..30: note = chr2:10408242-10408272
  misc_feature 1..30: note = hypo
  source 1..30: mol_type = genomic DNA
ggcccacaggaggggcgaggggcggggagg

SEQ ID NO: 39456 - DNA, 30 bp, Homo sapiens
  misc_feature 1..30: note = chr2:10526275-10526305
  misc_feature 1..30: note = hypo
  source 1..30: mol_type = genomic DNA
gggcctccctgatgtcggtttagacatgtg

SEQ ID NO: 39457 - DNA, 30 bp, Homo sapiens
  misc_feature 1..30: note = chr2:10577316-10577346
  misc_feature 1..30: note = hypo
  source 1..30: mol_type = genomic DNA
agggtagggaaacaccgaatgaatgctggg

SEQ ID NO: 39458 - DNA, 30 bp, Homo sapiens
  misc_feature 1..30: note = chr2:10600641-10600671
  misc_feature 1..30: note = hypo
  source 1..30: mol_type = genomic DNA
gtagataaaaccagacgggtcagattccct

SEQ ID NO: 39459 - DNA, 30 bp, Homo sapiens
  misc_feature 1..30: note = chr2:10911393-10911423
  misc_feature 1..30: note = hypo
  source 1..30: mol_type = genomic DNA
gcccatttactgatccgacagccttgatcc

SEQ ID NO: 39460 - DNA, 226 bp, Homo sapiens
  misc_feature 1..226: note = chr2:10924927-10925153
  misc_feature 1..226: note = hypo
  source 1..226: mol_type = genomic DNA
ctcttaaaaggcccacgggtgcaccagggctgaggtctgatgggaaggacttgactccaggtgcagagatgcacaggctcaagagagtaaaccaggactgctgcccgcacagcttccctcccgggcactcacctcgccatccctgccgtcccaaggctctctctcaacgatggtagggaaagccccgcctcctacaggtgccgtggagccacgcccaaaagagagc

SEQ ID NO: 39461 - DNA, 88 bp, Homo sapiens
  misc_feature 1..88: note = chr2:11538637-11538725
  misc_feature 1..88: note = hypo
  source 1..88: mol_type = genomic DNA
cagtcaatagttctccgttctggaaaccgactccagtcaggggctgtgtctcatgcctgtaatcccagctactcggcaggctgagttg

SEQ ID NO: 39462 - DNA, 148 bp, Homo sapiens
  misc_feature 1..148: note = chr2:11538785-11538933
  misc_feature 1..148: note = hypo
  source 1..148: mol_type = genomic DNA
tcaaaaaaaacaaataaataaaatgacattgagtaaactaaaaagtcatatttttcaaaaagctaactccagtccagtttatatatacacacgtaaatacacacacacacacacacacacacacagcagtccacgtatgggccgcccc

SEQ ID NO: 39463 - DNA, 126 bp, Homo sapiens
  misc_feature 1..126: note = chr2:11678173-11678299
  misc_feature 1..126: note = hypo
  source 1..126: mol_type = genomic DNA
gcacggggcactccacgtacagaccgcgtacagtgtgcctccccaacgagtaaagccctggcactagggatgcttcagagctgcagatgctcgctcgggcagaacctccagcgggtgccacccctg

SEQ ID NO: 39464 - DNA, 120 bp, Homo sapiens
  misc_feature 1..120: note = chr2:11886072-11886192
  misc_feature 1..120: note = hypo
  source 1..120: mol_type = genomic DNA
catttcaccaccagacgttatgtggctcattgtttatccgctgcctgcctcccggctggagaggcgcagggagctgcctgtccctcctgttcagagccaccgttccgcacctggaccacc

SEQ ID NO: 39465 - DNA, 34 bp, Homo sapiens
  misc_feature 1..34: note = chr2:12092493-12092527
  misc_feature 1..34: note = hypo
  source 1..34: mol_type = genomic DNA
agaggccacatgaaacgaccgaaagtggcttgct

SEQ ID NO: 39466 - DNA, 117 bp, Homo sapiens
  misc_feature 1..117: note = chr2:12103180-12103297
  misc_feature 1..117: note = hypo
  source 1..117: mol_type = genomic DNA
tcagccctttgaatacggcacaaatgtttttcatcagttataacagtgaaaccctggccattggaaaggtaataaaatctctgacccaaggaaagaatgtttcgcacatacctagca

SEQ ID NO: 39467 - DNA, 30 bp, Homo sapiens
  misc_feature 1..30: note = chr2:12303872-12303902
  misc_feature 1..30: note = hypo
  source 1..30: mol_type = genomic DNA
tctcctgcctgccctcggccacctccagcc

SEQ ID NO: 39468 - DNA, 76 bp, Homo sapiens
  misc_feature 1..76: note = chr2:12355766-12355842
  misc_feature 1..76: note = hypo
  source 1..76: mol_type = genomic DNA
gagtgccactctaaacgatgatgctcttgcactccctattaaccaatgcctaaaaacagtcacctcaaaactgttt

SEQ ID NO: 39469 - DNA, 19 bp, Homo sapiens
  misc_feature 1..19: note = chr2:15579677-15579696
  misc_feature 1..19: note = hypo
  source 1..19: mol_type = genomic DNA
gtctacagctcccagcgtg

SEQ ID NO: 39470 - DNA, 30 bp, Homo sapiens
  misc_feature 1..30: note = chr2:15960211-15960241
  misc_feature 1..30: note = hypo
  source 1..30: mol_type = genomic DNA
ggtatgtagcgcactcggcacatggcaagg

SEQ ID NO: 39471 - DNA, 68 bp, Homo sapiens
  misc_feature 1..68: note = chr2:18453289-18453357
  misc_feature 1..68: note = hypo
  source 1..68: mol_type = genomic DNA
cgtgtagcaagaggccggggtctggtctgcagccactgacttgggggcttgggcggctgcagtttcac

SEQ ID NO: 39472 - DNA, 39 bp, Homo sapiens
  misc_feature 1..39: note = chr2:20253274-20253313
  misc_feature 1..39: note = hypo
  source 1..39: mol_type = genomic DNA
taagatcaggggagccgggcgcggtggctcacgcctgta

SEQ ID NO: 39473 - DNA, 42 bp, Homo sapiens; identical to SEQ ID NO: 14394
  misc_feature 1..42: note = chr2:20431336-20431378
  misc_feature 1..42: note = hypo
  source 1..42: mol_type = genomic DNA

SEQ ID NO: 39474 - DNA, 142 bp, Homo sapiens; identical to SEQ ID NO: 14395
  misc_feature 1..142: note = chr2:20432683-20432825
  misc_feature 1..142: note = hypo
  source 1..142: mol_type = genomic DNA

SEQ ID NO: 39475 - DNA, 30 bp, Homo sapiens
  misc_feature 1..30: note = chr2:20442384-20442414
  misc_feature 1..30: note = hypo
  source 1..30: mol_type = genomic DNA
aaggcaggggcatctcgccatgtttcccag

SEQ ID NO: 39476 - DNA, 30 bp, Homo sapiens; identical to SEQ ID NO: 14396
  misc_feature 1..30: note = chr2:20456198-20456228
  misc_feature 1..30: note = hypo
  source 1..30: mol_type = genomic DNA

SEQ ID NO: 39477 - DNA, 30 bp, Homo sapiens
  misc_feature 1..30: note = chr2:20553860-20553890
  misc_feature 1..30: note = hypo
  source 1..30: mol_type = genomic DNA
tttgggaatgtgtctcgttggcctgttgag

SEQ ID NO: 39478 - DNA, 39 bp, Homo sapiens; identical to SEQ ID NO: 1545
  misc_feature 1..39: note = chr2:20642609-20642648
  misc_feature 1..39: note = hypo
  source 1..39: mol_type = genomic DNA

SEQ ID NO: 39479 - DNA, 21 bp, Homo sapiens
  misc_feature 1..21: note = chr2:24584330-24584351
  misc_feature 1..21: note = hypo
  source 1..21: mol_type = genomic DNA
tggcacagtggctcacgcttg

SEQ ID NO: 39480 - DNA, 63 bp, Homo sapiens
  misc_feature 1..63: note = chr2:24775908-24775971
  misc_feature 1..63: note = hypo
  source 1..63: mol_type = genomic DNA
agtggtgagagcagacgttcatgtctcgttcgtcatcttaggagacaacgtttaatcttttgt

SEQ ID NO: 39481 - DNA, 44 bp, Homo sapiens
  misc_feature 1..44: note = chr2:25241776-25241820
  misc_feature 1..44: note = hypo
  source 1..44: mol_type = genomic DNA
gacttttcaactttacgatggtgcaaaagcgatacacattccat

SEQ ID NO: 39482 - DNA, 28 bp, Homo sapiens
  misc_feature 1..28: note = chr2:25439965-25439993
  misc_feature 1..28: note = hypo
  source 1..28: mol_type = genomic DNA
gacagagaaagaccgtttctaaataagt

SEQ ID NO: 39483 - DNA, 77 bp, Homo sapiens
  misc_feature 1..77: note = chr2:26372967-26373044
  misc_feature 1..77: note = hypo
  source 1..77: mol_type = genomic DNA
cagagaaatcatggccgcatcagtgaaatccttagtgacagtgtggtgccagacattccgtccgctgtcacaacagc

SEQ ID NO: 39484 - DNA, 142 bp, Homo sapiens
  misc_feature 1..142: note = chr2:26607241-26607383
  misc_feature 1..142: note = hypo
  source 1..142: mol_type = genomic DNA
catattgcccgaggtcgtgtgatcaatggcggaagcaggactggaatttggagctctgttcagctgagcaggcgtgtattgtataacctcctgtgtgcttagagacactgagatgtggtatgccagtcgcacctcagagtct

SEQ ID NO: 39485 - DNA, 42 bp, Homo sapiens; identical to SEQ ID NO: 14399
  misc_feature 1..42: note = chr2:27090590-27090632
  misc_feature 1..42: note = hypo
  source 1..42: mol_type = genomic DNA

SEQ ID NO: 39486 - DNA, 24 bp, Homo sapiens
  misc_feature 1..24: note = chr2:27433305-27433329
  misc_feature 1..24: note = hypo
  source 1..24: mol_type = genomic DNA
ctttttttttggagacggagtctc

SEQ ID NO: 39487 - DNA, 135 bp, Homo sapiens
  misc_feature 1..135: note = chr2:27578363-27578498
  misc_feature 1..135: note = hypo
  source 1..135: mol_type = genomic DNA
gcaacaagaacaaaactccgtatcaaaaaaaaaaaaaatacacttctcatggaaggcagcagcaggatgtaatggtacaaattctggatacacagtaaaggaatagatgatcagtaaattcgtactgagtttcta

SEQ ID NO: 39488 - DNA, 141 bp, Homo sapiens; identical to SEQ ID NO: 14400
  misc_feature 1..141: note = chr2:27887525-27887666
  misc_feature 1..141: note = hypo
  source 1..141: mol_type = genomic DNA

SEQ ID NO: 39489 - DNA, 212 bp, Homo sapiens
  misc_feature 1..212: note = chr2:28676953-28677165
  misc_feature 1..212: note = hypo
  source 1..212: mol_type = genomic DNA
gccctgtgaagggcccgcttggagccatgcatgtctgggcctgagggtggcggtgcctacgtgaggccctgcggtctcttcaggagctccccgagaggggcacttggccactgttggagctgagaggggcctggcccagctcacccgcctctcctgcttctcacccagcccctgctgctgagagctctggcagcctccgtgtgcacagcagg

SEQ ID NO: 39490 - DNA, 40 bp, Homo sapiens
  misc_feature 1..40: note = chr2:29462699-29462739
  misc_feature 1..40: note = hypo
  source 1..40: mol_type = genomic DNA
caatgggacaaagaacgttggctcccgctgtggtatgaag

SEQ ID NO: 39491 - DNA, 81 bp, Homo sapiens
  misc_feature 1..81: note = chr2:29504693-29504774
  misc_feature 1..81: note = hypo
  source 1..81: mol_type = genomic DNA
gatgctgctcacgtacgactcagaaaatgtaccatctcattcaggcaacagactgttaatggacagcgaatataatgcctt

SEQ ID NO: 39492 - DNA, 87 bp, Homo sapiens
  misc_feature 1..87: note = chr2:30368623-30368710
  misc_feature 1..87: note = hypo
  source 1..87: mol_type = genomic DNA
ttatctcctggaaaactcacttattaaaagataactagtccttttgcctttgatgctcaggtaaacttcagacgaactaaatgaaaa

SEQ ID NO: 39493 - DNA, 37 bp, Homo sapiens
  misc_feature 1..37: note = chr2:30497257-30497294
  misc_feature 1..37: note = hypo
  source 1..37: mol_type = genomic DNA
tacaggcgtcagccaccgcacccggcctgacagactt

SEQ ID NO: 39494 - DNA, 79 bp, Homo sapiens
  misc_feature 1..79: note = chr2:32263984-32264063
  misc_feature 1..79: note = hypo
  source 1..79: mol_type = genomic DNA
gggatgataggcgtgggccatcgcgcccggcgaagggtttcttaattttaatatgcggtttttacgtagcaacatccca

SEQ ID NO: 39495 - DNA, 18 bp, Homo sapiens
  misc_feature 1..18: note = chr2:32275102-32275120
  misc_feature 1..18: note = hypo
  source 1..18: mol_type = genomic DNA
aaaaaatatctgggccgg

SEQ ID NO: 39496 - DNA, 44 bp, Homo sapiens
  misc_feature 1..44: note = chr2:32472347-32472391
  misc_feature 1..44: note = hypo
  source 1..44: mol_type = genomic DNA
gacaagcttaacctgcgtatatatttattttttttaattttttt

SEQ ID NO: 39497 - DNA, 30 bp, Homo sapiens
  misc_feature 1..30: note = chr2:32494200-32494230
  misc_feature 1..30: note = hypo
  source 1..30: mol_type = genomic DNA
aggcatgagccaccacgctcagtctcgtca

SEQ ID NO: 39498 - DNA, 180 bp, Homo sapiens
  misc_feature 1..180: note = chr2:32504317-32504497
  misc_feature 1..180: note = hypo
  source 1..180: mol_type = genomic DNA
gcgtgagccaccgcgccccggccattttcaaatttttattacacttcgtgcaccagttattttccagtgaccagacttactggctgctatgaaatcataaattatgtttacagaaatttcagtctgagaaagaacctagattttcctttttttttttttttttttttgagactgagtctc

SEQ ID NO: 39499 - DNA, 27 bp, Homo sapiens
  misc_feature 1..27: note = chr2:32551637-32551664
  misc_feature 1..27: note = hypo
  source 1..27: mol_type = genomic DNA
tgtgagccaccgcgcccagcctaccct

SEQ ID NO: 39500 - DNA, 22 bp, Homo sapiens
  misc_feature 1..22: note = chr2:33313226-33313248
  misc_feature 1..22: note = hypo
  source 1..22: mol_type = genomic DNA
atatggacagtgagccgggcgc

SEQ ID NO: 39501 - DNA, 30 bp, Homo sapiens
  misc_feature 1..30: note = chr2:33315571-33315601
  misc_feature 1..30: note = hypo
  source 1..30: mol_type = genomic DNA
gtactaaatgctgttcgtgaattacccatt

SEQ ID NO: 39502 - DNA, 34 bp, Homo sapiens
  misc_feature 1..34: note = chr2:33530065-33530099
  misc_feature 1..34: note = hypo
  source 1..34: mol_type = genomic DNA
tagtgtgggagataacgaaaaaatacaataaatg

SEQ ID NO: 39503 - DNA, 70 bp, Homo sapiens
  misc_feature 1..70: note = chr2:33532830-33532900
  misc_feature 1..70: note = hypo
  source 1..70: mol_type = genomic DNA
tttagggtcagtacccggaagcattttaattctgggtgaacagtcattataataacgtggttttatttga

SEQ ID NO: 39504 - DNA, 105 bp, Homo sapiens
  misc_feature 1..105: note = chr2:33653875-33653980
  misc_feature 1..105: note = hypo
  source 1..105: mol_type = genomic DNA
aggtgtgagccaccgtgaccgacctgatctcatttcttaaaccaaaccccctgattttgatgtttatactcagttcttcttcctttttcgcgtacctgacacatt

SEQ ID NO: 39505 - DNA, 66 bp, Homo sapiens
  misc_feature 1..66: note = chr2:36824207-36824273
  misc_feature 1..66: note = hypo
  source 1..66: mol_type = genomic DNA
ccccaccagaccatgcgatcgttaccatcagtaagcagggcccttcgttttcgtctctgtggcggc

SEQ ID NO: 39506 - DNA, 21 bp, Homo sapiens
  misc_feature 1..21: note = chr2:38365727-38365748
  misc_feature 1..21: note = hypo
  source 1..21: mol_type = genomic DNA
ctcccccgtcctgtcttaaag

SEQ ID NO: 39507 - DNA, 177 bp, Homo sapiens
  misc_feature 1..177: note = chr2:42281964-42282141
  misc_feature 1..177: note = hypo
  source 1..177: mol_type = genomic DNA
taggcctgagggatccggctccctggccaggttagcgttctgccccaggttggaatagaggaaggatgtgtctccaaaggctggattcctgagccactggtttccctctgccacaggtttttcttcacatacctcctgcctcacagtgccccgccttcactgcgtcctctgctggac

SEQ ID NO: 39508 - DNA, 30 bp, Homo sapiens
  misc_feature 1..30: note = chr2:42282578-42282608
  misc_feature 1..30: note = hypo
  source 1..30: mol_type = genomic DNA
gagggtgaatgaccccgcccaattaggcta

SEQ ID NO: 39509 - DNA, 30 bp, Homo sapiens
  misc_feature 1..30: note = chr2:43227374-43227404
  misc_feature 1..30: note = hypo
  source 1..30: mol_type = genomic DNA
ggcagccagttctgccgtttttggccaggc

SEQ ID NO: 39510 - DNA, 189 bp, Homo sapiens; identical to SEQ ID NO: 4967
  misc_feature 1..189: note = chr2:43408168-43408357
  misc_feature 1..189: note = hypo
  source 1..189: mol_type = genomic DNA

SEQ ID NO: 39511 - DNA, 39 bp, Homo sapiens; identical to SEQ ID NO: 14407
  misc_feature 1..39: note = chr2:43412683-43412722
  misc_feature 1..39: note = hypo
  source 1..39: mol_type = genomic DNA

SEQ ID NO: 39512 - DNA, 107 bp, Homo sapiens
  misc_feature 1..107: note = chr2:43812086-43812193
  misc_feature 1..107: note = hypo
  source 1..107: mol_type = genomic DNA
tacatgcacagtgcacgccaaatactgagacctcagccttcttccctcactcagcaaccagaatattaagacaatggtttggaagagtcttccgtggcaaatccagt

SEQ ID NO: 39513 - DNA, 40 bp, Homo sapiens; identical to SEQ ID NO: 14408
  misc_feature 1..40: note = chr2:43824353-43824393
  misc_feature 1..40: note = hypo
  source 1..40: mol_type = genomic DNA

SEQ ID NO: 39514 - DNA, 87 bp, Homo sapiens
  misc_feature 1..87: note = chr2:44224206-44224293
  misc_feature 1..87: note = hypo
  source 1..87: mol_type = genomic DNA
tctaaaacaaaacaaaaaaaccacgtcgctgccttcacagggcttacagactggatcggttccctgtgcacacgtgggaagctgaga

SEQ ID NO: 39515 - DNA, 45 bp, Homo sapiens
  misc_feature 1..45: note = chr2:44497699-44497744
  misc_feature 1..45: note = hypo
  source 1..45: mol_type = genomic DNA
aggtgcaactttcttcggtcgtctcgaatccgggttcatccgaca

SEQ ID NO: 39516 - DNA, 30 bp, Homo sapiens
  misc_feature 1..30: note = chr2:47200712-47200742
  misc_feature 1..30: note = hypo
  source 1..30: mol_type = genomic DNA
cacacaaacaaatggcgtgcttccaaacaa

SEQ ID NO: 39517 - DNA, 30 bp, Homo sapiens
  misc_feature 1..30: note = chr2:47567513-47567543
  misc_feature 1..30: note = hypo
  source 1..30: mol_type = genomic DNA
gaaggtcttgtgtgtcgattagagacaagc

SEQ ID NO: 39518 - DNA, 30 bp, Homo sapiens
  misc_feature 1..30: note = chr2:47574359-47574389
  misc_feature 1..30: note = hypo
  source 1..30: mol_type = genomic DNA
agctttcttttccgacgccagtgagaccac

SEQ ID NO: 39519 - DNA, 120 bp, Homo sapiens
  misc_feature 1..120: note = chr2:47597757-47597877
  misc_feature 1..120: note = hypo
  source 1..120: mol_type = genomic DNA
ctggagtgcaatggcaagatcttgactcattgtagactacgcctcccggcctcagaccatccttctgcgtcagcctttatgcctggctaatttttgtatttattatttattattattatt

SEQ ID NO: 39520 - DNA, 180 bp, Homo sapiens
  misc_feature 1..180: note = chr2:47598297-47598477
  misc_feature 1..180: note = hypo
  source 1..180: mol_type = genomic DNA
taaaatggtgactggtatgttgcaccgttattcaaatgttagacatgtagtttgatttcagtttctcttaactgtggaataaacaacttggctgccgtctctctctctctcttttttttggaaacagtgtctccgtctgtcgttcagcctggagtgcagtggcacatttacatgtcactg

SEQ ID NO: 39521 - DNA, 83 bp, Homo sapiens
  misc_feature 1..83: note = chr2:47598537-47598620
  misc_feature 1..83: note = hypo
  source 1..83: mol_type = genomic DNA
tacaggcatgagccaccggtccggcatctcttggtttatttgtaagatggtgcctagaagtggagtggcgtttgccaaaggtc

SEQ ID NO: 39522 - DNA, 23 bp, Homo sapiens
  misc_feature 1..23: note = chr2:47599482-47599505
  misc_feature 1..23: note = hypo
  source 1..23: mol_type = genomic DNA
agaggcggtgacagccgggcatg

SEQ ID NO: 39523 - DNA, 30 bp, Homo sapiens
  misc_feature 1..30: note = chr2:52856863-52856893
  misc_feature 1..30: note = hypo
  source 1..30: mol_type = genomic DNA
gtccgcgggagccttcggtcttcttgtctg

SEQ ID NO: 39524 - DNA, 30 bp, Homo sapiens
  misc_feature 1..30: note = chr2:55653035-55653065
  misc_feature 1..30: note = hypo
  source 1..30: mol_type = genomic DNA
ttttagcatcagcaacgggttttgtggaag

SEQ ID NO: 39525 - DNA, 21 bp, Homo sapiens
  misc_feature 1..21: note = chr2:55669245-55669266
  misc_feature 1..21: note = hypo
  source 1..21: mol_type = genomic DNA
tggagccaagatggccgaata

SEQ ID NO: 39526 - DNA, 28 bp, Homo sapiens
  misc_feature 1..28: note = chr2:55874935-55874963
  misc_feature 1..28: note = hypo
  source 1..28: mol_type = genomic DNA
gcgtgagccaccgcgcccagcagacatt

SEQ ID NO: 39527 - DNA, 166 bp, Homo sapiens
  misc_feature 1..166: note = chr2:58641373-58641539
  misc_feature 1..166: note = hypo
  source 1..166: mol_type = genomic DNA
cagtgatgtggataacgcctcttgaaaaccctatcgtgagaccaaaatgaagaattccattaagattttgtgttctcatccttgagatcttgaaaatattccacagaacggtggtaatcctgcctattttaaaaatcagtacattcaatatcgatattgctaactt

SEQ ID NO: 39528 - DNA, 44 bp, Homo sapiens
  misc_feature 1..44: note = chr2:59269682-59269726
  misc_feature 1..44: note = hypo
  source 1..44: mol_type = genomic DNA
tgacaacaagtctaaatctctgcttctgtcgcatttactaacat

SEQ ID NO: 39529 - DNA, 45 bp, Homo sapiens
  misc_feature 1..45: note = chr2:60411741-60411786
  misc_feature 1..45: note = hypo
  source 1..45: mol_type = genomic DNA
aaatctacacctggccgggcgcggtggctcacgcctgtaatccca

SEQ ID NO: 39530 - DNA, 30 bp, Homo sapiens; identical to SEQ ID NO: 14413
  misc_feature 1..30: note = chr2:60442223-60442253
  misc_feature 1..30: note = hypo
  source 1..30: mol_type = genomic DNA

SEQ ID NO: 39531 - DNA, 110 bp, Homo sapiens; identical to SEQ ID NO: 14414
  misc_feature 1..110: note = chr2:60705907-60706017
  misc_feature 1..110: note = hypo
  source 1..110: mol_type = genomic DNA

SEQ ID NO: 39532 - DNA, 185 bp, Homo sapiens
  misc_feature 1..185: note = chr2:60706789-60706974
  misc_feature 1..185: note = hypo
  source 1..185: mol_type = genomic DNA
cgaccaggcaagaaccgtcctgtactcctgccccagctctaatgcaataaaatgtcttttatcaatgtaattcaaggcaaagagtcaagggtctgtcaccattttaaagaggcttattacatggccacaaaaatttgcctcaggctcaaacctggcatgtaaggtatcagcgtgggacaggttct

SEQ ID NO: 39533 - DNA, 30 bp, Homo sapiens
  misc_feature 1..30: note = chr2:60733708-60733738
  misc_feature 1..30: note = hypo
  source 1..30: mol_type = genomic DNA
aaaacacagcacccacgtgcctttgtgcat

SEQ ID NO: 39534 - DNA, 30 bp, Homo sapiens; identical to SEQ ID NO: 14415
  misc_feature 1..30: note = chr2:60887794-60887824
  misc_feature 1..30: note = hypo
  source 1..30: mol_type = genomic DNA

SEQ ID NO: 39535 - DNA, 37 bp, Homo sapiens
  misc_feature 1..37: note = chr2:61231438-61231475
  misc_feature 1..37: note = hypo
  source 1..37: mol_type = genomic DNA
agaaataataaaagacggcaataaaataaagtaacat

SEQ ID NO: 39536 - DNA, 30 bp, Homo sapiens; identical to SEQ ID NO: 14416
  misc_feature 1..30: note = chr2:61406196-61406226
  misc_feature 1..30: note = hypo
  source 1..30: mol_type = genomic DNA

SEQ ID NO: 39537 - DNA, 18 bp, Homo sapiens
  misc_feature 1..18: note = chr2:61992299-61992317
  misc_feature 1..18: note = hypo
  source 1..18: mol_type = genomic DNA
aggcgtgagccaccgcgc

SEQ ID NO: 39538 - DNA, 56 bp, Homo sapiens
  misc_feature 1..56: note = chr2:62409597-62409653
  misc_feature 1..56: note = hypo
  source 1..56: mol_type = genomic DNA
agggatctgccctcacgaagggattaatgcagtttcttgagcgtgtgagagcaggt

SEQ ID NO: 39539 - DNA, 86 bp, Homo sapiens; identical to SEQ ID NO: 4970
  misc_feature 1..86: note = chr2:62589799-62589885
  misc_feature 1..86: note = hypo
  source 1..86: mol_type = genomic DNA

SEQ ID NO: 39540 - DNA, 30 bp, Homo sapiens
  misc_feature 1..30: note = chr2:64348216-64348246
  misc_feature 1..30: note = hypo
  source 1..30: mol_type = genomic DNA
ccacttaggttacagcgaaataaatctgcg

SEQ ID NO: 39541 - DNA, 145 bp, Homo sapiens
  misc_feature 1..145: note = chr2:64835504-64835649
  misc_feature 1..145: note = hypo
  source 1..145: mol_type = genomic DNA
ctgaggacagggaggcgaagtgagctgttaaaagtcaccatctaaggagctgtgctggggatagaacacgggtggctacgccgggcatggtggtgcgcacctgcagtcctggctgctggagaagctgaggcggaaggatcgctta

SEQ ID NO: 39542 - DNA, 92 bp, Homo sapiens
  misc_feature 1..92: note = chr2:65413492-65413584
  misc_feature 1..92: note = hypo
  source 1..92: mol_type = genomic DNA
ggccaacaaacacttaagtgtcttctatgaacctagcaagtgcttggcactgcttctgttgagtgcacagccccaagcggaagacaaacatt

SEQ ID NO: 39543 - DNA, 30 bp, Homo sapiens
  misc_feature 1..30: note = chr2:65868490-65868520
  misc_feature 1..30: note = hypo
  source 1..30: mol_type = genomic DNA
tcaaatgcataacagcgcccttgatttcac

SEQ ID NO: 39544 - DNA, 30 bp, Homo sapiens
  misc_feature 1..30: note = chr2:66561514-66561544
  misc_feature 1..30: note = hypo
  source 1..30: mol_type = genomic DNA
gagatggttgagccacgaaggcaaaatagt

SEQ ID NO: 39545 - DNA, 39 bp, Homo sapiens
  misc_feature 1..39: note = chr2:67625453-67625492
  misc_feature 1..39: note = hypo
  source 1..39: mol_type = genomic DNA
tttttttataccttacgtgtcttttttcttttgggaaag

SEQ ID NO: 39546 - DNA, 38 bp, Homo sapiens
  misc_feature 1..38: note = chr2:67625732-67625770
  misc_feature 1..38: note = hypo
  source 1..38: mol_type = genomic DNA
gctgggattacagccaccgcgcccggccaccttacatg

SEQ ID NO: 39547 - DNA, 39 bp, Homo sapiens
  misc_feature 1..39: note = chr2:68530252-68530291
  misc_feature 1..39: note = hypo
  source 1..39: mol_type = genomic DNA
caggcgtgagtcaccgcgcccggccgaaaaacattttaa

SEQ ID NO: 39548 - DNA, 39 bp, Homo sapiens
  misc_feature 1..39: note = chr2:68537171-68537210
  misc_feature 1..39: note = hypo
  source 1..39: mol_type = genomic DNA
tggattggccaggcacggtggctcactcctgtaatccca

SEQ ID NO: 39549 - DNA, 249 bp, Homo sapiens
  misc_feature 1..249: note = chr2:68672689-68672938
  misc_feature 1..249: note = hypo
  source 1..249: mol_type = genomic DNA
tcaaaataacaaacacgcacgacgtcttcgatcaccttcctgtaaaaccgggtttctagccggacccatgtcctcacagttcctgaatcaagttcaccgtctgtgcaagcgccacctgacagagctccctgcgacactgaaacgcgtttgggcacttcccacgtgggaaccactcgccacgggcacctcctgagtacaaggtgcagtgctggggctggggcaggctgaagcgttcgttctaagtttctt

SEQ ID NO: 39550 - DNA, 48 bp, Homo sapiens
  misc_feature 1..48: note = chr2:68882413-68882461
  misc_feature 1..48: note = hypo
  source 1..48: mol_type = genomic DNA
ctgggcgcccttctacggcttcaccatcgtgcgcgacttcttccccac

SEQ ID NO: 39551 - DNA, 139 bp, Homo sapiens
  misc_feature 1..139: note = chr2:69182056-69182195
  misc_feature 1..139: note = hypo
  source 1..139: mol_type = genomic DNA
tcactcccagctccccgccgagggagtgaaattgctgacctggaagggcctggtgctgacggtgcccacctttggataccctgacgtagtaggtctaaaacttccgtgggttattcagattgaacgctgtttcaagtct

SEQ ID NO: 39552 - DNA, 141 bp, Homo sapiens
  misc_feature 1..141: note = chr2:69720070-69720211
  misc_feature 1..141: note = hypo
  source 1..141: mol_type = genomic DNA
actacttgctttttgcggggtaaaaccaaatttgtagtttgcccaggttctagagacactgaaccctgagccctttcctcactcaatattcaaaaatgttaaaaaaggatgcagtaaggctgaggcaggagaatggcgtga

SEQ ID NO: 39553 - DNA, 95 bp, Homo sapiens
  misc_feature 1..95: note = chr2:69914132-69914227
  misc_feature 1..95: note = hypo
  source 1..95: mol_type = genomic DNA
agagaaccaaagtcacgagtgtgtgaaacaacggagaggagcggcgctgtgcagcctggagctcaagacacttgcatgagcggtgagatgagagg

SEQ ID NO: 39554 - DNA, 48 bp, Homo sapiens; identical to SEQ ID NO: 14421
  misc_feature 1..48: note = chr2:70364215-70364263
  misc_feature 1..48: note = hypo
  source 1..48: mol_type = genomic DNA

SEQ ID NO: 39555 - DNA, 90 bp, Homo sapiens
  misc_feature 1..90: note = chr2:70367809-70367899
  misc_feature 1..90: note = hypo
  source 1..90: mol_type = genomic DNA
acaggcatgagacaccgtgcccagcgacaagataattttaaaaggagagggaacgtctgcttttgttgcctttctcgtcttttgtggttc

SEQ ID NO: 39556 - DNA, 19 bp, Homo sapiens
  misc_feature 1..19: note = chr2:70477741-70477760
  misc_feature 1..19: note = hypo
  source 1..19: mol_type = genomic DNA
gtcggctgagcggggcggc

SEQ ID NO: 39557 - DNA, 30 bp, Homo sapiens
  misc_feature 1..30: note = chr2:71270959-71270989
  misc_feature 1..30: note = hypo
  source 1..30: mol_type = genomic DNA
ccacatggcagggggcgggcgccccccgtg

SEQ ID NO: 39558 - DNA, 30 bp, Homo sapiens
  misc_feature 1..30: note = chr2:71355087-71355117
  misc_feature 1..30: note = hypo
  source 1..30: mol_type = genomic DNA
gtttgaggaaacatacgtatttagaaagtc

SEQ ID NO: 39559 - DNA, 92 bp, Homo sapiens
  misc_feature 1..92: note = chr2:71455196-71455288
  misc_feature 1..92: note = hypo
  source 1..92: mol_type = genomic DNA
atcaataaatacaaattaaaataaaactttattgcctcccttggatttagaatgtccaatctgcttgcaaaggacttcgaattgtattccac

SEQ ID NO: 39560 - DNA, 30 bp, Homo sapiens
  misc_feature 1..30: note = chr2:71502899-71502929
  misc_feature 1..30: note = hypo
  source 1..30: mol_type = genomic DNA
tagttgtcctctggccgaaatctcctcgtg

SEQ ID NO: 39561 - DNA, 32 bp, Homo sapiens
  misc_feature 1..32: note = chr2:71622692-71622724
  misc_feature 1..32: note = hypo
  source 1..32: mol_type = genomic DNA
ttgatcatcctattgcgcgcaggactgctccc

SEQ ID NO: 39562 - DNA, 83 bp, Homo sapiens
  misc_feature 1..83: note = chr2:72778912-72778995
  misc_feature 1..83: note = hypo
  source 1..83: mol_type = genomic DNA
ccgcgcccggccattaaaatcttaatagcttataaaaactagcatacacacagtgatgagatacaatgcggtcatactataat

SEQ ID NO: 39563 - DNA, 23 bp, Homo sapiens
  misc_feature 1..23: note = chr2:73440127-73440150
  misc_feature 1..23: note = hypo
  source 1..23: mol_type = genomic DNA
caggtgatcctcccacgcatcac

SEQ ID NO: 39564 - DNA, 23 bp, Homo sapiens
  misc_feature 1..23: note = chr2:73440270-73440293
  misc_feature 1..23: note = hypo
  source 1..23: mol_type = genomic DNA
cgacaaagcgagaccctgtctca

SEQ ID NO: 39565 - DNA, 30 bp, Homo sapiens
  misc_feature 1..30: note = chr2:73723848-73723878
  misc_feature 1..30: note = hypo
  source 1..30: mol_type = genomic DNA
actccacatcctcaccgatgtgtaaattgt

SEQ ID NO: 39566 - DNA, 93 bp, Homo sapiens
  misc_feature 1..93: note = chr2:74010528-74010621
  misc_feature 1..93: note = hypo
  source 1..93: mol_type = genomic DNA
acaatgggcagtcaacgaactttgccgttcaaccaagttacaaaagaaggctctttaatcccttctttggcccttaaaagcggcagcagggcc

SEQ ID NO: 39567 - DNA, 17 bp, Homo sapiens
  misc_feature 1..17: note = chr2:74425137-74425154
  misc_feature 1..17: note = hypo
  source 1..17: mol_type = genomic DNA
atatggtctcactctcg

SEQ ID NO: 39568 - DNA, 317 bp, Homo sapiens
  misc_feature 1..317: note = chr2:74454002-74454319
  misc_feature 1..317: note = hypo
  source 1..317: mol_type = genomic DNA
caggaggggaggttgcgctgcacctctgggttgcccaggccaacctgccaggcaggagggggaagcccgtgcccactttaccatgaccgggaagatgatggcagccaccgtggatttgaggatccagagcaccgccaggcagaggatctgcaccagggtgaagaggtggatccggcgcagcggcacgtgccgcaggaaggcatggtccggctggtgcttggctggcatcaggaagagcttgcagcgttcccagaactagggggacagcgggggctcagccaggcagccagaccccgagggcccgctgggtcctggga

SEQ ID NO: 39569 - DNA, 22 bp, Homo sapiens
  misc_feature 1..22: note = chr2:74669781-74669803
  misc_feature 1..22: note = hypo
  source 1..22: mol_type = genomic DNA
cataaagagcagctgcgcgcgg

SEQ ID NO: 39570 - DNA, 92 bp, Homo sapiens
  misc_feature 1..92: note = chr2:74700397-74700489
  misc_feature 1..92: note = hypo
  source 1..92: mol_type = genomic DNA
ttctccatgaattagcgtagctcccaggacttaagttgaagtgcattctagccagttttctttttttgagacgaagttttgctcttgttgcc

SEQ ID NO: 39571 - DNA, 36 bp, Homo sapiens
  misc_feature 1..36: note = chr2:74733345-74733381
  misc_feature 1..36: note = hypo
  source 1..36: mol_type = genomic DNA
gactggtagaattcccgaatccgtttctcttcacct

SEQ ID NO: 39572 - DNA, 24 bp, Homo sapiens
  misc_feature 1..24: note = chr2:74874703-74874727
  misc_feature 1..24: note = hypo
  source 1..24: mol_type = genomic DNA
tgggttcactttaaacgaaatgaa

SEQ ID NO: 39573 - DNA, 35 bp, Homo sapiens
  misc_feature 1..35: note = chr2:81421368-81421403
  misc_feature 1..35: note = hypo
  source 1..35: mol_type = genomic DNA
ccccgcccgggtggacgtggcgctccctcctcggc

SEQ ID NO: 39574 - DNA, 54 bp, Homo sapiens
  misc_feature 1..54: note = chr2:81424249-81424303
  misc_feature 1..54: note = hypo
  source 1..54: mol_type = genomic DNA
gaggcaggacagcaccgacgtaggggtgggcacaccggtcggctctggtcaggc

SEQ ID NO: 39575 - DNA, 30 bp, Homo sapiens
  misc_feature 1..30: note = chr2:85533655-85533685
  misc_feature 1..30: note = hypo
  source 1..30: mol_type = genomic DNA
ccaacctggtcagcccgggacaactatgta

SEQ ID NO: 39576 - DNA, 30 bp, Homo sapiens
  misc_feature 1..30: note = chr2:85542244-85542274
  misc_feature 1..30: note = hypo
  source 1..30: mol_type = genomic DNA
gttttcatctgcctgcgaggcaccaaggag

SEQ ID NO: 39577 - DNA, 34 bp, Homo sapiens
  misc_feature 1..34: note = chr2:85769773-85769807
  misc_feature 1..34: note = hypo
  source 1..34: mol_type = genomic DNA
ggattataccaaggtcgaccgttcagctgcttat

SEQ ID NO: 39578 - DNA, 28 bp, Homo sapiens
  misc_feature 1..28: note = chr2:85838295-85838323
  misc_feature 1..28: note = hypo
  source 1..28: mol_type = genomic DNA
actccagcctgggcgacagagacctagt

SEQ ID NO: 39579 - DNA, 29 bp, Homo sapiens
  misc_feature 1..29: note = chr2:86423740-86423769
  misc_feature 1..29: note = hypo
  source 1..29: mol_type = genomic DNA
atcaaaataaaacacgttaaatattaagc

SEQ ID NO: 39580 - DNA, 16 bp, Homo sapiens
  misc_feature 1..16: note = chr2:87056517-87056533
  misc_feature 1..16: note = hypo
  source 1..16: mol_type = genomic DNA
gcgcctggctggcata

SEQ ID NO: 39581 - DNA, 80 bp, Homo sapiens
  misc_feature 1..80: note = chr2:87961966-87962046
  misc_feature 1..80: note = hypo
  source 1..80: mol_type = genomic DNA
ggtggcaaggcagggcggaaggtaagcggagaccttctccaatcagaagtctagaaggcagggcacgcagtaggtctgca

SEQ ID NO: 39582 - DNA, 30 bp, Homo sapiens
  misc_feature 1..30: note = chr2:88306721-88306751
  misc_feature 1..30: note = hypo
  source 1..30: mol_type = genomic DNA
gaattccagcttcctcgctgcttaccagtc

SEQ ID NO: 39583 - DNA, 96 bp, Homo sapiens
  misc_feature 1..96: note = chr2:88469312-88469408
  misc_feature 1..96: note = hypo
  source 1..96: mol_type = genomic DNA
ctcacaaccctgcagcgaagactccgaggctgaacgtcaataaagcgtttactaaagcgccttaaaaaatgggccgcggggctgggcgcggtggct

SEQ ID NO: 39584 - DNA, 87 bp, Homo sapiens
  misc_feature 1..87: note = chr2:88573562-88573649
  misc_feature 1..87: note = hypo
  source 1..87: mol_type = genomic DNA
gggacacagtggatacgcaaaaggttcttgtcagattagactactaatagacggcagctctagggcaggtgtgtgtgtgtgtgtgtg

SEQ ID NO: 39585 - DNA, 232 bp, Homo sapiens
  misc_feature 1..232: note = chr2:88990189-88990421
  misc_feature 1..232: note = hypo
  source 1..232: mol_type = genomic DNA
agattcaagagctcacggcctcagagggcaaagcatagttaagaaaatctaggtgataaccggcagttaacagtggcccataccagtgacttgcgctcacggaagagttctgaaggcctggaatgcgtttgaagatgagttcatgagcagacagaaaggattccactaacagccgagaaacacaaaggtcatgtgtttttagggacctccaagtggtcggtaaggttggggt

SEQ ID NO: 39586 - DNA, 34 bp, Homo sapiens
  misc_feature 1..34: note = chr2:89071947-89071981
  misc_feature 1..34: note = hypo
  source 1..34: mol_type = genomic DNA
gtgagccaccacgcccggccgtgaatgatacatt

SEQ ID NO: 39587 - DNA, 30 bp, Homo sapiens
  misc_feature 1..30: note = chr2:89371674-89371704
  misc_feature 1..30: note = hypo
  source 1..30: mol_type = genomic DNA
agatgatattactttcgatatcgtaaacac

SEQ ID NO: 39588 - DNA, 38 bp, Homo sapiens
  misc_feature 1..38: note = chr2:90003862-90003900
  misc_feature 1..38: note = hypo
  source 1..38: mol_type = genomic DNA
aaacagctccttggccgggcgcggtggctcacgcctgt

SEQ ID NO: 39589 - DNA, 89 bp, Homo sapiens
  misc_feature 1..89: note = chr2:95742095-95742184
  misc_feature 1..89: note = hypo
  source 1..89: mol_type = genomic DNA
tgaaagtaaagctcacgggtttttttctacttcgggttgtttaaataaccacaatcggtcgggagcggtggctcacgcctgtaatccca

SEQ ID NO: 39590 - DNA, 30 bp, Homo sapiens
  misc_feature 1..30: note = chr2:95745768-95745798
  misc_feature 1..30: note = hypo
  source 1..30: mol_type = genomic DNA
ccaccgtgcctggcccggacacaagcattt

SEQ ID NO: 39591 - DNA, 223 bp, Homo sapiens
  misc_feature 1..223: note = chr2:95941629-95941852
  misc_feature 1..223: note = hypo
  source 1..223: mol_type = genomic DNA
ctgggcagtgggggtcgggtcacccctcatgccctgctgcctgcccaggtggtgcggtacgaggcgggctacgtggtatgcgctgtgatcgcgggcctctacctgctgctggtgcccactgccgggctttgcttctgctgctgccgctgccaccggcgctgcgggggacgagtgaagacagagcacaaggcgctggcctgtgagcgcgcggccctcatggtct

SEQ ID NO: 39592 - DNA, 82 bp, Homo sapiens
  misc_feature 1..82: note = chr2:96784580-96784662
  misc_feature 1..82: note = hypo
  source 1..82: mol_type = genomic DNA
gccccaggctgtcaccgtctactgcagctgtctcctcctggctccaccccaggatggacaagtgcagcgtgggtgcgccagc

SEQ ID NO: 39593 - DNA, 24 bp, Homo sapiens
  misc_feature 1..24: note = chr2:96872240-96872264
  misc_feature 1..24: note = hypo
  source 1..24: mol_type = genomic DNA
cttaaaagtggaacacggccgggc

SEQ ID NO: 39594 - DNA, 92 bp, Homo sapiens; identical to SEQ ID NO: 1550
  misc_feature 1..92: note = chr2:97427763-97427855
  misc_feature 1..92: note = hypo
  source 1..92: mol_type = genomic DNA

SEQ ID NO: 39595 - DNA, 30 bp, Homo sapiens; identical to SEQ ID NO: 14434
  misc_feature 1..30: note = chr2:97428063-97428093
  misc_feature 1..30: note = hypo
  source 1..30: mol_type = genomic DNA

SEQ ID NO: 39596 - DNA, 30 bp, Homo sapiens
  misc_feature 1..30: note = chr2:97437788-97437818
  misc_feature 1..30: note = hypo
  source 1..30: mol_type = genomic DNA
ccaggctctctggaacgcctggtctctggc

SEQ ID NO: 39597 - DNA, 30 bp, Homo sapiens
  misc_feature 1..30: note = chr2:97603228-97603258
  misc_feature 1..30: note = hypo
  source 1..30: mol_type = genomic DNA
ctgaggccaactgcccgtggctcagtagcc

SEQ ID NO: 39598 - DNA, 119 bp, Homo sapiens
  misc_feature 1..119: note = chr2:97605950-97606069
  misc_feature 1..119: note = hypo
  source 1..119: mol_type = genomic DNA
ggagtaaagggcacccggcatgagaacggtatggggtccagggcccaggcacttaagtgctccacacatatgggcagctgctgctgccaccgccacaggagacgcgacctgcagatgag

SEQ ID NO: 39599 - DNA, 32 bp, Homo sapiens
  misc_feature 1..32: note = chr2:97652373-97652405
  misc_feature 1..32: note = hypo
  source 1..32: mol_type = genomic DNA
gtgcgcatccacgtgcgcgggaattggctggc

SEQ ID NO: 39600 - DNA, 30 bp, Homo sapiens; identical to SEQ ID NO: 14435
  misc_feature 1..30: note = chr2:98025687-98025717
  misc_feature 1..30: note = hypo
  source 1..30: mol_type = genomic DNA

SEQ ID NO: 39601 - DNA, 30 bp, Homo sapiens
  misc_feature 1..30: note = chr2:98263541-98263571
  misc_feature 1..30: note = hypo
  source 1..30: mol_type = genomic DNA
ctgatgaagagcaggcgactgggttggaga

SEQ ID NO: 39602 - DNA, 30 bp, Homo sapiens
  misc_feature 1..30: note = chr2:98351134-98351164
  misc_feature 1..30: note = hypo
  source 1..30: mol_type = genomic DNA
aactttggctcagtgcgccagggcgtgtac

SEQ ID NO: 39603 - DNA, 30 bp, Homo sapiens
  misc_feature 1..30: note = chr2:98354137-98354167
  misc_feature 1..30: note = hypo
  source 1..30: mol_type = genomic DNA
tgcccctgtgatgcccgactggatgggctg

SEQ ID NO: 39604 - DNA, 145 bp, Homo sapiens
  misc_feature 1..145: note = chr2:98357736-98357881
  misc_feature 1..145: note = hypo
  source 1..145: mol_type = genomic DNA
gatcttttctcttggcggctctgaccaagccccttcaccctcctccagggtttccagcgcccacgcggactcccctctgggcctctgcattcaccgctgccgctgcctggaaagctctccccgtccccaccggtgatgtccccta

SEQ ID NO: 39605 - DNA, 189 bp, Homo sapiens
  misc_feature 1..189: note = chr2:98702143-98702332
  misc_feature 1..189: note = hypo
  source 1..189: mol_type = genomic DNA
atagacacataaacacgaaagatagggacagatcatcttggtgacttgcacgtatgtggcaagtgtcctagggaaaggagcaggcatggggtgaaggtgggaacaagagtgcctggcgtgaccatgtgaggcagggcatttggctatgtgttgctgtgtgctctgtctcacccccgtgacccaagaata

SEQ ID NO: 39606 - DNA, 30 bp, Homo sapiens
  misc_feature 1..30: note = chr2:98957314-98957344
  misc_feature 1..30: note = hypo
  source 1..30: mol_type = genomic DNA
tatgtagtagaagtacgcatttcttggctt

SEQ ID NO: 39607 - DNA, 30 bp, Homo sapiens
  misc_feature 1..30: note = chr2:99004156-99004186
  misc_feature 1..30: note = hypo
  source 1..30: mol_type = genomic DNA
gaacctgcgaccacacgtatttgccactac

SEQ ID NO: 39608 - DNA, 88 bp, Homo sapiens
  misc_feature 1..88: note = chr2:99795933-99796021
  misc_feature 1..88: note = hypo
  source 1..88: mol_type = genomic DNA
cactcagcactgaaacgtgatatctatgcttattgctgttgtcactgtcatcattatcatcaaataatgccccaggcaaggtagagtt

SEQ ID NO: 39609 - DNA, 148 bp, Homo sapiens
  misc_feature 1..148: note = chr2:99796321-99796469
  misc_feature 1..148: note = hypo
  source 1..148: mol_type = genomic DNA
cggccggtagagtttgtagttctgaccaaagcaccaaaccataaagggctcccctctgctgccccaaagcttctgtaacactttaattataagaagcttaaactagaaagaacagagggagcttagtccagaccgggagtgtcggggg

SEQ ID NO: 39610 - DNA, 100 bp, Homo sapiens; identical to SEQ ID NO: 1551
  misc_feature 1..100: note = chr2:99798646-99798746
  misc_feature 1..100: note = hypo
  source 1..100: mol_type = genomic DNA

SEQ ID NO: 39611 - DNA, 39 bp, Homo sapiens
  misc_feature 1..39: note = chr2:99951448-99951487
  misc_feature 1..39: note = hypo
  source 1..39: mol_type = genomic DNA
ttacaggcgtgagccagccgcgcccggccaaaattttac

SEQ ID NO: 39612 - DNA, 30 bp, Homo sapiens
  misc_feature 1..30: note = chr2:100107667-100107697
  misc_feature 1..30: note = hypo
  source 1..30: mol_type = genomic DNA
tcgtcgctaatccaacgaatttagattgca

SEQ ID NO: 39613 - DNA, 162 bp, Homo sapiens
  misc_feature 1..162: note = chr2:100108060-100108222
  misc_feature 1..162: note = hypo
  source 1..162: mol_type = genomic DNA
ctcacgaccagttgccgactgcaacaccaggaggtcatctgctgagatgctacagaaaaacagtggtaaccccttgttatgggtgagttttgttttggttgttgttcttttgcttgttttaaatgtctaaatggcagcattcctgcacgattgtatttcaat

SEQ ID NO: 39614 - DNA, 95 bp, Homo sapiens
  misc_feature 1..95: note = chr2:101009832-101009927
  misc_feature 1..95: note = hypo
  source 1..95: mol_type = genomic DNA
atacacggtaatgcccggagggatagtcgggtatgacaccaggtggtcaatgccagcctcttttaagatgtatggggcatcgtcctccagggtct

SEQ ID NO: 39615 - DNA, 177 bp, Homo sapiens
  misc_feature 1..177: note = chr2:101520526-101520703
  misc_feature 1..177: note = hypo
  source 1..177: mol_type = genomic DNA
ctaagggaggaactgcggattacactcctttggggctgattcttccaggccacttgtcagaggagcttgtgtggtttgaatggacagataaacactctcctttaggatgtcataggccactggggtcctgcaagcaggagtgaacaaggcccgctgtggtgtcgctaacggatccca

SEQ ID NO: 39616 - DNA, 41 bp, Homo sapiens
  misc_feature 1..41: note = chr2:101835056-101835097
  misc_feature 1..41: note = hypo
  source 1..41: mol_type = genomic DNA
gctgggattacaggcatgagccaccgcgcccagcctagtca

SEQ ID NO: 39617 - DNA, 30 bp, Homo sapiens
  misc_feature 1..30: note = chr2:101893777-101893807
  misc_feature 1..30: note = hypo
  source 1..30: mol_type = genomic DNA
gagggcagcatattccgagcttcaactatg

SEQ ID NO: 39618 - DNA, 204 bp, Homo sapiens
  misc_feature 1..204: note = chr2:102246999-102247203
  misc_feature 1..204: note = hypo
  source 1..204: mol_type = genomic DNA
accgtcttgtgtttgcgccacactgcctgtgaggttggaacaggggacaatggctcacaggggtctttccaccctgccagccaatgcctccttctctgcctagcttgtcctcaccccgaaagtgcctgcttctgacctcttcttggtccacccgggctggcccgtgattggcattctagaaatgctgctcgagggaccgggcct

SEQ ID NO: 39619 - DNA, 91 bp, Homo sapiens
  misc_feature 1..91: note = chr2:104014594-104014685
  misc_feature 1..91: note = hypo
  source 1..91: mol_type = genomic DNA
aatttacaatagctccgtgaaccggtgcagggtcagatgctgacacaatggtggaggggcgctgatgccgaacttacggataatactgtca

SEQ ID NO: 39620 - DNA, 30 bp, Homo sapiens
  misc_feature 1..30: note = chr2:105719619-105719649
  misc_feature 1..30: note = hypo
  source 1..30: mol_type = genomic DNA
agacaccagaggggtcggctcgggtttcag

SEQ ID NO: 39621 - DNA, 41 bp, Homo sapiens
  misc_feature 1..41: note = chr2:105858359-105858400
  misc_feature 1..41: note = hypo
  source 1..41: mol_type = genomic DNA
gctgaacaccagcaacgcctcagactcggggtccacccagt

SEQ ID NO: 39622 - DNA, 156 bp, Homo sapiens
  misc_feature 1..156: note = chr2:105972350-105972506
  misc_feature 1..156: note = hypo
  source 1..156: mol_type = genomic DNA
gccagcaaaccaatgcgtaaatgaacatacatggctgtgtttgaataaaacttttttgttaagaaaacagaccaggtgtgatgactcatgctggtaatcccagcgttttggaatgccaagatggggggaatcgcttgagcccaggagtttgagacc

SEQ ID NO: 39623 - DNA, 257 bp, Homo sapiens
  misc_feature 1..257: note = chr2:106016141-106016398
  misc_feature 1..257: note = hypo
  source 1..257: mol_type = genomic DNA
cccacattccaagcccgggccctctgcgtgacgctgacgctgggtagggacagatggcactgttcagcattgtcgcagggagagcacaggttgagcccatccctgggagagggtgcgtcgtgatggaaacatttgctcctgagcaggtaaccggtccacttgcagaaaccggtggacgatgagtaggtggaccacaaaggcgtcctcggcactttgggggcaggtgtattatttttaacattcggggcagctcatag

SEQ ID NO: 39624 - DNA, 177 bp, Homo sapiens; identical to SEQ ID NO: 14440
  misc_feature 1..177: note = chr2:106060615-106060792
  misc_feature 1..177: note = hypo
  source 1..177: mol_type = genomic DNA

SEQ ID NO: 39625 - DNA, 30 bp, Homo sapiens
  misc_feature 1..30: note = chr2:106111101-106111131
  misc_feature 1..30: note = hypo
  source 1..30: mol_type = genomic DNA
ctaccaacctcctctcgacagccagccgct

SEQ ID NO: 39626 - DNA, 30 bp, Homo sapiens; identical to SEQ ID NO: 14441
  misc_feature 1..30: note = chr2:106672847-106672877
  misc_feature 1..30: note = hypo
  source 1..30: mol_type = genomic DNA

SEQ ID NO: 39627 - DNA, 201 bp, Homo sapiens
  misc_feature 1..201: note = chr2:106959338-106959539
  misc_feature 1..201: note = hypo
  source 1..201: mol_type = genomic DNA
acactccctgcctctcgaggactctgcttgttcctcatcacagcacggttgctctcgcacccaaggcggtgtccccccagcgcctcaccacgatcgcggcagagatctcctgcagggcgtccgggccttgggaaggcatcgccatctcccgcagcgccctcccggactagcgcagcaggctggcatcgcttcctgaggttt

SEQ ID NO: 39628 - DNA, 127 bp, Homo sapiens; identical to SEQ ID NO: 14443
  misc_feature 1..127: note = chr2:106959916-106960043
  misc_feature 1..127: note = hypo
  source 1..127: mol_type = genomic DNA

SEQ ID NO: 39629 - DNA, 21 bp, Homo sapiens
  misc_feature 1..21: note = chr2:107278930-107278951
  misc_feature 1..21: note = hypo
  source 1..21: mol_type = genomic DNA
ccaccgcgcctggcctatttt

SEQ ID NO: 39630 - DNA, 245 bp, Homo sapiens
  misc_feature 1..245: note = chr2:107460171-107460416
  misc_feature 1..245: note = hypo
  source 1..245: mol_type = genomic DNA
aaccggctgggtgggcgcggggcagcgcctggcgtgcgtccaggcccccaggcggggagggctcatgtgcggcgcccatgatggcccgctgcttcccctgcaccggcaggagcctcctggtctccaggaaggagagggagctgggtacaggctcagcggggttgctgtcggtgaagtagatgaaaatcagcaaaaagaggagcccccaagcgaatattccgaaaagcattcgttgtctccattgc

SEQ ID NO: 39631 - DNA, 24 bp, Homo sapiens
  misc_feature 1..24: note = chr2:108104796-108104820
  misc_feature 1..24: note = hypo
  source 1..24: mol_type = genomic DNA
tttttttttttgagacggagtccc

SEQ ID NO: 39632 - DNA, 47 bp, Homo sapiens
  misc_feature 1..47: note = chr2:108160878-108160925
  misc_feature 1..47: note = hypo
  source 1..47: mol_type = genomic DNA
ggagatggaaggagacgcggtgcactgagaagcggatgtgaaactga

SEQ ID NO: 39633 - DNA, 92 bp, Homo sapiens
  misc_feature 1..92: note = chr2:109335074-109335166
  misc_feature 1..92: note = hypo
  source 1..92: mol_type = genomic DNA
tacaggcgtgaaccacagcgcccggcggaatgcgtggattttggcataagacggtggttctggaaccaatcccccgccgagatgactgttta

SEQ ID NO: 39634 - DNA, 30 bp, Homo sapiens
  misc_feature 1..30: note = chr2:111438469-111438499
  misc_feature 1..30: note = hypo
  source 1..30: mol_type = genomic DNA
tcaagagccacttgacgatacagaataaag

SEQ ID NO: 39635 - DNA, 40 bp, Homo sapiens
  misc_feature 1..40: note = chr2:111898079-111898119
  misc_feature 1..40: note = hypo
  source 1..40: mol_type = genomic DNA
attttctcttaggcacgtgcatctgcgaaggtgtctgagg

SEQ ID NO: 39636 - DNA, 157 bp, Homo sapiens
  misc_feature 1..157: note = chr2:113013160-113013317
  misc_feature 1..157: note = hypo
  source 1..157: mol_type = genomic DNA
agcccagaatttttaaaattagttgttaggattctgctttcaccttggtgaaaactcttccatcaaaatcacagtatttctaagggatggtagtaacagctaacatttatctgagcactccactactattccttagaaatagcgtttcacatgttag

SEQ ID NO: 39637 - DNA, 38 bp, Homo sapiens
  misc_feature 1..38: note = chr2:113103393-113103431
  misc_feature 1..38: note = hypo
  source 1..38: mol_type = genomic DNA
gcatcccgggcagagcgcagctgcgcagcaatcttgct

SEQ ID NO: 39638 - DNA, 30 bp, Homo sapiens
  misc_feature 1..30: note = chr2:114394659-114394689
  misc_feature 1..30: note = hypo
  source 1..30: mol_type = genomic DNA
gtctgtaaatacgcacggccttaccttggc

SEQ ID NO: 39639 - DNA, 16 bp, Homo sapiens
  misc_feature 1..16: note = chr2:114469916-114469932
  misc_feature 1..16: note = hypo
  source 1..16: mol_type = genomic DNA
acggagtctcgctgtc

SEQ ID NO: 39640 - DNA, 265 bp, Homo sapiens
  misc_feature 1..265: note = chr2:114515303-114515568
  misc_feature 1..265: note = hypo
  source 1..265: mol_type = genomic DNA
atcttggtcagatggcgtgaagaaattaaattttcttactcctatagtcgcgatgtagtgtacctcttaccttttaagtctcgtttcagtgaagttgaatgcatattctagcaactaataaaacaataccaatgaacattttttaattgatcgaatcagtttcaaactatcagcatcaaacacctctaataagtcattcagaaacctattgtgcagagtaaaaaaaaaaaccaaccaggccggtcgcggtggctcatgcctgtaa

SEQ ID NO: 39641 - DNA, 24 bp, Homo sapiens
  misc_feature 1..24: note = chr2:114515808-114515832
  misc_feature 1..24: note = hypo
  source 1..24: mol_type = genomic DNA
gcgagactccgtctcaaaataaat

SEQ ID NO: 39642 - DNA, 37 bp, Homo sapiens
  misc_feature 1..37: note = chr2:118628528-118628565
  misc_feature 1..37: note = hypo
  source 1..37: mol_type = genomic DNA
tacaggtatgagccactgtgcgcggcttcctcctcca

SEQ ID NO: 39643 - DNA, 270 bp, Homo sapiens
  misc_feature 1..270: note = chr2:120005499-120005769
  misc_feature 1..270: note = hypo
  source 1..270: mol_type = genomic DNA
gttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacct

SEQ ID NO: 39644 - DNA, 30 bp, Homo sapiens
  misc_feature 1..30: note = chr2:120441329-120441359
  misc_feature 1..30: note = hypo
  source 1..30: mol_type = genomic DNA
gtgtgtatgtgtgtgcgtgtgtgtgcgcgt

SEQ ID NO: 39645 - DNA, 81 bp, Homo sapiens
  misc_feature 1..81: note = chr2:120973474-120973555
  misc_feature 1..81: note = hypo
  source 1..81: mol_type = genomic DNA
ctttcaactctttatcggatgagaaggcgtaggaatcatgtctttctaactggctgatgatatggccgagcagatgctaac

SEQ ID NO: 39646 - DNA, 211 bp, Homo sapiens
  misc_feature 1..211: note = chr2:120973770-120973981
  misc_feature 1..211: note = hypo
  source 1..211: mol_type = genomic DNA
gcccaaccccagtctcggccctgctccactccagcactgtagttgtagcagttttcctactcatccgtttctactctttaatagaaaataacctattcatccaaacctttacattatgtctaggggctattaccaccctacttacagcaatctgcccttcagcgccaggggaatgcccgacagctaccttctcccccgtgaccgccgggct

SEQ ID NO: 39647 - DNA, 424 bp, Homo sapiens
  misc_feature 1..424: note = chr2:120980068-120980492
  misc_feature 1..424: note = hypo
  source 1..424: mol_type = genomic DNA
tgtccagctttagggcgatgaagatgaactgcaggatgttgaccgagcacaggatctccagctccagcgacctatcgtgtcgaaagccccagacgcaggcagccacggacacgggggacacgaagaagagaggcatgaagaccagcagccagaagtgggtgcccctctccaccctgtcgcagaccaggacttcgaacatgagcagcagcaggtggatgcccacagcgatcagcatggctttgaactccacacaggcctctccctcggtgcggtagcgagggttgcgggcccaaacgcccgcgcccacggaggcgcctgcgacgactagaagcttccacagccatatgggggcaaagacggcccagtagctccattggatgatgccgtccaggcggaggggcagcagcaccgagaagagcagcag

SEQ ID NO: 39648 - DNA, 120 bp, Homo sapiens
  misc_feature 1..120: note = chr2:121003516-121003636
  misc_feature 1..120: note = hypo
  source 1..120: mol_type = genomic DNA
cccaccccagagatgcgcattttaatggtttggtggtcttacctcctggtggagcgagggtctggggccttctcaggtatgtccttttaccccccgacaccaccccgcattcctcgagcc

SEQ ID NO: 39649 - DNA, 30 bp, Homo sapiens
  misc_feature 1..30: note = chr2:121639825-121639855
  misc_feature 1..30: note = hypo
  source 1..30: mol_type = genomic DNA
ggaaggcagccagggcgtgaggccttgggt

SEQ ID NO: 39650 - DNA, 24 bp, Homo sapiens
  misc_feature 1..24: note = chr2:122013325-122013349
  misc_feature 1..24: note = hypo
  source 1..24: mol_type = genomic DNA
tttttttttttgagacggaatctc

SEQ ID NO: 39651 - DNA, 47 bp, Homo sapiens
  misc_feature 1..47: note = chr2:122088821-122088868
  misc_feature 1..47: note = hypo
  source 1..47: mol_type = genomic DNA
gctcccccactgaaccggctcaactgcccacccgacaaagtacaatg

SEQ ID NO: 39652 - DNA, 30 bp, Homo sapiens
  misc_feature 1..30: note = chr2:122104569-122104599
  misc_feature 1..30: note = hypo
  source 1..30: mol_type = genomic DNA
cagagcccaggtgtgcgtatcagcccaggt

SEQ ID NO: 39653 - DNA, 272 bp, Homo sapiens
  misc_feature 1..272: note = chr2:122495322-122495594
  misc_feature 1..272: note = hypo
  source 1..272: mol_type = genomic DNA
caccgcgcccggccctaatttggttattctttcactcacttgtgtgtgagctctcctgtgtggccccgtccgtccgcggcccttggagaacttacagcctgagggcagcatggctgctttaagagaccaaagaggcttgtgggggagaggcacactgggtggcgccggagggtcccccttaggaggtggcgttagcaccgaggcctgaaggctaaagagcggggtgtggagaaccgagcgcctgccgtccgctggaccggacaggcctgcac

SEQ ID NO: 39654 - DNA, 30 bp, Homo sapiens
  misc_feature 1..30: note = chr2:122511801-122511831
  misc_feature 1..30: note = hypo
  source 1..30: mol_type = genomic DNA
gacccgactgggcaacgtaatgagaccaaa

SEQ ID NO: 39655 - DNA, 37 bp, Homo sapiens
  misc_feature 1..37: note = chr2:126237007-126237044
  misc_feature 1..37: note = hypo
  source 1..37: mol_type = genomic DNA
cctgactggtggcgccggctggcggctccagggccct

SEQ ID NO: 39656 - DNA, 27 bp, Homo sapiens
  misc_feature 1..27: note = chr2:126347693-126347720
  misc_feature 1..27: note = hypo
  source 1..27: mol_type = genomic DNA
accaacaaaataggccgggtgtagtgg

SEQ ID NO: 39657 - DNA, 21 bp, Homo sapiens
  misc_feature 1..21: note = chr2:126413305-126413326
  misc_feature 1..21: note = hypo
  source 1..21: mol_type = genomic DNA
agcaatggccgggtgcggtgt

SEQ ID NO: 39658 - DNA, 30 bp, Homo sapiens
  misc_feature 1..30: note = chr2:127395350-127395380
  misc_feature 1..30: note = hypo
  source 1..30: mol_type = genomic DNA
ataaatttaacacaacgttggcagcacaca

SEQ ID NO: 39659 - DNA, 30 bp, Homo sapiens
  misc_feature 1..30: note = chr2:127397957-127397987
  misc_feature 1..30: note = hypo
  source 1..30: mol_type = genomic DNA
tatgcattctcaccacgttttcaggtgtct

SEQ ID NO: 39660 - DNA, 81 bp, Homo sapiens
  misc_feature 1..81: note = chr2:127422857-127422938
  misc_feature 1..81: note = hypo
  source 1..81: mol_type = genomic DNA
aacttttatagagtacgttgttacaattgttttacttcattattcattgttgttaatatcttactgtgtctaatttataaa

SEQ ID NO: 39661 - DNA, 21 bp, Homo sapiens
  misc_feature 1..21: note = chr2:127423058-127423079
  misc_feature 1..21: note = hypo
  source 1..21: mol_type = genomic DNA
aaccaccgattcatgggacag

SEQ ID NO: 39662 - DNA, 64 bp, Homo sapiens
  misc_feature 1..64: note = chr2:127423286-127423350
  misc_feature 1..64: note = hypo
  source 1..64: mol_type = genomic DNA
gcacgccctggcaagcgcccactctgccctgctccgcacctagtgaggacgtgtaacacacaca

SEQ ID NO: 39663 - DNA, 30 bp, Homo sapiens
  misc_feature 1..30: note = chr2:127427725-127427755
  misc_feature 1..30: note = hypo
  source 1..30: mol_type = genomic DNA
gtctccttctgagaccgcagctcccactca

SEQ ID NO: 39664 - DNA, 59 bp, Homo sapiens; identical to SEQ ID NO: 4979
  misc_feature 1..59: note = chr2:127428985-127429044
  misc_feature 1..59: note = hypo
  source 1..59: mol_type = genomic DNA

SEQ ID NO: 39665 - DNA, 127 bp, Homo sapiens
  misc_feature 1..127: note = chr2:127433244-127433371
  misc_feature 1..127: note = hypo
  source 1..127: mol_type = genomic DNA
ctgttcgtcactacccgagaaaacgcagacttcttagtctgatcttcaggatccttcattgccctttcctcacccaagcaggtgagtaataaaatttattagtgatattcaccgtagtagtgatggt

SEQ ID NO: 39666 - DNA, 40 bp, Homo sapiens; identical to SEQ ID NO: 14455
  misc_feature 1..40: note = chr2:127435251-127435291
  misc_feature 1..40: note = hypo
  source 1..40: mol_type = genomic DNA

SEQ ID NO: 39667 - DNA, 53 bp, Homo sapiens
  misc_feature 1..53: note = chr2:127438087-127438140
  misc_feature 1..53: note = hypo
  source 1..53: mol_type = genomic DNA
caaactcagggagctcgagaagcaaagtctgtggccagcggccctgtgattcc

SEQ ID NO: 39668 - DNA, 262 bp, Homo sapiens
  misc_feature 1..262: note = chr2:127438633-127438895
  misc_feature 1..262: note = hypo
  source 1..262: mol_type = genomic DNA
actgtaaaaataacacgttttttgtagatgacttggaaaatacagacagccatatgttagaagtaaacaaaaccactcctaacccgtctacttcttaaaagccggtacttaacatttgaagcgtatttcttttcatcgctttgttttaaggtttttgtggaatatttttcatcatttctatttagagggtcccgttttcttcacttaacatcaataccctaagcatttcttcctgttgctaagttcacgtgcaccccttccc

SEQ ID NO: 39669 - DNA, 113 bp, Homo sapiens
  misc_feature 1..113: note = chr2:127453528-127453641
  misc_feature 1..113: note = hypo
  source 1..113: mol_type = genomic DNA
tgctgctgtggccatcgtcctagtctccctcctcttcgtcatgctgcgctacatgtaccggcacaagggcacgtaccacaccaatgaggccaagggcacggagtttgctgaga

SEQ ID NO: 39670 - DNA, 21 bp, Homo sapiens
  misc_feature 1..21: note = chr2:127459661-127459682
  misc_feature 1..21: note = hypo
  source 1..21: mol_type = genomic DNA
ccaccgcgctcagcccaggaa

SEQ ID NO: 39671 - DNA, 81 bp, Homo sapiens
  misc_feature 1..81: note = chr2:127801154-127801235
  misc_feature 1..81: note = hypo
  source 1..81: mol_type = genomic DNA
cattcccctggaacacgaaggagcaaacctgcccggctgcattccgccctcccgctgccctaggcccgctataggctggat

SEQ ID NO: 39672 - DNA, 30 bp, Homo sapiens
  misc_feature 1..30: note = chr2:127809267-127809297
  misc_feature 1..30: note = hypo
  source 1..30: mol_type = genomic DNA
ccagcgcaggtggtgcggtgcagcctgtgc

SEQ ID NO: 39673 - DNA, 169 bp, Homo sapiens
  misc_feature 1..169: note = chr2:128050797-128050966
  misc_feature 1..169: note = hypo
  source 1..169: mol_type = genomic DNA
taaatgctatttattcggcagataaaaggattcactacatggggtagggctggggaaggagtgagagtaaaccgaggggttagagctgttggaagcccaggtccggccgccacacgtgtgcgcaactgctcgctgttgccttgggctgttccaacgtgtgtggatgaaa

SEQ ID NO: 39674 - DNA, 30 bp, Homo sapiens
  misc_feature 1..30: note = chr2:128293422-128293452
  misc_feature 1..30: note = hypo
  source 1..30: mol_type = genomic DNA
gggcgtgtctgccagcggggagtagggggt

SEQ ID NO: 39675 - DNA, 51 bp, Homo sapiens
  misc_feature 1..51: note = chr2:128380871-128380922
  misc_feature 1..51: note = hypo
  source 1..51: mol_type = genomic DNA
aatgtgcatgcacatcgctcacaagcagggcctcagcgaccacctgggctt

SEQ ID NO: 39676 - DNA, 151 bp, Homo sapiens
  misc_feature 1..151: note = chr2:128616477-128616628
  misc_feature 1..151: note = hypo
  source 1..151: mol_type = genomic DNA
aaatgatgctgttttcgacactggagaaaacaaaaggttgtacaataaggtaaataatcatagcttattagtcaacaatatcttagctcattagtcaacaatgtttagatggtcatattgtaaactctgttgatttaataaaaaatgaatt

SEQ ID NO: 39677 - DNA, 120 bp, Homo sapiens
  misc_feature 1..120: note = chr2:128847683-128847803
  misc_feature 1..120: note = hypo
  source 1..120: mol_type = genomic DNA
catcctcagcgtgagccaccgcgcccggcctccatcagtgttccattagtcatctccttcatcctcctctccttcctccccttcatcatgttggctcatgtttatttattaaaattattt

SEQ ID NO: 39678 - DNA, 30 bp, Homo sapiens
  misc_feature 1..30: note = chr2:129128223-129128253
  misc_feature 1..30: note = hypo
  source 1..30: mol_type = genomic DNA
gatggatgaggaaaacgaatctcagggagc

SEQ ID NO: 39679 - DNA, 171 bp, Homo sapiens
  misc_feature 1..171: note = chr2:130497037-130497208
  misc_feature 1..171: note = hypo
  source 1..171: mol_type = genomic DNA
ggccatcccagcccccgcggtatggaggaggttaaccgaaatgtgaaactgggtaacagctcacagttttatagtccctgtaattatttaccaattaaaaagaaccacaactgtttatcatagggctgcgtgcatattaatggccggcaggctattcgtgtgatgcttctg

SEQ ID NO: 39680 - DNA, 178 bp, Homo sapiens
  misc_feature 1..178: note = chr2:130666498-130666676
  misc_feature 1..178: note = hypo
  source 1..178: mol_type = genomic DNA
ctcctctctgctcctcggggagggccagctgcgggcagcactcacacccagagccatctggctctgctgaactcccagctgctctcacatggggtcacccggcctgatacccagccacctccagcccctgcctcacctctgtgagatgaagatggtgaaggcccggtgcccactgagg

SEQ ID NO: 39681 - DNA, 30 bp, Homo sapiens
  misc_feature 1..30: note = chr2:130886777-130886807
  misc_feature 1..30: note = hypo
  source 1..30: mol_type = genomic DNA
ggcaggagaagctcccgctactggttgccc

SEQ ID NO: 39682 - DNA, 135 bp, Homo sapiens
  misc_feature 1..135: note = chr2:130947982-130948117
  misc_feature 1..135: note = hypo
  source 1..135: mol_type = genomic DNA
caggtgctgcagttacggggcacgcccattcctaatcattgtgctttgtgtctcctcagggagaaacaaaggcagcgctgccctcgggggagcattggccctggcggaacgcagcagccgcgaaggatccagcca

SEQ ID NO: 39683 - DNA, 42 bp, Homo sapiens
  misc_feature 1..42: note = chr2:131114462-131114504
  misc_feature 1..42: note = hypo
  source 1..42: mol_type = genomic DNA
tataaagattctaaacgtgggccaggtgcggtggctcacacc

SEQ ID NO: 39684 - DNA, 151 bp, Homo sapiens; identical to SEQ ID NO: 14462
  misc_feature 1..151: note = chr2:131477785-131477936
  misc_feature 1..151: note = hypo
  source 1..151: mol_type = genomic DNA

SEQ ID NO: 39685 - DNA, 61 bp, Homo sapiens
  misc_feature 1..61: note = chr2:131486943-131487004
  misc_feature 1..61: note = hypo
  source 1..61: mol_type = genomic DNA
atcctgcggaaccaacggctgcgacaggagccccactacctgctcccggctaacatcctgc

SEQ ID NO: 39686 - DNA, 261 bp, Homo sapiens; identical to SEQ ID NO: 14463
  misc_feature 1..261: note = chr2:131967115-131967376
  misc_feature 1..261: note = hypo
  source 1..261: mol_type = genomic DNA

SEQ ID NO: 39687 - DNA, 103 bp, Homo sapiens
  misc_feature 1..103: note = chr2:132415272-132415375
  misc_feature 1..103: note = hypo
  source 1..103: mol_type = genomic DNA
ccaggggtaccagggcggggatccacagttgccatagtgaggacctctgaggagtctggttcctgccttgctgcagtccggggagcagcgggcaggggtcctc

SEQ ID NO: 39688 - DNA, 30 bp, Homo sapiens
  misc_feature 1..30: note = chr2:132416768-132416798
  misc_feature 1..30: note = hypo
  source 1..30: mol_type = genomic DNA
gctcctgcacagaggcggtctgtgcctcta

SEQ ID NO: 39689 - DNA, 30 bp, Homo sapiens
  misc_feature 1..30: note = chr2:135832320-135832350
  misc_feature 1..30: note = hypo
  source 1..30: mol_type = genomic DNA
gatttagagaaagtacgtagatgtatttag

SEQ ID NO: 39690 - DNA, 36 bp, Homo sapiens
  misc_feature 1..36: note = chr2:140650928-140650964
  misc_feature 1..36: note = hypo
  source 1..36: mol_type = genomic DNA
gtcttttttttttaatcaacacggtgtatttttatc

SEQ ID NO: 39691 - DNA, 30 bp, Homo sapiens
  misc_feature 1..30: note = chr2:143931491-143931521
  misc_feature 1..30: note = hypo
  source 1..30: mol_type = genomic DNA
cgcttttcaaggggtcgttccgagttttat

SEQ ID NO: 39692 - DNA, 41 bp, Homo sapiens
  misc_feature 1..41: note = chr2:145167740-145167781
  misc_feature 1..41: note = hypo
  source 1..41: mol_type = genomic DNA
gctgggattacaggcgtgagccaccgcgcccagccataaaa

SEQ ID NO: 39693 - DNA, 43 bp, Homo sapiens
  misc_feature 1..43: note = chr2:145174534-145174577
  misc_feature 1..43: note = hypo
  source 1..43: mol_type = genomic DNA
ggctagaaatgatagcgcatttattatgcgctaacgttgcact

SEQ ID NO: 39694 - DNA, 21 bp, Homo sapiens
  misc_feature 1..21: note = chr2:145204291-145204312
  misc_feature 1..21: note = hypo
  source 1..21: mol_type = genomic DNA
taacaattggctggacgcggt

SEQ ID NO: 39695 - DNA, 153 bp, Homo sapiens
  misc_feature 1..153: note = chr2:148776729-148776882
  misc_feature 1..153: note = hypo
  source 1..153: mol_type = genomic DNA
atcggacatgattaccgtacacaatacagaagatactaagggctaagcaatgatgcataaacggggtccactgcccaaacttacagaaagcaaaacgtggaaaattagtaactttaactgatagtgtacacctaaagaacctacaccggccgg

SEQ ID NO: 39696 - DNA, 38 bp, Homo sapiens
  misc_feature 1..38: note = chr2:149514655-149514693
  misc_feature 1..38: note = hypo
  source 1..38: mol_type = genomic DNA
atagttagggctgggcgtggtggctcacgcctgtaatc

SEQ ID NO: 39697 - DNA, 79 bp, Homo sapiens
  misc_feature 1..79: note = chr2:152266023-152266102
  misc_feature 1..79: note = hypo
  source 1..79: mol_type = genomic DNA
gtgcttggattacaaggtgtgagtcaccgcgcccggccagctcttagtcttaaacccaacagtacgttatctccttttg

SEQ ID NO: 39698 - DNA, 30 bp, Homo sapiens
  misc_feature 1..30: note = chr2:162087925-162087955
  misc_feature 1..30: note = hypo
  source 1..30: mol_type = genomic DNA
ctctggatagagctgcgtgtttgccacctg

SEQ ID NO: 39699 - DNA, 40 bp, Homo sapiens
  misc_feature 1..40: note = chr2:162166372-162166412
  misc_feature 1..40: note = hypo
  source 1..40: mol_type = genomic DNA
cattttaatttaggccgggtgcggtggctcacacctgtaa

SEQ ID NO: 39700 - DNA, 105 bp, Homo sapiens
  misc_feature 1..105: note = chr2:170282975-170283080
  misc_feature 1..105: note = hypo
  source 1..105: mol_type = genomic DNA
tggcccagagccaggcgggagcgtcagtaccgcgcactgttaacagcggcccgacaaacccagcaaatgcagaattggccaggggatccccgaaagaaccaatcc

SEQ ID NO: 39701 - DNA, 164 bp, Homo sapiens
  misc_feature 1..164: note = chr2:170551729-170551893
  misc_feature 1..164: note = hypo
  source 1..164: mol_type = genomic DNA
ctatcagatgttccacgtaataatgctggtaagtatggaataattaagaaaatatttgaagacagaaattagtttgtgcacatacagcgctggtaggtttttggaactataccttaaaaagtgtcaagaactgggggccaggcgcggtggctcacgcctgtaat

SEQ ID NO: 39702 - DNA, 30 bp, Homo sapiens
  misc_feature 1..30: note = chr2:170584782-170584812
  misc_feature 1..30: note = hypo
  source 1..30: mol_type = genomic DNA
aactctcttactattcgttaaaatgtatag

SEQ ID NO: 39703 - DNA, 23 bp, Homo sapiens
  misc_feature 1..23: note = chr2:170681880-170681903
  misc_feature 1..23: note = hypo
  source 1..23: mol_type = genomic DNA
agtggagaggcagggcgcggcgg

SEQ ID NO: 39704 - DNA, 240 bp, Homo sapiens
  misc_feature 1..240: note = chr2:170682143-170682383
  misc_feature 1..240: note = hypo
  source 1..240: mol_type = genomic DNA
ctgggagacagagcgagactccgtctcaaaaaaaaaaagacagtggaaatgaaaataaaagaataggtagtggtgtcaaatactggaaagaggtcgggcttcataaagtaggagcagaaattaagttgtagcagattgtggagcgaatggaaatttaggaagaagaaagagtaaatgtgaacaattaaacgtggccccggaagcggtggctcacccctgtgatcccaacattttgggagg

SEQ ID NO: 39705 - DNA, 29 bp, Homo sapiens
  misc_feature 1..29: note = chr2:171624032-171624061
  misc_feature 1..29: note = hypo
  source 1..29: mol_type = genomic DNA
tgagccaccgcgtccggccctcaacaaat

SEQ ID NO: 39706 - DNA, 23 bp, Homo sapiens
  misc_feature 1..23: note = chr2:171769313-171769336
  misc_feature 1..23: note = hypo
  source 1..23: mol_type = genomic DNA
catctaatcgctttggtaacttc

SEQ ID NO: 39707 - DNA, 21 bp, Homo sapiens
  misc_feature 1..21: note = chr2:172129423-172129444
  misc_feature 1..21: note = hypo
  source 1..21: mol_type = genomic DNA
ccaccgcgcctagatggggca

SEQ ID NO: 39708 - DNA, 74 bp, Homo sapiens; identical to SEQ ID NO: 14471
  misc_feature 1..74: note = chr2:172367021-172367095
  misc_feature 1..74: note = hypo
  source 1..74: mol_type = genomic DNA

SEQ ID NO: 39709 - DNA, 41 bp, Homo sapiens
  misc_feature 1..41: note = chr2:172411125-172411166
  misc_feature 1..41: note = hypo
  source 1..41: mol_type = genomic DNA
ggatagtcaccagaccgcaatggaaacgtcctaaggagcca

SEQ ID NO: 39710 - DNA, 20 bp, Homo sapiens
  misc_feature 1..20: note = chr2:173036684-173036704
  misc_feature 1..20: note = hypo
  source 1..20: mol_type = genomic DNA
caccgcgcccagcccaataa

SEQ ID NO: 39711 - DNA, 30 bp, Homo sapiens
  misc_feature 1..30: note = chr2:173291566-173291596
  misc_feature 1..30: note = hypo
  source 1..30: mol_type = genomic DNA
ctagttctgaaagtccggggctaggaaaga

SEQ ID NO: 39712 - DNA, 49 bp, Homo sapiens
  misc_feature 1..49: note = chr2:173422685-173422734
  misc_feature 1..49: note = hypo
  source 1..49: mol_type = genomic DNA
caagcctagaactaccggcaagcaccaccacgcccggctattttttatt

SEQ ID NO: 39713 - DNA, 21 bp, Homo sapiens
  misc_feature 1..21: note = chr2:176030420-176030441
  misc_feature 1..21: note = hypo
  source 1..21: mol_type = genomic DNA
ggagtctcgctgtgtcgccca

SEQ ID NO: 39714 - DNA, 79 bp, Homo sapiens
  misc_feature 1..79: note = chr2:176430829-176430908
  misc_feature 1..79: note = hypo
  source 1..79: mol_type = genomic DNA
cagctcccaacctgccgcactgagtgtgcatcatacagctgtcagcagagccagggcaccacagcgatgagtgcttgtg

SEQ ID NO: 39715 - DNA, 20 bp, Homo sapiens
  misc_feature 1..20: note = chr2:176569563-176569583
  misc_feature 1..20: note = hypo
  source 1..20: mol_type = genomic DNA
tagaccggagctgttcctat

SEQ ID NO: 39716 - DNA, 97 bp, Homo sapiens
  misc_feature 1..97: note = chr2:177498024-177498121
  misc_feature 1..97: note = hypo
  source 1..97: mol_type = genomic DNA
gagcactagttactccggttctaaaaagctatgaattttgatatatagcctacgttatgaaagcttacctctttatggcttcaaccaggtgagtgta

SEQ ID NO: 39717 - DNA, 32 bp, Homo sapiens
  misc_feature 1..32: note = chr2:178089350-178089382
  misc_feature 1..32: note = hypo
  source 1..32: mol_type = genomic DNA
aatcttaaagaatggcgtgtctaggctgggtg

SEQ ID NO: 39718 - DNA, 30 bp, Homo sapiens
  misc_feature 1..30: note = chr2:178131780-178131810
  misc_feature 1..30: note = hypo
  source 1..30: mol_type = genomic DNA
ctgtctttgggaagacggccttccctacat

SEQ ID NO: 39719 - DNA, 186 bp, Homo sapiens
  misc_feature 1..186: note = chr2:178972992-178973178
  misc_feature 1..186: note = hypo
  source 1..186: mol_type = genomic DNA
cctggccagagtccacgcctcaacttcgaggctggcgatccagaaagagcacctcacgccctgggctgcaagcgcagccggacgcgcgcgaccagtgatcgccagccaatggcaagccgggacccggtcccactgctgattggcccccagatcccgtgggatctcacctctcgcagaggcttaaag

SEQ ID NO: 39720 - DNA, 38 bp, Homo sapiens; identical to SEQ ID NO: 4985
  misc_feature 1..38: note = chr2:179317019-179317057
  misc_feature 1..38: note = hypo
  source 1..38: mol_type = genomic DNA

SEQ ID NO: 39721 - DNA, 30 bp, Homo sapiens
  misc_feature 1..30: note = chr2:179672126-179672156
  misc_feature 1..30: note = hypo
  source 1..30: mol_type = genomic DNA
gaggctgggaatgcacgactgctcaagagc

SEQ ID NO: 39722 - DNA, 138 bp, Homo sapiens
  misc_feature 1..138: note = chr2:180886772-180886910
  misc_feature 1..138: note = hypo
  source 1..138: mol_type = genomic DNA
ccacgcgaggtggttcgtaatatccagtgggggagagggtgatatcacacccacatcgcggggggtgggagggcatgtacacaggatattatgttggttgaggttactgactctgaggcaaggcggccagaatatgta

SEQ ID NO: 39723 - DNA, 148 bp, Homo sapiens
  misc_feature 1..148: note = chr2:182422221-182422369
  misc_feature 1..148: note = hypo
  source 1..148: mol_type = genomic DNA
ggatgagtgattgtgtaatacaatcagcttttgaatgatgtttccctcttttctggatcacagtgttgctctaacggttctccgtgtctctgacctctactttctcctgctcccaacctctaatcattccacacggtgaggcaaaatg

SEQ ID NO: 39724 - DNA, 128 bp, Homo sapiens
  misc_feature 1..128: note = chr2:184406833-184406961
  misc_feature 1..128: note = hypo
  source 1..128: mol_type = genomic DNA
taaatatcctttatacgctccatctttctgtatgattaacagtttatggttttataatcaactatgctaagttctagaagcagttataaaattttagatgaatgaaatagttgcgtcacacacagatt

SEQ ID NO: 39725 - DNA, 141 bp, Homo sapiens
  misc_feature 1..141: note = chr2:188235961-188236102
  misc_feature 1..141: note = hypo
  source 1..141: mol_type = genomic DNA
ccgtctaaaaaaaaaaaaaagttaaataaataatatctaatgtaaagcctgggatacagaccgcagaataggctatatctcaggaccatagtgtataacaaatttacaatgaataaatggacgtaccgtgagttaagagag

SEQ ID NO: 39726 - DNA, 16 bp, Homo sapiens
  misc_feature 1..16: note = chr2:196302359-196302375
  misc_feature 1..16: note = hypo
  source 1..16: mol_type = genomic DNA
ccgcaggtcacttcag

SEQ ID NO: 39727 - DNA, 30 bp, Homo sapiens
  misc_feature 1..30: note = chr2:196319761-196319791
  misc_feature 1..30: note = hypo
  source 1..30: mol_type = genomic DNA
atctttaaatcatctcgagttaattttcgt

SEQ ID NO: 39728 - DNA, 30 bp, Homo sapiens
  misc_feature 1..30: note = chr2:197503336-197503366
  misc_feature 1..30: note = hypo
  source 1..30: mol_type = genomic DNA
aatgagctctcatctcggatctgattgctt

SEQ ID NO: 39729 - DNA, 102 bp, Homo sapiens
  misc_feature 1..102: note = chr2:200524640-200524742
  misc_feature 1..102: note = hypo
  source 1..102: mol_type = genomic DNA
tatgctgatgctcctcggagtcagtaataaaatgactgacagggaaagggataaagtgatgcctcagattatccaaggttttaaagacgcagctgaagacgc

SEQ ID NO: 39730 - DNA, 30 bp, Homo sapiens; identical to SEQ ID NO: 14479
  misc_feature 1..30: note = chr2:203129332-203129362
  misc_feature 1..30: note = hypo
  source 1..30: mol_type = genomic DNA

SEQ ID NO: 39731 - DNA, 23 bp, Homo sapiens
  misc_feature 1..23: note = chr2:203484340-203484363
  misc_feature 1..23: note = hypo
  source 1..23: mol_type = genomic DNA
tgccatatcgggtgcaccagtta

SEQ ID NO: 39732 - DNA, 106 bp, Homo sapiens
  misc_feature 1..106: note = chr2:206757186-206757292
  misc_feature 1..106: note = hypo
  source 1..106: mol_type = genomic DNA
aacatggggtctgcacgcccaagagcattgtcccttggttaccatggtaacccaagcgcatccaccaagcactttactccaaaggaaatagcgagcttgggctatg

SEQ ID NO: 39733 - DNA, 30 bp, Homo sapiens
  misc_feature 1..30: note = chr2:206859091-206859121
  misc_feature 1..30: note = hypo
  source 1..30: mol_type = genomic DNA
gctagtccttgctaccgtgcagtttctttg

SEQ ID NO: 39734 - DNA, 18 bp, Homo sapiens
  misc_feature 1..18: note = chr2:207022702-207022720
  misc_feature 1..18: note = hypo
  source 1..18: mol_type = genomic DNA
tttgagacagagtctcgc

SEQ ID NO: 39735 - DNA, 107 bp, Homo sapiens
  misc_feature 1..107: note = chr2:207557814-207557921
  misc_feature 1..107: note = hypo
  source 1..107: mol_type = genomic DNA
agaaagattgctggccggttaccataacacccagggcccttggtggctgctctgtgggatcagccaatcctcgcagccactcacctggcctgcgcatggtgaggcac

SEQ ID NO: 39736 - DNA, 30 bp, Homo sapiens
  misc_feature 1..30: note = chr2:208140368-208140398
  misc_feature 1..30: note = hypo
  source 1..30: mol_type = genomic DNA
agtagagtggtccagcgtagctccttcaaa

SEQ ID NO: 39737 - DNA, 180 bp, Homo sapiens
  misc_feature 1..180: note = chr2:208574959-208575139
  misc_feature 1..180: note = hypo
  source 1..180: mol_type = genomic DNA
gaaattgggacgcagaagttaagttacttccgcaagcttacatgactgctcagggtgagggtccctgatcatgatgatcagaaaataaaggtagaaatcaagcttagggaggaagtgacattgtgtgtatatatatatatttgtttatttatttttatttttatgttttatttttttgaa

SEQ ID NO: 39738 - DNA, 31 bp, Homo sapiens
  misc_feature 1..31: note = chr2:209094651-209094682
  misc_feature 1..31: note = hypo
  source 1..31: mol_type = genomic DNA
gatgcaggctgggggcggtggctcacgcctg

SEQ ID NO: 39739 - DNA, 30 bp, Homo sapiens
  misc_feature 1..30: note = chr2:209225350-209225380
  misc_feature 1..30: note = hypo
  source 1..30: mol_type = genomic DNA
gggtaaaacagcacccggaagcagtcgtcg

SEQ ID NO: 39740 - DNA, 175 bp, Homo sapiens
  misc_feature 1..175: note = chr2:214080302-214080477
  misc_feature 1..175: note = hypo
  source 1..175: mol_type = genomic DNA
aataaataaatgatgcgtgtttgttgacctatgtgtgtttgttgacctatgaaggtaccgttgaaaaataatcctacgtcttatactaggttcttcgatgctactcattttattcatgtttgttttgaagctttaaagaactgtcaggttctctttaaatcgcactgcatcaatg

SEQ ID NO: 39741 - DNA, 48 bp, Homo sapiens
  misc_feature 1..48: note = chr2:217675074-217675122
  misc_feature 1..48: note = hypo
  source 1..48: mol_type = genomic DNA
tggctgtgggggagacgggcgggaggcccagaccggcagggagctttc

SEQ ID NO: 39742 - DNA, 30 bp, Homo sapiens
  misc_feature 1..30: note = chr2:219250043-219250073
  misc_feature 1..30: note = hypo
  source 1..30: mol_type = genomic DNA
cattttcagcttccacgatcaaataaatac

SEQ ID NO: 39743 - DNA, 30 bp, Homo sapiens
  misc_feature 1..30: note = chr2:219251809-219251839
  misc_feature 1..30: note = hypo
  source 1..30: mol_type = genomic DNA
ccagccctgaggctccgtaggagttagaga

SEQ ID NO: 39744 - DNA, 185 bp, Homo sapiens
  misc_feature 1..185: note = chr2:219284495-219284680
  misc_feature 1..185: note = hypo
  source 1..185: mol_type = genomic DNA
catctcccctctacccggagctgccccattggcctccccagccactgtgggcccattcagcagaactaggaatgggagctagctgcagaccaggctctgaggacacactggctgctgtcttctcgggacatcatctgctggggcagagcctttgggctggagggtcttggcgggtgtccattccc

SEQ ID NO: 39745 - DNA, 189 bp, Homo sapiens
  misc_feature 1..189: note = chr2:219431996-219432185
  misc_feature 1..189: note = hypo
  source 1..189: mol_type = genomic DNA
tcatggcttgcaagacgcatcctcctctattggttattaaacagcaggaattcgtcaatgctccatcctaggtgcctttattttacagcactatactctttttcggcaatttcatccacatccatggcttcaattactatcaatatggcagatgacaaacacatacacacaccgcgcacatttacgtac

SEQ ID NO: 39746 - DNA, 30 bp, Homo sapiens
  misc_feature 1..30: note = chr2:219611841-219611871
  misc_feature 1..30: note = hypo
  source 1..30: mol_type = genomic DNA
tatcctgccccaggacgccaagctcctgcg

SEQ ID NO: 39747 - DNA, 30 bp, Homo sapiens
  misc_feature 1..30: note = chr2:219773320-219773350
  misc_feature 1..30: note = hypo
  source 1..30: mol_type = genomic DNA
cagccagactgacttcgagtttcggccgca

SEQ ID NO: 39748 - DNA, 33 bp, Homo sapiens
  misc_feature 1..33: note = chr2:220080826-220080859
  misc_feature 1..33: note = hypo
  source 1..33: mol_type = genomic DNA
atgagcagctccacccgccgagacgtgaactgc

SEQ ID NO: 39749 - DNA, 30 bp, Homo sapiens; identical to SEQ ID NO: 14482
  misc_feature 1..30: note = chr2:220316287-220316317
  misc_feature 1..30: note = hypo
  source 1..30: mol_type = genomic DNA

SEQ ID NO: 39750 - DNA, 42 bp, Homo sapiens
  misc_feature 1..42: note = chr2:220384416-220384458
  misc_feature 1..42: note = hypo
  source 1..42: mol_type = genomic DNA
gtggctataggctgccgtgttggacagcgcagctctggatgg

SEQ ID NO: 39751 - DNA, 39 bp, Homo sapiens
  misc_feature 1..39: note = chr2:221861787-221861826
  misc_feature 1..39: note = hypo
  source 1..39: mol_type = genomic DNA
ctgtgtgaaatctagcgtttcctgcatttaattgttcat

SEQ ID NO: 39752 - DNA, 119 bp, Homo sapiens
  misc_feature 1..119: note = chr2:223753484-223753603
  misc_feature 1..119: note = hypo
  source 1..119: mol_type = genomic DNA
cagacgctttgtttgcgacgctttgtttgcgtatccaagattgccatcttttaatgaagtagatgtgatggaaaaaggaatatactttgtccactttaatagtacgcctcactttgttt

SEQ ID NO: 39753 - DNA, 30 bp, Homo sapiens; identical to SEQ ID NO: 14483
  misc_feature 1..30: note = chr2:223764711-223764741
  misc_feature 1..30: note = hypo
  source 1..30: mol_type = genomic DNA

SEQ ID NO: 39754 - DNA, 75 bp, Homo sapiens
  misc_feature 1..75: note = chr2:225394300-225394375
  misc_feature 1..75: note = hypo
  source 1..75: mol_type = genomic DNA
gtgccactgtactccgagactccctctcaaaaagaaaaaaaaaagaatgaatcaaattaacgtatgtaagtaaag

SEQ ID NO: 39755 - DNA, 24 bp, Homo sapiens
  misc_feature 1..24: note = chr2:226298377-226298401
  misc_feature 1..24: note = hypo
  source 1..24: mol_type = genomic DNA
aaaaaattagttgggcgtgatggc

SEQ ID NO: 39756 - DNA, 32 bp, Homo sapiens
  misc_feature 1..32: note = chr2:228264610-228264642
  misc_feature 1..32: note = hypo
  source 1..32: mol_type = genomic DNA
cctataaatagccaccgcgcctggcctataaa

SEQ ID NO: 39757 - DNA, 28 bp, Homo sapiens
  misc_feature 1..28: note = chr2:228466749-228466777
  misc_feature 1..28: note = hypo
  source 1..28: mol_type = genomic DNA
aaaacctgtttgacgttggactaggaac

SEQ ID NO: 39758 - DNA, 30 bp, Homo sapiens
  misc_feature 1..30: note = chr2:228735796-228735826
  misc_feature 1..30: note = hypo
  source 1..30: mol_type = genomic DNA
cctgccttccattcccgcctatccatttag

SEQ ID NO: 39759 - DNA, 215 bp, Homo sapiens
  misc_feature 1..215: note = chr2:228888319-228888534
  misc_feature 1..215: note = hypo
  source 1..215: mol_type = genomic DNA
ttacccagtattttccgagtgcctattgcatgcaaattatgcaaggaggtgcattttccgagtgcctattgtatgcaaattatgcaaggaggtgcaaaaatgaatcagacaattgctctggggagaagggcacactatactatcagtgagtcaacctcagcagagtccaagtgattcacacggagttgattcacttccagcgccaggggtgatca

SEQ ID NO: 39760 - DNA, 100 bp, Homo sapiens
  misc_feature 1..100: note = chr2:230795535-230795635
  misc_feature 1..100: note = hypo
  source 1..100: mol_type = genomic DNA
tgctggagccctcctcgaggtgtgctgtggttttccctcctgctgtcatttaccccctcactgctcctcctgatggcagcaagtgcgcaaacattccctt

SEQ ID NO: 39761 - DNA, 37 bp, Homo sapiens
  misc_feature 1..37: note = chr2:231170274-231170311
  misc_feature 1..37: note = hypo
  source 1..37: mol_type = genomic DNA
ctaggcccagctgcccgtagggcgtggtcaggcaggg

SEQ ID NO: 39762 - DNA, 99 bp, Homo sapiens
  misc_feature 1..99: note = chr2:232243072-232243171
  misc_feature 1..99: note = hypo
  source 1..99: mol_type = genomic DNA
catttctgtgatcaccgagggcttcttccagttgtcctgggtgtcacttggacaccttcctgcttggcacagtgttgctgctcacgctctcgctgtccc

SEQ ID NO: 39763 - DNA, 30 bp, Homo sapiens
  misc_feature 1..30: note = chr2:232283743-232283773
  misc_feature 1..30: note = hypo
  source 1..30: mol_type = genomic DNA
gtgtgctccctttcacgagggtcggaatgc

SEQ ID NO: 39764 - DNA, 40 bp, Homo sapiens
  misc_feature 1..40: note = chr2:232330287-232330327
  misc_feature 1..40: note = hypo
  source 1..40: mol_type = genomic DNA
aaaatcacctcaggccgggcgcggtggctcagatccgcaa

SEQ ID NO: 39765 - DNA, 39 bp, Homo sapiens
  misc_feature 1..39: note = chr2:232485651-232485690
  misc_feature 1..39: note = hypo
  source 1..39: mol_type = genomic DNA
cgttgttcctcatagcggcatctccgcagtatggatgga

SEQ ID NO: 39766 - DNA, 16 bp, Homo sapiens
  misc_feature 1..16: note = chr2:232526123-232526139
  misc_feature 1..16: note = hypo
  source 1..16: mol_type = genomic DNA
tttctactggccgggc

SEQ ID NO: 39767 - DNA, 30 bp, Homo sapiens
  misc_feature 1..30: note = chr2:232541215-232541245
  misc_feature 1..30: note = hypo
  source 1..30: mol_type = genomic DNA
agagacacagacacacgcacacacaataca

SEQ ID NO: 39768 - DNA, 27 bp, Homo sapiens
  misc_feature 1..27: note = chr2:232546676-232546703
  misc_feature 1..27: note = hypo
  source 1..27: mol_type = genomic DNA
attaaaagagctggccgggcgcggtga

SEQ ID NO: 39769 - DNA, 25 bp, Homo sapiens
  misc_feature 1..25: note = chr2:232570350-232570375
  misc_feature 1..25: note = hypo
  source 1..25: mol_type = genomic DNA
cctgcatgggaataacgtcagaaaa

SEQ ID NO: 39770 - DNA, 46 bp, Homo sapiens
  misc_feature 1..46: note = chr2:233322968-233323014
  misc_feature 1..46: note = hypo
  source 1..46: mol_type = genomic DNA
aggcactcactgaggcggtcatgttcgacgacgccattgagagggc

SEQ ID NO: 39771 - DNA, 30 bp, Homo sapiens
  misc_feature 1..30: note = chr2:233474440-233474470
  misc_feature 1..30: note = hypo
  source 1..30: mol_type = genomic DNA
tcacccaagatgagacggaaacagtcccga

SEQ ID NO: 39772 - DNA, 50 bp, Homo sapiens
  misc_feature 1..50: note = chr2:233750505-233750555
  misc_feature 1..50: note = hypo
  source 1..50: mol_type = genomic DNA
gtgacacatggggcccggcacagggccaggctcgccgcaggctctcaggg

SEQ ID NO: 39773 - DNA, 30 bp, Homo sapiens; identical to SEQ ID NO: 14487
  misc_feature 1..30: note = chr2:233960620-233960650
  misc_feature 1..30: note = hypo
  source 1..30: mol_type = genomic DNA

SEQ ID NO: 39774 - DNA, 55 bp, Homo sapiens
  misc_feature 1..55: note = chr2:233986907-233986962
  misc_feature 1..55: note = hypo
  source 1..55: mol_type = genomic DNA
tgcaataccctgtgccgctggaggaagaggacacaggcgacgaccctgaggagga

SEQ ID NO: 39775 - DNA, 116 bp, Homo sapiens
  misc_feature 1..116: note = chr2:233991021-233991137
  misc_feature 1..116: note = hypo
  source 1..116: mol_type = genomic DNA
tgacagggctgaagccgcatttccaacttgaaggatccatctgaggctgccagggctgccctcctcctactctctcacttggcaaaatatgaagtagatgccgatgggacacatac

SEQ ID NO: 39776 - DNA, 30 bp, Homo sapiens
  misc_feature 1..30: note = chr2:233997245-233997275
  misc_feature 1..30: note = hypo
  source 1..30: mol_type = genomic DNA
ctttcatcagtaaggcgacagccaggcttg

SEQ ID NO: 39777 - DNA, 111 bp, Homo sapiens
  misc_feature 1..111: note = chr2:234079674-234079785
  misc_feature 1..111: note = hypo
  source 1..111: mol_type = genomic DNA
gaatcagaattaaaacgaaagtctctctgtttcagaggaggaagaaatcacgtttgccccaacctaccgttttgagagactgactcgggacaaatacgcctacaccaagca

SEQ ID NO: 39778 - DNA, 176 bp, Homo sapiens
  misc_feature 1..176: note = chr2:234109964-234110140
  misc_feature 1..176: note = hypo
  source 1..176: mol_type = genomic DNA
tttcagctcccaaagcgaatggatcttggtgcataacaacgagcacacagcttggtgggagcatgctccccacagccccatggtgacagctgcagacaggctgccatccacgggcaaggggcccccagggtacgcttctaactcactgctcaccaaggaggcgcttggagcctgga

SEQ ID NO: 39779 - DNA, 30 bp, Homo sapiens
  misc_feature 1..30: note = chr2:234330364-234330394
  misc_feature 1..30: note = hypo
  source 1..30: mol_type = genomic DNA
tcttttctggtctcccgtttttccataggg

SEQ ID NO: 39780 - DNA, 43 bp, Homo sapiens
  misc_feature 1..43: note = chr2:234331271-234331314
  misc_feature 1..43: note = hypo
  source 1..43: mol_type = genomic DNA
tacacttttaacttgcgctgcccacatacgcccttgtccttaa

SEQ ID NO: 39781 - DNA, 380 bp, Homo sapiens
  misc_feature 1..380: note = chr2:234369732-234370112
  misc_feature 1..380: note = hypo
  source 1..380: mol_type = genomic DNA
agccactgtgtccctcgtggctggtggtcagcattgtctgccattcctgctcctcgcccgccaggtgcgggttccgcctgtgagtccctcccagccggcagctgtgctgctccgccggtgcggggcctgcctgcattctccccccgtggccgcacgctggctggtgccctggtgtccctttcttgtttcccctgggctccttcttctcctggctgtggacaggtgcacccgtcggttttgtgcccggcatgccgtgtgcccttccaggcagcctgcccagccctggcgtgcagatggatcgtctgtgccagccttcggctcttgtcgagcaggtggtcgctgtcccagtcatcaccggcgttcctcgctctgcacttcca

SEQ ID NO: 39782 - DNA, 30 bp, Homo sapiens
  misc_feature 1..30: note = chr2:235382081-235382111
  misc_feature 1..30: note = hypo
  source 1..30: mol_type = genomic DNA
ccagctggtactcaccgggaccaccatgct

SEQ ID NO: 39783 - DNA, 92 bp, Homo sapiens
  misc_feature 1..92: note = chr2:236452425-236452517
  misc_feature 1..92: note = hypo
  source 1..92: mol_type = genomic DNA
gtggtagtgtcagggcggtagccatctgagctcacactggccctaggggctgtactttggggtatccaggggcaacacgtgccctctaaaag

SEQ ID NO: 39784 - DNA, 30 bp, Homo sapiens
  misc_feature 1..30: note = chr2:236877238-236877268
  misc_feature 1..30: note = hypo
  source 1..30: mol_type = genomic DNA
agccgacggcctgtccggcactgctgaagg

SEQ ID NO: 39785 - DNA, 110 bp, Homo sapiens
  misc_feature 1..110: note = chr2:238475095-238475205
  misc_feature 1..110: note = hypo
  source 1..110: mol_type = genomic DNA
ccagctccgtgcacacgcaccctgatgcctgtgtgacgctgctcctgccccttctcccccaggccgtgtcctcctcatttggatctcccctccagcggggcctcctcgga

SEQ ID NO: 39786 - DNA, 360 bp, Homo sapiens
  misc_feature 1..360: note = chr2:239050963-239051323
  misc_feature 1..360: note = hypo
  source 1..360: mol_type = genomic DNA
cttcagagccttgcccgtggacggtcaccttgtattctaattcctggcagtgggagatctgggggttccatatggggggccagggtggatggctgtgggagagcctggggtcctgggagacctaggcagtgactgcttaccggccgttcctaagacagccagcatttcccactgagccgggacaccctcgtgccgcctgctggaggccacccagggagcaggggcagggagaagcttatgcgtggcgctgcggacctgctatgggatcggttctgaagatggttcaggaactccaggaatgcccctgaaaggcacatggtgcaaggagggagcagcttgtgcactcgggcacacgccatc

SEQ ID NO: 39787 - DNA, 30 bp, Homo sapiens
  misc_feature 1..30: note = chr2:239083135-239083165
  misc_feature 1..30: note = hypo
  source 1..30: mol_type = genomic DNA
cgtttaagatcaccacggggctcccaaatc

SEQ ID NO: 39788 - DNA, 30 bp, Homo sapiens
  misc_feature 1..30: note = chr2:239134032-239134062
  misc_feature 1..30: note = hypo
  source 1..30: mol_type = genomic DNA
tggcccatgtggatacgtgcaagagcacca

SEQ ID NO: 39789 - DNA, 42 bp, Homo sapiens
  misc_feature 1..42: note = chr2:239147417-239147459
  misc_feature 1..42: note = hypo
  source 1..42: mol_type = genomic DNA
agatccagggagggccgggcccacccccgcaggactctggct

SEQ ID NO: 39790 - DNA, 30 bp, Homo sapiens
  misc_feature 1..30: note = chr2:239183260-239183290
  misc_feature 1..30: note = hypo
  source 1..30: mol_type = genomic DNA
cccaactgatcagaacgaactttccctttg

SEQ ID NO: 39791 - DNA, 89 bp, Homo sapiens
  misc_feature 1..89: note = chr2:239265698-239265787
  misc_feature 1..89: note = hypo
  source 1..89: mol_type = genomic DNA
gtgagccaccgcgcctggccgggaatgtttttaagtcttttttttaaatacatgttctattgtacctggttccccgcagtctccctcac

SEQ ID NO: 39792 - DNA, 184 bp, Homo sapiens
  misc_feature 1..184: note = chr2:239322426-239322610
  misc_feature 1..184: note = hypo
  source 1..184: mol_type = genomic DNA
tcacatggttgggcacggtgttgtatctatatatgcccattctgtcgagcttgtaaccattttgttcaaatcgatatgctaatagatgttttttctattggattcaccatttaatgagagaggtgttttaaagtttcccgagtactacgatgaacaatttatttctcctcgtagttttttctgg

SEQ ID NO: 39793 - DNA, 247 bp, Homo sapiens
  misc_feature 1..247: note = chr2:239957267-239957514
  misc_feature 1..247: note = hypo
  source 1..247: mol_type = genomic DNA
ctagcctagcagccccgctctcctgcgggctcccccgtgggccaagtctcctaaactgggccagcctggagtcaggtgcgtgcagccctgccactctacctccttgcagcgaggcctggagggcgttccacgcgtgggcaccgcggccttcggaggcctccagagtcggcctcagtgggcgcgtcctccctcctgctggaggggactggacaccgttaatgacagcgaaaatcgcctggagttgatg

SEQ ID NO: 39794 - DNA, 127 bp, Homo sapiens
  misc_feature 1..127: note = chr2:239997460-239997587
  misc_feature 1..127: note = hypo
  source 1..127: mol_type = genomic DNA
cctgcagcctgaagacgacatctcccctcagcttcccagggaatagagctgggctgggacagcagacaggtgccagccactccccttggtttcccgggaaacaaagctgggccgggatagcaggtgg

SEQ ID NO: 39795 - DNA, 57 bp, Homo sapiens
  misc_feature 1..57: note = chr2:240080496-240080553
  misc_feature 1..57: note = hypo
  source 1..57: mol_type = genomic DNA
ggtcccaggccagaccgcacacgcgtgccctccgcgaagaagcgtccagcagggcga

SEQ ID NO: 39796 - DNA, 134 bp, Homo sapiens
  misc_feature 1..134: note = chr2:240103588-240103722
  misc_feature 1..134: note = hypo
  source 1..134: mol_type = genomic DNA
gatgtcgcctagagacgccgacttcctgcagacactaaatatcctaaggtaaaatcaggccccctcaaggctagggagatactacctggagcacaccttcctaacgcggtgttccttgccgccacatgcaagca

SEQ ID NO: 39797 - DNA, 121 bp, Homo sapiens
  misc_feature 1..121: note = chr2:240103944-240104065
  misc_feature 1..121: note = hypo
  source 1..121: mol_type = genomic DNA
atctcctcgtcatggcgagcccctcccctctggctgtcacctgcacagggccccttggctccctccctcccgctgctcagagctcactcagggcggaaacgcagagcggacagatgcagcc

SEQ ID NO: 39798 - DNA, 323 bp, Homo sapiens
  misc_feature 1..323: note = chr2:240168786-240169109
  misc_feature 1..323: note = hypo
  source 1..323: mol_type = genomic DNA
aggtgatgcagctatcggcaatggctggagactagctctgcggtctgctcgtggataaccgcgctccctcgctgccgggccacccgcacagccgggcaaaccaaaaggcccactttttcatgctgtacccaccacttctgtttccccgcaggcatcctactttctaaactaacaccttttcactcccgagaattctaacaaatattatacaattcctacccgcatctaccctccacctggacgtagaacccgtgtgggaggcagtcctgcagggtttggggtggaatatcccccctgtcgagtggagacgaggctgacatgag

SEQ ID NO: 39799 - DNA, 50 bp, Homo sapiens
  misc_feature 1..50: note = chr2:240213736-240213786
  misc_feature 1..50: note = hypo
  source 1..50: mol_type = genomic DNA
cagcccagctcagggcggccacaccaggggctgcgcgcacagcccagctc

SEQ ID NO: 39800 - DNA, 58 bp, Homo sapiens
  misc_feature 1..58: note = chr2:240566166-240566224
  misc_feature 1..58: note = hypo
  source 1..58: mol_type = genomic DNA
gtttgggacgtttgacgtctgcgtagatacacacaggtgcagccgtccatccagttat

SEQ ID NO: 39801 - DNA, 55 bp, Homo sapiens
  misc_feature 1..55: note = chr2:240582300-240582355
  misc_feature 1..55: note = hypo
  source 1..55: mol_type = genomic DNA
tcatttgtcaagtaccgacgagacaccctctggtgtgaggcggcattgttagtaa

SEQ ID NO: 39802 - DNA, 326 bp, Homo sapiens
  misc_feature 1..326: note = chr2:240658183-240658509
  misc_feature 1..326: note = hypo
  source 1..326: mol_type = genomic DNA
ggcagtgatgtctgtcggtaccccaaggcctgtgtggaggcagcaaagtgtctgggggacggactggtttcccggctttgctcaagctccgatgcccacgggaggagggtaggaggcagtcgctggtctcggtaggacacgggatgccacgcatggctggttggccaatctgtgtttgggtcaacgcgcccctgtgtgctcggacctggaactgcacctttgtcgggcaccctgagataggaagggctcacaccctgacaggtgcgatcagtcagggcagggaggcgggcagcaggactggccactggccccgataggtgctggtg

SEQ ID NO: 39803 - DNA, 42 bp, Homo sapiens
  misc_feature 1..42: note = chr2:240658874-240658916
  misc_feature 1..42: note = hypo
  source 1..42: mol_type = genomic DNA
tgcttctctccaggtcgcagcagggcacggggggcagggagt

SEQ ID NO: 39804 - DNA, 203 bp, Homo sapiens
  misc_feature 1..203: note = chr2:240809498-240809701
  misc_feature 1..203: note = hypo
  source 1..203: mol_type = genomic DNA
ggagaatcctggacacgcagcctcacctgggacacctgtcactccgacggagaatcctggacaggcagcctcacccgggacacctgtcattccgaaggagaatcctggacatgcagcctcacctgggacacctgtcactccgatggagaatcctggacacgcagcctcacctgggacacctgtcactccgatggagaatcctg

SEQ ID NO: 39805 - DNA, 148 bp, Homo sapiens; identical to SEQ ID NO: 14498
  misc_feature 1..148: note = chr2:241095637-241095785
  misc_feature 1..148: note = hypo
  source 1..148: mol_type = genomic DNA

SEQ ID NO: 39806 - DNA, 163 bp, Homo sapiens
  misc_feature 1..163: note = chr2:241107135-241107298
  misc_feature 1..163: note = hypo
  source 1..163: mol_type = genomic DNA
agccttgacaaatgccgccagggtgaaattgctctcatggctctggtccggcacagggatgaagcccataaatccagagttcaggggcaggaggctctgaggagggatgaggaccgagggctgctccctgctaatagctgggtggctgcgtggcacgtgccac

SEQ ID NO: 39807 - DNA, 30 bp, Homo sapiens
  misc_feature 1..30: note = chr2:241262151-241262181
  misc_feature 1..30: note = hypo
  source 1..30: mol_type = genomic DNA
agaccttcacagactcgagatctcagtcag

SEQ ID NO: 39808 - DNA, 115 bp, Homo sapiens
  misc_feature 1..115: note = chr2:241350181-241350296
  misc_feature 1..115: note = hypo
  source 1..115: mol_type = genomic DNA
gtccccctgggcaagcggcaaagcaggtaagcagaaaacagccggcaattgaacattcataagggccagtgtagaaggaagagcacccaagcgagggaggcggcccccaccatgg

SEQ ID NO: 39809 - DNA, 30 bp, Homo sapiens
  misc_feature 1..30: note = chr2:241398532-241398562
  misc_feature 1..30: note = hypo
  source 1..30: mol_type = genomic DNA
ctggagaccgcgctccgggacagcagccgc

SEQ ID NO: 39810 - DNA, 30 bp, Homo sapiens
  misc_feature 1..30: note = chr2:241542135-241542165
  misc_feature 1..30: note = hypo
  source 1..30: mol_type = genomic DNA
aggctcctggggcaccgccgcccactccct

SEQ ID NO: 39811 - DNA, 56 bp, Homo sapiens
  misc_feature 1..56: note = chr2:241543418-241543474
  misc_feature 1..56: note = hypo
  source 1..56: mol_type = genomic DNA
ttcccttggggctaccgccccggctcacacctgctggccagcgtatttactccttg

SEQ ID NO: 39812 - DNA, 30 bp, Homo sapiens; identical to SEQ ID NO: 14499
  misc_feature 1..30: note = chr2:241544980-241545010
  misc_feature 1..30: note = hypo
  source 1..30: mol_type = genomic DNA

SEQ ID NO: 39813 - DNA, 30 bp, Homo sapiens
  misc_feature 1..30: note = chr2:241662384-241662414
  misc_feature 1..30: note = hypo
  source 1..30: mol_type = genomic DNA
gcctcaggagagggccgaggggtgggcaga

SEQ ID NO: 39814 - DNA, 44 bp, Homo sapiens
  misc_feature 1..44: note = chr2:241721534-241721578
  misc_feature 1..44: note = hypo
  source 1..44: mol_type = genomic DNA
ccaggcagcttcacacgtggcgcgctccgcggcacctccgactc

SEQ ID NO: 39815 - DNA, 58 bp, Homo sapiens; identical to SEQ ID NO: 14500
  misc_feature 1..58: note = chr2:241722184-241722242
  misc_feature 1..58: note = hypo
  source 1..58: mol_type = genomic DNA

SEQ ID NO: 39816 - DNA, 30 bp, Homo sapiens
  misc_feature 1..30: note = chr2:241861894-241861924
  misc_feature 1..30: note = hypo
  source 1..30: mol_type = genomic DNA
ccagcccctgcctggcgggttcaggagcag

SEQ ID NO: 39817 - DNA, 77 bp, Homo sapiens
  misc_feature 1..77: note = chr2:241862358-241862435
  misc_feature 1..77: note = hypo
  source 1..77: mol_type = genomic DNA
gcctcctgggctcagcgtgggcctctcacgcaaccaggcaccaccgtcccagcctctgagagcggctcagcagcatc

SEQ ID NO: 39818 - DNA, 671 bp, Homo sapiens
  misc_feature 1..671: note = chr2:241864757-241865428
  misc_feature 1..671: note = hypo
  source 1..671: mol_type = genomic DNA
gtctgactccctctccgcgtcaccccgccccgcgaaaggcacctccctcccagcccctggcaccttgtctcaggcattgagggacgggccaaggttgcagagccagagccaggagagctcggggcaggggcagatatcgcagggaggcaggagggcactgggctggcacctgggagagccaccttgatgctggcactcagtttaggggtcctttgtggggcccatggcaggtgggggcagagcagcggctgtgcacctgagcccaggtcagttaggcccagagggtttggggttccattcaagccccttgacttggggactctgagcgcctctcttaggagaggcttcctacccccaccatgccctgtgggttctctgtccaggagcaccggcctctgtcaggtgaacgcgctcctgcgggagcagctggaacatatgaagaaggccaatgacgcgctgggccgggagctggccgggatgacgggcagcgtgcagcgcctgcagggcgagctggagctgaggcgctgggcccagagacaggtgctcccccaacccttgctcacctcatggcggccgcctgtctgggtgcctatggctgggtagcaggcagggacatggtgagggtgcactggctcagtggctgtccctcttggggacgaggccacagcttc

SEQ ID NO: 39819 - DNA, 254 bp, Homo sapiens
  misc_feature 1..254: note = chr2:242004922-242005176
  misc_feature 1..254: note = hypo
  source 1..254: mol_type = genomic DNA
ggcctacaacatctccgtcttctcagtgaagcgaaacagtaacaacaagaatgacatcagcaggcctgccgtgctgctggcccgcacgcgtgagtgtccccgagcctggccgtccctgcccagcccctgcccctcgagggcagcgctggccccggcacctgcagggcggctgtcatgccgtccaccctcctagttcttgcagcagcaagacagacagctgagctgggggttggaggcaccgccctgctggagac

SEQ ID NO: 39820 - DNA, 78 bp, Homo sapiens
  misc_feature 1..78: note = chr2:242006616-242006694
  misc_feature 1..78: note = hypo
  source 1..78: mol_type = genomic DNA
ttgccgggagctgagcgctgccctctggctctgcctggtgcatcagcagtggcactggagcttcggaggagactggct

SEQ ID NO: 39821 - DNA, 284 bp, Homo sapiens
  misc_feature 1..284: note = chr2:242009374-242009658
  misc_feature 1..284: note = hypo
  source 1..284: mol_type = genomic DNA
tgccacctctgcccacgtggtctgggatgccccgactccaggcagcttgctggaggcttatgtcatcaatgtgaccaccagccagagcaccaagagccgctatgtccccaacgggaagctggcgtcctacacggtgcgcgacctgctgccgggacggcggtaccagctctctgtgatagcagtgcagagcacggagctcgggccgcagcacagcgagcccgcccacctctacatcatcacctgtgagtgccgtgggccctgcgcgtgggcggggccagtgtttg

SEQ ID NO: 39822 - DNA, 30 bp, Homo sapiens
  misc_feature 1..30: note = chr2:242011200-242011230
  misc_feature 1..30: note = hypo
  source 1..30: mol_type = genomic DNA
ctctctgcaggttctcggagcttgtggacg

SEQ ID NO: 39823 - DNA, 70 bp, Homo sapiens
  misc_feature 1..70: note = chr2:242021761-242021831
  misc_feature 1..70: note = hypo
  source 1..70: mol_type = genomic DNA
aggcgtctgtcaccacgtgtaagttggtttctgtcctccgccttaccgcatttgtcgtgtgttcttgact

SEQ ID NO: 39824 - DNA, 30 bp, Homo sapiens
  misc_feature 1..30: note = chr2:242128768-242128798
  misc_feature 1..30: note = hypo
  source 1..30: mol_type = genomic DNA
acaccctccggtcatcgtcgcagctccaaa

SEQ ID NO: 39825 - DNA, 30 bp, Homo sapiens
  misc_feature 1..30: note = chr2:242131916-242131946
  misc_feature 1..30: note = hypo
  source 1..30: mol_type = genomic DNA
cctcctataaggacacgagttgtcatggat

SEQ ID NO: 39826 - DNA, 30 bp, Homo sapiens
  misc_feature 1..30: note = chr2:242138318-242138348
  misc_feature 1..30: note = hypo
  source 1..30: mol_type = genomic DNA
tgtacacctggtgaccgatcaaaggtgagg

SEQ ID NO: 39827 - DNA, 74 bp, Homo sapiens
  misc_feature 1..74: note = chr2:242156554-242156628
  misc_feature 1..74: note = hypo
  source 1..74: mol_type = genomic DNA
tcttaacctagcaagcgggcatgtgagccggcaggccccggagctccccagcgtagccgcggcatctgtggaaa

SEQ ID NO: 39828 - DNA, 106 bp, Homo sapiens
  misc_feature 1..106: note = chr2:242436356-242436462
  misc_feature 1..106: note = hypo
  source 1..106: mol_type = genomic DNA
tgagcctcctgtcaccgggtgtcacccaccctcggggggctgtggctggatcagcaggctgcccaggacctggacccgagtggctgcttcccgctggggcctccac

SEQ ID NO: 39829 - DNA, 79 bp, Homo sapiens
  misc_feature 1..79: note = chr2:242523982-242524061
  misc_feature 1..79: note = hypo
  source 1..79: mol_type = genomic DNA
gtagccaggccctcccgagggctccagaagctctaggtttacggggtcaccttcttgtaggtgacgtgaagatgctgag

SEQ ID NO: 39830 - DNA, 120 bp, Homo sapiens
  misc_feature 1..120: note = chr2:242636866-242636986
  misc_feature 1..120: note = hypo
  source 1..120: mol_type = genomic DNA
aagtacatgggtaaactgtggaacatccggacgttggaatatttttcaaattaaacatgaactagctattaagccacggaaaggcacgctgggaccttaaatgcatattgctgagtgaaa

SEQ ID NO: 39831 - DNA, 86 bp, Homo sapiens
  misc_feature 1..86: note = chr2:242637046-242637132
  misc_feature 1..86: note = hypo
  source 1..86: mol_type = genomic DNA
caaactggaaacagtaaaatgatcagtggttgccaggggcctcgggagggggagagggatgaatcgggaagcgcaggggattttta

SEQ ID NO: 39832 - DNA, 71 bp, Homo sapiens
  misc_feature 1..71: note = chr2:242672951-242673022
  misc_feature 1..71: note = hypo
  source 1..71: mol_type = genomic DNA
aggacaaatccagctcgccggttttctgtgtgactaccaggacccatctgctgtcacgggcgtagcctcca

SEQ ID NO: 39833 - DNA, 587 bp, Homo sapiens
  misc_feature 1..587: note = chr2:242756039-242756626
  misc_feature 1..587: note = hypo
  source 1..587: mol_type = genomic DNA
gcccaggtccctggacgtcctggtcagcggaacttcctcctctgggcagtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcagggtaggcgggcagggtgccggtctgggtccctttgattggccacggtccacatggaagggagattccagcgggaaattgccattctgccccacccctgtctccagccacaagggaaccaaccatccctttccccaggactgttctgcgcctcccgtcccaggcaaatccctctccccaggaccgtcctgagcctcccgtcccagacaaatccctctccccaggactgttctgcgcctcccgtcccaggcaaatccctctccccaggaccgtcctgcacctccc

SEQ ID NO: 39834 - DNA, 135 bp, Homo sapiens
  misc_feature 1..135: note = chr2:242757497-242757632
  misc_feature 1..135: note = hypo
  source 1..135: mol_type = genomic DNA
cagccctcactccttcgccttctacagcgatgaccacggccgcacctggcgctgtggaggcctcgtgcccaacctgcgctcaggcgagtgccagctggcggcggtggacggtgggcaggccggcagcttcctcta

SEQ ID NO: 39835 - DNA, 30 bp, Homo sapiens
  misc_feature 1..30: note = chr2:242763132-242763162
  misc_feature 1..30: note = hypo
  source 1..30: mol_type = genomic DNA
gcccctcctagcagccgtggcctcctcagg

SEQ ID NO: 39836 - DNA, 98 bp, Homo sapiens
  misc_feature 1..98: note = chr2:242784279-242784377
  misc_feature 1..98: note = hypo
  source 1..98: mol_type = genomic DNA
ccagtctatgaaggccggagagaaaggagagaaaggaggatggaatcctgcctgcaggcatctttggatttgagtggctacttcggctcctcctgcgt

SEQ ID NO: 39837 - DNA, 39 bp, Homo sapiens
  misc_feature 1..39: note = chr2:242791597-242791636
  misc_feature 1..39: note = hypo
  source 1..39: mol_type = genomic DNA
gcagccctcccaccccgctgtggacgccctggcaccagg

SEQ ID NO: 39838 - DNA, 165 bp, Homo sapiens
  misc_feature 1..165: note = chr2:242794852-242795017
  misc_feature 1..165: note = hypo
  source 1..165: mol_type = genomic DNA
ccgctgtcattgcgccgggccctgaccacgctcatgtggaagtcacgcccgttgggcagttgtgtgacacggaagcggcagtcctggccgggctggctgcggtcctcggggaaggcggccagcttgtccgtctggttgctggggctcatgcggtaccagtttagc

SEQ ID NO: 39839 - DNA, 30 bp, Homo sapiens
  misc_feature 1..30: note = chr2:242814897-242814927
  misc_feature 1..30: note = hypo
  source 1..30: mol_type = genomic DNA
cgtcccagtgggtcacgacgccctgccaga

SEQ ID NO: 39840 - DNA, 342 bp, Homo sapiens
  misc_feature 1..342: note = chr2:242832880-242833222
  misc_feature 1..342: note = hypo
  source 1..342: mol_type = genomic DNA
tggatacgtcccagccgaaatgttcaccgtgaatccggcaacctgtggagctgatttccatttctaaggaatgaggggggatggggaagaaccccccaggacagcaccaacagtccctgcggggacctttcccggacacccggccttctcggcggtgaggcaggtggcggcaccgacaggcccgggggggacctttcccggacacccagcctcctcggtggcgaggcaggtggcggcaccgacaggcccggcggggacctttcccggacacctggcctccttggcaaggcaggtggcggcaccaacaggcccgggggggacctttcccggacacctggcctc

SEQ ID NO: 39841 - DNA, 110 bp, Homo sapiens
  misc_feature 1..110: note = chr2:242833478-242833588
  misc_feature 1..110: note = hypo
  source 1..110: mol_type = genomic DNA
ttggttctgtggcctcggtttctgtcttcctgatggcacctctgtgacaggagctcagaccccggcatcagaccggcctccgcagggaggagctgcggtgcccaggccag

SEQ ID NO: 39842 - DNA, 32 bp, Homo sapiens; identical to SEQ ID NO: 14514
  misc_feature 1..32: note = chr2:242833797-242833829
  misc_feature 1..32: note = hypo
  source 1..32: mol_type = genomic DNA

SEQ ID NO: 39843 - DNA, 56 bp, Homo sapiens
  misc_feature 1..56: note = chr2:242836469-242836525
  misc_feature 1..56: note = hypo
  source 1..56: mol_type = genomic DNA
tcagcccatcccacgcggagcctggggcagggcgataatttcggcattgtgagtca

SEQ ID NO: 39844 - DNA, 76 bp, Homo sapiens
  misc_feature 1..76: note = chr2:242891535-242891611
  misc_feature 1..76: note = hypo
  source 1..76: mol_type = genomic DNA
gctgaatctggaagccgggggccaggggtgctccatgtaccgtgggcgttggaagtgggggcgtcttgtgggctca

SEQ ID NO: 39845 - DNA, 30 bp, Homo sapiens
  misc_feature 1..30: note = chr2:242892372-242892402
  misc_feature 1..30: note = hypo
  source 1..30: mol_type = genomic DNA
gcatgggtccgtgtgcgagcacaggtgtgc

SEQ ID NO: 39846 - DNA, 166 bp, Homo sapiens
  misc_feature 1..166: note = chr2:242925496-242925662
  misc_feature 1..166: note = hypo
  source 1..166: mol_type = genomic DNA
tctcaaaagatacttcgagcaaaaacaccggacagaagcgtccgtgccagccccgcaggctgcctgtgtgccaggctatcccgtgccatctgatccgggagaagcaggactttcttgcacaggtactcagcgctgtggctgtgggaggagccgggagggccctggc

SEQ ID NO: 39847 - DNA, 114 bp, Homo sapiens
  misc_feature 1..114: note = chr2:242985077-242985191
  misc_feature 1..114: note = hypo
  source 1..114: mol_type = genomic DNA
gctgttacctgaggacggagcaggtgcggctgttacctgaggactgagcaggtgcggctgttacctgaggacggagcaggtgcggctgttacctgaggacggagcaggtgcggc

SEQ ID NO: 39848 - DNA, 30 bp, Homo sapiens
  misc_feature 1..30: note = chr3:1741068-1741098
  misc_feature 1..30: note = hypo
  source 1..30: mol_type = genomic DNA
aacaagtgggagtcccgcccccttccaaat

SEQ ID NO: 39849 - DNA, 191 bp, Homo sapiens
  misc_feature 1..191: note = chr3:2909417-2909608
  misc_feature 1..191: note = hypo
  source 1..191: mol_type = genomic DNA
cacccaaccatgctgcgtcaggtacctactgtatcgagtctacgaccataccccaaaagatctcataattctgcatcacagttgtctgtgttcttcactgtctgtcttactagcaatttgcctttttaaagcatatgtagtaccttattcacagccacctctgctgcacctggtttcgcaactggtacatc

SEQ ID NO: 39850 - DNA, 38 bp, Homo sapiens
  misc_feature 1..38: note = chr3:3167655-3167693
  misc_feature 1..38: note = hypo
  source 1..38: mol_type = genomic DNA
cggcaaaagtaatcccggcacttttgggggccgaggcc

SEQ ID NO: 39851 - DNA, 30 bp, Homo sapiens
  misc_feature 1..30: note = chr3:3167988-3168018
  misc_feature 1..30: note = hypo
  source 1..30: mol_type = genomic DNA
ctctttgctcttttccgctctagaaagaat

SEQ ID NO: 39852 - DNA, 30 bp, Homo sapiens
  misc_feature 1..30: note = chr3:4755974-4756004
  misc_feature 1..30: note = hypo
  source 1..30: mol_type = genomic DNA
ctgaggacgacaccacggtgagtgtggagg

SEQ ID NO: 39853 - DNA, 87 bp, Homo sapiens
  misc_feature 1..87: note = chr3:5831053-5831140
  misc_feature 1..87: note = hypo
  source 1..87: mol_type = genomic DNA
ttaaagaaaacagaagatgaaagggaaacaaggccaagtaacatctctgcagagttcctctgctgtctcattcgctgggcaggctca

SEQ ID NO: 39854 - DNA, 30 bp, Homo sapiens
  misc_feature 1..30: note = chr3:5970953-5970983
  misc_feature 1..30: note = hypo
  source 1..30: mol_type = genomic DNA
gccggtggccaaatgcgctcaccctggctc

SEQ ID NO: 39855 - DNA, 30 bp, Homo sapiens
  misc_feature 1..30: note = chr3:9006374-9006404
  misc_feature 1..30: note = hypo
  source 1..30: mol_type = genomic DNA
atttaagaccaggtccgtggcctgagtgaa

SEQ ID NO: 39856 - DNA, 17 bp, Homo sapiens
  misc_feature 1..17: note = chr3:9688167-9688184
  misc_feature 1..17: note = hypo
  source 1..17: mol_type = genomic DNA
gccggattggtcatttc

SEQ ID NO: 39857 - DNA, 30 bp, Homo sapiens
  misc_feature 1..30: note = chr3:10127378-10127408
  misc_feature 1..30: note = hypo
  source 1..30: mol_type = genomic DNA
attcttttttcaaaccgttaaactattgat

SEQ ID NO: 39858 - DNA, 49 bp, Homo sapiens; identical to SEQ ID NO: 14519
  misc_feature 1..49: note = chr3:10182868-10182917
  misc_feature 1..49: note = hypo
  source 1..49: mol_type = genomic DNA

SEQ ID NO: 39859 - DNA, 35 bp, Homo sapiens
  misc_feature 1..35: note = chr3:10452258-10452293
  misc_feature 1..35: note = hypo
  source 1..35: mol_type = genomic DNA
gccaggtgtgcggggcggttcgtgggtctgaggcc

SEQ ID NO: 39860 - DNA, 66 bp, Homo sapiens
  misc_feature 1..66: note = chr3:11581322-11581388
  misc_feature 1..66: note = hypo
  source 1..66: mol_type = genomic DNA
cctgccctgcacagccgcctggaggttcacctgcatcattgcgtgtgtcagcgcttggtgcctttc

SEQ ID NO: 39861 - DNA, 30 bp, Homo sapiens
  misc_feature 1..30: note = chr3:12039968-12039998
  misc_feature 1..30: note = hypo
  source 1..30: mol_type = genomic DNA
cttgctatatcaagccgctgatgaccgcag

SEQ ID NO: 39862 - DNA, 30 bp, Homo sapiens; identical to SEQ ID NO: 14520
  misc_feature 1..30: note = chr3:12586227-12586257
  misc_feature 1..30: note = hypo
  source 1..30: mol_type = genomic DNA

SEQ ID NO: 39863 - DNA, 68 bp, Homo sapiens
  misc_feature 1..68: note = chr3:12867218-12867286
  misc_feature 1..68: note = hypo
  source 1..68: mol_type = genomic DNA
catcagagcaggtgccggggccacatggcctgggtcaagtcctgccctgactccgagctgtgggaccc

SEQ ID NO: 39864 - DNA, 30 bp, Homo sapiens
  misc_feature 1..30: note = chr3:13083168-13083198
  misc_feature 1..30: note = hypo
  source 1..30: mol_type = genomic DNA
ggaggtatgaacattcgggcttgtggtgcc

SEQ ID NO: 39865 - DNA, 100 bp, Homo sapiens
  misc_feature 1..100: note = chr3:13083990-13084090
  misc_feature 1..100: note = hypo
  source 1..100: mol_type = genomic DNA
atggcccagcccgcccggcgcagcttgtacagtacacgcctccaatacaaagagcagccagcacaaaagcctagcaactcattcacgcagctcgcctggc

SEQ ID NO: 39866 - DNA, 30 bp, Homo sapiens
  misc_feature 1..30: note = chr3:13096379-13096409
  misc_feature 1..30: note = hypo
  source 1..30: mol_type = genomic DNA
tcctcatttgtaaaacggggctgatcagag

SEQ ID NO: 39867 - DNA, 30 bp, Homo sapiens
  misc_feature 1..30: note = chr3:13367390-13367420
  misc_feature 1..30: note = hypo
  source 1..30: mol_type = genomic DNA
gaggatgctgttggccgaggagctccaggt

SEQ ID NO: 39868 - DNA, 42 bp, Homo sapiens
  misc_feature 1..42: note = chr3:13373208-13373250
  misc_feature 1..42: note = hypo
  source 1..42: mol_type = genomic DNA
aagtgtcctgtggcccgtggagtctcccgcttggcaactgcc

SEQ ID NO: 39869 - DNA, 30 bp, Homo sapiens
  misc_feature 1..30: note = chr3:13442799-13442829
  misc_feature 1..30: note = hypo
  source 1..30: mol_type = genomic DNA
cctaggcagatgtcccgccttctggctgga

SEQ ID NO: 39870 - DNA, 188 bp, Homo sapiens
  misc_feature 1..188: note = chr3:13612034-13612222
  misc_feature 1..188: note = hypo
  source 1..188: mol_type = genomic DNA
gcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcg

SEQ ID NO: 39871 - DNA, 97 bp, Homo sapiens
  misc_feature 1..97: note = chr3:13679132-13679229
  misc_feature 1..97: note = hypo
  source 1..97: mol_type = genomic DNA
agctcaacttccagacgggcctcctggtgcctgcgcatatcttccgcattggccccgcgccagccttcacgggggacaccatcgccctgaacatcat

SEQ ID NO: 39872 - DNA, 30 bp, Homo sapiens; identical to SEQ ID NO: 14522
  misc_feature 1..30: note = chr3:13680779-13680809
  misc_feature 1..30: note = hypo
  source 1..30: mol_type = genomic DNA

SEQ ID NO: 39873 - DNA, 78 bp, Homo sapiens
  misc_feature 1..78: note = chr3:13860693-13860771
  misc_feature 1..78: note = hypo
  source 1..78: mol_type = genomic DNA
gtgtccatgggcttgcggtacgacagtggcttcttgatcttcaggaaggtgggccgcttgttgcggctggcacgcaca

SEQ ID NO: 39874 - DNA, 30 bp, Homo sapiens
  misc_feature 1..30: note = chr3:14197900-14197930
  misc_feature 1..30: note = hypo
  source 1..30: mol_type = genomic DNA
tatttcaggagatgccgcttcagggcatac

SEQ ID NO: 39875 - DNA, 161 bp, Homo sapiens
  misc_feature 1..161: note = chr3:14443179-14443340
  misc_feature 1..161: note = hypo
  source 1..161: mol_type = genomic DNA
aaggatcggctctctcctccccgcctcccaggtgcagagagagagagagagagagagggacaggagaaggctggggttcggggttctcacagcgtttccctctcatgctgccagggcggggcagtggaaaatggtccctgagggcccgttcattcaaataa

SEQ ID NO: 39876 - DNA, 30 bp, Homo sapiens
  misc_feature 1..30: note = chr3:14676121-14676151
  misc_feature 1..30: note = hypo
  source 1..30: mol_type = genomic DNA
tcgtttgctggaccacgatctccttgaagt

SEQ ID NO: 39877 - DNA, 30 bp, Homo sapiens
  misc_feature 1..30: note = chr3:14964046-14964076
  misc_feature 1..30: note = hypo
  source 1..30: mol_type = genomic DNA
tgtggcaaggtgagtcgctgcatctggggt

SEQ ID NO: 39878 - DNA, 30 bp, Homo sapiens
  misc_feature 1..30: note = chr3:15105526-15105556
  misc_feature 1..30: note = hypo
  source 1..30: mol_type = genomic DNA
caaatggctaggaagcggcttccggatctc

SEQ ID NO: 39879 - DNA, 30 bp, Homo sapiens
  misc_feature 1..30: note = chr3:16952388-16952418
  misc_feature 1..30: note = hypo
  source 1..30: mol_type = genomic DNA
ctttggttttatcttcgagatataactagt

SEQ ID NO: 39880 - DNA, 38 bp, Homo sapiens
  misc_feature 1..38: note = chr3:17001303-17001341
  misc_feature 1..38: note = hypo
  source 1..38: mol_type = genomic DNA
tgtaagaaggtccaccgggtgctgtggctcatgcctgt

SEQ ID NO: 39881 - DNA, 66 bp, Homo sapiens; identical to SEQ ID NO: 14524
  misc_feature 1..66: note = chr3:17499802-17499868
  misc_feature 1..66: note = hypo
  source 1..66: mol_type = genomic DNA

SEQ ID NO: 39882 - DNA, 36 bp, Homo sapiens
  misc_feature 1..36: note = chr3:18299798-18299834
  misc_feature 1..36: note = hypo
  source 1..36: mol_type = genomic DNA
tggaggcaagaaagccgagcctttttttttttttta

SEQ ID NO: 39883 - DNA, 92 bp, Homo sapiens
  misc_feature 1..92: note = chr3:19791264-19791356
  misc_feature 1..92: note = hypo
  source 1..92: mol_type = genomic DNA
tgaggggagttctcccgggcccaggatggcaaaggtccgcgtgggaagtgtggatcccccggggcctctcactcaatcgccccttccccacc

SEQ ID NO: 39884 - DNA, 31 bp, Homo sapiens
  misc_feature 1..31: note = chr3:20013239-20013270
  misc_feature 1..31: note = hypo
  source 1..31: mol_type = genomic DNA
tacaggtggaagccaccgcacctggcccagt

SEQ ID NO: 39885 - DNA, 20 bp, Homo sapiens
  misc_feature 1..20: note = chr3:20139710-20139730
  misc_feature 1..20: note = hypo
  source 1..20: mol_type = genomic DNA
gacaacgtcccaaattaaaa

SEQ ID NO: 39886 - DNA, 81 bp, Homo sapiens
  misc_feature 1..81: note = chr3:21447519-21447600
  misc_feature 1..81: note = hypo
  source 1..81: mol_type = genomic DNA
accacggagcaggtccgtgccttggagggcgtcttccggcaccaccagtacctgggccctctggagcggaattggctggcc

SEQ ID NO: 39887 - DNA, 91 bp, Homo sapiens
  misc_feature 1..91: note = chr3:22370592-22370683
  misc_feature 1..91: note = hypo
  source 1..91: mol_type = genomic DNA
ttattaaagttgctcatatcactttctaggctcactgctatttctcatatgccatgccttcctctagtccaccgtccgtgctgatgtacat

SEQ ID NO: 39888 - DNA, 158 bp, Homo sapiens
  misc_feature 1..158: note = chr3:32151266-32151424
  misc_feature 1..158: note = hypo
  source 1..158: mol_type = genomic DNA
agctggacacagtcccggtccttaaacaacttaccttcaggtctgagatcagtgaggacatggaagataagaccgaaggaattgccaagtggaatggagtaactgctctgttacactttaaatcgtgtttctttttttgtttgtttgtttttgttttt

SEQ ID NO: 39889 - DNA, 197 bp, Homo sapiens
  misc_feature 1..197: note = chr3:33841159-33841356
  misc_feature 1..197: note = hypo
  source 1..197: mol_type = genomic DNA
taagaacattttttacgattttatagttaaacatttcttttgcataccttgttaatctcgttttctccgtatagtatattctacttgtttcacaggagaatcacaattgtattccaatccaagtagcagaaacccaggctaaactagcttgagctaagaaaagacttattctgccgggcgcggtggctcacgcctgt

SEQ ID NO: 39890 - DNA, 76 bp, Homo sapiens
  misc_feature 1..76: note = chr3:33841656-33841732
  misc_feature 1..76: note = hypo
  source 1..76: mol_type = genomic DNA
ctgaaaagtctagggatattccttccttagctttaggtatcactggagatcgtcttgcctccgtgatgcttccctc

SEQ ID NO: 39891 - DNA, 17 bp, Homo sapiens
  misc_feature 1..17: note = chr3:34246982-34246999
  misc_feature 1..17: note = hypo
  source 1..17: mol_type = genomic DNA
gggcgcggtgactcacg

SEQ ID NO: 39892 - DNA, 180 bp, Homo sapiens
  misc_feature 1..180: note = chr3:34690946-34691126
  misc_feature 1..180: note = hypo
  source 1..180: mol_type = genomic DNA
ctgaacttcattttccgtaactacacagttatcattaaactcagattgactcataaagttaccattaatcatcaaagaccaatgaaattcagagtgtaatcctgatcaaggcaagaaagttggataatttagaattacttgcagcagtcaatattatgtaatgctcgctaatccccgaag

SEQ ID NO: 39893 - DNA, 17 bp, Homo sapiens
  misc_feature 1..17: note = chr3:37296942-37296959
  misc_feature 1..17: note = hypo
  source 1..17: mol_type = genomic DNA
cacgcctgacctttata

SEQ ID NO: 39894 - DNA, 37 bp, Homo sapiens
  misc_feature 1..37: note = chr3:37876204-37876241
  misc_feature 1..37: note = hypo
  source 1..37: mol_type = genomic DNA
gcttatccacggtttcgctttccgagctttcagttat

SEQ ID NO: 39895 - DNA, 32 bp, Homo sapiens
  misc_feature 1..32: note = chr3:38032423-38032455
  misc_feature 1..32: note = hypo
  source 1..32: mol_type = genomic DNA
gggccacagagcctccgcggcagaattgggag

SEQ ID NO: 39896 - DNA, 30 bp, Homo sapiens
  misc_feature 1..30: note = chr3:38041112-38041142
  misc_feature 1..30: note = hypo
  source 1..30: mol_type = genomic DNA
aatcatacacagccacgggcactcacacaa

SEQ ID NO: 39897 - DNA, 147 bp, Homo sapiens
  misc_feature 1..147: note = chr3:38627339-38627486
  misc_feature 1..147: note = hypo
  source 1..147: mol_type = genomic DNA
gcagcaggcctgagtcgctgtccctcagctccgagtagttcttgccaaagagctgcatgcccaccacagcaaagatgaacacgatgatggctagcaccagtgtcaggttccccagtgcccccactgagttcccgatgatcttgatga

SEQ ID NO: 39898 - DNA, 30 bp, Homo sapiens
  misc_feature 1..30: note = chr3:38950258-38950288
  misc_feature 1..30: note = hypo
  source 1..30: mol_type = genomic DNA
agcatcaagaccaagcgttccccgttttga

SEQ ID NO: 39899 - DNA, 37 bp, Homo sapiens; identical to SEQ ID NO: 14527
  misc_feature 1..37: note = chr3:40501058-40501095
  misc_feature 1..37: note = hypo
  source 1..37: mol_type = genomic DNA

SEQ ID NO: 39900 - DNA, 52 bp, Homo sapiens
  misc_feature 1..52: note = chr3:41289147-41289199
  misc_feature 1..52: note = hypo
  source 1..52: mol_type = genomic DNA
ccatgaccaggagaccgttccatgcattcctgctctgcgcatcaaagcccct

SEQ ID NO: 39901 - DNA, 149 bp, Homo sapiens
  misc_feature 1..149: note = chr3:42200630-42200779
  misc_feature 1..149: note = hypo
  source 1..149: mol_type = genomic DNA
cctgagcagaattctcggccctaaggattcaaagacgaatgagatatggttcccgaacttgtgtagaaaattgttttatgaagaccttgcccctgctaaaatctctcttggctacctgggggaggcagcctgttcgggaggttggaatg

SEQ ID NO: 39902 - DNA, 18 bp, Homo sapiens
  misc_feature 1..18: note = chr3:42222719-42222737
  misc_feature 1..18: note = hypo
  source 1..18: mol_type = genomic DNA
ttgcattgaaatgtgcgt

SEQ ID NO: 39903 - DNA, 120 bp, Homo sapiens
  misc_feature 1..120: note = chr3:42640761-42640881
  misc_feature 1..120: note = hypo
  source 1..120: mol_type = genomic DNA
atgtgtattttatagtttaaaaaaaaaacttataaaatagtgtggtactcagacacagatcattggaacaaaaatccagaaacagacccacacatatatggtcacaaggcgaaggtaatt

SEQ ID NO: 39904 - DNA, 30 bp, Homo sapiens
  misc_feature 1..30: note = chr3:42851003-42851033
  misc_feature 1..30: note = hypo
  source 1..30: mol_type = genomic DNA
agctgctattgaacacggcaggtgagagaa

SEQ ID NO: 39905 - DNA, 21 bp, Homo sapiens
  misc_feature 1..21: note = chr3:43664372-43664393
  misc_feature 1..21: note = hypo
  source 1..21: mol_type = genomic DNA
tttgagatagagcctcgcaat

SEQ ID NO: 39906 - DNA, 30 bp, Homo sapiens
  misc_feature 1..30: note = chr3:44938829-44938859
  misc_feature 1..30: note = hypo
  source 1..30: mol_type = genomic DNA
ccacttatgggctgacgttaggtgtaaatg

SEQ ID NO: 39907 - DNA, 34 bp, Homo sapiens
  misc_feature 1..34: note = chr3:44999995-45000029
  misc_feature 1..34: note = hypo
  source 1..34: mol_type = genomic DNA
aacattcaatagccacgtgcgcagcttggcatat

SEQ ID NO: 39908 - DNA, 30 bp, Homo sapiens
  misc_feature 1..30: note = chr3:45821641-45821671
  misc_feature 1..30: note = hypo
  source 1..30: mol_type = genomic DNA
ctccgccaggcccagcgtgtgctcccagga

SEQ ID NO: 39909 - DNA, 30 bp, Homo sapiens; identical to SEQ ID NO: 14530
  misc_feature 1..30: note = chr3:45885052-45885082
  misc_feature 1..30: note = hypo
  source 1..30: mol_type = genomic DNA

SEQ ID NO: 39910 - DNA, 37 bp, Homo sapiens
  misc_feature 1..37: note = chr3:46584785-46584822
  misc_feature 1..37: note = hypo
  source 1..37: mol_type = genomic DNA
ttccctttaccataccgggcacattaaacacgcttta

SEQ ID NO: 39911 - DNA, 46 bp, Homo sapiens
  misc_feature 1..46: note = chr3:46949012-46949058
  misc_feature 1..46: note = hypo
  source 1..46: mol_type = genomic DNA
gtcattctccatgtgcgagcgtttgtatgcgcgtgctgcttgtgta

SEQ ID NO: 39912 - DNA, 22 bp, Homo sapiens
  misc_feature 1..22: note = chr3:47555871-47555893
  misc_feature 1..22: note = hypo
  source 1..22: mol_type = genomic DNA
gccgacacggaattatatcttg

SEQ ID NO: 39913 - DNA, 20 bp, Homo sapiens
  misc_feature 1..20: note = chr3:48227769-48227789
  misc_feature 1..20: note = hypo
  source 1..20: mol_type = genomic DNA
atgtttatcaccgggcgcgg

SEQ ID NO: 39914 - DNA, 41 bp, Homo sapiens
  misc_feature 1..41: note = chr3:48236523-48236564
  misc_feature 1..41: note = hypo
  source 1..41: mol_type = genomic DNA
aatgggagtaatggccgggcgcggtggctcacgcctgtaat

SEQ ID NO: 39915 - DNA, 459 bp, Homo sapiens
  misc_feature 1..459: note = chr3:48636676-48637135
  misc_feature 1..459: note = hypo
  source 1..459: mol_type = genomic DNA
cacctggccctgtgccgcacccagctcggagatgctgcccagagcagcacaagacaggctttgagtggaaagagaggagagaacattcccccaggggtgctgagcctgtcccttcatgttctggcccttgaagccccaccccacatggaggtgcccgttacctgacgggtgcagggtattgatgaaggcaccttggcaggcagtcaaggaactgctgggacaggttttctgagcaagaactccctggcagccaggggactggggagagctgcttggggccttaactggctgctctgtaagctgagcagcagtgcgggagcagaggtggaaggggaggccaagagaacggcctgaggaaataaacaaagagcagaccccctaggccacttaccatatccagccactgctgggcactggtcatagatgtacttggagcagatctcacgtaccacactggca

SEQ ID NO: 39916 - DNA, 30 bp, Homo sapiens
  misc_feature 1..30: note = chr3:48883988-48884018
  misc_feature 1..30: note = hypo
  source 1..30: mol_type = genomic DNA
tgcccaggctggtctcgaactcttggattc

SEQ ID NO: 39917 - DNA, 30 bp, Homo sapiens; identical to SEQ ID NO: 14534
  misc_feature 1..30: note = chr3:48948476-48948506
  misc_feature 1..30: note = hypo
  source 1..30: mol_type = genomic DNA

SEQ ID NO: 39918 - DNA, 90 bp, Homo sapiens
  misc_feature 1..90: note = chr3:49034204-49034294
  misc_feature 1..90: note = hypo
  source 1..90: mol_type = genomic DNA
ataattaagtctgtccggggttcgacaaacagcatcttgtccaaggtgagcatagcccaaggctatgtgcctgcccggagactcagcttg

SEQ ID NO: 39919 - DNA, 21 bp, Homo sapiens
  misc_feature 1..21: note = chr3:49056918-49056939
  misc_feature 1..21: note = hypo
  source 1..21: mol_type = genomic DNA
tttttttttttgagacggagt

SEQ ID NO: 39920 - DNA, 48 bp, Homo sapiens
  misc_feature 1..48: note = chr3:49057282-49057330
  misc_feature 1..48: note = hypo
  source 1..48: mol_type = genomic DNA
ggcaacagccatttacgggccaaccaaataatgcgaccataatagaaa

SEQ ID NO: 39921 - DNA, 30 bp, Homo sapiens
  misc_feature 1..30: note = chr3:49140985-49141015
  misc_feature 1..30: note = hypo
  source 1..30: mol_type = genomic DNA
cacctccttctcactcgtgcccagaagaaa

SEQ ID NO: 39922 - DNA, 25 bp, Homo sapiens
  misc_feature 1..25: note = chr3:49189546-49189571
  misc_feature 1..25: note = hypo
  source 1..25: mol_type = genomic DNA
ggccgggcacagtggcgcacgcctg

SEQ ID NO: 39923 - DNA, 51 bp, Homo sapiens
  misc_feature 1..51: note = chr3:49755535-49755586
  misc_feature 1..51: note = hypo
  source 1..51: mol_type = genomic DNA
ctacgtgcttgtggacgctggccttgcggctgggtgcgtctggcggtgtgg

SEQ ID NO: 39924 - DNA, 892 bp, Homo sapiens
  misc_feature 1..892: note = chr3:49939702-49940594
  misc_feature 1..892: note = hypo
  source 1..892: mol_type = genomic DNA
cgcctgcccccccaccgcgcccccagatcccctcagtgatggaagggaagcagcctgtgttcagccatgtgcatgcagctcacaagtaagggccccttctttcagcttaccgggttggggcaaaaactgggcgactggaagaagtcgaggcctcgccggaggcctggatggactggggattcacaacagcgctccacaccctcatcaattagtgtgtccagcaggtcaatggggaaggcacagacgacagagttggggcccacgccaggaccaccatccttgccagtcacaaagaccccaaatagtacttcctggccctcggcgatgctcagctcagtggcaagttgggcacccactggagcggagtgggccacccgcagcacagggtagggctgtccgccttctggggccccccggcgcctgcgttttggagcaaatctgcagtcgaggaccagctcccgatagtcacccaactctggctcagtggcgctaagccgtgccaggcgtgtgtgcagggcactaggatcatctgtcacgctggccggctgtacagtcaggaagtatacgaaggctcccgtgtggaagctgtgcacgtattcaatactgtaggagacaagatgcttgggcagcactgacaacgccacaaagcccggtgcgaatcccgaggcgtcagccttgagacgcctgatagacactgagcgtgggctgaagctggcagccacggctgcgtccagtgaggatgccacgtagaaataggaggcctggccttgctcaaccacagttacacgggtgcccaatgggctggccacacagtcggggcagtcatcgggccggttatggtgggctgagaagaggcaggctggcgctgccagatgcacggctgtcccttggg

SEQ ID NO: 39925 - DNA, 30 bp, Homo sapiens; identical to SEQ ID NO: 14538
  misc_feature 1..30: note = chr3:50395506-50395536
  misc_feature 1..30: note = hypo
  source 1..30: mol_type = genomic DNA

SEQ ID NO: 39926 - DNA, 43 bp, Homo sapiens
  misc_feature 1..43: note = chr3:50425370-50425413
  misc_feature 1..43: note = hypo
  source 1..43: mol_type = genomic DNA
agggagtgaggaagacggagaacagagccgagtttgggcagga

SEQ ID NO: 39927 - DNA, 30 bp, Homo sapiens
  misc_feature 1..30: note = chr3:50426624-50426654
  misc_feature 1..30: note = hypo
  source 1..30: mol_type = genomic DNA
ctcggcctttccctgcgcccggctccgacc

SEQ ID NO: 39928 - DNA, 192 bp, Homo sapiens
  misc_feature 1..192: note = chr3:50433950-50434142
  misc_feature 1..192: note = hypo
  source 1..192: mol_type = genomic DNA
acaaatgcctgcccacgccgaccccaaacccagggatggatgaggcccccaattcataagcctgcagtgaccttgtgtagagggcattactgtgtgacttgtacggttcgcaatgcttgtcaccagtgttaggcgagcacctgcagtacagcaggtgccgagctcagtaacttggcccggaggctgtgtaaa

SEQ ID NO: 39929 - DNA, 27 bp, Homo sapiens
  misc_feature 1..27: note = chr3:50575602-50575629
  misc_feature 1..27: note = hypo
  source 1..27: mol_type = genomic DNA
ggggctcaagcaatacgactccagcca

SEQ ID NO: 39930 - DNA, 20 bp, Homo sapiens
  misc_feature 1..20: note = chr3:52352335-52352355
  misc_feature 1..20: note = hypo
  source 1..20: mol_type = genomic DNA
acaggcgtgagccactgcgc

SEQ ID NO: 39931 - DNA, 128 bp, Homo sapiens
  misc_feature 1..128: note = chr3:52415830-52415958
  misc_feature 1..128: note = hypo
  source 1..128: mol_type = genomic DNA
tcacaaggctcgcctcgcacatgtgagcgcctccagggcgtgctgggcagtgggcggccagggctggctggtcggtttgactgacccatgcttttgcacagtggtagaggcctcgggcaaccctgaag

SEQ ID NO: 39932 - DNA, 30 bp, Homo sapiens
  misc_feature 1..30: note = chr3:52429714-52429744
  misc_feature 1..30: note = hypo
  source 1..30: mol_type = genomic DNA
cagacccagtggggccgcctctgcatccat

SEQ ID NO: 39933 - DNA, 30 bp, Homo sapiens
  misc_feature 1..30: note = chr3:52537738-52537768
  misc_feature 1..30: note = hypo
  source 1..30: mol_type = genomic DNA
gttcttggggttggacgtggtgttcccctc

SEQ ID NO: 39934 - DNA, 84 bp, Homo sapiens; identical to SEQ ID NO: 14542
  misc_feature 1..84: note = chr3:52552577-52552661
  misc_feature 1..84: note = hypo
  source 1..84: mol_type = genomic DNA

SEQ ID NO: 39935 - DNA, 240 bp, Homo sapiens; identical to SEQ ID NO: 14543
  misc_feature 1..240: note = chr3:52553207-52553447
  misc_feature 1..240: note = hypo
  source 1..240: mol_type = genomic DNA

SEQ ID NO: 39936 - DNA, 30 bp, Homo sapiens
  misc_feature 1..30: note = chr3:52599737-52599767
  misc_feature 1..30: note = hypo
  source 1..30: mol_type = genomic DNA
ctaaaaaaagacatacgaatgtccaatagg

SEQ ID NO: 39937 - DNA, 135 bp, Homo sapiens
  misc_feature 1..135: note = chr3:52900714-52900849
  misc_feature 1..135: note = hypo
  source 1..135: mol_type = genomic DNA
gtcctcctcagagcccgatctgggctggcgctccacgtggacccactgactagcagaaggaagttggaattttacacttgatgtcacagagtggtagagtaacaagtcaaaaaacacaggcgttggaagggatat

SEQ ID NO: 39938 - DNA, 31 bp, Homo sapiens
  misc_feature 1..31: note = chr3:53032137-53032168
  misc_feature 1..31: note = hypo
  source 1..31: mol_type = genomic DNA
aaatgtagatcaggtcgggcacggtggctca

SEQ ID NO: 39939 - DNA, 837 bp, Homo sapiens
  misc_feature 1..837: note = chr3:53032798-53033635
  misc_feature 1..837: note = hypo
  source 1..837: mol_type = genomic DNA
gggagctggtgctgccgatcgacctgactggcccacaacgtcttcagctaccactgcaagggcctgcggggtgacggctgtgcagcgctgctcgcctagctgttgatcgcctggctgttgatgggctggcacccgcagagctgccctgccggccaccgaccaccatggagggagcattcagctggtgcgcgagctgggtactaaactggctctactgtgagccgccctcggcccctccatctcctcttaccccttgtcatccatgcgtaagccggggacgcccgaggacatgctcttcacccaaggcctgcgccggcgtctgctgatcaagggcccagtacaaaggccgtcatggagatccaggccttcgccaacagcggcctgttctggtgcaagggccagccgggcagcccaaggacctcacgactggctgctgggtcaaggcgttcccggggtgaaggtggataagcagaccaccaagggctcctggaaccctacgtgaaggaggccaagcacagccgtggacaccggcctgaaggctgggaaaggagccgacgccccacctcctctgaccaggcctgcggggaggagccacccacgcgccacagcaagtcctggacctggccctgcattccagggtggggcagggaggctggattctgagagagctgcttccggattgcgttggggtagtcaaggagctcgggacatcgcaggggaggcaaaaagccttggccagtgctcttttggtgtatcccttcagcttccagaggggaagccacaccctgatgctatgttcaaacgctccagaagacaggagttcgtgtccttgcccct

SEQ ID NO: 39940 - DNA, 30 bp, Homo sapiens
  misc_feature 1..30: note = chr3:53217535-53217565
  misc_feature 1..30: note = hypo
  source 1..30: mol_type = genomic DNA
cttctgtgaccactgcggcagcctgctctg

SEQ ID NO: 39941 - DNA, 38 bp, Homo sapiens
  misc_feature 1..38: note = chr3:56718243-56718281
  misc_feature 1..38: note = hypo
  source 1..38: mol_type = genomic DNA
cagtataaactatcacgggttatcgtgagtacagccaa

SEQ ID NO: 39942 - DNA, 28 bp, Homo sapiens
  misc_feature 1..28: note = chr3:57740997-57741025
  misc_feature 1..28: note = hypo
  source 1..28: mol_type = genomic DNA
gagccaccgcgcccggcctaattgctac

SEQ ID NO: 39943 - DNA, 187 bp, Homo sapiens
  misc_feature 1..187: note = chr3:58456517-58456704
  misc_feature 1..187: note = hypo
  source 1..187: mol_type = genomic DNA
gatctggggcctcctcgacttccataggggaggttgggcctgcactgtccaccatgacccatacaaccacagacagaagttccttggtagtaaccagcatgtgttcattacagtgaatgaaaagaccagagcaggtagcatggatctcagccgcagctcatggaccacccagcgctgggaattgcag

SEQ ID NO: 39944 - DNA, 30 bp, Homo sapiens
  misc_feature 1..30: note = chr3:67047776-67047806
  misc_feature 1..30: note = hypo
  source 1..30: mol_type = genomic DNA
gatgaaggatctaagcgctcaggggttgaa

SEQ ID NO: 39945 - DNA, 31 bp, Homo sapiens
  misc_feature 1..31: note = chr3:68834960-68834991
  misc_feature 1..31: note = hypo
  source 1..31: mol_type = genomic DNA
gtgaggactgccagcacgctgtaacctctca

SEQ ID NO: 39946 - DNA, 81 bp, Homo sapiens
  misc_feature 1..81: note = chr3:69741003-69741084
  misc_feature 1..81: note = hypo
  source 1..81: mol_type = genomic DNA
tgggcttgatcttgttataatgtcaccatttctcagatgagaattcagaggctcagaagcacatcgcgagagaatgtggga

SEQ ID NO: 39947 - DNA, 21 bp, Homo sapiens
  misc_feature 1..21: note = chr3:70083716-70083737
  misc_feature 1..21: note = hypo
  source 1..21: mol_type = genomic DNA
aggcgtggtggctcacgctta

SEQ ID NO: 39948 - DNA, 30 bp, Homo sapiens
  misc_feature 1..30: note = chr3:72305951-72305981
  misc_feature 1..30: note = hypo
  source 1..30: mol_type = genomic DNA
ggaaggctgggatttcgcagctctttgcac

SEQ ID NO: 39949 - DNA, 30 bp, Homo sapiens
  misc_feature 1..30: note = chr3:72773579-72773609
  misc_feature 1..30: note = hypo
  source 1..30: mol_type = genomic DNA
cagtataaagaaaaccggcaatggggatgg

SEQ ID NO: 39950 - DNA, 28 bp, Homo sapiens
  misc_feature 1..28: note = chr3:73045129-73045157
  misc_feature 1..28: note = hypo
  source 1..28: mol_type = genomic DNA
tttttgaaacagtctcgctttgtcgcct

SEQ ID NO: 39951 - DNA, 88 bp, Homo sapiens
  misc_feature 1..88: note = chr3:73045517-73045605
  misc_feature 1..88: note = hypo
  source 1..88: mol_type = genomic DNA
tcccaaagtgttgggatcaccggcctgagccccctgcccggcctcgctctacgttttttaggcgcattctgaacgtgaagtgtataca

SEQ ID NO: 39952 - DNA, 165 bp, Homo sapiens
  misc_feature 1..165: note = chr3:73498616-73498781
  misc_feature 1..165: note = hypo
  source 1..165: mol_type = genomic DNA
ccataatccacagtgcgagcaaatcctccgtggatgcatattgatttctgaatcatgatgaggacttgtatattgaacaaataattattttgcttctttctactggcagccacattgttaatcatatcccacgcctcactgttaaataagcgaacaacgcgtgta

SEQ ID NO: 39953 - DNA, 32 bp, Homo sapiens
  misc_feature 1..32: note = chr3:86960228-86960260
  misc_feature 1..32: note = hypo
  source 1..32: mol_type = genomic DNA
tgaaagttgacacttcggccgggcgcggtggc

SEQ ID NO: 39954 - DNA, 28 bp, Homo sapiens
  misc_feature 1..28: note = chr3:87226527-87226555
  misc_feature 1..28: note = hypo
  source 1..28: mol_type = genomic DNA
tcagtgtgtttcacggaatagttttgga

SEQ ID NO: 39955 - DNA, 163 bp, Homo sapiens; identical to SEQ ID NO: 14551
  misc_feature 1..163: note = chr3:87782694-87782857
  misc_feature 1..163: note = hypo
  source 1..163: mol_type = genomic DNA

SEQ ID NO: 39956 - DNA, 28 bp, Homo sapiens
  misc_feature 1..28: note = chr3:87881755-87881783
  misc_feature 1..28: note = hypo
  source 1..28: mol_type = genomic DNA
gcgtgagccaccgcgcccagccagaata

SEQ ID NO: 39957 - DNA, 37 bp, Homo sapiens
  misc_feature 1..37: note = chr3:88248004-88248041
  misc_feature 1..37: note = hypo
  source 1..37: mol_type = genomic DNA
ggattacagggttgagcaaccccgcccgcccgattct

SEQ ID NO: 39958 - DNA, 18 bp, Homo sapiens
  misc_feature 1..18: note = chr3:93697929-93697947
  misc_feature 1..18: note = hypo
  source 1..18: mol_type = genomic DNA
tatttatttttgagacgg

SEQ ID NO: 39959 - DNA, 30 bp, Homo sapiens
  misc_feature 1..30: note = chr3:93801136-93801166
  misc_feature 1..30: note = hypo
  source 1..30: mol_type = genomic DNA
aacttgctagagctacgaatttcaggctct

SEQ ID NO: 39960 - DNA, 52 bp, Homo sapiens
  misc_feature 1..52: note = chr3:97200376-97200428
  misc_feature 1..52: note = hypo
  source 1..52: mol_type = genomic DNA
gggggtccctagagccgccggggcgcggcgcgtccggcgctgggggactgtt

SEQ ID NO: 39961 - DNA, 31 bp, Homo sapiens
  misc_feature 1..31: note = chr3:98029454-98029485
  misc_feature 1..31: note = hypo
  source 1..31: mol_type = genomic DNA
ggcaaaattcacccccgatatttcatgtagg

SEQ ID NO: 39962 - DNA, 153 bp, Homo sapiens
  misc_feature 1..153: note = chr3:101230951-101231104
  misc_feature 1..153: note = hypo
  source 1..153: mol_type = genomic DNA
ccgcgcccggccaataaatctgtaattgttaactgtctctgcagaaaccaacggtaccatcagaaacagaaaaatgaaatgaaataattgattcattgggcgttcgtttgtgtactggactgtaagcatatgagtcctcgtcctctcctccta

SEQ ID NO: 39963 - DNA, 93 bp, Homo sapiens
  misc_feature 1..93: note = chr3:101397204-101397297
  misc_feature 1..93: note = hypo
  source 1..93: mol_type = genomic DNA
tttcccccatggggtcgggcagtgagagcagaagaccaaatgcaccctctgcgaacccaggaggctggtctacgtgtcaggccaaccccactc

SEQ ID NO: 39964 - DNA, 30 bp, Homo sapiens
  misc_feature 1..30: note = chr3:107632034-107632064
  misc_feature 1..30: note = hypo
  source 1..30: mol_type = genomic DNA
tttaaacattggaaccgttggctgaaatgc

SEQ ID NO: 39965 - DNA, 30 bp, Homo sapiens
  misc_feature 1..30: note = chr3:107771985-107772015
  misc_feature 1..30: note = hypo
  source 1..30: mol_type = genomic DNA
cagcagatggaggcacgcctccaggactgc

SEQ ID NO: 39966 - DNA, 30 bp, Homo sapiens; identical to SEQ ID NO: 14555
  misc_feature 1..30: note = chr3:107833994-107834024
  misc_feature 1..30: note = hypo
  source 1..30: mol_type = genomic DNA

SEQ ID NO: 39967 - DNA, 34 bp, Homo sapiens
  misc_feature 1..34: note = chr3:111988003-111988037
  misc_feature 1..34: note = hypo
  source 1..34: mol_type = genomic DNA
gcccgggctggagtgcgatcatagctcactgcag

SEQ ID NO: 39968 - DNA, 18 bp, Homo sapiens
  misc_feature 1..18: note = chr3:113557458-113557476
  misc_feature 1..18: note = hypo
  source 1..18: mol_type = genomic DNA
tttcgcacattggggcag

SEQ ID NO: 39969 - DNA, 30 bp, Homo sapiens
  misc_feature 1..30: note = chr3:113958215-113958245
  misc_feature 1..30: note = hypo
  source 1..30: mol_type = genomic DNA
ccggttgggtcggggcgacctgcaagcttg

SEQ ID NO: 39970 - DNA, 36 bp, Homo sapiens
  misc_feature 1..36: note = chr3:115502421-115502457
  misc_feature 1..36: note = hypo
  source 1..36: mol_type = genomic DNA
aaagaaaacaaaaaaaatgcacggagggaaaacagc

SEQ ID NO: 39971 - DNA, 71 bp, Homo sapiens
  misc_feature 1..71: note = chr3:115752446-115752517
  misc_feature 1..71: note = hypo
  source 1..71: mol_type = genomic DNA
ctccgtaacatgctgcggggccagagcactctagcgaatgatttctgtggcagccacgaccctctgtgact

SEQ ID NO: 39972 - DNA, 148 bp, Homo sapiens
  misc_feature 1..148: note = chr3:116990241-116990389
  misc_feature 1..148: note = hypo
  source 1..148: mol_type = genomic DNA
ctccatcttaaaaaaaaaaaaaaaaaaaaaaaggagcataatctctcaacatctgctaaattaaaaacaaaaggatctggccctttatgtgtcagtaaacaggtaagaactctgttctcaactatgcgaccggcggcagtggcacaaa

SEQ ID NO: 39973 - DNA, 37 bp, Homo sapiens; identical to SEQ ID NO: 14558
  misc_feature 1..37: note = chr3:118976384-118976421
  misc_feature 1..37: note = hypo
  source 1..37: mol_type = genomic DNA

SEQ ID NO: 39974 - DNA, 30 bp, Homo sapiens
  misc_feature 1..30: note = chr3:119055204-119055234
  misc_feature 1..30: note = hypo
  source 1..30: mol_type = genomic DNA
tttacatcagccagtcgctagatgggccat

SEQ ID NO: 39975 - DNA, 98 bp, Homo sapiens
  misc_feature 1..98: note = chr3:119815404-119815502
  misc_feature 1..98: note = hypo
  source 1..98: mol_type = genomic DNA
taattgttaggggcccgatagcagtaggagggtgaaaacaaaatggtttgggaccttaaataattgaaatgtatctttatttatttatttatttttga

SEQ ID NO: 39976 - DNA, 180 bp, Homo sapiens
  misc_feature 1..180: note = chr3:119815742-119815922
  misc_feature 1..180: note = hypo
  source 1..180: mol_type = genomic DNA
gagtgtcaggattacaggcgtaagccaccacaccgggccggttgaaatttatctttaaaatagtgcacctttaatcctttttttatttctgtgtgtatcttataatgtgcatatcatgttagctcaagatcaagagtttatggacaagccaggagtggtggcttatgactgtaatcccag

SEQ ID NO: 39977 - DNA, 18 bp, Homo sapiens
  misc_feature 1..18: note = chr3:119817451-119817469
  misc_feature 1..18: note = hypo
  source 1..18: mol_type = genomic DNA
aaacgctaggattactgg

SEQ ID NO: 39978 - DNA, 25 bp, Homo sapiens
  misc_feature 1..25: note = chr3:121265940-121265965
  misc_feature 1..25: note = hypo
  source 1..25: mol_type = genomic DNA
aaataaaagagatctcgccggccgt

SEQ ID NO: 39979 - DNA, 30 bp, Homo sapiens
  misc_feature 1..30: note = chr3:121438641-121438671
  misc_feature 1..30: note = hypo
  source 1..30: mol_type = genomic DNA
gcaagttacactccccgaatattgcacaaa

SEQ ID NO: 39980 - DNA, 82 bp, Homo sapiens
  misc_feature 1..82: note = chr3:121563924-121564006
  misc_feature 1..82: note = hypo
  source 1..82: mol_type = genomic DNA
gaaaagctctgatgccgaaagaacaaagagtttgtggaataagtgactttacgtagtaaatcatagtataatgaaaaatggg

SEQ ID NO: 39981 - DNA, 34 bp, Homo sapiens
  misc_feature 1..34: note = chr3:121638037-121638071
  misc_feature 1..34: note = hypo
  source 1..34: mol_type = genomic DNA
tctcctgtagtctagcgagcgggagcgtgttacg

SEQ ID NO: 39982 - DNA, 30 bp, Homo sapiens
  misc_feature 1..30: note = chr3:121980857-121980887
  misc_feature 1..30: note = hypo
  source 1..30: mol_type = genomic DNA
cagatcccaggcttccgggaattcctgaag

SEQ ID NO: 39983 - DNA, 30 bp, Homo sapiens
  misc_feature 1..30: note = chr3:122100925-122100955
  misc_feature 1..30: note = hypo
  source 1..30: mol_type = genomic DNA
gggattctaggcactcgattttaaacactc

SEQ ID NO: 39984 - DNA, 38 bp, Homo sapiens
  misc_feature 1..38: note = chr3:122231278-122231316
  misc_feature 1..38: note = hypo
  source 1..38: mol_type = genomic DNA
cataatgcggctgggcgcggtggctcatgcctgtaatc

SEQ ID NO: 39985 - DNA, 32 bp, Homo sapiens
  misc_feature 1..32: note = chr3:122234217-122234249
  misc_feature 1..32: note = hypo
  source 1..32: mol_type = genomic DNA
gcttgataacgtatgcgtagtatcaaaaataa

SEQ ID NO: 39986 - DNA, 91 bp, Homo sapiens
  misc_feature 1..91: note = chr3:122234549-122234640
  misc_feature 1..91: note = hypo
  source 1..91: mol_type = genomic DNA
ataataacaataataataataataataatgaaactacatgaaacacatactcgttttactctcaactgctctcaaacgaaaacttggagca

SEQ ID NO: 39987 - DNA, 29 bp, Homo sapiens
  misc_feature 1..29: note = chr3:122573648-122573677
  misc_feature 1..29: note = hypo
  source 1..29: mol_type = genomic DNA
gactcaaaggctgggcgcggtggctcacg

SEQ ID NO: 39988 - DNA, 148 bp, Homo sapiens
  misc_feature 1..148: note = chr3:122702275-122702423
  misc_feature 1..148: note = hypo
  source 1..148: mol_type = genomic DNA
gcacaataaatcatccgcggggcggggacggggcggggtggtaaaaaaaacctataaagacacacgagaaagccaagctacttttgggggagcacagagaagcttctagaatggctgacagagtcctattacttgacttgggtgatga

SEQ ID NO: 39989 - DNA, 102 bp, Homo sapiens; identical to SEQ ID NO: 14566
  misc_feature 1..102: note = chr3:125456444-125456546
  misc_feature 1..102: note = hypo
  source 1..102: mol_type = genomic DNA

SEQ ID NO: 39990 - DNA, 39 bp, Homo sapiens; identical to SEQ ID NO: 14567
  misc_feature 1..39: note = chr3:125785793-125785832
  misc_feature 1..39: note = hypo
  source 1..39: mol_type = genomic DNA

SEQ ID NO: 39991 - DNA, 98 bp, Homo sapiens
  misc_feature 1..98: note = chr3:126134590-126134688
  misc_feature 1..98: note = hypo
  source 1..98: mol_type = genomic DNA
gacacggggcggggtcggggtgtggggaggtgagtcctgccttcctgctcctccgaaagttttctcccaagggagggctggctcgaagccacccccag

SEQ ID NO: 39992 - DNA, 35 bp, Homo sapiens
  misc_feature 1..35: note = chr3:126138969-126139004
  misc_feature 1..35: note = hypo
  source 1..35: mol_type = genomic DNA
ggaggtttctgcagacgatgcggctggggcggagc

SEQ ID NO: 39993 - DNA, 167 bp, Homo sapiens
  misc_feature 1..167: note = chr3:126195886-126196053
  misc_feature 1..167: note = hypo
  source 1..167: mol_type = genomic DNA
cccccacccctcccccgcaccccacctctttttcccagttcatccagcaagccaagctggttccagcctcagagacttggcgcagctgatctctgattcctctgggaggactctgcgccccttctgatccaaagcacatgcttacccagtcccgtattcccacctct

SEQ ID NO: 39994 - DNA, 77 bp, Homo sapiens
  misc_feature 1..77: note = chr3:127394832-127394909
  misc_feature 1..77: note = hypo
  source 1..77: mol_type = genomic DNA
accttcgatggtgagcgctgcctctatggggcactgagtgaccccatccgccgggctctacgcgattacaagcaggt

SEQ ID NO: 39995 - DNA, 48 bp, Homo sapiens
  misc_feature 1..48: note = chr3:127395914-127395962
  misc_feature 1..48: note = hypo
  source 1..48: mol_type = genomic DNA
tgtctgagtttggtgcgagcagggtttggggcccggggccatgggtgc

SEQ ID NO: 39996 - DNA, 68 bp, Homo sapiens
  misc_feature 1..68: note = chr3:127534964-127535032
  misc_feature 1..68: note = hypo
  source 1..68: mol_type = genomic DNA
cccagggagcatctgcgctaaaccagctggctggtgatgcgggaacacctagtcgcaggtggcgtgag

SEQ ID NO: 39997 - DNA, 90 bp, Homo sapiens
  misc_feature 1..90: note = chr3:127536741-127536831
  misc_feature 1..90: note = hypo
  source 1..90: mol_type = genomic DNA
tgggccagtctccatcgccgtgctgatagcatcagtggacatttgctcatgatccagtatccccccctttttctttttttgagatggagt

SEQ ID NO: 39998 - DNA, 52 bp, Homo sapiens
  misc_feature 1..52: note = chr3:127637657-127637709
  misc_feature 1..52: note = hypo
  source 1..52: mol_type = genomic DNA
aggaaagtcaggagacgaggcaggaaagtttgggaggcgccagaatgcctga

SEQ ID NO: 39999 - DNA, 30 bp, Homo sapiens
  misc_feature 1..30: note = chr3:128346689-128346719
  misc_feature 1..30: note = hypo
  source 1..30: mol_type = genomic DNA
aacatgccagcaagacgcccataaaaacga

SEQ ID NO: 40000 - DNA, 80 bp, Homo sapiens
  misc_feature 1..80: note = chr3:128599546-128599626
  misc_feature 1..80: note = hypo
  source 1..80: mol_type = genomic DNA
gccttaaaatggagatagtgttgtgtctccttcacagatgtgttgtagagccccagtgagataaacggtgcatggagagt

SEQ ID NO: 40001 - DNA, 34 bp, Homo sapiens
  misc_feature 1..34: note = chr3:128611894-128611928
  misc_feature 1..34: note = hypo
  source 1..34: mol_type = genomic DNA
caattttattctggccgggcgtggtggctcacac

SEQ ID NO: 40002 - DNA, 30 bp, Homo sapiens
  misc_feature 1..30: note = chr3:128765921-128765951
  misc_feature 1..30: note = hypo
  source 1..30: mol_type = genomic DNA
ggaggcccctctgtgcggccagcttcgtcc

SEQ ID NO: 40003 - DNA, 41 bp, Homo sapiens
  misc_feature 1..41: note = chr3:128790177-128790218
  misc_feature 1..41: note = hypo
  source 1..41: mol_type = genomic DNA
tgattaagacaccaccgcgtggcgcccgctggagtggacca

SEQ ID NO: 40004 - DNA, 72 bp, Homo sapiens
  misc_feature 1..72: note = chr3:130127080-130127152
  misc_feature 1..72: note = hypo
  source 1..72: mol_type = genomic DNA
atcaccctgggaaaacgaatgcattcccggtgtgggggtggtggcagggggtgggggcgggtctctaaaatg

SEQ ID NO: 40005 - DNA, 217 bp, Homo sapiens
  misc_feature 1..217: note = chr3:130474409-130474626
  misc_feature 1..217: note = hypo
  source 1..217: mol_type = genomic DNA
tagcagtaacatagtcgtttattgtcattaccaagtattctgtattgtgcatagttgtatgtgctagactgttatatgactggcaatgcaggttattttgcaccagcatcaccacaaacaggtgagcaatagaaatttttcagctccattataatcttatgggacgttgtatatgtggtccatcattgaacacatttttatgcggccattggcggta

SEQ ID NO: 40006 - DNA, 39 bp, Homo sapiens
  misc_feature 1..39: note = chr3:130519901-130519940
  misc_feature 1..39: note = hypo
  source 1..39: mol_type = genomic DNA
tgtaaattggccaggcgtcgtggctcatgcctgtaatcc

SEQ ID NO: 40007 - DNA, 30 bp, Homo sapiens
  misc_feature 1..30: note = chr3:133101687-133101717
  misc_feature 1..30: note = hypo
  source 1..30: mol_type = genomic DNA
gcctctcatagctttcggtctccttcaggt

SEQ ID NO: 40008 - DNA, 220 bp, Homo sapiens
  misc_feature 1..220: note = chr3:134320427-134320647
  misc_feature 1..220: note = hypo
  source 1..220: mol_type = genomic DNA
tagctgttatgcctccggggcctttgtgcatttttcaggtgtgagtgacacgaggctggctgggtggcctcggtggcagagactgcggagggcgcaggacctgcccaggacagttcagccccccaggggagacaccccttttgctcgaggccgccggcctgttggatgatgggcacccttgtgagctggttctgggctaggccaccgtgctgggtggcag

SEQ ID NO: 40009 - DNA, 30 bp, Homo sapiens
  misc_feature 1..30: note = chr3:134624264-134624294
  misc_feature 1..30: note = hypo
  source 1..30: mol_type = genomic DNA
ttctcttgtcattcccggcattactgactg

SEQ ID NO: 40010 - DNA, 120 bp, Homo sapiens
  misc_feature 1..120: note = chr3:136582940-136583060
  misc_feature 1..120: note = hypo
  source 1..120: mol_type = genomic DNA
tcaaaaaaataaataaaatgtgtatttatttttctaggcattatcctttgtccaggtttctgcagtgctttcaggtccatctaaataaaatttgaaacctacgtgtaatgttggccgggc

SEQ ID NO: 40011 - DNA, 17 bp, Homo sapiens
  misc_feature 1..17: note = chr3:137561189-137561206
  misc_feature 1..17: note = hypo
  source 1..17: mol_type = genomic DNA
agtctagctattggccg

SEQ ID NO: 40012 - DNA, 84 bp, Homo sapiens
  misc_feature 1..84: note = chr3:137717830-137717914
  misc_feature 1..84: note = hypo
  source 1..84: mol_type = genomic DNA
acagctgttttcaactaccaggggctgtggcgctcctgtgtccgagagagctctggcttcaccgagtgccggggctacttcacc

SEQ ID NO: 40013 - DNA, 22 bp, Homo sapiens
  misc_feature 1..22: note = chr3:138058968-138058990
  misc_feature 1..22: note = hypo
  source 1..22: mol_type = genomic DNA
gccaccgcgcccagccagcatc

SEQ ID NO: 40014 - DNA, 236 bp, Homo sapiens
  misc_feature 1..236: note = chr3:141174296-141174532
  misc_feature 1..236: note = hypo
  source 1..236: mol_type = genomic DNA
ggccgccattttcgtcgtctcttatcacgatgggaatcagcgttctctgctgctgctcctgctgaacacgacgacattccagccaccgggaactgctcgggactcagtatcattctcagacctaggcaggagcgttccgtgcttgccctcctccacaggtgccccgccgcacggggcaaagagtctgcagggccaacagggatgtgcccccgcaatgtccacgccatccccagaga

SEQ ID NO: 40015 - DNA, 138 bp, Homo sapiens
  misc_feature 1..138: note = chr3:141481968-141482106
  misc_feature 1..138: note = hypo
  source 1..138: mol_type = genomic DNA
ctattcggccatcttggctcctcctccagatcttcttaaggatgaaaaatatgggcttggattcttcccatacctcatgcttcaaatagccgttgatgaccctgaagccatagtgctgtgtttcggtcaaacaacagc

SEQ ID NO: 40016 - DNA, 30 bp, Homo sapiens
  misc_feature 1..30: note = chr3:142337360-142337390
  misc_feature 1..30: note = hypo
  source 1..30: mol_type = genomic DNA
gctctaggggagaatcgttttcatggctca

SEQ ID NO: 40017 - DNA, 28 bp, Homo sapiens
  misc_feature 1..28: note = chr3:142791151-142791179
  misc_feature 1..28: note = hypo
  source 1..28: mol_type = genomic DNA
atattaagactgtcacgcgcgttcgtgt

SEQ ID NO: 40018 - DNA, 17 bp, Homo sapiens
  misc_feature 1..17: note = chr3:142802592-142802609
  misc_feature 1..17: note = hypo
  source 1..17: mol_type = genomic DNA
agcgtgagccaccgtgc

SEQ ID NO: 40019 - DNA, 24 bp, Homo sapiens
  misc_feature 1..24: note = chr3:142853160-142853184
  misc_feature 1..24: note = hypo
  source 1..24: mol_type = genomic DNA
gggctcaagcgatcctcccatcta

SEQ ID NO: 40020 - DNA, 30 bp, Homo sapiens
  misc_feature 1..30: note = chr3:142896285-142896315
  misc_feature 1..30: note = hypo
  source 1..30: mol_type = genomic DNA
catcactccgacgctcgatggggccagggg

SEQ ID NO: 40021 - DNA, 35 bp, Homo sapiens; identical to SEQ ID NO: 5001
  misc_feature 1..35: note = chr3:142913215-142913250
  misc_feature 1..35: note = hypo
  source 1..35: mol_type = genomic DNA

SEQ ID NO: 40022 - DNA, 30 bp, Homo sapiens
  misc_feature 1..30: note = chr3:142973621-142973651
  misc_feature 1..30: note = hypo
  source 1..30: mol_type = genomic DNA
gccacatgaactccacgtgactacttgaat

SEQ ID NO: 40023 - DNA, 30 bp, Homo sapiens
  misc_feature 1..30: note = chr3:142973851-142973881
  misc_feature 1..30: note = hypo
  source 1..30: mol_type = genomic DNA
tgtaggctggcaggccgagtaactgcctct

SEQ ID NO: 40024 - DNA, 21 bp, Homo sapiens
  misc_feature 1..21: note = chr3:142977041-142977062
  misc_feature 1..21: note = hypo
  source 1..21: mol_type = genomic DNA
acagagcgatactccatctca

SEQ ID NO: 40025 - DNA, 45 bp, Homo sapiens; identical to SEQ ID NO: 14579
  misc_feature 1..45: note = chr3:143092973-143093018
  misc_feature 1..45: note = hypo
  source 1..45: mol_type = genomic DNA

SEQ ID NO: 40026 - DNA, 34 bp, Homo sapiens
  misc_feature 1..34: note = chr3:143151477-143151511
  misc_feature 1..34: note = hypo
  source 1..34: mol_type = genomic DNA
attatttttttgagacggagtctcattctgttgc

SEQ ID NO: 40027 - DNA, 38 bp, Homo sapiens
  misc_feature 1..38: note = chr3:143210840-143210878
  misc_feature 1..38: note = hypo
  source 1..38: mol_type = genomic DNA
cacctaccacttggccgggtgtggtggctcaagcctgt

SEQ ID NO: 40028 - DNA, 58 bp, Homo sapiens
  misc_feature 1..58: note = chr3:146187920-146187978
  misc_feature 1..58: note = hypo
  source 1..58: mol_type = genomic DNA
gtgaaaatgatgaggcgtgtagaatgtttaatttttcaggacgcgcctttgatttttc

SEQ ID NO: 40029 - DNA, 37 bp, Homo sapiens
  misc_feature 1..37: note = chr3:146188305-146188342
  misc_feature 1..37: note = hypo
  source 1..37: mol_type = genomic DNA
gcctgggagagagagcaagactcgtctcaaacaaaca

SEQ ID NO: 40030 - DNA, 43 bp, Homo sapiens
  misc_feature 1..43: note = chr3:148472167-148472210
  misc_feature 1..43: note = hypo
  source 1..43: mol_type = genomic DNA
ccataaaggtctggccgggcgcggtggctcacacctgtaattc

SEQ ID NO: 40031 - DNA, 20 bp, Homo sapiens
  misc_feature 1..20: note = chr3:148556015-148556035
  misc_feature 1..20: note = hypo
  source 1..20: mol_type = genomic DNA
cagagcgagactctgtctca

SEQ ID NO: 40032 - DNA, 41 bp, Homo sapiens
  misc_feature 1..41: note = chr3:148705411-148705452
  misc_feature 1..41: note = hypo
  source 1..41: mol_type = genomic DNA
ccgaatggggggcctcgtctcggccccgctcggctccgcca

SEQ ID NO: 40033 - DNA, 27 bp, Homo sapiens
  misc_feature 1..27: note = chr3:148802983-148803010
  misc_feature 1..27: note = hypo
  source 1..27: mol_type = genomic DNA
actacaattatgggccggatgcggtgg

SEQ ID NO: 40034 - DNA, 26 bp, Homo sapiens
  misc_feature 1..26: note = chr3:148803250-148803276
  misc_feature 1..26: note = hypo
  source 1..26: mol_type = genomic DNA
ggacgacagagcgagactccatgtca

SEQ ID NO: 40035 - DNA, 30 bp, Homo sapiens
  misc_feature 1..30: note = chr3:149956581-149956611
  misc_feature 1..30: note = hypo
  source 1..30: mol_type = genomic DNA
tctgcacaccttgtccgaggctccgatgtt

SEQ ID NO: 40036 - DNA, 161 bp, Homo sapiens; identical to SEQ ID NO: 14584
  misc_feature 1..161: note = chr3:150135175-150135336
  misc_feature 1..161: note = hypo
  source 1..161: mol_type = genomic DNA

SEQ ID NO: 40037 - DNA, 88 bp, Homo sapiens
  misc_feature 1..88: note = chr3:150237908-150237996
  misc_feature 1..88: note = hypo
  source 1..88: mol_type = genomic DNA
ctcgtgatccgcccgcctcggcatcccaaagtgcactccaggttttaattacctctcgggtgattgtggtgcacgctcaagtttgaga

SEQ ID NO: 40038 - DNA, 90 bp, Homo sapiens
  misc_feature 1..90: note = chr3:152321039-152321129
  misc_feature 1..90: note = hypo
  source 1..90: mol_type = genomic DNA
gttctcattcagacacgaatgtgagctgcttcttctgcatagagctcagtatggttgcctgacaatctatttttttttttttaagacgga

SEQ ID NO: 40039 - DNA, 30 bp, Homo sapiens
  misc_feature 1..30: note = chr3:152332728-152332758
  misc_feature 1..30: note = hypo
  source 1..30: mol_type = genomic DNA
tgccatctcatataacgatattatggactg

SEQ ID NO: 40040 - DNA, 27 bp, Homo sapiens
  misc_feature 1..27: note = chr3:152829598-152829625
  misc_feature 1..27: note = hypo
  source 1..27: mol_type = genomic DNA
ggcgtgagcgaccgcacccagctgata

SEQ ID NO: 40041 - DNA, 30 bp, Homo sapiens
  misc_feature 1..30: note = chr3:152877598-152877628
  misc_feature 1..30: note = hypo
  source 1..30: mol_type = genomic DNA
gtgagttcagagtcccgaccagatcctgaa

SEQ ID NO: 40042 - DNA, 25 bp, Homo sapiens
  misc_feature 1..25: note = chr3:152979662-152979687
  misc_feature 1..25: note = hypo
  source 1..25: mol_type = genomic DNA
ccaccacgtccggccaactcatatt

SEQ ID NO: 40043 - DNA, 30 bp, Homo sapiens
  misc_feature 1..30: note = chr3:152999015-152999045
  misc_feature 1..30: note = hypo
  source 1..30: mol_type = genomic DNA
catgagaggtgacaacgtgctagcagccct

SEQ ID NO: 40044 - DNA, 18 bp, Homo sapiens
  misc_feature 1..18: note = chr3:153018756-153018774
  misc_feature 1..18: note = hypo
  source 1..18: mol_type = genomic DNA
aaaaatatgattggccgg

SEQ ID NO: 40045 - DNA, 23 bp, Homo sapiens
  misc_feature 1..23: note = chr3:154623592-154623615
  misc_feature 1..23: note = hypo
  source 1..23: mol_type = genomic DNA
cgagactccgtctcaaaaaaaat

SEQ ID NO: 40046 - DNA, 101 bp, Homo sapiens
  misc_feature 1..101: note = chr3:157303466-157303567
  misc_feature 1..101: note = hypo
  source 1..101: mol_type = genomic DNA
ttatggctttctctgcggctcgttgcatctctattcataaacccttgatcggctatttccagtaactgtgaggtattcatacccacaaacccagcctgttt

SEQ ID NO: 40047 - DNA, 30 bp, Homo sapiens
  misc_feature 1..30: note = chr3:166984418-166984448
  misc_feature 1..30: note = hypo
  source 1..30: mol_type = genomic DNA
cagaaatagggatgacgttaagggtataaa

SEQ ID NO: 40048 - DNA, 30 bp, Homo sapiens
  misc_feature 1..30: note = chr3:168490451-168490481
  misc_feature 1..30: note = hypo
  source 1..30: mol_type = genomic DNA
tcccctgaaaatgttcgatcattattcaca

SEQ ID NO: 40049 - DNA, 64 bp, Homo sapiens
  misc_feature 1..64: note = chr3:169485397-169485461
  misc_feature 1..64: note = hypo
  source 1..64: mol_type = genomic DNA
atatccttaactaaccgcttgtctaaaccagggaaagaggttgatcccccggcaaggataatat

SEQ ID NO: 40050 - DNA, 562 bp, Homo sapiens
  misc_feature 1..562: note = chr3:169540047-169540609
  misc_feature 1..562: note = hypo
  source 1..562: mol_type = genomic DNA
tgtcagcttcctccacgccctgcgcgagctccggctctaccagaccgacctgaaggaaattcccgtcgtcatctttaaaaacctccaccatctcgagctgctcggactgaccggaaaccacctgaaatgtctgcccaaggaaatagtgaaccagaccaagctgagggagatctacctgaagcgaaaccagtttgaagttttcccccaggagctctgtgttctctacaccctggaaatcattgacctggacgagaacaaaataggtgccatcccagaagagatcggacacctgacggggctgcagaagttctatatggcttctaacaaccttcccgttctgcccgcgtccttgtgccagtgtagccaactgtcggtgctcgatttatcccacaacctcctccactccatcccgaagagcttcgccgagctcaggaagatgacggaaatcgggctgagcgggaaccgcctggagaaggtgccacgcctcatttgcaggtggacctcgctgcacctgctctacctgggaaacaccggcctgcacaggctgcggggctccttcagg

SEQ ID NO: 40051 - DNA, 79 bp, Homo sapiens
  misc_feature 1..79: note = chr3:169541070-169541149
  misc_feature 1..79: note = hypo
  source 1..79: mol_type = genomic DNA
tgtaagtgctgcagccgcgattccagcccacagctgccaggctccagggtctacattcttttttttttttttttctctt

SEQ ID NO: 40052 - DNA, 42 bp, Homo sapiens
  misc_feature 1..42: note = chr3:169980664-169980706
  misc_feature 1..42: note = hypo
  source 1..42: mol_type = genomic DNA
accttcttttgtggccgggcgcggtgactcacgcctgtaatc

SEQ ID NO: 40053 - DNA, 33 bp, Homo sapiens
  misc_feature 1..33: note = chr3:171193088-171193121
  misc_feature 1..33: note = hypo
  source 1..33: mol_type = genomic DNA
aggtacagtggctctcgcctgtaatcccagcac

SEQ ID NO: 40054 - DNA, 145 bp, Homo sapiens
  misc_feature 1..145: note = chr3:172033174-172033319
  misc_feature 1..145: note = hypo
  source 1..145: mol_type = genomic DNA
aaaaaaggaatttacaggtgtcattggcttttcagctgtggccttcagtttcgattttcacctgaaacaggtcagtttttattacttgagaaggtgtggccattccttgccaagttcccttgtggtgactcgtgagctttagtgt

SEQ ID NO: 40055 - DNA, 58 bp, Homo sapiens; identical to SEQ ID NO: 14590
  misc_feature 1..58: note = chr3:172384961-172385019
  misc_feature 1..58: note = hypo
  source 1..58: mol_type = genomic DNA

SEQ ID NO: 40056 - DNA, 18 bp, Homo sapiens
  misc_feature 1..18: note = chr3:172425382-172425400
  misc_feature 1..18: note = hypo
  source 1..18: mol_type = genomic DNA
attatttttttgagacgg

SEQ ID NO: 40057 - DNA, 17 bp, Homo sapiens
  misc_feature 1..17: note = chr3:172425700-172425717
  misc_feature 1..17: note = hypo
  source 1..17: mol_type = genomic DNA
aacgttcatctcccaga

SEQ ID NO: 40058 - DNA, 31 bp, Homo sapiens
  misc_feature 1..31: note = chr3:172469925-172469956
  misc_feature 1..31: note = hypo
  source 1..31: mol_type = genomic DNA
ttttttttttttagacggagtctacctcttg

SEQ ID NO: 40059 - DNA, 31 bp, Homo sapiens
  misc_feature 1..31: note = chr3:172470196-172470227
  misc_feature 1..31: note = hypo
  source 1..31: mol_type = genomic DNA
tgtgagccaccgcgtccggcctttcaaatgg

SEQ ID NO: 40060 - DNA, 162 bp, Homo sapiens
  misc_feature 1..162: note = chr3:172727266-172727428
  misc_feature 1..162: note = hypo
  source 1..162: mol_type = genomic DNA
tgcctggaatctgtgcggaggcaccactcaagcccatgtgaagcccaatggatcttggatcccagagcaccctagagccagctacagtagccccaccaacaggggaggctaggctctttcgcatgcccttaggatagctgcagcagccgcagtgctcaggag

SEQ ID NO: 40061 - DNA, 92 bp, Homo sapiens
  misc_feature 1..92: note = chr3:172858998-172859090
  misc_feature 1..92: note = hypo
  source 1..92: mol_type = genomic DNA
atcaggctgcttgctcgcggggacgccaggacttgaaacgtcccgtgccacgaggcccatcgcgcccacaagtggcgcgggtcactggcacc

SEQ ID NO: 40062 - DNA, 24 bp, Homo sapiens
  misc_feature 1..24: note = chr3:176545097-176545121
  misc_feature 1..24: note = hypo
  source 1..24: mol_type = genomic DNA
aaaagagaatttttccgacgggtg

SEQ ID NO: 40063 - DNA, 41 bp, Homo sapiens
  misc_feature 1..41: note = chr3:176872455-176872496
  misc_feature 1..41: note = hypo
  source 1..41: mol_type = genomic DNA
tacaggcatgagccaccgcgcccggccgacagaacttttta

SEQ ID NO: 40064 - DNA, 77 bp, Homo sapiens
  misc_feature 1..77: note = chr3:176897068-176897145
  misc_feature 1..77: note = hypo
  source 1..77: mol_type = genomic DNA
agtgtactttgagctcgactattgttacctgatgcaaaacatgaatatgctggggaaaatcacgtatgaaccagagc

SEQ ID NO: 40065 - DNA, 28 bp, Homo sapiens
  misc_feature 1..28: note = chr3:178577720-178577748
  misc_feature 1..28: note = hypo
  source 1..28: mol_type = genomic DNA
aaacaaaataaagttcggaaggggagcc

SEQ ID NO: 40066 - DNA, 34 bp, Homo sapiens
  misc_feature 1..34: note = chr3:178861413-178861447
  misc_feature 1..34: note = hypo
  source 1..34: mol_type = genomic DNA
ggctgaaaatagtcttttacgaatttcaaagctt

SEQ ID NO: 40067 - DNA, 30 bp, Homo sapiens
  misc_feature 1..30: note = chr3:179136841-179136871
  misc_feature 1..30: note = hypo
  source 1..30: mol_type = genomic DNA
cataggtgttcaatacgtatttgcttatga

SEQ ID NO: 40068 - DNA, 23 bp, Homo sapiens
  misc_feature 1..23: note = chr3:179171196-179171219
  misc_feature 1..23: note = hypo
  source 1..23: mol_type = genomic DNA
accgatcccggccccatattctt

SEQ ID NO: 40069 - DNA, 23 bp, Homo sapiens
  misc_feature 1..23: note = chr3:179367897-179367920
  misc_feature 1..23: note = hypo
  source 1..23: mol_type = genomic DNA
acccgcctcggcctcccaaagtg

SEQ ID NO: 40070 - DNA, 30 bp, Homo sapiens
  misc_feature 1..30: note = chr3:180042862-180042892
  misc_feature 1..30: note = hypo
  source 1..30: mol_type = genomic DNA
cggccgtctggagtccgcgagactgaaagg

SEQ ID NO: 40071 - DNA, 323 bp, Homo sapiens
  misc_feature 1..323: note = chr3:182314974-182315297
  misc_feature 1..323: note = hypo
  source 1..323: mol_type = genomic DNA
ccggaagcagtgaaacgcactgggcttattgcaacaaccccagctactgaaaatgccaccctctccacgacgaagcaccgccagtcccaaactccaatcagccgctgggctgggaggccgaaaaggcaagaagacacagagcggggttgaaatgaagaaggaactctttttcaacgagactcattacagtatgcaaaacctaaaaaactgtaccctgtgttgtaatgagaatatgactgcatgggaaatgtgggttacaactcttgactttacctgcttttcacatattttcacatagtgagtaaaatcgctgtgggaggaaa

SEQ ID NO: 40072 - DNA, 21 bp, Homo sapiens
  misc_feature 1..21: note = chr3:182704506-182704527
  misc_feature 1..21: note = hypo
  source 1..21: mol_type = genomic DNA
agcaaatgggctgggcgcggt

SEQ ID NO: 40073 - DNA, 30 bp, Homo sapiens
  misc_feature 1..30: note = chr3:182800477-182800507
  misc_feature 1..30: note = hypo
  source 1..30: mol_type = genomic DNA
cgagtgtggccagggcggtggctcacgtcg

SEQ ID NO: 40074 - DNA, 19 bp, Homo sapiens
  misc_feature 1..19: note = chr3:182812783-182812802
  misc_feature 1..19: note = hypo
  source 1..19: mol_type = genomic DNA
tgccctggccaggcacggt

SEQ ID NO: 40075 - DNA, 18 bp, Homo sapiens
  misc_feature 1..18: note = chr3:182816009-182816027
  misc_feature 1..18: note = hypo
  source 1..18: mol_type = genomic DNA
ccccgccaacttccaaca

SEQ ID NO: 40076 - DNA, 41 bp, Homo sapiens
  misc_feature 1..41: note = chr3:182895956-182895997
  misc_feature 1..41: note = hypo
  source 1..41: mol_type = genomic DNA
attaaaaataaattccggctgggcgcggtggctcacgcctg

SEQ ID NO: 40077 - DNA, 52 bp, Homo sapiens
  misc_feature 1..52: note = chr3:182987877-182987929
  misc_feature 1..52: note = hypo
  source 1..52: mol_type = genomic DNA
cctgaaaactatgatcgacgttccggaattagaaggacgtggggcaatgaaa

SEQ ID NO: 40078 - DNA, 30 bp, Homo sapiens
  misc_feature 1..30: note = chr3:183035309-183035339
  misc_feature 1..30: note = hypo
  source 1..30: mol_type = genomic DNA
ggacagggtgccttccgtagtcctttttct

SEQ ID NO: 40079 - DNA, 29 bp, Homo sapiens
  misc_feature 1..29: note = chr3:183183673-183183702
  misc_feature 1..29: note = hypo
  source 1..29: mol_type = genomic DNA
gtgagccactgccccgggccatgaaaaaa

SEQ ID NO: 40080 - DNA, 30 bp, Homo sapiens
  misc_feature 1..30: note = chr3:183603067-183603097
  misc_feature 1..30: note = hypo
  source 1..30: mol_type = genomic DNA
ccctagaggaaccaacgtggcaagccaagt

SEQ ID NO: 40081 - DNA, 172 bp, Homo sapiens
  misc_feature 1..172: note = chr3:183622013-183622185
  misc_feature 1..172: note = hypo
  source 1..172: mol_type = genomic DNA
gaggtcacacactggcgcacggcacccatggccatgacgctgctgaggcgctgcacgtcatggaggacagcatggtgtaaggcagtcgcttgcggtcttcatagcagacaaccggggcagcacccagcacctcgtccagctccagctgcaccgtctccgcaggtggcttagt

SEQ ID NO: 40082 - DNA, 30 bp, Homo sapiens; identical to SEQ ID NO: 14600
  misc_feature 1..30: note = chr3:183648152-183648182
  misc_feature 1..30: note = hypo
  source 1..30: mol_type = genomic DNA

SEQ ID NO: 40083 - DNA, 222 bp, Homo sapiens
  misc_feature 1..222: note = chr3:183684023-183684245
  misc_feature 1..222: note = hypo
  source 1..222: mol_type = genomic DNA
aacaccctcacacagcgtgtacacacacaggtgtacctacgtacaccacaaactggtagcattctgatgtgcacttcaaagggttcagaagtccccagggggtctactgtggaaagccggcacttctggctgctgcacaaacaccgcacattgcagcgctatcaacagatgtaaactacagttaaagcagggctgaccagcccaacccgtttccctgccaga

SEQ ID NO: 40084 - DNA, 34 bp, Homo sapiens
  misc_feature 1..34: note = chr3:183713864-183713898
  misc_feature 1..34: note = hypo
  source 1..34: mol_type = genomic DNA
gattacaggtgtaagccaccgtgtccggccagaa

SEQ ID NO: 40085 - DNA, 17 bp, Homo sapiens
  misc_feature 1..17: note = chr3:183728806-183728823
  misc_feature 1..17: note = hypo
  source 1..17: mol_type = genomic DNA
ggcgtgagccaccgtgc

SEQ ID NO: 40086 - DNA, 16 bp, Homo sapiens
  misc_feature 1..16: note = chr3:183965935-183965951
  misc_feature 1..16: note = hypo
  source 1..16: mol_type = genomic DNA
ccggcagaaatgcatc

SEQ ID NO: 40087 - DNA, 26 bp, Homo sapiens
  misc_feature 1..26: note = chr3:184016195-184016221
  misc_feature 1..26: note = hypo
  source 1..26: mol_type = genomic DNA
atgaggttaataggccgggcgcggtg

SEQ ID NO: 40088 - DNA, 149 bp, Homo sapiens
  misc_feature 1..149: note = chr3:184018038-184018187
  misc_feature 1..149: note = hypo
  source 1..149: mol_type = genomic DNA
ttgtctgagccctgtcgtctcttgatcaggagaaggatacatccctgtatcgaccagcgctggaggaattgcgaaggcagattcgttcttctacaacttccatgacttcagtgcccaagcctctcaaatttctgcgtccacactatggc

SEQ ID NO: 40089 - DNA, 26 bp, Homo sapiens
  misc_feature 1..26: note = chr3:184057527-184057553
  misc_feature 1..26: note = hypo
  source 1..26: mol_type = genomic DNA
gtgagccactgcgcccggcctgagaa

SEQ ID NO: 40090 - DNA, 71 bp, Homo sapiens
  misc_feature 1..71: note = chr3:184200659-184200730
  misc_feature 1..71: note = hypo
  source 1..71: mol_type = genomic DNA
taaagtgagtgcctccgtgggtctccccgaggcatgaaggtgctggattgaatgtgcgtggagaatctcag

SEQ ID NO: 40091 - DNA, 30 bp, Homo sapiens
  misc_feature 1..30: note = chr3:184226786-184226816
  misc_feature 1..30: note = hypo
  source 1..30: mol_type = genomic DNA
actctggaatctcaccggcccaagaatcag

SEQ ID NO: 40092 - DNA, 109 bp, Homo sapiens
  misc_feature 1..109: note = chr3:184785147-184785256
  misc_feature 1..109: note = hypo
  source 1..109: mol_type = genomic DNA
acactgggctggctgcggtgaacacaaaagggagccgtacacagccctgccctcaggcacctgccggctggggaaggacacgttcagcaggaaacgctcccatagctct

SEQ ID NO: 40093 - DNA, 29 bp, Homo sapiens
  misc_feature 1..29: note = chr3:185001906-185001935
  misc_feature 1..29: note = hypo
  source 1..29: mol_type = genomic DNA
tgaaccactacgcgcggccactttccttt

SEQ ID NO: 40094 - DNA, 23 bp, Homo sapiens
  misc_feature 1..23: note = chr3:185270882-185270905
  misc_feature 1..23: note = hypo
  source 1..23: mol_type = genomic DNA
aaaagaaaaacaggccggcacgg

SEQ ID NO: 40095 - DNA, 87 bp, Homo sapiens
  misc_feature 1..87: note = chr3:185271296-185271383
  misc_feature 1..87: note = hypo
  source 1..87: mol_type = genomic DNA
taattccctttctggcgagagtgcttgcaacactaactcaggcttctagtggtctgatgagcttaaaaatcaattaataagccgggc

SEQ ID NO: 40096 - DNA, 30 bp, Homo sapiens; identical to SEQ ID NO: 14609
  misc_feature 1..30: note = chr3:185278325-185278355
  misc_feature 1..30: note = hypo
  source 1..30: mol_type = genomic DNA

SEQ ID NO: 40097 - DNA, 304 bp, Homo sapiens
  misc_feature 1..304: note = chr3:185363001-185363305
  misc_feature 1..304: note = hypo
  source 1..304: mol_type = genomic DNA
aactaaaagggatagcgtcgtgggagttcaggagagatccgagtggatggtgaagtggatggctgaagcctgcagaagccctggggggcgggaggcggggctcggtggttctggcaaacctggctgaccttccccgcccctcctcggcccctggggttctcagggcctcggcagagtccctggccgcctccgcagacttctcattcctcagatggtctttggtttgctcccgatctggctggctgcgtttggtctcattctgtcaggtgttggaagggctacattcatccgttgttttgctggt

SEQ ID NO: 40098 - DNA, 136 bp, Homo sapiens
  misc_feature 1..136: note = chr3:185385541-185385677
  misc_feature 1..136: note = hypo
  source 1..136: mol_type = genomic DNA
cacctcattttattgcgtttggctttattgaactttgcagataatcgtgttttttacaaactggaaggcttgtggcaaccctatgtcacacaagtctattggtatcatttgtccaaatgcgcgtgctcactttgtg

SEQ ID NO: 40099 - DNA, 30 bp, Homo sapiens
  misc_feature 1..30: note = chr3:185504526-185504556
  misc_feature 1..30: note = hypo
  source 1..30: mol_type = genomic DNA
aaccctcttaagatacgtggaaacctacat

SEQ ID NO: 40100 - DNA, 25 bp, Homo sapiens
  misc_feature 1..25: note = chr3:185551925-185551950
  misc_feature 1..25: note = hypo
  source 1..25: mol_type = genomic DNA
atcccaggctgggtgcggtggctca

SEQ ID NO: 40101 - DNA, 66 bp, Homo sapiens
  misc_feature 1..66: note = chr3:185643324-185643390
  misc_feature 1..66: note = hypo
  source 1..66: mol_type = genomic DNA
ctgtaagacctgctacgtgatcgtctatgggagcgggagcgagaccgtgaccgggtataatgcctt

SEQ ID NO: 40102 - DNA, 91 bp, Homo sapiens
  misc_feature 1..91: note = chr3:185667518-185667609
  misc_feature 1..91: note = hypo
  source 1..91: mol_type = genomic DNA
ctctaattcagactgcgtggcttacttctaagtgtcttaacggagactgtgctgatattgttcttctatttgatacctgtcaggcctctga

SEQ ID NO: 40103 - DNA, 21 bp, Homo sapiens
  misc_feature 1..21: note = chr3:186019128-186019149
  misc_feature 1..21: note = hypo
  source 1..21: mol_type = genomic DNA
tccatgtgacgggtgcggtgg

SEQ ID NO: 40104 - DNA, 30 bp, Homo sapiens
  misc_feature 1..30: note = chr3:186495172-186495202
  misc_feature 1..30: note = hypo
  source 1..30: mol_type = genomic DNA
aatgactaatacacacggcatacaatttac

SEQ ID NO: 40105 - DNA, 78 bp, Homo sapiens
  misc_feature 1..78: note = chr3:186527185-186527263
  misc_feature 1..78: note = hypo
  source 1..78: mol_type = genomic DNA
ccctgtgaagttttttaatcttaaaagagggctttcaaaagttgagtacagctttatttagtgcgttgccctttgaaa

SEQ ID NO: 40106 - DNA, 30 bp, Homo sapiens
  misc_feature 1..30: note = chr3:187416788-187416818
  misc_feature 1..30: note = hypo
  source 1..30: mol_type = genomic DNA
agcagtggaacctgccgggaggagaaggag

SEQ ID NO: 40107 - DNA, 190 bp, Homo sapiens
  misc_feature 1..190: note = chr3:187870406-187870596
  misc_feature 1..190: note = hypo
  source 1..190: mol_type = genomic DNA
gtaaaggggggactacgctctgtcctatctaactcacctgaagatgcaatagccgggtgagagactgctttcattatgtgctaacgtgagggattactttagatattaataggagagaagtgcaaggaaaggaagtctcagggtatggaatgctttcctggccatggctgctgcgcgtcataatccccta

SEQ ID NO: 40108 - DNA, 29 bp, Homo sapiens
  misc_feature 1..29: note = chr3:190065742-190065771
  misc_feature 1..29: note = hypo
  source 1..29: mol_type = genomic DNA
agaccatgggctgggcgcggtggctcaca

SEQ ID NO: 40109 - DNA, 30 bp, Homo sapiens
  misc_feature 1..30: note = chr3:193093790-193093820
  misc_feature 1..30: note = hypo
  source 1..30: mol_type = genomic DNA
gccacagggaatcttcggggaaggaagagc

SEQ ID NO: 40110 - DNA, 80 bp, Homo sapiens; identical to SEQ ID NO: 5008
  misc_feature 1..80: note = chr3:193312128-193312208
  misc_feature 1..80: note = hypo
  source 1..80: mol_type = genomic DNA

SEQ ID NO: 40111 - DNA, 174 bp, Homo sapiens; identical to SEQ ID NO: 5009
  misc_feature 1..174: note = chr3:193548530-193548704
  misc_feature 1..174: note = hypo
  source 1..174: mol_type = genomic DNA

SEQ ID NO: 40112 - DNA, 35 bp, Homo sapiens
  misc_feature 1..35: note = chr3:193588124-193588159
  misc_feature 1..35: note = hypo
  source 1..35: mol_type = genomic DNA
tggggaaatggaggccgagacgtgggaatgcttta

SEQ ID NO: 40113 - DNA, 30 bp, Homo sapiens
  misc_feature 1..30: note = chr3:193656666-193656696
  misc_feature 1..30: note = hypo
  source 1..30: mol_type = genomic DNA
acacagctgcacactcggtaaatagactca

SEQ ID NO: 40114 - DNA, 30 bp, Homo sapiens
  misc_feature 1..30: note = chr3:193774655-193774685
  misc_feature 1..30: note = hypo
  source 1..30: mol_type = genomic DNA
caaattctgactcctcgacagtctagccaa

SEQ ID NO: 40115 - DNA, 36 bp, Homo sapiens; identical to SEQ ID NO: 14616
  misc_feature 1..36: note = chr3:193922775-193922811
  misc_feature 1..36: note = hypo
  source 1..36: mol_type = genomic DNA

SEQ ID NO: 40116 - DNA, 18 bp, Homo sapiens
  misc_feature 1..18: note = chr3:194041075-194041093
  misc_feature 1..18: note = hypo
  source 1..18: mol_type = genomic DNA
agcactttgggaggccga

SEQ ID NO: 40117 - DNA, 197 bp, Homo sapiens
  misc_feature 1..197: note = chr3:194048751-194048948
  misc_feature 1..197: note = hypo
  source 1..197: mol_type = genomic DNA
cacacaaccacacaacggtgtggctgaagccagcagaaatgaaaagtcctctggtacctccccttcaaacagctcacactcatgcgggtcactgtggcacggcgccctcacacgcgcatccgcagagcgcacctgtcccagcgtggccaagaccgcctctttcacccagggccctctgtggacgttagtctgctctg

SEQ ID NO: 40118 - DNA, 30 bp, Homo sapiens
  misc_feature 1..30: note = chr3:194128418-194128448
  misc_feature 1..30: note = hypo
  source 1..30: mol_type = genomic DNA
attctggggtggggacggggaaagtctgaa

SEQ ID NO: 40119 - DNA, 30 bp, Homo sapiens
  misc_feature 1..30: note = chr3:195183871-195183901
  misc_feature 1..30: note = hypo
  source 1..30: mol_type = genomic DNA
gaagtttaaaaagcacggtacagggctggg

SEQ ID NO: 40120 - DNA, 30 bp, Homo sapiens; identical to SEQ ID NO: 14618
  misc_feature 1..30: note = chr3:195536686-195536716
  misc_feature 1..30: note = hypo
  source 1..30: mol_type = genomic DNA

SEQ ID NO: 40121 - DNA, 36 bp, Homo sapiens
  misc_feature 1..36: note = chr3:195538313-195538349
  misc_feature 1..36: note = hypo
  source 1..36: mol_type = genomic DNA
gattacaggcatgagccaccgcgcacggcctccact

SEQ ID NO: 40122 - DNA, 265 bp, Homo sapiens
  misc_feature 1..265: note = chr3:195586997-195587262
  misc_feature 1..265: note = hypo
  source 1..265: mol_type = genomic DNA
caggatcacgagagccgcctctaacccacccccaaaacaacaaaaggatgcgctctggccttgccaacttcagtgcctgggacaagccggctcgtgcccgccgcctcggctgcagggccctccacctgcagcgctttcgtccctacctggcgttcaccgttctcacccatcacatcagcacaacgtgaccttgtggggagccacctcctctgctcccaagacacctggtgcgtaacgattacagagcacccgtcctgccgtgatg

SEQ ID NO: 40123 - DNA, 72 bp, Homo sapiens
  misc_feature 1..72: note = chr3:195597490-195597562
  misc_feature 1..72: note = hypo
  source 1..72: mol_type = genomic DNA
catggccaggaggtgcgggagaggctgggccacctgtcctgctccggatccaccctccgtccctgcaccaac

SEQ ID NO: 40124 - DNA, 108 bp, Homo sapiens
  misc_feature 1..108: note = chr3:195599732-195599840
  misc_feature 1..108: note = hypo
  source 1..108: mol_type = genomic DNA
gttccctggcaaggccggggccccagtcctcttctggccacttgatttcactcctcggctgggttccaggagttctgagaggtgcgggggtgccgggggacacctagg

SEQ ID NO: 40125 - DNA, 485 bp, Homo sapiens
  misc_feature 1..485: note = chr3:195600086-195600571
  misc_feature 1..485: note = hypo
  source 1..485: mol_type = genomic DNA
ctctgacctcagacacgaaacctctgctgatgtggcctaagccggggcctgggcaggggcaggggcaggggcaggggcaggcaggccaggaagcacagggctcccgcaagacactcctgactcccgaaggctctcacaggttgtgaggctcccgcgtctgctgctggacttgtcatacgtgatgccgtgagcagagtctgggcaggcgggggcggtgagagccccgtgggcagtgtctgggcaggcgggggcggtgagagccccgtgggcagtgtctgggcaggcgggggcggtgacagccccgtgggcagagtctgggcacgcgggggcggtgacagcccagagctgctagggtggacacgtgtggcaccacactgcacgccctccccaccaacccccacttctcctgtcccagggccaaagcgtgaagaagggctcctctgaaacccagccaggccggggagagaggacggaggaggtggcga

SEQ ID NO: 40126 - DNA, 112 bp, Homo sapiens
  misc_feature 1..112: note = chr3:195600916-195601028
  misc_feature 1..112: note = hypo
  source 1..112: mol_type = genomic DNA
gcacacagcctcccacggcggcccgtagaggaggaaccccggcaccggctgggctgcggctctcccgctacacccacgggctccccggtggctgccgcgggccagacgccgg

SEQ ID NO: 40127 - DNA, 40 bp, Homo sapiens
  misc_feature 1..40: note = chr3:195601324-195601364
  misc_feature 1..40: note = hypo
  source 1..40: mol_type = genomic DNA
aggagagtaagagtgcggaggacgtgtgcaagaagctccc

SEQ ID NO: 40128 - DNA, 30 bp, Homo sapiens
  misc_feature 1..30: note = chr3:195603893-195603923
  misc_feature 1..30: note = hypo
  source 1..30: mol_type = genomic DNA
catgaggctggacttcgggctggaggccct

SEQ ID NO: 40129 - DNA, 37 bp, Homo sapiens
  misc_feature 1..37: note = chr3:195604262-195604299
  misc_feature 1..37: note = hypo
  source 1..37: mol_type = genomic DNA
ggcacaggattgcaccgaaggccgcagactccaaaag

SEQ ID NO: 40130 - DNA, 30 bp, Homo sapiens
  misc_feature 1..30: note = chr3:195604945-195604975
  misc_feature 1..30: note = hypo
  source 1..30: mol_type = genomic DNA
aaggcactaggaagacggaggcaggcctgt

SEQ ID NO: 40131 - DNA, 55 bp, Homo sapiens
  misc_feature 1..55: note = chr3:195637288-195637343
  misc_feature 1..55: note = hypo
  source 1..55: mol_type = genomic DNA
atgtcccagcccaaacggaggcagccctgggcagcgggcgcgtggagcccaaggg

SEQ ID NO: 40132 - DNA, 219 bp, Homo sapiens
  misc_feature 1..219: note = chr3:195648722-195648941
  misc_feature 1..219: note = hypo
  source 1..219: mol_type = genomic DNA
acagaggagcacttccgtcacccaggaacacggctctgatcaaggaattcaagaacccaacagaaaaatacagaacagaaactactgcgataaagctctaataccttgattggagtgacagttactcttacatttttcaaaattcataaagtttacatttaagatctgttgcggggcgagggggcgaagcgggggagagcatcgggacaaatagctaag

SEQ ID NO: 40133 - DNA, 30 bp, Homo sapiens
  misc_feature 1..30: note = chr3:195835032-195835062
  misc_feature 1..30: note = hypo
  source 1..30: mol_type = genomic DNA
gtgctgggtgaaaggcgcagcctagagggc

SEQ ID NO: 40134 - DNA, 30 bp, Homo sapiens
  misc_feature 1..30: note = chr3:195874797-195874827
  misc_feature 1..30: note = hypo
  source 1..30: mol_type = genomic DNA
attcctatggaatgacgttttcatcaaaca

SEQ ID NO: 40135 - DNA, 16 bp, Homo sapiens
  misc_feature 1..16: note = chr3:195926800-195926816
  misc_feature 1..16: note = hypo
  source 1..16: mol_type = genomic DNA
gcgacactctggctca

SEQ ID NO: 40136 - DNA, 36 bp, Homo sapiens
  misc_feature 1..36: note = chr3:195993024-195993060
  misc_feature 1..36: note = hypo
  source 1..36: mol_type = genomic DNA
ctactgccatactagcgcattgtaaatatgcaataa

SEQ ID NO: 40137 - DNA, 37 bp, Homo sapiens
  misc_feature 1..37: note = chr3:196056123-196056160
  misc_feature 1..37: note = hypo
  source 1..37: mol_type = genomic DNA
ttttaagaagatgacaattcagcgggaaaaagtctct

SEQ ID NO: 40138 - DNA, 30 bp, Homo sapiens
  misc_feature 1..30: note = chr3:196063648-196063678
  misc_feature 1..30: note = hypo
  source 1..30: mol_type = genomic DNA
aggtgagcacgtcatcggctagatgtccag

SEQ ID NO: 40139 - DNA, 360 bp, Homo sapiens
  misc_feature 1..360: note = chr3:196069871-196070231
  misc_feature 1..360: note = hypo
  source 1..360: mol_type = genomic DNA
caagacacttctttaagaaatcatgtacttgagataaacgggtctcgtaaggctagcgttgggactatctcttcatttccatgtggcgagcctcctagggcaacagaggcacggtcgctgccatgaaagcactgaagcttcacctctttgagacgtgttaataaccgcggagtgtggctctactggagatggagctacttgctgttactttgtcggtgatgctcctagggaggagcaaatgggagtctgaggacataaatgacgaacagggcctgggctgagaaaaccagtcatgccacaaaaggcttcctgaggctgaaagatttgggagacggccaggtgccagtgacccacacctgt

SEQ ID NO: 40140 - DNA, 26 bp, Homo sapiens
  misc_feature 1..26: note = chr3:196226403-196226429
  misc_feature 1..26: note = hypo
  source 1..26: mol_type = genomic DNA
ctaaaacagcccggacgcggtggctc

SEQ ID NO: 40141 - DNA, 78 bp, Homo sapiens
  misc_feature 1..78: note = chr3:196256227-196256305
  misc_feature 1..78: note = hypo
  source 1..78: mol_type = genomic DNA
tcattggtttaggaacggacaggtggcagaattctggcccatgaaatataagaagaggcccactgtggagcttctgag

SEQ ID NO: 40142 - DNA, 30 bp, Homo sapiens; identical to SEQ ID NO: 14628
  misc_feature 1..30: note = chr3:196294577-196294607
  misc_feature 1..30: note = hypo
  source 1..30: mol_type = genomic DNA

SEQ ID NO: 40143 - DNA, 30 bp, Homo sapiens
  misc_feature 1..30: note = chr3:196386861-196386891
  misc_feature 1..30: note = hypo
  source 1..30: mol_type = genomic DNA
cctctcagagaactacgaagagacggcagc

SEQ ID NO: 40144 - DNA, 507 bp, Homo sapiens
  misc_feature 1..507: note = chr3:196387158-196387665
  misc_feature 1..507: note = hypo
  source 1..507: mol_type = genomic DNA
caacctcccctgcatcgtggacttcgggctcacgcggctgcgggtcctcaacgtcagctacaacgtcctggagtggttcctcgcgaccgggggagaggctgccttcgagctggagacgctggacctgtctcacaaccagctgctgttcttcccgctgctgccccagtacagcaagttgcggaccctcctgctgcgcgacaacaacatgggcttctaccgggacctgtacaacacctcgtcgccgagggagatggtggcccagttcctcctcgtggacggcaacgtgaccaacatcaccaccgtcagcctctgggaagaattctcctccagcgacctcgcagatctccgcttcctggacatgagccagaaccagttccagtacctgccagacggcttcctgaggaaaatgccttccctctcccacctgaacctccaccagaattgcctgatgacgcttcacattcgggagcacgagccccccggagcgctcaccgagctggacctgag

SEQ ID NO: 40145 - DNA, 265 bp, Homo sapiens
  misc_feature 1..265: note = chr3:196388333-196388598
  misc_feature 1..265: note = hypo
  source 1..265: mol_type = genomic DNA
tgcagcatgggcagacggtggccgactgggccatggtcacctgcaacctctcctccaagatcatccgcgtgacggagctgcccggaggtgtgcctcgggactgcaagtgggagcggctggacctgggcctgctctacctcgtgctcatcctccccagctgcctcaccctgctggtggcctgcactgtcatcgtcctcacttttaagaagcctctgcttcaggtcatcaagagccgctgccactggtcctccgtttactgacctgg

SEQ ID NO: 40146 - DNA, 41 bp, Homo sapiens
  misc_feature 1..41: note = chr3:196402166-196402207
  misc_feature 1..41: note = hypo
  source 1..41: mol_type = genomic DNA
gttgtacttactggccgggcgcggtggctcccgcctgtaat

SEQ ID NO: 40147 - DNA, 30 bp, Homo sapiens
  misc_feature 1..30: note = chr3:196731020-196731050
  misc_feature 1..30: note = hypo
  source 1..30: mol_type = genomic DNA
tcacccgcccagtgccgctagctgcaaatt

SEQ ID NO: 40148 - DNA, 246 bp, Homo sapiens
  misc_feature 1..246: note = chr3:196731283-196731529
  misc_feature 1..246: note = hypo
  source 1..246: mol_type = genomic DNA
ggtgggattcctgagcgttctgctaggcctgctgagcacttcttggccttttccataaggctttctcactctgtcttacagatatctccccacaaacctaaacaatttcgagagggacttgtgttctgcaaccagtcacagaatatcaggtgagctgggcgtgtcttcactgacccacccgcccagggatgctgcactcctctccaccctgctcagaatcactagaatgaccgttctgtggctaca

SEQ ID NO: 40149 - DNA, 220 bp, Homo sapiens
  misc_feature 1..220: note = chr3:196754516-196754736
  misc_feature 1..220: note = hypo
  source 1..220: mol_type = genomic DNA
ccgggcctggcagggcgaggtcggctcctttcctggtgaatggggctgttgtgtgctccctcctgagtcacagccctcttgtctggcagggtggaagggagaggactcaccgcgatgagctggacgcagtggtcggcggaggtgccccggacgcagaggagggagggctggatgcccgcttcccggaaggcctcgctcatgttgccgcacttgtgctgct

SEQ ID NO: 40150 - DNA, 30 bp, Homo sapiens
  misc_feature 1..30: note = chr3:196784239-196784269
  misc_feature 1..30: note = hypo
  source 1..30: mol_type = genomic DNA
gccgcacctgacagtcgttgactatttgaa

SEQ ID NO: 40151 - DNA, 39 bp, Homo sapiens
  misc_feature 1..39: note = chr3:197313900-197313939
  misc_feature 1..39: note = hypo
  source 1..39: mol_type = genomic DNA
tataagaacccaacacggcgaaaccccgtctctactaaa

SEQ ID NO: 40152 - DNA, 300 bp, Homo sapiens
  misc_feature 1..300: note = chr3:197327024-197327324
  misc_feature 1..300: note = hypo
  source 1..300: mol_type = genomic DNA
gcccggcccaattcaacattctttacttttctagtcataacctattttcagctggaaaccagaaaggctggttctatgtgcagatggcaatgctgaggtttagaggtaaaacacccacctgaagtgaatagaggctggactggaacccaggatggctcacctggaggcggcgctcccatacggcacccggcagcctgttttgtacaggaacaatacttgccttcctccgcaaaaaacaaacaaacaaacaaaaaatgcaggggttgaaaagaaaactgcctgagctgaaaagttttgttg

SEQ ID NO: 40153 - DNA, 52 bp, Homo sapiens
  misc_feature 1..52: note = chr3:197327804-197327856
  misc_feature 1..52: note = hypo
  source 1..52: mol_type = genomic DNA
ccagctggttacacacgagcgcgcgacatgtccaaagcgaagcacagccctt

SEQ ID NO: 40154 - DNA, 66 bp, Homo sapiens
  misc_feature 1..66: note = chr3:197402137-197402203
  misc_feature 1..66: note = hypo
  source 1..66: mol_type = genomic DNA
gccacagccccttctcgccaccaaggcgtggtgtcccctggggaggccccgcgaggtgctgagtgg

SEQ ID NO: 40155 - DNA, 29 bp, Homo sapiens
  misc_feature 1..29: note = chr3:197685787-197685816
  misc_feature 1..29: note = hypo
  source 1..29: mol_type = genomic DNA
tgcctcctggctgggcgcggtggctcacg

SEQ ID NO: 40156 - DNA, 29 bp, Homo sapiens
  misc_feature 1..29: note = chr3:197686056-197686085
  misc_feature 1..29: note = hypo
  source 1..29: mol_type = genomic DNA
gacgagtgaaactccgtctcaaaaaaaaa

SEQ ID NO: 40157 - DNA, 288 bp, Homo sapiens
  misc_feature 1..288: note = chr4:619531-619819
  misc_feature 1..288: note = hypo
  source 1..288: mol_type = genomic DNA
gtgcccgccggactgcgacagcctccgggacctctgccaggtggaggagagcacggcgctgctggagctggtgcaggatatgcaggagagcatcaacatggagcgcgtggtcttcaaggtcctgcggcgcctctgcaccctcctgcaggccgaccgctgcagcctcttcatgtaccgccagcgcaacggcgtggccgagctggccaccaggcttttcagcgtgcagccggacagcgtcctggaggactgcctggtgccccccgactccgagatcgtcttcccactgga

SEQ ID NO: 40158 - DNA, 74 bp, Homo sapiens
  misc_feature 1..74: note = chr4:628132-628206
  misc_feature 1..74: note = hypo
  source 1..74: mol_type = genomic DNA
ggcatccaggaagcccgacgtggccggagggcggcaggtgcgtgaggtgccaggcagggcggggccccccatga

SEQ ID NO: 40159 - DNA, 344 bp, Homo sapiens
  misc_feature 1..344: note = chr4:628444-628788
  misc_feature 1..344: note = hypo
  source 1..344: mol_type = genomic DNA
ctctttcctctcttgcggcagtgccctcacttcagctcatttgctgacgagctcactgactacaagacaaagaatatgctggccacacccatcatgaatggcaaagacgtcgtggcggtgatcatggcagtgaacaagctcaacggcccattcttcaccagcgaagacgaagatgtgagtgtggggggcacctgggcagccgcgcgtctgcctccctgcctgcctgcccgcccgcctgttctgtgctgcgcatccacctctttacctgcctgcccgcctgcccgtgtgttctctgctgcgtgtctgcctccttacctgcctgcccgcgtgttctgtgctgcgtg

SEQ ID NO: 40160 - DNA, 437 bp, Homo sapiens
  misc_feature 1..437: note = chr4:650884-651321
  misc_feature 1..437: note = hypo
  source 1..437: mol_type = genomic DNA
tccccgccaagcattcggctgtgtgcgtgtgctcatgtgtgtgcggtatgcatgcggccagggagaggacgacaaagggcccccccgggagcaggagcctctgcagagcacccgggagaccccacacagaagcactgcgacaccatggtggcagccccaggacctgcccgccgagccacggggcctggcacacaggcacatgggagggggcgcgccgggagcgctgagcgccagtgacactgccatcccctccagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctggtgcggcggggcaggacgtccaggggtcacccaggggt

SEQ ID NO: 40161 - DNA, 335 bp, Homo sapiens
  misc_feature 1..335: note = chr4:660894-661229
  misc_feature 1..335: note = hypo
  source 1..335: mol_type = genomic DNA
ctgagtctctgaggacgcaaggcggacatggagggggagactcgatggggcaggggtctgaccgtggggccctgtgtgatgcccataagagccagctgcctccggccacactccctggtgatggaatccacgccccaaggaggatgccacgggttccacatgaagttgtcccggagtgggctgtgcccactccccgccccatcctacccaccccgggtcgtcagtgctggggagaaggtgggacaagggtggatatttgggcctgaagtggccacaggtcacggccccactgcaggtgccccccactgccttccccaccccgccacactccatgt

SEQ ID NO: 40162 - DNA, 177 bp, Homo sapiens
  misc_feature 1..177: note = chr4:672016-672193
  misc_feature 1..177: note = hypo
  source 1..177: mol_type = genomic DNA
gtgttgtgggaagtacgtgcctcacgttgctctcctggtgagagtccggagcaggatgagggggttcctggctttcacaaaatcccggtacccagaacaagcccacccagagtccacttgcccctcaagccttcagaggccaagctggctcctgctggacggcgatccctgaccact

SEQ ID NO: 40163 - DNA, 78 bp, Homo sapiens
  misc_feature 1..78: note = chr4:676743-676821
  misc_feature 1..78: note = hypo
  source 1..78: mol_type = genomic DNA
gggaaatgttgacatcggtgctgtcccttgtgccaccaccctcctgaaggcagcacgcagcctcggtcatgggcccta

SEQ ID NO: 40164 - DNA, 161 bp, Homo sapiens
  misc_feature 1..161: note = chr4:678471-678632
  misc_feature 1..161: note = hypo
  source 1..161: mol_type = genomic DNA
aaatccaccctaccccggggatcccacggcactgaccagcttgagcccatccaggaacttctctgaggtggagctggcagccccggcagagggcggggtggggggcacactctcccacaggcagatggtggacagcaggcagacgacgccagcagggatgg

SEQ ID NO: 40165 - DNA, 30 bp, Homo sapiens
  misc_feature 1..30: note = chr4:679038-679068
  misc_feature 1..30: note = hypo
  source 1..30: mol_type = genomic DNA
cctgatacacatgcacgagcacacacaggt

SEQ ID NO: 40166 - DNA, 59 bp, Homo sapiens; identical to SEQ ID NO: 14641
  misc_feature 1..59: note = chr4:718181-718240
  misc_feature 1..59: note = hypo
  source 1..59: mol_type = genomic DNA

SEQ ID NO: 40167 - DNA, 76 bp, Homo sapiens
  misc_feature 1..76: note = chr4:738388-738464
  misc_feature 1..76: note = hypo
  source 1..76: mol_type = genomic DNA
tgaaaccaaagcagacgacagttcaaacaaagaggccgcggaggagaagccggaggaggacaacgactaccaccgc

SEQ ID NO: 40168 - DNA, 33 bp, Homo sapiens
  misc_feature 1..33: note = chr4:759808-759841
  misc_feature 1..33: note = hypo
  source 1..33: mol_type = genomic DNA
gtgtcttccagaaggcgccgctcctgctgcact

SEQ ID NO: 40169 - DNA, 161 bp, Homo sapiens
  misc_feature 1..161: note = chr4:828951-829112
  misc_feature 1..161: note = hypo
  source 1..161: mol_type = genomic DNA
ggacagctctgaccccgccccaaccaggcacccactgcagctcgcctgcggtaggacagtcggggtctgctgccacctggggcttctggggggacgtggagtcctcagcccccggctcgggtcatcctgctgcagtggcagtcgggcgtggtctgtttctg

SEQ ID NO: 40170 - DNA, 81 bp, Homo sapiens
  misc_feature 1..81: note = chr4:829611-829692
  misc_feature 1..81: note = hypo
  source 1..81: mol_type = genomic DNA
cagacacccggactgcgtcctcaggagtggagctccccgaggaaagagtgcctttgcttcccttgacgtgtcctgcacttt

SEQ ID NO: 40171 - DNA, 270 bp, Homo sapiens
  misc_feature 1..270: note = chr4:955184-955454
  misc_feature 1..270: note = hypo
  source 1..270: mol_type = genomic DNA
gccagctgggctcagcggggaccggggacgcccaccctgggctcgcccgcccactcggccggcggctcaccatgtgcacgacgcccgtcacgcccacaacctccagcagcccgtcgtccatgcgtggcttctcaaacctggtgtcgctgtcggagccccacaggtcggcccccgagccccagctgccgcataagagagcgggcacagaggtgtaggtgcaggcaggacgagggctgagcctgcccatggccccgccgggcagagcctctg

SEQ ID NO: 40172 - DNA, 934 bp, Homo sapiens
  misc_feature 1..934: note = chr4:955867-956801
  misc_feature 1..934: note = hypo
  source 1..934: mol_type = genomic DNA
gatctggggacagggcgttcatctcccaggacccggccgccctcaccaggccccctgagctccccaacagctctgccggcaggcagagacaagagcaaggaccaccctggcaccaagccgagcacccaggagagggcagcatgggcaggtcctggccaggctctgtcgccagctggctcagcacaatccccagcagtggctactttctgtgtctccctcaactgcccgctttgcagaggggatgatgcgggcgcgtacacccgagtgtggctgggaagaggacgcccgttgtgacgcgtgtagcggggtcatatgcaggagcctggaaggcaccccacgccgggctgccctgtaccttggggggctctgcgtctgccgtgtcgttctctgcactgccagcctcgtgggcatccagcaggatggtccagcggtccatgagcacggcgtcggcctcgtccacagacagcagtacggagaacgggtcctcgccgctgtagcccgccccccagcggaggactcgaccaaggtcattccctgggacacaagcagacacagagcatctgtccacacccacccgcccatcagctgggtgcagaccccaccacgaggacagccagcccaggcctcggcaaaagctgcacaggaaggggtagaccctgaggccccctcctcggctgcacggctgagcccacctgtgcccaggggcaggatggccacagaaggctccgggcaggccagtcggtaccgtgtctcctccagggcgccaagcacccagcccacagtgccatcgccaccacacaccagcacccggaagcagggcacctgggagaacaggtggagcctagcgggagacaggaagtgtcctctaccagctgcgggcgcagcccatcccccacccaggctgcctcttccaagtgcccgtcctggccgtgtg

SEQ ID NO: 40173 - DNA, 30 bp, Homo sapiens
  misc_feature 1..30: note = chr4:957020-957050
  misc_feature 1..30: note = hypo
  source 1..30: mol_type = genomic DNA
cactcttggggttcacgaacacaaggaggg

SEQ ID NO: 40174 - DNA, 35 bp, Homo sapiens
  misc_feature 1..35: note = chr4:1016331-1016366
  misc_feature 1..35: note = hypo
  source 1..35: mol_type = genomic DNA
acggggacacacctggggcccgagagtcagccagc

SEQ ID NO: 40175 - DNA, 150 bp, Homo sapiens
  misc_feature 1..150: note = chr4:1016642-1016792
  misc_feature 1..150: note = hypo
  source 1..150: mol_type = genomic DNA
ttctgttctcttctgcgcctggggcccgggcgctgggcttggacaggtgtccagagagacacgccctccatacctagggacccggcaccccgcctgctccgctgggctcctgggtgtggggccctcgggtggagctcctgggagctgggc

SEQ ID NO: 40176 - DNA, 150 bp, Homo sapiens
  misc_feature 1..150: note = chr4:1016852-1017002
  misc_feature 1..150: note = hypo
  source 1..150: mol_type = genomic DNA
tctgaatacaggagcctggcccaggccccagcagggtctgggggtgcggcctgagacagcctggtcctgggctcagtgaaggagcggctgtcacagggtggatggaggggacattccacagcacgccctgcccctcggcattgtgtggaa

SEQ ID NO: 40177 - DNA, 30 bp, Homo sapiens
  misc_feature 1..30: note = chr4:1022834-1022864
  misc_feature 1..30: note = hypo
  source 1..30: mol_type = genomic DNA
ctcacctgtcctgcccgggtcacctgcaca

SEQ ID NO: 40178 - DNA, 194 bp, Homo sapiens
  misc_feature 1..194: note = chr4:1024234-1024428
  misc_feature 1..194: note = hypo
  source 1..194: mol_type = genomic DNA
gctggtggggcctggcgggtcctgggcctcagccacacaagacccaggcctgtgttccagggctctgggttgccgatgaattttaggtttgcattgcagtgcctgaggagagacgccagtccctgagaaacaccggctctgcccaggggccgcactcgccaccgttggcctcctctgctcggcctgtctctccc

SEQ ID NO: 40179 - DNA, 318 bp, Homo sapiens
  misc_feature 1..318: note = chr4:1025875-1026193
  misc_feature 1..318: note = hypo
  source 1..318: mol_type = genomic DNA
cctgggcacgcaggccgacatggattctgtggctgaggccgtcagcgtgtgaaagccacagacacaggcgggcccggagtgcctgtccaccccgaggcgcctgccctggcccggcctctccttcctgggtgtcggaagaccttcatctatgcccctgccctgtacccgctcagtgggctgagcacgggcagggtgtggttctgaggggcaaccccaccagcctgcttgggccccagcgtcttctcagcgtctgcctcctgtgaaaaccttccactcagtaaaggagcacagtaggttggttgccgggccaggctgggg

SEQ ID NO: 40180 - DNA, 294 bp, Homo sapiens
  misc_feature 1..294: note = chr4:1036245-1036539
  misc_feature 1..294: note = hypo
  source 1..294: mol_type = genomic DNA
cacccacacacacaccgacacacacaccgacacacacacctccacatacacccccgcacactgacacacccacacacacaccgacacacacacctccacaaacacaccccccgcacactgacacacacccacccccacacactgacacatccaccccccacaccgacacacacctacagtgacacccgcacactgacacacacccactcctgcacactgacacccactcctgcacactgacacacacccccgcacagacacacacccacccccgcacaccgatacacacaccta

SEQ ID NO: 40181 - DNA, 38 bp, Homo sapiens
  misc_feature 1..38: note = chr4:1282473-1282511
  misc_feature 1..38: note = hypo
  source 1..38: mol_type = genomic DNA
taggaaggtcaggaacgctgttacggggagcagggtta

SEQ ID NO: 40182 - DNA, 163 bp, Homo sapiens
  misc_feature 1..163: note = chr4:1299056-1299219
  misc_feature 1..163: note = hypo
  source 1..163: mol_type = genomic DNA
gtccctgtggaaagccgctgcactaggtgagcccggccctggtgagggtgccttgtgagtggagcctgcttgtgctgctgtgccccgctgcttccaggcggcgcggccctccgtctgattgctggaggactcttcggtgtggacacaccgtggtttgtttacc

SEQ ID NO: 40183 - DNA, 185 bp, Homo sapiens
  misc_feature 1..185: note = chr4:1299450-1299635
  misc_feature 1..185: note = hypo
  source 1..185: mol_type = genomic DNA
tgttcttctgggtgccggggttctccagagaaacagagccagtggcacccacatgtgtgtgtgcgcacgcgtgtgtgggagtgtgcgtgcgtgcacgtgcgcacgcgtgcgtgtaaggagctgtgtcacaaagaattggctggtgcagttatcaaagctaagtcccgagccggagacccaggaga

SEQ ID NO: 40184 - DNA, 30 bp, Homo sapiens
  misc_feature 1..30: note = chr4:1331816-1331846
  misc_feature 1..30: note = hypo
  source 1..30: mol_type = genomic DNA
ttgtggaactctgggcgagagggctggcgt

SEQ ID NO: 40185 - DNA, 119 bp, Homo sapiens
  misc_feature 1..119: note = chr4:1332541-1332660
  misc_feature 1..119: note = hypo
  source 1..119: mol_type = genomic DNA
ggggccaggctggcacgcgtcgccatcgggacagggctgtgtggggcgggcagggcagcggggccaggctggcacacgtcgccattgggacagggctgtcctctcgccccaccctgcct

SEQ ID NO: 40186 - DNA, 222 bp, Homo sapiens
  misc_feature 1..222: note = chr4:1332878-1333100
  misc_feature 1..222: note = hypo
  source 1..222: mol_type = genomic DNA
tcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactctta

SEQ ID NO: 40187 - DNA, 91 bp, Homo sapiens; identical to SEQ ID NO: 14656
  misc_feature 1..91: note = chr4:1338688-1338779
  misc_feature 1..91: note = hypo
  source 1..91: mol_type = genomic DNA

SEQ ID NO: 40188 - DNA, 16 bp, Homo sapiens
  misc_feature 1..16: note = chr4:1339130-1339146
  misc_feature 1..16: note = hypo
  source 1..16: mol_type = genomic DNA
gggcaggcccaggcac

SEQ ID NO: 40189 - DNA, 211 bp, Homo sapiens
  misc_feature 1..211: note = chr4:1504889-1505100
  misc_feature 1..211: note = hypo
  source 1..211: mol_type = genomic DNA
ttgtgtcctctgcaccgcgatggcttcgctgggggagggagtggggagagctggcctgcccacggggcatcgctgcacgtggtagggggtgacctgggccgaaggaggataccgggcctctgctagggcagggaggccaagggagtttgggccggaggggacaccctgagcgccccacctgcctcccgactgttgccggcctgtgattgat

SEQ ID NO: 40190 - DNA, 54 bp, Homo sapiens; identical to SEQ ID NO: 14658
  misc_feature 1..54: note = chr4:1512344-1512398
  misc_feature 1..54: note = hypo
  source 1..54: mol_type = genomic DNA

SEQ ID NO: 40191 - DNA, 110 bp, Homo sapiens
  misc_feature 1..110: note = chr4:1556398-1556508
  misc_feature 1..110: note = hypo
  source 1..110: mol_type = genomic DNA
tgtccacccccagaccgccttctgcctgtgcagccacggcccccaccagcctcgacctgcccgtcccgtcatccatttatttatgccccgcttgccgatgcctgcggctg

SEQ ID NO: 40192 - DNA, 55 bp, Homo sapiens
  misc_feature 1..55: note = chr4:1562145-1562200
  misc_feature 1..55: note = hypo
  source 1..55: mol_type = genomic DNA
atccactgcaaaatgcgtcatttcttgttgtgttagcggtcgctgtttcctgact

SEQ ID NO: 40193 - DNA, 250 bp, Homo sapiens
  misc_feature 1..250: note = chr4:1576408-1576658
  misc_feature 1..250: note = hypo
  source 1..250: mol_type = genomic DNA
ggggccttgcacacacgggcacccctgagacaggcgaggcctggacaggtgcaggaggtgggcctggagccggtgggtggggctggctggacggcaggtggtcagcgggcggcaggctcagcttgtctctggcaggagggcccacgccctgtgtgccaggctgctgggcctccccggacggaccggctgcccgaacccctcggctatggcaagctttcatggtctctgcctccctcggtgtcaacacatg

SEQ ID NO: 40194 - DNA, 118 bp, Homo sapiens
  misc_feature 1..118: note = chr4:1577697-1577815
  misc_feature 1..118: note = hypo
  source 1..118: mol_type = genomic DNA
caccccccacctgcccggctgtgggctgcagcctccctcctggccatcccagcagcatctgcagctgggcctatgcggtgagtccaccttaagtgggtttgatcggcccgtgcactgg

SEQ ID NO: 40195 - DNA, 154 bp, Homo sapiens
  misc_feature 1..154: note = chr4:1605613-1605767
  misc_feature 1..154: note = hypo
  source 1..154: mol_type = genomic DNA
aggcctgacattggccggtgtcagttctcggggcgacagggccaaggccaccttgggccagccaggtaggagggttcccatccctcacaagccctcatgggcacagctgctgcctccagcctgccagaaaagccctgcccggctgccctcagag

SEQ ID NO: 40196 - DNA, 530 bp, Homo sapiens
  misc_feature 1..530: note = chr4:1616563-1617093
  misc_feature 1..530: note = hypo
  source 1..530: mol_type = genomic DNA
cacccagaggcaggtcgccccacacgcatttctccacggggtgccccatggccgtcctatgctgacggacaccagatggcatttcagcaccgggcacaggggccgctttaaacagcaaaatcaccaaagggacacgagagcaaaaacatggcacacgcaaaccacaaaaaaggacatttacagatgagcagagacagaaggcaggatgcggccacgcccaccccacctgggcacacagaaggcaggacacgaccacgcccacctcacctggggacacaagggaggcaggatgcagccacgcccaccccacctgggtacacacggaagacaggatgcggctacgcccaccctacttgggcacacacacggaaaacaggatgcggccatgcccatcccgcctgggcacacatggaagacaggatgtggccacgcccaccctacctgggcccacacggaagacaggatgcggccacacccaccccacctgggcgcacactgaagacaggatgcggccacgcccaccccacctg

SEQ ID NO: 40197 - DNA, 30 bp, Homo sapiens
  misc_feature 1..30: note = chr4:1623727-1623757
  misc_feature 1..30: note = hypo
  source 1..30: mol_type = genomic DNA
ttaaagggcaggttccgaccccatctgctc

SEQ ID NO: 40198 - DNA, 74 bp, Homo sapiens
  misc_feature 1..74: note = chr4:1663439-1663513
  misc_feature 1..74: note = hypo
  source 1..74: mol_type = genomic DNA
gctcagcgaggcacccgtgcccactcccctcccaccgcctcatgcctgtggttactggtcgtctgtgtaggtcc

SEQ ID NO: 40199 - DNA, 357 bp, Homo sapiens
  misc_feature 1..357: note = chr4:1687122-1687479
  misc_feature 1..357: note = hypo
  source 1..357: mol_type = genomic DNA
ggccaccgtggggctcggtggccacgtcccacagtggacactgtgggcagacagatgcatggaggccggctggttccgggaataggctatgggtgaggccatgcagcacccctggggctggatgctgggggaggcatcggggctcccaggggtcaggctggggcctcccaacaggttctgggcctggtaaggctagtccggtgcaggctgcgaagccaggccagctgacaccaggactggctggagtcagcctcacctgtctggaagagtgggagtcccagcggggctggggaggggagaagggctggagcaggcgtccaggccattctcttcgctggggtccggtaatcccccacc

SEQ ID NO: 40200 - DNA, 66 bp, Homo sapiens
  misc_feature 1..66: note = chr4:1791278-1791344
  misc_feature 1..66: note = hypo
  source 1..66: mol_type = genomic DNA
ccctgtcgggaaaggcggcagctgcctgcccggagtgctgtggggaacaggcggtgtggatctgag

SEQ ID NO: 40201 - DNA, 345 bp, Homo sapiens
  misc_feature 1..345: note = chr4:1803132-1803477
  misc_feature 1..345: note = hypo
  source 1..345: mol_type = genomic DNA
agctgctggccgtgccggccgccaacaccgtccgcttccgctgcccagccgctggcaaccccactccctccatctcctggctgaagaacggcagggagttccgcggcgagcaccgcattggaggcatcaaggtgggcgcggcggggtggctctgggcctggcaggcgcggtggttgctgcctccgctcactcacccgcccgcgtcccggtgcagctgcggcatcagcagtggagcctggtcatggaaagcgtggtgccctcggaccgcggcaactacacctgcgtcgtggagaacaagtttggcagcatccggcagacgtacacgctggacgtgctgggtgaggg

SEQ ID NO: 40202 - DNA, 335 bp, Homo sapiens
  misc_feature 1..335: note = chr4:1805302-1805637
  misc_feature 1..335: note = hypo
  source 1..335: mol_type = genomic DNA
aggagttggtggtggcggcgttttccttgcagcggctggatcctgccgtgtggactctgtgcggtgcccgcagggcggtgctggcgctcgcctatcgctctgctctctctttgtagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccaggtaccggcttctgctgctgctgctgctccgcactgtctgggggacgctggctcgggacacgccaaagctgccag

SEQ ID NO: 40203 - DNA, 398 bp, Homo sapiens
  misc_feature 1..398: note = chr4:1807294-1807692
  misc_feature 1..398: note = hypo
  source 1..398: mol_type = genomic DNA
ctgacaaggacctgtcggacctggtgtctgagatggagatgatgaagatgatcgggaaacacaaaaacatcatcaacctgctgggcgcctgcacgcagggcggtaggtgcggtagcggcggtggtgccggctgggcggccctcctgggcctggcagcccgtctgaggagcccgtgtccccagggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaaggtgggcagggcggcaggtgtgggtg

SEQ ID NO: 40204 - DNA, 260 bp, Homo sapiens
  misc_feature 1..260: note = chr4:1960118-1960378
  misc_feature 1..260: note = hypo
  source 1..260: mol_type = genomic DNA
actgagccccaaacacgtagatcctgtacctcagagagcaagatggcggggcggcaggggagcttgccagttctgtgtttattccagtgagctcgagagccccagcaggaggaagtgcagccagggcagggctctgtgagagctccaggcccctcagggctgcctgcgctcagagctggtgcggcaagccgcatccccaggagcctcgtggccgttcctgacgagtgtttgtgataagtgtgtgccggaggtcaggtgct

SEQ ID NO: 40205 - DNA, 30 bp, Homo sapiens
  misc_feature 1..30: note = chr4:1961374-1961404
  misc_feature 1..30: note = hypo
  source 1..30: mol_type = genomic DNA
cagtgcttcaccaagcgccagtacccagag

SEQ ID NO: 40206 - DNA, 155 bp, Homo sapiens
  misc_feature 1..155: note = chr4:1976939-1977094
  misc_feature 1..155: note = hypo
  source 1..155: mol_type = genomic DNA
tgttgacctaatacacgccccttagcttttgaagagaaaggcaggtgtttccaatttggtgtctgtctcctcttctcccagggacggagctgacttttaactacaacctcgattgtctgggcaatgaaaaaacggtctgccggtgtggagcctcc

SEQ ID NO: 40207 - DNA, 620 bp, Homo sapiens
  misc_feature 1..620: note = chr4:1993715-1994335
  misc_feature 1..620: note = hypo
  source 1..620: mol_type = genomic DNA
ggcctactcttccaccggtgcgcagatgcaagaaaacctgaagggtgagaagccggggccaccactgctcccgcagaaagcctgcgggtgggaaatcctggggatgaggggcgtagagcaggcaggtgcccggcacagcagagcgcaggagcagggtggagtcacctgccgcgggggtgtgtgcctgggcagcagggggtggggcctgggacctggggcagcacccgtgacagctgagctggtgcctagtcaccatctaggcagggacggctgcctctgggtctggacggcgctgggagttggcgctcgtggagcctggaggtggccccgggatctggagtgaggccagggccttggggaggccatgggcgacgtgcgtggaggaagcaggcgcaccccgtgctccctcaatacctgggaggccagatccatccacaccagggcctgcttcggccacataaaccccctcccacgaggaaacgcagagagccaggccatggcgtgcctgtgcctctgccatgcgcccactgggctgctcacagtgtgagacagctgggctggctggcgctgggggtgaacaacagcgccctgccctgtccagacgccggggctgaaacccc

SEQ ID NO: 40208 - DNA, 74 bp, Homo sapiens; identical to SEQ ID NO: 14668
  misc_feature 1..74: note = chr4:1994756-1994830
  misc_feature 1..74: note = hypo
  source 1..74: mol_type = genomic DNA

SEQ ID NO: 40209 - DNA, 30 bp, Homo sapiens
  misc_feature 1..30: note = chr4:2009272-2009302
  misc_feature 1..30: note = hypo
  source 1..30: mol_type = genomic DNA
cactaactccaaatccggcaaccaagctgt

SEQ ID NO: 40210 - DNA, 299 bp, Homo sapiens
  misc_feature 1..299: note = chr4:2065601-2065900
  misc_feature 1..299: note = hypo
  source 1..299: mol_type = genomic DNA
ccgaggcaagggcatcgccaaggcgctgggccggaaggtgctggagttcgccgtggtgcacaactactccgcggtggtgctgggcacgacggccgtcaaggtggccgcccacaagctctacgagtcgctgggcttcagacacatgggcgccagtgaccactacgtgctgccgggcatgaccctctcgctggctgagcgcctcttcttccaggtccgctaccaccgctaccgcctgcagctgcgcgaggagtgaccgccgccgctcgcccgcccgcccccccggccgccctgtccgcctt

SEQ ID NO: 40211 - DNA, 151 bp, Homo sapiens; identical to SEQ ID NO: 5014
  misc_feature 1..151: note = chr4:2066114-2066265
  misc_feature 1..151: note = hypo
  source 1..151: mol_type = genomic DNA

SEQ ID NO: 40212 - DNA, 30 bp, Homo sapiens
  misc_feature 1..30: note = chr4:2129422-2129452
  misc_feature 1..30: note = hypo
  source 1..30: mol_type = genomic DNA
gcaggatctttcacccgcagctcaagaagc

SEQ ID NO: 40213 - DNA, 141 bp, Homo sapiens
  misc_feature 1..141: note = chr4:2278785-2278926
  misc_feature 1..141: note = hypo
  source 1..141: mol_type = genomic DNA
agaaggccggattggcgtggcgcccgacacagaaggctcaggggtattattgcccaaaaccactgaactgtgtgatttagaaaggtgaattttgtggtatgtatgttacatatcaataaaggcttttttttaaagatcacg

SEQ ID NO: 40214 - DNA, 333 bp, Homo sapiens
  misc_feature 1..333: note = chr4:2305585-2305918
  misc_feature 1..333: note = hypo
  source 1..333: mol_type = genomic DNA
gagaagtgggcagtgcgctcggatgcggctcagggcaaggggcccggcgctggcacagcccgctcccactgccccgcacaggcacgcggctcacaccaggggcgggatgggccggggctgcggcaggtgagctgagggcttggcactgcgcccatgtcacctgacaggcacccggaacatcagaaacagggaagcgggcccgctggcgcacattttctggtgcatgacgccccacagggcaggtgcctctgcagccagctcctgcccctgcccctcctcacacacagaccccacactcggccagggcccagcacctgccggtggccaagatgg

SEQ ID NO: 40215 - DNA, 124 bp, Homo sapiens
  misc_feature 1..124: note = chr4:2459775-2459899
  misc_feature 1..124: note = hypo
  source 1..124: mol_type = genomic DNA
agagccaggaggcaccgccgccctcttctgcactcccggcctgaggcgcccagccgtctccctgtgccatggtctgacgctgtggctgcgcggggagggccggtgtggacgcctcttttctctc

SEQ ID NO: 40216 - DNA, 35 bp, Homo sapiens; identical to SEQ ID NO: 14672
  misc_feature 1..35: note = chr4:2527902-2527937
  misc_feature 1..35: note = hypo
  source 1..35: mol_type = genomic DNA

SEQ ID NO: 40217 - DNA, 114 bp, Homo sapiens
  misc_feature 1..114: note = chr4:2926282-2926396
  misc_feature 1..114: note = hypo
  source 1..114: mol_type = genomic DNA
gttgctctcctgggccgtcgtcatcctgggagctaggcactcctcctaagaggacctcttcaccggtttttgtctcgttctagaccagccactgcattacgtagttgtgactga

SEQ ID NO: 40218 - DNA, 139 bp, Homo sapiens
  misc_feature 1..139: note = chr4:2932947-2933086
  misc_feature 1..139: note = hypo
  source 1..139: mol_type = genomic DNA
gctcaccatagccagcgaccacggaggacaggcagggcaccacaacggcggcggctggtgggagacatcgaggaggtgcccgtcagcccaggggagggtgcatcacccagcccctgctgcccatcggatcccctgccag

SEQ ID NO: 40219 - DNA, 30 bp, Homo sapiens
  misc_feature 1..30: note = chr4:2978968-2978998
  misc_feature 1..30: note = hypo
  source 1..30: mol_type = genomic DNA
tatgatgagtaacagcgcatactactgctg

SEQ ID NO: 40220 - DNA, 45 bp, Homo sapiens
  misc_feature 1..45: note = chr4:2987431-2987476
  misc_feature 1..45: note = hypo
  source 1..45: mol_type = genomic DNA
tcagatacagaaggccgggtgtggtggctcacgcccgtaatccca

SEQ ID NO: 40221 - DNA, 30 bp, Homo sapiens
  misc_feature 1..30: note = chr4:3252743-3252773
  misc_feature 1..30: note = hypo
  source 1..30: mol_type = genomic DNA
ggcaggccccaaagccgggacctagggtgc

SEQ ID NO: 40222 - DNA, 30 bp, Homo sapiens
  misc_feature 1..30: note = chr4:3292632-3292662
  misc_feature 1..30: note = hypo
  source 1..30: mol_type = genomic DNA
ttgacaccttctctccgtctcaggcaattt

SEQ ID NO: 40223 - DNA, 50 bp, Homo sapiens
  misc_feature 1..50: note = chr4:3310501-3310551
  misc_feature 1..50: note = hypo
  source 1..50: mol_type = genomic DNA
ctgggaagcggctggcgccgttcagggctgggagccgctctgtcaggatt

SEQ ID NO: 40224 - DNA, 91 bp, Homo sapiens
  misc_feature 1..91: note = chr4:3313229-3313320
  misc_feature 1..91: note = hypo
  source 1..91: mol_type = genomic DNA
gaaggagtgacagtgcgggttgagcatcccttatccagatgctccagaatcggaaaccctctgacaccgatgtggcacctcaggcatagct

SEQ ID NO: 40225 - DNA, 35 bp, Homo sapiens
  misc_feature 1..35: note = chr4:3418235-3418270
  misc_feature 1..35: note = hypo
  source 1..35: mol_type = genomic DNA
ctgtgcatgtcgctgcggcacgtgggtcacgttca

SEQ ID NO: 40226 - DNA, 213 bp, Homo sapiens
  misc_feature 1..213: note = chr4:3445886-3446099
  misc_feature 1..213: note = hypo
  source 1..213: mol_type = genomic DNA
aggtgagctgggcctcggaggtccgcaggggtccaggggccggagcaagtccccggaggatgggagaacaggtggctcccgagtgcagggcaggggccctgcacggggacagcaggtggcagggtgtgagggcttactgtgcacccctcagagaaatgctttgatgagacccgctacgagtacctggaggggggcgaccgctgggcccgcgtg

SEQ ID NO: 40227 - DNA, 686 bp, Homo sapiens
  misc_feature 1..686: note = chr4:3446443-3447129
  misc_feature 1..686: note = hypo
  source 1..686: mol_type = genomic DNA
acggctctgcaacatcggtgagtgggtcagccccccggggtgccctggggcagtgccgggtggacccaccgtgggccggcctcactgcccctctgcccgcagagcctgatgagcgctgcttcttggggaacggcactgggtaccgtggcgtggccagcacctcagcctcgggcctcagctgcctggcctggaactccgatctgctctaccaggagctgcacgtggactccgtgggcgccgcggccctgctgggcctgggcccccatgcctactgccggtcagcaccacgccgctccaggccgccgcatgcggggcaggcaggatttgtcctggggagaggccccccggctccctaggacccaggcggggccagctccgtccagacaggccccggaacctctgcctgggaggctgcccgagggagggccactctcttcccactgctccaggtgcggggaaccgccctgctgggggttccgatgccccctccccatgccctcttcgaggggcagtgtgactccctgccagcccccacttatgcaccgcaggaatccggacaatgacgagaggccctggtgctacgtggtgaaggacagcgcgctctcctgggagtactgccgcctggaggcctgcggtgcgcggctggcggggggtgctgccttgggccccaccgaggtcacagcagt

SEQ ID NO: 40228 - DNA, 199 bp, Homo sapiens
  misc_feature 1..199: note = chr4:3447816-3448015
  misc_feature 1..199: note = hypo
  source 1..199: mol_type = genomic DNA
ctgagccagcctccccggggcgccaggcctgcggcaggaggcacaagaagaggacgttcctgcggccacgtatcatcggcggctcctcctcgctgcccggctcgcacccctggctggccgccatctacatcggggacagcttctgcgccgggagcctggtccacacctgctgggtggtgtcggccgcccactgcttctc

SEQ ID NO: 40229 - DNA, 30 bp, Homo sapiens
  misc_feature 1..30: note = chr4:3449723-3449753
  misc_feature 1..30: note = hypo
  source 1..30: mol_type = genomic DNA
acaagtgccagattgcgggctggggccact

SEQ ID NO: 40230 - DNA, 271 bp, Homo sapiens
  misc_feature 1..271: note = chr4:3475099-3475370
  misc_feature 1..271: note = hypo
  source 1..271: mol_type = genomic DNA
ggctggcgtccctgacggccacgctccttgcagactgcctgctgatgctggtctacaaggacaagtcggagcgtatcaagggcctgcgggagcgcagcagcctgacgctagaggacatctgcgggctggagcccggcctgccctacgagggcttggtccacacgctggccattgtctgcctgtcccaggccatcatgctgggctttgacagccacgaggccatgtgtgcgtgggatgcccggatccgctatgcgctcggcgagggtgagtg

SEQ ID NO: 40231 - DNA, 38 bp, Homo sapiens
  misc_feature 1..38: note = chr4:3664470-3664508
  misc_feature 1..38: note = hypo
  source 1..38: mol_type = genomic DNA
cggtcccacctgctccggcgccccgtggctgctgtctt

SEQ ID NO: 40232 - DNA, 61 bp, Homo sapiens
  misc_feature 1..61: note = chr4:3690841-3690902
  misc_feature 1..61: note = hypo
  source 1..61: mol_type = genomic DNA
gtccccagaggctcacgcggtggaagctggatcccacggccggccgcggtgctgaggggtg

SEQ ID NO: 40233 - DNA, 30 bp, Homo sapiens
  misc_feature 1..30: note = chr4:3702485-3702515
  misc_feature 1..30: note = hypo
  source 1..30: mol_type = genomic DNA
tttggaatctaagagcgttccagcccttag

SEQ ID NO: 40234 - DNA, 30 bp, Homo sapiens
  misc_feature 1..30: note = chr4:3782694-3782724
  misc_feature 1..30: note = hypo
  source 1..30: mol_type = genomic DNA
atccccaggtgcccccgacatgaggtgagc

SEQ ID NO: 40235 - DNA, 34 bp, Homo sapiens
  misc_feature 1..34: note = chr4:3783286-3783320
  misc_feature 1..34: note = hypo
  source 1..34: mol_type = genomic DNA
ccaaactcctcctcccgcacgaaactcctcccct

SEQ ID NO: 40236 - DNA, 30 bp, Homo sapiens
  misc_feature 1..30: note = chr4:4251746-4251776
  misc_feature 1..30: note = hypo
  source 1..30: mol_type = genomic DNA
ctcttctctctcgtacggggttagaagcct

SEQ ID NO: 40237 - DNA, 82 bp, Homo sapiens; identical to SEQ ID NO: 14678
  misc_feature 1..82: note = chr4:4256159-4256241
  misc_feature 1..82: note = hypo
  source 1..82: mol_type = genomic DNA

SEQ ID NO: 40238 - DNA, 30 bp, Homo sapiens
  misc_feature 1..30: note = chr4:4417662-4417692
  misc_feature 1..30: note = hypo
  source 1..30: mol_type = genomic DNA
ctgtttgttctgtagcgtgtcaggtgcttc

SEQ ID NO: 40239 - DNA, 30 bp, Homo sapiens
  misc_feature 1..30: note = chr4:5171284-5171314
  misc_feature 1..30: note = hypo
  source 1..30: mol_type = genomic DNA
gaaaatcaaggtgtgcgtgccaggtgccac

SEQ ID NO: 40240 - DNA, 30 bp, Homo sapiens
  misc_feature 1..30: note = chr4:5458789-5458819
  misc_feature 1..30: note = hypo
  source 1..30: mol_type = genomic DNA
atgccgtggaataaacgctgttatgggggt

SEQ ID NO: 40241 - DNA, 68 bp, Homo sapiens
  misc_feature 1..68: note = chr4:6537166-6537234
  misc_feature 1..68: note = hypo
  source 1..68: mol_type = genomic DNA
acacaccacatgcaacgcgagcaccgccacccacggccgccctggccgccgcccggcacagctccagc

SEQ ID NO: 40242 - DNA, 182 bp, Homo sapiens
  misc_feature 1..182: note = chr4:6540136-6540318
  misc_feature 1..182: note = hypo
  source 1..182: mol_type = genomic DNA
ccccagcgacgcaagcgtttcagagcaaaacggaaacatacaaggatgatttaacaatctgtgttgatggtgctgaacacacccaatggtgggaagggaacaaaatcaatcccctgctattttcactaggcaaaggaaaatgagatgaggtcacgtcatcttccaaacgccaataacacggc

SEQ ID NO: 40243 - DNA, 30 bp, Homo sapiens
  misc_feature 1..30: note = chr4:6627192-6627222
  misc_feature 1..30: note = hypo
  source 1..30: mol_type = genomic DNA
cagcaatcctggaagcggctagccgcaggt

SEQ ID NO: 40244 - DNA, 47 bp, Homo sapiens; identical to SEQ ID NO: 14679
  misc_feature 1..47: note = chr4:6670153-6670200
  misc_feature 1..47: note = hypo
  source 1..47: mol_type = genomic DNA

SEQ ID NO: 40245 - DNA, 93 bp, Homo sapiens
  misc_feature 1..93: note = chr4:6719866-6719959
  misc_feature 1..93: note = hypo
  source 1..93: mol_type = genomic DNA
agagcatggtatatttctttcctctcgaaatggatagttaaattatttgtgtgagtgaatggtattaggattttcctgcggatacagtagact

SEQ ID NO: 40246 - DNA, 153 bp, Homo sapiens; identical to SEQ ID NO: 14681
  misc_feature 1..153: note = chr4:6748421-6748574
  misc_feature 1..153: note = hypo
  source 1..153: mol_type = genomic DNA

SEQ ID NO: 40247 - DNA, 44 bp, Homo sapiens
  misc_feature 1..44: note = chr4:6896389-6896433
  misc_feature 1..44: note = hypo
  source 1..44: mol_type = genomic DNA
gcaatccccaggctgcggggtgctgagcacgcaaggcaacccct

SEQ ID NO: 40248 - DNA, 43 bp, Homo sapiens
  misc_feature 1..43: note = chr4:6957577-6957620
  misc_feature 1..43: note = hypo
  source 1..43: mol_type = genomic DNA
tagcagcctcggacacgtaagtccgagtcgcagctctgtgttg

SEQ ID NO: 40249 - DNA, 19 bp, Homo sapiens
  misc_feature 1..19: note = chr4:7035959-7035978
  misc_feature 1..19: note = hypo
  source 1..19: mol_type = genomic DNA
gagacgcagggaaggatgt

SEQ ID NO: 40250 - DNA, 151 bp, Homo sapiens
  misc_feature 1..151: note = chr4:7047052-7047203
  misc_feature 1..151: note = hypo
  source 1..151: mol_type = genomic DNA
cccggctgatgtttacgtttacttcttgccttgaccactttgggagcctccttgttcgttattccccctccaccccattcccctattccacacaccataaccggagcgagctttggaagcacaaagcgcctcacaccggcctcagtggctt

SEQ ID NO: 40251 - DNA, 24 bp, Homo sapiens
  misc_feature 1..24: note = chr4:7084531-7084555
  misc_feature 1..24: note = hypo
  source 1..24: mol_type = genomic DNA
cgccatgcccggccccttgttcct

SEQ ID NO: 40252 - DNA, 30 bp, Homo sapiens
  misc_feature 1..30: note = chr4:7134112-7134142
  misc_feature 1..30: note = hypo
  source 1..30: mol_type = genomic DNA
gttgccacgtcgccacgcagccacctaaag

SEQ ID NO: 40253 - DNA, 30 bp, Homo sapiens
  misc_feature 1..30: note = chr4:7237615-7237645
  misc_feature 1..30: note = hypo
  source 1..30: mol_type = genomic DNA
acaggtgtgagcacccgtgaaactctaggt

SEQ ID NO: 40254 - DNA, 32 bp, Homo sapiens
  misc_feature 1..32: note = chr4:7475475-7475507
  misc_feature 1..32: note = hypo
  source 1..32: mol_type = genomic DNA
aggtgggagggtgggcgcggtcctggcatggg

SEQ ID NO: 40255 - DNA, 233 bp, Homo sapiens
  misc_feature 1..233: note = chr4:7647740-7647973
  misc_feature 1..233: note = hypo
  source 1..233: mol_type = genomic DNA
tgccctagagtcaaacgtgttcattcggtcagcaaatgggccttgcgcacccggcagccacggattccgggctaccgctggtgccgcaggtgagcgaggcaggtgtgtgcccccgggctgtgagcggcttagccgaggagcaggagataaactcccaggacgcaaggaagtcagcaaacagctgtgcaggcgtgagctccgcacagcgcacacggggccggcaggctggggac

SEQ ID NO: 40256 - DNA, 30 bp, Homo sapiens
  misc_feature 1..30: note = chr4:7679932-7679962
  misc_feature 1..30: note = hypo
  source 1..30: mol_type = genomic DNA
agtgcttcctggaggcggctgagcaggagt

SEQ ID NO: 40257 - DNA, 339 bp, Homo sapiens
  misc_feature 1..339: note = chr4:7741325-7741664
  misc_feature 1..339: note = hypo
  source 1..339: mol_type = genomic DNA
caggtgaaggatgggcgaggactcaggcaaggactcaggtgtgtctgggctgtgccgcgggtgctcccagccgtgtctcccggtgcccttgaggcggggcagctctgggtcctgggtcctcgacctgtctccttgactcctaaccagcccccacccgggacacccggctcaccccttggcactgacatccctatgcccccctctctcccactctcgcctcccggggcctcgccactctacgccctgcagcgcccactgccaggagggggcggagcctcagcccctctcgcacccccttgctgccgatgccgggggcgatccccacgcaggtcagtggct

SEQ ID NO: 40258 - DNA, 30 bp, Homo sapiens
  misc_feature 1..30: note = chr4:7968495-7968525
  misc_feature 1..30: note = hypo
  source 1..30: mol_type = genomic DNA
agcggggaagggtggcgtgaagctagccgt

SEQ ID NO: 40259 - DNA, 105 bp, Homo sapiens
  misc_feature 1..105: note = chr4:8039486-8039591
  misc_feature 1..105: note = hypo
  source 1..105: mol_type = genomic DNA
acccctcagcagggtcgggggcccttctgtcctgtctacctctggcctaccctggcccacagtggcgctcctgcccttgctgaatgaatgcgggacgctgggaga

SEQ ID NO: 40260 - DNA, 114 bp, Homo sapiens
  misc_feature 1..114: note = chr4:8240177-8240291
  misc_feature 1..114: note = hypo
  source 1..114: mol_type = genomic DNA
acactggcactgcatcggtgctcgttgtgggctggggggccagggcgctccagtccagggactgagctcttgggggccttagaacaacatgaggagctgcggcaaccctaagac

SEQ ID NO: 40261 - DNA, 32 bp, Homo sapiens
  misc_feature 1..32: note = chr4:8252769-8252801
  misc_feature 1..32: note = hypo
  source 1..32: mol_type = genomic DNA
caccagcacagggtccgcgcctagcaggcgtt

SEQ ID NO: 40262 - DNA, 105 bp, Homo sapiens
  misc_feature 1..105: note = chr4:8327019-8327124
  misc_feature 1..105: note = hypo
  source 1..105: mol_type = genomic DNA
gggccagaggagacacggactcagagaagaggcaggtggtctcactgttcaactcccctgggccctcggcacaggctaatcatcaaatgccgctcctgtgcagga

SEQ ID NO: 40263 - DNA, 30 bp, Homo sapiens
  misc_feature 1..30: note = chr4:8378202-8378232
  misc_feature 1..30: note = hypo
  source 1..30: mol_type = genomic DNA
gcagggtgaagcacacggcagcagggtctc

SEQ ID NO: 40264 - DNA, 30 bp, Homo sapiens
  misc_feature 1..30: note = chr4:8386144-8386174
  misc_feature 1..30: note = hypo
  source 1..30: mol_type = genomic DNA
gaaaacgggcactgacgggcagtgaattct

SEQ ID NO: 40265 - DNA, 50 bp, Homo sapiens
  misc_feature 1..50: note = chr4:8483913-8483963
  misc_feature 1..50: note = hypo
  source 1..50: mol_type = genomic DNA
cagttcttcaggaaccgcctggaggcactcctcaacggcatcctcctcca

SEQ ID NO: 40266 - DNA, 225 bp, Homo sapiens
  misc_feature 1..225: note = chr4:8607707-8607932
  misc_feature 1..225: note = hypo
  source 1..225: mol_type = genomic DNA
gcccccagtggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgaggtgagcgcccagatgcctgg

SEQ ID NO: 40267 - DNA, 110 bp, Homo sapiens
  misc_feature 1..110: note = chr4:8608541-8608651
  misc_feature 1..110: note = hypo
  source 1..110: mol_type = genomic DNA
acgtccgagtactaccggctggcggagacccgcggcgcacgcagcgaccacatccccatcccccagcactactggtggggtaaggtaggagccgccgctgcccatgctgg

SEQ ID NO: 40268 - DNA, 39 bp, Homo sapiens
  misc_feature 1..39: note = chr4:8615881-8615920
  misc_feature 1..39: note = hypo
  source 1..39: mol_type = genomic DNA
cagctgcaggaggggcgtctgtggcgagtacctgctgca

SEQ ID NO: 40269 - DNA, 30 bp, Homo sapiens
  misc_feature 1..30: note = chr4:8793763-8793793
  misc_feature 1..30: note = hypo
  source 1..30: mol_type = genomic DNA
ccgatgggagacagacgtgcacacgcacac

SEQ ID NO: 40270 - DNA, 124 bp, Homo sapiens
  misc_feature 1..124: note = chr4:8967222-8967346
  misc_feature 1..124: note = hypo
  source 1..124: mol_type = genomic DNA
acgctgccttcctcacgccgaacttcagtgaaaagcagactcagaagcggtcccaaggtgccactgtaagctgggtgaaggccagcgctgtgtgcttccagttccccctcggcatctgtagact

SEQ ID NO: 40271 - DNA, 30 bp, Homo sapiens
  misc_feature 1..30: note = chr4:10200240-10200270
  misc_feature 1..30: note = hypo
  source 1..30: mol_type = genomic DNA
atgtctcatggaaagcggcttctgccctgt

SEQ ID NO: 40272 - DNA, 30 bp, Homo sapiens
  misc_feature 1..30: note = chr4:15697120-15697150
  misc_feature 1..30: note = hypo
  source 1..30: mol_type = genomic DNA
aagctgagtggtcctcgggggctgactcgc

SEQ ID NO: 40273 - DNA, 33 bp, Homo sapiens
  misc_feature 1..33: note = chr4:15789491-15789524
  misc_feature 1..33: note = hypo
  source 1..33: mol_type = genomic DNA
ttaacattgttgttccgccgtgcagggagcagt

SEQ ID NO: 40274 - DNA, 100 bp, Homo sapiens
  misc_feature 1..100: note = chr4:16787098-16787198
  misc_feature 1..100: note = hypo
  source 1..100: mol_type = genomic DNA
tgcccattccgactccgtaaacaggccaaaatgtaatgtggcagcatcgcctaccgtggctgcaatggccgggcagcagccgcatcgggtgaaagcagag

SEQ ID NO: 40275 - DNA, 30 bp, Homo sapiens
  misc_feature 1..30: note = chr4:24535112-24535142
  misc_feature 1..30: note = hypo
  source 1..30: mol_type = genomic DNA
cctcagacttaaagacggcaaagttttatt

SEQ ID NO: 40276 - DNA, 37 bp, Homo sapiens
  misc_feature 1..37: note = chr4:36418721-36418758
  misc_feature 1..37: note = hypo
  source 1..37: mol_type = genomic DNA
aggaaaaattaagcacgcagatattgaaaagtgaatg

SEQ ID NO: 40277 - DNA, 97 bp, Homo sapiens
  misc_feature 1..97: note = chr4:36418818-36418915
  misc_feature 1..97: note = hypo
  source 1..97: mol_type = genomic DNA
gttgttggttgcccccttcacagttgaacacaagggcttttatatatccgctgatggggctgggttccctaggtgtataaagcgccaattcctggcg

SEQ ID NO: 40278 - DNA, 174 bp, Homo sapiens
  misc_feature 1..174: note = chr4:39448304-39448478
  misc_feature 1..174: note = hypo
  source 1..174: mol_type = genomic DNA
gcctctgttgcatgccgacgggtggctgaacccatcgacggccgaggccttccaggcctacgctgggctgtgcttccaggagctgggggacctggtgaagctctggatcaccatcaacgagcctaaccggctaagtgacatctacaaccgctctggcaacgacacctacggggc

SEQ ID NO: 40279 - DNA, 98 bp, Homo sapiens; identical to SEQ ID NO: 5017
  misc_feature 1..98: note = chr4:39816677-39816775
  misc_feature 1..98: note = hypo
  source 1..98: mol_type = genomic DNA

SEQ ID NO: 40280 - DNA, 38 bp, Homo sapiens; identical to SEQ ID NO: 5018
  misc_feature 1..38: note = chr4:39817075-39817113
  misc_feature 1..38: note = hypo
  source 1..38: mol_type = genomic DNA

SEQ ID NO: 40281 - DNA, 30 bp, Homo sapiens
  misc_feature 1..30: note = chr4:40479216-40479246
  misc_feature 1..30: note = hypo
  source 1..30: mol_type = genomic DNA
aaacggccagaatgacgacaagaacatttt

SEQ ID NO: 40282 - DNA, 100 bp, Homo sapiens
  misc_feature 1..100: note = chr4:40533094-40533194
  misc_feature 1..100: note = hypo
  source 1..100: mol_type = genomic DNA
gacagagtaagactctggaataaataaataaaatagaattctctatgcaaccattgtcaatggcatggacttggtttacataaaacgaaacctgtttgcc

SEQ ID NO: 40283 - DNA, 30 bp, Homo sapiens; identical to SEQ ID NO: 14692
  misc_feature 1..30: note = chr4:40910280-40910310
  misc_feature 1..30: note = hypo
  source 1..30: mol_type = genomic DNA

SEQ ID NO: 40284 - DNA, 81 bp, Homo sapiens
  misc_feature 1..81: note = chr4:41314285-41314366
  misc_feature 1..81: note = hypo
  source 1..81: mol_type = genomic DNA
ctcctatcccgctgggagccacttccattgcccaataaaattctccatatacactacccttcaatccgtttgtgtgatctg

SEQ ID NO: 40285 - DNA, 29 bp, Homo sapiens
  misc_feature 1..29: note = chr4:41994108-41994137
  misc_feature 1..29: note = hypo
  source 1..29: mol_type = genomic DNA
ttgtaaaccttaggacgctgaggtgggtg

SEQ ID NO: 40286 - DNA, 151 bp, Homo sapiens
  misc_feature 1..151: note = chr4:42200720-42200871
  misc_feature 1..151: note = hypo
  source 1..151: mol_type = genomic DNA
ggaaaaaagaaagaaagaaagaaacagacactgtttagatgctactcaaatgatcagagagaaggattatacctcttcgttatagggaagttagtctaaatctggaactgcactgtgacaataccactacttctagcgctaacaccaatat

SEQ ID NO: 40287 - DNA, 30 bp, Homo sapiens
  misc_feature 1..30: note = chr4:42316051-42316081
  misc_feature 1..30: note = hypo
  source 1..30: mol_type = genomic DNA
tgaggcggcgtgccccgcccccctgtggcg

SEQ ID NO: 40288 - DNA, 90 bp, Homo sapiens
  misc_feature 1..90: note = chr4:43553281-43553371
  misc_feature 1..90: note = hypo
  source 1..90: mol_type = genomic DNA
tgagttccaggtgggcgtgagctcattgggccccagacttggagcggccgcccagtgccaacagcccaggcagtgaggggcttagcaccc

SEQ ID NO: 40289 - DNA, 30 bp, Homo sapiens
  misc_feature 1..30: note = chr4:45473432-45473462
  misc_feature 1..30: note = hypo
  source 1..30: mol_type = genomic DNA
gggatttgggaaagccgccctcaccaagtc

SEQ ID NO: 40290 - DNA, 19 bp, Homo sapiens
  misc_feature 1..19: note = chr4:48378645-48378664
  misc_feature 1..19: note = hypo
  source 1..19: mol_type = genomic DNA
tttttttttttgagacgga

SEQ ID NO: 40291 - DNA, 37 bp, Homo sapiens
  misc_feature 1..37: note = chr4:52892695-52892732
  misc_feature 1..37: note = hypo
  source 1..37: mol_type = genomic DNA
tacaggcgtaagtcatcgcgcccggcctaaattgctt

SEQ ID NO: 40292 - DNA, 178 bp, Homo sapiens
  misc_feature 1..178: note = chr4:55393642-55393820
  misc_feature 1..178: note = hypo
  source 1..178: mol_type = genomic DNA
agaactcaacgcccccgccgccccactcctcacgcttcctgatacattagggaacaccccttaagccataattgccgctggtgtcagtaaacattttaacaggcaaaaacatggccactgcacttctaagggaatctgagtctgtaaatgaagagaattctgtcgatactcacttcca

SEQ ID NO: 40293 - DNA, 31 bp, Homo sapiens
  misc_feature 1..31: note = chr4:55406444-55406475
  misc_feature 1..31: note = hypo
  source 1..31: mol_type = genomic DNA
atacacatttccggccgggcgcggtggctca

SEQ ID NO: 40294 - DNA, 68 bp, Homo sapiens
  misc_feature 1..68: note = chr4:57182183-57182251
  misc_feature 1..68: note = hypo
  source 1..68: mol_type = genomic DNA
aggaaaaagcctcaccgtttggaataaaattgagaaggaccaactattccttgcgcttcaactgcgac

SEQ ID NO: 40295 - DNA, 16 bp, Homo sapiens
  misc_feature 1..16: note = chr4:61380678-61380694
  misc_feature 1..16: note = hypo
  source 1..16: mol_type = genomic DNA
gaagcagtctggatgc

SEQ ID NO: 40296 - DNA, 30 bp, Homo sapiens
  misc_feature 1..30: note = chr4:72226942-72226972
  misc_feature 1..30: note = hypo
  source 1..30: mol_type = genomic DNA
ctttcccctggtaaccggttttcaaacatt

SEQ ID NO: 40297 - DNA, 32 bp, Homo sapiens
  misc_feature 1..32: note = chr4:74468507-74468539
  misc_feature 1..32: note = hypo
  source 1..32: mol_type = genomic DNA
aatagacacaagtttcggccaggcgcggtggc

SEQ ID NO: 40298 - DNA, 29 bp, Homo sapiens
  misc_feature 1..29: note = chr4:75241002-75241031
  misc_feature 1..29: note = hypo
  source 1..29: mol_type = genomic DNA
taaagtaatgactagcgattctttttttt

SEQ ID NO: 40299 - DNA, 148 bp, Homo sapiens
  misc_feature 1..148: note = chr4:75241331-75241479
  misc_feature 1..148: note = hypo
  source 1..148: mol_type = genomic DNA
caccgcgcccggcctgaccagcgattcttaaggttaacaggatagtggatgtaatatttctctggagatagattttttattcattggatcgcattcactcttctaccctagtttgcaagtgtttgggagcagacgcatattgcaggaa

SEQ ID NO: 40300 - DNA, 27 bp, Homo sapiens
  misc_feature 1..27: note = chr4:76912383-76912410
  misc_feature 1..27: note = hypo
  source 1..27: mol_type = genomic DNA
gtttatttttaatcccgcagtctaaaa

SEQ ID NO: 40301 - DNA, 199 bp, Homo sapiens
  misc_feature 1..199: note = chr4:76912718-76912917
  misc_feature 1..199: note = hypo
  source 1..199: mol_type = genomic DNA
cgctagataacactattccctcttaggaggaaaaaagagcaacgagggtcatataagttaatgtgtatgattttagatatgtttttattttggttttggttgtttcaacttagcgtgacccatacaagggaaaagagggctggataaaatgtgatcatgttgaccattaataaatgcaattaatcgttaaaattcaacc

SEQ ID NO: 40302 - DNA, 30 bp, Homo sapiens
  misc_feature 1..30: note = chr4:77156176-77156206
  misc_feature 1..30: note = hypo
  source 1..30: mol_type = genomic DNA
taaaaataaattggccggtcgcggtggctc

SEQ ID NO: 40303 - DNA, 30 bp, Homo sapiens
  misc_feature 1..30: note = chr4:79689676-79689706
  misc_feature 1..30: note = hypo
  source 1..30: mol_type = genomic DNA
gtggacctgtacatgcggcagaaagtctct

SEQ ID NO: 40304 - DNA, 30 bp, Homo sapiens
  misc_feature 1..30: note = chr4:79861382-79861412
  misc_feature 1..30: note = hypo
  source 1..30: mol_type = genomic DNA
atgtgtataatagaacgcttagtccattgt

SEQ ID NO: 40305 - DNA, 177 bp, Homo sapiens
  misc_feature 1..177: note = chr4:81307899-81308076
  misc_feature 1..177: note = hypo
  source 1..177: mol_type = genomic DNA
ggccttcagcttgtccggccggttgaacaacttaccgcagcttgtgtgcgtcgataaagggcatttatatttcttgaagggctggtggatcaacatgtctctcttacagtttgtccttgaggttgaatgcggactcgcacaccgagcatttgtagggcttctcgcctgagtggttgt

SEQ ID NO: 40306 - DNA, 30 bp, Homo sapiens
  misc_feature 1..30: note = chr4:82157454-82157484
  misc_feature 1..30: note = hypo
  source 1..30: mol_type = genomic DNA
cgctagatgtccagccgcttgtcttcttcc

SEQ ID NO: 40307 - DNA, 28 bp, Homo sapiens
  misc_feature 1..28: note = chr4:83149079-83149107
  misc_feature 1..28: note = hypo
  source 1..28: mol_type = genomic DNA
aacaggcaatgcagccgggcgcggtggc

SEQ ID NO: 40308 - DNA, 16 bp, Homo sapiens
  misc_feature 1..16: note = chr4:83301216-83301232
  misc_feature 1..16: note = hypo
  source 1..16: mol_type = genomic DNA
gcgacaggccatgaat

SEQ ID NO: 40309 - DNA, 100 bp, Homo sapiens
  misc_feature 1..100: note = chr4:83323436-83323536
  misc_feature 1..100: note = hypo
  source 1..100: mol_type = genomic DNA
tgcaaatgatctagacgcttgctggagttgacttgtttcatggtgagggctccttgaaacactggcaccaccaggtacttcaggtcggtggaagcaatct

SEQ ID NO: 40310 - DNA, 152 bp, Homo sapiens
  misc_feature 1..152: note = chr4:83551716-83551868
  misc_feature 1..152: note = hypo
  source 1..152: mol_type = genomic DNA
tcaagcacatgacaacgtatatttgacgtattttagctatagcgattaaatcacatgtccacactctaatgttaaatcgtagtaatattgacttgaaaagttttttaggctgggcgcgctggctcccagctactcgggaggctgaggcagga

SEQ ID NO: 40311 - DNA, 41 bp, Homo sapiens; identical to SEQ ID NO: 14696
  misc_feature 1..41: note = chr4:84169961-84170002
  misc_feature 1..41: note = hypo
  source 1..41: mol_type = genomic DNA

SEQ ID NO: 40312 - DNA, 30 bp, Homo sapiens
  misc_feature 1..30: note = chr4:86922651-86922681
  misc_feature 1..30: note = hypo
  source 1..30: mol_type = genomic DNA
aagaatggcatttaacgattcaggctttga

SEQ ID NO: 40313 - DNA, 37 bp, Homo sapiens; identical to SEQ ID NO: 14697
  misc_feature 1..37: note = chr4:87899606-87899643
  misc_feature 1..37: note = hypo
  source 1..37: mol_type = genomic DNA

SEQ ID NO: 40314 - DNA, 22 bp, Homo sapiens
  misc_feature 1..22: note = chr4:88010193-88010215
  misc_feature 1..22: note = hypo
  source 1..22: mol_type = genomic DNA
cgcatgtcgagtattaagccag

SEQ ID NO: 40315 - DNA, 30 bp, Homo sapiens
  misc_feature 1..30: note = chr4:88025280-88025310
  misc_feature 1..30: note = hypo
  source 1..30: mol_type = genomic DNA
gtgcagggtggctcacgcctgtaaccccag

SEQ ID NO: 40316 - DNA, 128 bp, Homo sapiens
  misc_feature 1..128: note = chr4:89116521-89116649
  misc_feature 1..128: note = hypo
  source 1..128: mol_type = genomic DNA
tagaagggtttgttccgggctatccagaaaacagatagggtccatataatatgtggtcggcttgttagcagcagaaggtatcctagtcacgtggcaccaaaatatgttagtagcggccaatccacaca

SEQ ID NO: 40317 - DNA, 20 bp, Homo sapiens
  misc_feature 1..20: note = chr4:89912577-89912597
  misc_feature 1..20: note = hypo
  source 1..20: mol_type = genomic DNA
gactccgtctcaaaataaaa

SEQ ID NO: 40318 - DNA, 106 bp, Homo sapiens
  misc_feature 1..106: note = chr4:90043853-90043959
  misc_feature 1..106: note = hypo
  source 1..106: mol_type = genomic DNA
tctatacgattcctgcgtgtttcccacaccaggtttcccttttataaaccccttcagtcagccttaaaatttgagttatcattttgagactcgagtccggacatgt

SEQ ID NO: 40319 - DNA, 203 bp, Homo sapiens
  misc_feature 1..203: note = chr4:91168356-91168559
  misc_feature 1..203: note = hypo
  source 1..203: mol_type = genomic DNA
gattgccattggcagcgagtgactgaaactgtggaaagcaaaactgcagctccatcccatagcaaacattaggcataaaatctttatcaaattcttatctcgtacagagttgaggacaggtaaaagggaacttgtcgtagttgttgatacatcctggttgctatgtgaataataattcacaacaatatcggaataatatagat

SEQ ID NO: 40320 - DNA, 143 bp, Homo sapiens
  misc_feature 1..143: note = chr4:95127590-95127733
  misc_feature 1..143: note = hypo
  source 1..143: mol_type = genomic DNA
attaaaacaattgaacgtatgagaaacggtagaacgatggctaccagaggctgggaagggtagtgtggggcgggggaggaccccggtggtcggtgagcatggttaatgggtacgaaaatacagtttgaatgaataagatctag

SEQ ID NO: 40321 - DNA, 17 bp, Homo sapiens
  misc_feature 1..17: note = chr4:95762912-95762929
  misc_feature 1..17: note = hypo
  source 1..17: mol_type = genomic DNA
ttcggccatcttggctc

SEQ ID NO: 40322 - DNA, 78 bp, Homo sapiens
  misc_feature 1..78: note = chr4:97118687-97118765
  misc_feature 1..78: note = hypo
  source 1..78: mol_type = genomic DNA
ggggggtttagttaccggggatggctttgggatgaaactgtcccacctcagatcatcattctcataaggagcgtgcaa

SEQ ID NO: 40323 - DNA, 17 bp, Homo sapiens
  misc_feature 1..17: note = chr4:97118825-97118842
  misc_feature 1..17: note = hypo
  source 1..17: mol_type = genomic DNA
cccgcggatctgacagg

SEQ ID NO: 40324 - DNA, 64 bp, Homo sapiens
  misc_feature 1..64: note = chr4:97442548-97442612
  misc_feature 1..64: note = hypo
  source 1..64: mol_type = genomic DNA
cactgcctcagtccccgccgtgggctcccgtgggcccaagactccctgacgggtgctaccccct

SEQ ID NO: 40325 - DNA, 106 bp, Homo sapiens
  misc_feature 1..106: note = chr4:99495888-99495994
  misc_feature 1..106: note = hypo
  source 1..106: mol_type = genomic DNA
tattacctaaaagcacgaagggtgcctagcgacggacctgatccccaacagacacatggtaaatggcaacattactgaagaagttagaggccgctctgcctggtga

SEQ ID NO: 40326 - DNA, 24 bp, Homo sapiens
  misc_feature 1..24: note = chr4:103350988-103351012
  misc_feature 1..24: note = hypo
  source 1..24: mol_type = genomic DNA
ctgaggcaggagaatcgcttgaac

SEQ ID NO: 40327 - DNA, 27 bp, Homo sapiens
  misc_feature 1..27: note = chr4:103811714-103811741
  misc_feature 1..27: note = hypo
  source 1..27: mol_type = genomic DNA
ggcttggtgcagtgacgacacacctgt

SEQ ID NO: 40328 - DNA, 30 bp, Homo sapiens
  misc_feature 1..30: note = chr4:107134495-107134525
  misc_feature 1..30: note = hypo
  source 1..30: mol_type = genomic DNA
tagaaataagaataccgggggaggaaccaa

SEQ ID NO: 40329 - DNA, 23 bp, Homo sapiens
  misc_feature 1..23: note = chr4:107994276-107994299
  misc_feature 1..23: note = hypo
  source 1..23: mol_type = genomic DNA
gggctacacgtggcacttgcagg

SEQ ID NO: 40330 - DNA, 122 bp, Homo sapiens
  misc_feature 1..122: note = chr4:108302152-108302274
  misc_feature 1..122: note = hypo
  source 1..122: mol_type = genomic DNA
ggaagaaatcgtttacgccctctgttggcagcaggggcctgtcctcctttactctttagaatctagagggagaaagccaaaaaccaacctctctagaagggaaagaccggtgtctagacaac

SEQ ID NO: 40331 - DNA, 26 bp, Homo sapiens
  misc_feature 1..26: note = chr4:109311251-109311277
  misc_feature 1..26: note = hypo
  source 1..26: mol_type = genomic DNA
aataaaaacagccaacggcggccggg

SEQ ID NO: 40332 - DNA, 79 bp, Homo sapiens
  misc_feature 1..79: note = chr4:110735440-110735519
  misc_feature 1..79: note = hypo
  source 1..79: mol_type = genomic DNA
aaaaagaccaacattcgttaaaatcaaattgcagcatttactaaactaaaagaaaaagaacaagtaaagtttcctctct

SEQ ID NO: 40333 - DNA, 19 bp, Homo sapiens
  misc_feature 1..19: note = chr4:110735819-110735838
  misc_feature 1..19: note = hypo
  source 1..19: mol_type = genomic DNA
gccccgcctacaaaggtat

SEQ ID NO: 40334 - DNA, 30 bp, Homo sapiens; identical to SEQ ID NO: 14701
  misc_feature 1..30: note = chr4:113154853-113154883
  misc_feature 1..30: note = hypo
  source 1..30: mol_type = genomic DNA

SEQ ID NO: 40335 - DNA, 30 bp, Homo sapiens
  misc_feature 1..30: note = chr4:113199029-113199059
  misc_feature 1..30: note = hypo
  source 1..30: mol_type = genomic DNA
ttcatccatttctgtcggagaactgctttg

SEQ ID NO: 40336 - DNA, 28 bp, Homo sapiens
  misc_feature 1..28: note = chr4:113559151-113559179
  misc_feature 1..28: note = hypo
  source 1..28: mol_type = genomic DNA
tattaaaacattttgcgaggctgggcac

SEQ ID NO: 40337 - DNA, 87 bp, Homo sapiens
  misc_feature 1..87: note = chr4:113559419-113559506
  misc_feature 1..87: note = hypo
  source 1..87: mol_type = genomic DNA
gcagcctgggccactgagagaggctgcgtctccaaacaaacatttttcatataatttcctcaggagaaattacgaaatacttttaaa

SEQ ID NO: 40338 - DNA, 30 bp, Homo sapiens
  misc_feature 1..30: note = chr4:114176916-114176946
  misc_feature 1..30: note = hypo
  source 1..30: mol_type = genomic DNA
tgcccagggagaccacgtggaatgtgtgaa

SEQ ID NO: 40339 - DNA, 89 bp, Homo sapiens; identical to SEQ ID NO: 14704
  misc_feature 1..89: note = chr4:123866964-123867053
  misc_feature 1..89: note = hypo
  source 1..89: mol_type = genomic DNA

SEQ ID NO: 40340 - DNA, 34 bp, Homo sapiens
  misc_feature 1..34: note = chr4:124335284-124335318
  misc_feature 1..34: note = hypo
  source 1..34: mol_type = genomic DNA
tgtttgcaggccgggcgcggcagctcacgcctgt

SEQ ID NO: 40341 - DNA, 100 bp, Homo sapiens
  misc_feature 1..100: note = chr4:128984233-128984333
  misc_feature 1..100: note = hypo
  source 1..100: mol_type = genomic DNA
ccaatgctgtatggccgtcggtgctttattttgattgtagtaactgcaacttaagaaagtaaaaatgggccggcgcggtggctcacgcctgtaatcccag

SEQ ID NO: 40342 - DNA, 30 bp, Homo sapiens
  misc_feature 1..30: note = chr4:136320705-136320735
  misc_feature 1..30: note = hypo
  source 1..30: mol_type = genomic DNA
ggccaaaatttctttcgcagatcttacact

SEQ ID NO: 40343 - DNA, 37 bp, Homo sapiens
  misc_feature 1..37: note = chr4:140566711-140566748
  misc_feature 1..37: note = hypo
  source 1..37: mol_type = genomic DNA
agattacaggcatgggccaccgcgcccggcctgtttt

SEQ ID NO: 40344 - DNA, 30 bp, Homo sapiens
  misc_feature 1..30: note = chr4:140753539-140753569
  misc_feature 1..30: note = hypo
  source 1..30: mol_type = genomic DNA
acaaacgtgagccaccgcacctggcccctc

SEQ ID NO: 40345 - DNA, 59 bp, Homo sapiens
  misc_feature 1..59: note = chr4:140754226-140754285
  misc_feature 1..59: note = hypo
  source 1..59: mol_type = genomic DNA
gactacatcgataaacggaggttcagctccctcactcttcgtcacgtcaccagcagctt

SEQ ID NO: 40346 - DNA, 30 bp, Homo sapiens
  misc_feature 1..30: note = chr4:141031335-141031365
  misc_feature 1..30: note = hypo
  source 1..30: mol_type = genomic DNA
agtaaggaaatcagacggtaaaatgtccta

SEQ ID NO: 40347 - DNA, 30 bp, Homo sapiens
  misc_feature 1..30: note = chr4:144100466-144100496
  misc_feature 1..30: note = hypo
  source 1..30: mol_type = genomic DNA
ttcacatttttgggccgaccagccattagg

SEQ ID NO: 40348 - DNA, 43 bp, Homo sapiens
  misc_feature 1..43: note = chr4:146853888-146853931
  misc_feature 1..43: note = hypo
  source 1..43: mol_type = genomic DNA
gtgttgggattacaggcgtgagccaccgcgctcagcttgtatt

SEQ ID NO: 40349 - DNA, 32 bp, Homo sapiens
  misc_feature 1..32: note = chr4:147048518-147048550
  misc_feature 1..32: note = hypo
  source 1..32: mol_type = genomic DNA
tccctgttgttaagtgacgcatgactatatat

SEQ ID NO: 40350 - DNA, 20 bp, Homo sapiens
  misc_feature 1..20: note = chr4:153437373-153437393
  misc_feature 1..20: note = hypo
  source 1..20: mol_type = genomic DNA
caactggtactggtccgtgg

SEQ ID NO: 40351 - DNA, 100 bp, Homo sapiens
  misc_feature 1..100: note = chr4:153535608-153535708
  misc_feature 1..100: note = hypo
  source 1..100: mol_type = genomic DNA
ggaggccctagccaccggtgcagccttcattgcctgccactccccctatgcaccctaagtgcggcagccaagccgtgcagtcctgcgctttctgactcac

SEQ ID NO: 40352 - DNA, 30 bp, Homo sapiens
  misc_feature 1..30: note = chr4:153702805-153702835
  misc_feature 1..30: note = hypo
  source 1..30: mol_type = genomic DNA
gcttagcatgacccacgtcttctcccaact

SEQ ID NO: 40353 - DNA, 181 bp, Homo sapiens
  misc_feature 1..181: note = chr4:153918964-153919145
  misc_feature 1..181: note = hypo
  source 1..181: mol_type = genomic DNA
gatgctcggactctccgtgtgtgccattttgcagtggggtcacgctccacgtgttgttctgccactgcctttggtttctcgacactgcctcgtggacacgcagggagagcttgcagctggtgacaagctctccagcaggtgagtaatccagcagctctttctgcctcgaggtgagtgaggt

SEQ ID NO: 40354 - DNA, 63 bp, Homo sapiens
  misc_feature 1..63: note = chr4:154216373-154216436
  misc_feature 1..63: note = hypo
  source 1..63: mol_type = genomic DNA
gtagagtctccttctcgccggtggagggcactgccccgggctaggccccgccctgtgggacga

SEQ ID NO: 40355 - DNA, 163 bp, Homo sapiens
  misc_feature 1..163: note = chr4:154216735-154216898
  misc_feature 1..163: note = hypo
  source 1..163: mol_type = genomic DNA
cagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacgggga

SEQ ID NO: 40356 - DNA, 30 bp, Homo sapiens
  misc_feature 1..30: note = chr4:154372568-154372598
  misc_feature 1..30: note = hypo
  source 1..30: mol_type = genomic DNA
gccagcgtggtggctcgggcctgtaatcct

SEQ ID NO: 40357 - DNA, 115 bp, Homo sapiens
  misc_feature 1..115: note = chr4:154540115-154540230
  misc_feature 1..115: note = hypo
  source 1..115: mol_type = genomic DNA
ctgggatatgtctcacgcctctgaatctagcttgtcctgcattccccttttctttgtcatactcacggagaactctttgatgcttctggtcaccgagtcccgcctctcagtagtc

SEQ ID NO: 40358 - DNA, 30 bp, Homo sapiens
  misc_feature 1..30: note = chr4:154702659-154702689
  misc_feature 1..30: note = hypo
  source 1..30: mol_type = genomic DNA
ctgccaccgcttcaccgaggtgatcaccag

SEQ ID NO: 40359 - DNA, 40 bp, Homo sapiens
  misc_feature 1..40: note = chr4:155321157-155321197
  misc_feature 1..40: note = hypo
  source 1..40: mol_type = genomic DNA
gtaagtaggctttcacggccgggcgcggtggctcatgcct

SEQ ID NO: 40360 - DNA, 173 bp, Homo sapiens
  misc_feature 1..173: note = chr4:155677688-155677861
  misc_feature 1..173: note = hypo
  source 1..173: mol_type = genomic DNA
gggatgttgcggttgcggggagaaggcagactgtgggttgagatttaaatggaaaatgactacgagcttctctttgtagcagtttggtgggagaagaaagaaacagataaagcccaaagactcagaaagcagtataacgtgatatctcttactacttccgcatgctttagaac

SEQ ID NO: 40361 - DNA, 89 bp, Homo sapiens
  misc_feature 1..89: note = chr4:156676888-156676977
  misc_feature 1..89: note = hypo
  source 1..89: mol_type = genomic DNA
caggcgtgagccaccgcgcccggccgattacaatacttttaatacttaacttaccaaagtaatttatttttattcgctgaaaatgtgag

SEQ ID NO: 40362 - DNA, 40 bp, Homo sapiens
  misc_feature 1..40: note = chr4:157119835-157119875
  misc_feature 1..40: note = hypo
  source 1..40: mol_type = genomic DNA
ggcagagacacaagcagcttgatgtcgtgaggaacaccta

SEQ ID NO: 40363 - DNA, 169 bp, Homo sapiens
  misc_feature 1..169: note = chr4:158740667-158740836
  misc_feature 1..169: note = hypo
  source 1..169: mol_type = genomic DNA
acgcaccagccgtcacgctccctctccacactgcagcttccttctgcctcacggcaactccccacttcacactgctagtacgtgtctgccaggtgtctgccaggtgagttctgcttctgttgccctgccagcacacaggagttcaatccacctccgatagccccactga

SEQ ID NO: 40364 - DNA, 153 bp, Homo sapiens
  misc_feature 1..153: note = chr4:170484641-170484794
  misc_feature 1..153: note = hypo
  source 1..153: mol_type = genomic DNA
aatgctgcttcaccacgattttctaggtaggtaatcatatcaaatgtaaatacgatatgtctatgttttctctcctcttccaatatttacatttctttccttttaattgctctagctagaacctctggcataatttaacgatggcaatgacag

SEQ ID NO: 40365 - DNA, 30 bp, Homo sapiens
  misc_feature 1..30: note = chr4:170919945-170919975
  misc_feature 1..30: note = hypo
  source 1..30: mol_type = genomic DNA
ttaaatctgccaaaacgagtatgttagttt

SEQ ID NO: 40366 - DNA, 22 bp, Homo sapiens
  misc_feature 1..22: note = chr4:172596059-172596081
  misc_feature 1..22: note = hypo
  source 1..22: mol_type = genomic DNA
taacatacgcccacttgggctc

SEQ ID NO: 40367 - DNA, 31 bp, Homo sapiens
  misc_feature 1..31: note = chr4:172903760-172903791
  misc_feature 1..31: note = hypo
  source 1..31: mol_type = genomic DNA
gtttgcttcttccagacgagcttgttggagg

SEQ ID NO: 40368 - DNA, 69 bp, Homo sapiens
  misc_feature 1..69: note = chr4:175940800-175940869
  misc_feature 1..69: note = hypo
  source 1..69: mol_type = genomic DNA
agtacgcgtgtgcctcgcgccagtccacgctaggagagcactgggaccgagacccggcaccacctcccg

SEQ ID NO: 40369 - DNA, 21 bp, Homo sapiens
  misc_feature 1..21: note = chr4:178599688-178599709
  misc_feature 1..21: note = hypo
  source 1..21: mol_type = genomic DNA
ccactgcgcccagccgagtcc

SEQ ID NO: 40370 - DNA, 30 bp, Homo sapiens
  misc_feature 1..30: note = chr4:180818589-180818619
  misc_feature 1..30: note = hypo
  source 1..30: mol_type = genomic DNA
tcctagttgtaaggacgtacgaaatgattc

SEQ ID NO: 40371 - DNA, 30 bp, Homo sapiens
  misc_feature 1..30: note = chr4:183959079-183959109
  misc_feature 1..30: note = hypo
  source 1..30: mol_type = genomic DNA
aatcaactcatatgccgctacagaggcccc

SEQ ID NO: 40372 - DNA, 30 bp, Homo sapiens
  misc_feature 1..30: note = chr4:184205426-184205456
  misc_feature 1..30: note = hypo
  source 1..30: mol_type = genomic DNA
gttcgccccaaagagcgcagcagcctgagc

SEQ ID NO: 40373 - DNA, 15 bp, Homo sapiens
  misc_feature 1..15: note = chr4:184375711-184375726
  misc_feature 1..15: note = hypo
  source 1..15: mol_type = genomic DNA
cgatcctgcttcttt

SEQ ID NO: 40374 - DNA, 30 bp, Homo sapiens
  misc_feature 1..30: note = chr4:184921881-184921911
  misc_feature 1..30: note = hypo
  source 1..30: mol_type = genomic DNA
ggtgttatccttcctcgactctcagcaccc

SEQ ID NO: 40375 - DNA, 30 bp, Homo sapiens
  misc_feature 1..30: note = chr4:185833058-185833088
  misc_feature 1..30: note = hypo
  source 1..30: mol_type = genomic DNA
caatgcccgctgcagcgggaaacaattgtt

SEQ ID NO: 40376 - DNA, 30 bp, Homo sapiens
  misc_feature 1..30: note = chr4:185913935-185913965
  misc_feature 1..30: note = hypo
  source 1..30: mol_type = genomic DNA
ttcttggggacaggacgtcaacgtatcctt

SEQ ID NO: 40377 - DNA, 161 bp, Homo sapiens
  misc_feature 1..161: note = chr4:186348467-186348628
  misc_feature 1..161: note = hypo
  source 1..161: mol_type = genomic DNA
ggatgtggggaagggcgttgtatttagttatgtttcagtttaaaatgaatcttcacttgcccctttggtgttacgtattagcaatgattcatgctcaggtgagccagtttcaggcaggcttgcagagaggcactcaaacagcttgctttaaatttaaggta

SEQ ID NO: 40378 - DNA, 72 bp, Homo sapiens
  misc_feature 1..72: note = chr4:190474969-190475041
  misc_feature 1..72: note = hypo
  source 1..72: mol_type = genomic DNA
cagcgcacctgtccacgagtctggccgcagcgcacctgtccccgagtccggccgcagcgcacctgtccacaa

SEQ ID NO: 40379 - DNA, 36 bp, Homo sapiens
  misc_feature 1..36: note = chr5:109867-109903
  misc_feature 1..36: note = hypo
  source 1..36: mol_type = genomic DNA
ccattcctgctctaccgccaccgccccattggctaa

SEQ ID NO: 40380 - DNA, 30 bp, Homo sapiens
  misc_feature 1..30: note = chr5:139715-139745
  misc_feature 1..30: note = hypo
  source 1..30: mol_type = genomic DNA
tgcaggtcacgtcggcggggaagcagtcag

SEQ ID NO: 40381 - DNA, 37 bp, Homo sapiens
  misc_feature 1..37: note = chr5:140350-140387
  misc_feature 1..37: note = hypo
  source 1..37: mol_type = genomic DNA
ccgagcagcaggaggcggccgccgggggaccccactt

SEQ ID NO: 40382 - DNA, 81 bp, Homo sapiens
  misc_feature 1..81: note = chr5:192215-192296
  misc_feature 1..81: note = hypo
  source 1..81: mol_type = genomic DNA
gcccctcgttccgggcggacagcctgagccccagccagctcctgcacgtgctgcgtctggctggcccgggtgccctgcgca

SEQ ID NO: 40383 - DNA, 46 bp, Homo sapiens
  misc_feature 1..46: note = chr5:429731-429777
  misc_feature 1..46: note = hypo
  source 1..46: mol_type = genomic DNA
gcagctcagccttgccgcgcgatcctgcagccgccactgggcagcc

SEQ ID NO: 40384 - DNA, 30 bp, Homo sapiens
  misc_feature 1..30: note = chr5:430228-430258
  misc_feature 1..30: note = hypo
  source 1..30: mol_type = genomic DNA
cttaagttgcagtcacgtgtgttgccttgt

SEQ ID NO: 40385 - DNA, 75 bp, Homo sapiens
  misc_feature 1..75: note = chr5:435499-435574
  misc_feature 1..75: note = hypo
  source 1..75: mol_type = genomic DNA
attagaaatacaacacgcggagaaaggggtccgtgagcccactcatagaggaatctagaacgttccaggcagcag

SEQ ID NO: 40386 - DNA, 30 bp, Homo sapiens
  misc_feature 1..30: note = chr5:478182-478212
  misc_feature 1..30: note = hypo
  source 1..30: mol_type = genomic DNA
actgcactcagacctcgccaggtgggcacc

SEQ ID NO: 40387 - DNA, 286 bp, Homo sapiens
  misc_feature 1..286: note = chr5:479388-479674
  misc_feature 1..286: note = hypo
  source 1..286: mol_type = genomic DNA
gtgcgggagccagggcggcagtggcctcggggctgggtggggcgcctggcctctggtctctggagcagtcaggggctctgcagacgctgagaggcctgctcatagtggactgggagatgctggagcagcctcagagccatggccggcccacagcgggagacggccctgctgctgcccctctgcctgtgcgtgtgcacctgtgggcacctgcgtgtgctggggcaggcagggctgtattgggaccaggtcccgtaacagcctgcctgcttaccgtctgctcccatcc

SEQ ID NO: 40388 - DNA, 164 bp, Homo sapiens; identical to SEQ ID NO: 14710
  misc_feature 1..164: note = chr5:480880-481044
  misc_feature 1..164: note = hypo
  source 1..164: mol_type = genomic DNA

SEQ ID NO: 40389 - DNA, 30 bp, Homo sapiens
  misc_feature 1..30: note = chr5:484548-484578
  misc_feature 1..30: note = hypo
  source 1..30: mol_type = genomic DNA
gctggctcgccctgccggacccaggagggt

SEQ ID NO: 40390 - DNA, 30 bp, Homo sapiens
  misc_feature 1..30: note = chr5:488495-488525
  misc_feature 1..30: note = hypo
  source 1..30: mol_type = genomic DNA
ggacctcctcaaacacggccaggacggcca

SEQ ID NO: 40391 - DNA, 146 bp, Homo sapiens
  misc_feature 1..146: note = chr5:488846-488992
  misc_feature 1..146: note = hypo
  source 1..146: mol_type = genomic DNA
tcatctttgggtgaacggaggcaggtgggtgcaggggcaccgcatgctggggagggatgggggcccatcgcctggagtggcgtcccagcccaggagaagcaagtggggctgacccaggacgggcccggagccgggacacacagcac

SEQ ID NO: 40392 - DNA, 839 bp, Homo sapiens
  misc_feature 1..839: note = chr5:491305-492144
  misc_feature 1..839: note = hypo
  source 1..839: mol_type = genomic DNA
aagctgtagcatccccggcagcagcggcgggcatcagggctgcaccgcacctggcatgttgagaggcgccagccacgcgtggtctgggtccggggcgggaggcagtgcccgagagatgaagcatccaagaccaaaaccgcgcagcagttctggctccggctgtggctgcagcggtggccgagcggctccggcacacaggctgggagggacggtgcccgatacaccaggctctgcagtcctcctcctctccctgggacctggtggccggcgagtgtggacggacccctacctctgcccagtgccggaggaagagcggcagcccctggccacctgcagcccccaagccgagctgccgagatgggaactcctccccaagcagaacacgtgctgggacctggggacgcgcaggggactggccttggtcacgagggcctacggggctgccagccacgtttctcacctgacacttaccgcctggaggccagggtgcggcaccccgacctttctgagatgaggcagcgccgcccctcccggaccccaccctgatcccggccggggcaacagtggcgcagactcacccatgagcccactgaggaagacgccgtagagggacagcccggtggtggccgcgttccacacggtacccacgacggcgtacaacaggatggtccccaggttgccgaagaagaggcggttgggcatgaagtagccggcgtccagcacgatggggggcagcaggtagaagaagaagacggtgggcgtcagtgtgaaggacgcgatgtggtcggccgcccagacgatgccgcccagcaccaggcccagcacgatgagcagggcgc

SEQ ID NO: 40393 - DNA, 197 bp, Homo sapiens
  misc_feature 1..197: note = chr5:516758-516955
  misc_feature 1..197: note = hypo
  source 1..197: mol_type = genomic DNA
tttaggccaggtgagcgtggtttctctctgggcacatgacccactcctgagagagctctgtgtggggcagatggtgctcaccatgctgagcccagatctgccaaagtgctctgagccgatgctgcaattgcttgtcaatgatcccactttgcaggttaagtctgccactccttggcaggcggcgcctctaaagccat

SEQ ID NO: 40394 - DNA, 30 bp, Homo sapiens
  misc_feature 1..30: note = chr5:519988-520018
  misc_feature 1..30: note = hypo
  source 1..30: mol_type = genomic DNA
gaccctgtgccctagcgtcctcctgaccct

SEQ ID NO: 40395 - DNA, 49 bp, Homo sapiens
  misc_feature 1..49: note = chr5:537890-537939
  misc_feature 1..49: note = hypo
  source 1..49: mol_type = genomic DNA
gtgtctgcattggcccgagggcctgggggaatcccgttcccacactggt

SEQ ID NO: 40396 - DNA, 265 bp, Homo sapiens; identical to SEQ ID NO: 14714
  misc_feature 1..265: note = chr5:538686-538951
  misc_feature 1..265: note = hypo
  source 1..265: mol_type = genomic DNA

SEQ ID NO: 40397 - DNA, 284 bp, Homo sapiens
  misc_feature 1..284: note = chr5:554299-554583
  misc_feature 1..284: note = hypo
  source 1..284: mol_type = genomic DNA
ggcaaggaaaataaacgagccgttacctttcaccaaatcgcactgtattttattcatttagggtgtacacacctatctgctcttcaaaggaattttgggcagattgtaaaattacgctcaacatacagcaaggcgactataaatacaaaagcagcactgaggtgctggtgctgcgggtgggtcacgggataaaccaggcgtggggtctgggtcacgggatgacccgagggtgggtcacgggataaaccaggggtggggtctgggtcacaggatgacccgggggt

SEQ ID NO: 40398 - DNA, 120 bp, Homo sapiens
  misc_feature 1..120: note = chr5:554823-554943
  misc_feature 1..120: note = hypo
  source 1..120: mol_type = genomic DNA
cgggatgaacggggttgggggctgggtcacgggatgaaccggggggtgggtcacgggatgaacggggggggggtgggtcacgggctaaaccggggttgggggtgggtcacgggatgaacg

SEQ ID NO: 40399 - DNA, 43 bp, Homo sapiens
  misc_feature 1..43: note = chr5:555183-555226
  misc_feature 1..43: note = hypo
  source 1..43: mol_type = genomic DNA
cggggtgaggggtgggtcaccggatgaacgggggtgggtcatg

SEQ ID NO: 40400 - DNA, 30 bp, Homo sapiens
  misc_feature 1..30: note = chr5:555668-555698
  misc_feature 1..30: note = hypo
  source 1..30: mol_type = genomic DNA
gtccctcgagccctccgcataaacctctgt

SEQ ID NO: 40401 - DNA, 250 bp, Homo sapiens
  misc_feature 1..250: note = chr5:556065-556315
  misc_feature 1..250: note = hypo
  source 1..250: mol_type = genomic DNA
cagggaggggtgggccgagaagtgtggatgggtacatggagggtcccgggccctcggggtctggctggtagcactgggaggaggtgaaaagcaaggcttgtgagggctcagctcccagagttgcaactctgcggactgcagcggggccttggctccacctgcgcttctggtctcggctgccctgacagccactgggctccaggcaggcctgggtggtgaggacggcgctgggctgcggccaccagatcca

SEQ ID NO: 40402 - DNA, 30 bp, Homo sapiens
  misc_feature 1..30: note = chr5:583170-583200
  misc_feature 1..30: note = hypo
  source 1..30: mol_type = genomic DNA
cctgtgactggggatcgctctgccatcggc

SEQ ID NO: 40403 - DNA, 30 bp, Homo sapiens
  misc_feature 1..30: note = chr5:595300-595330
  misc_feature 1..30: note = hypo
  source 1..30: mol_type = genomic DNA
aaagaaaaatcgatgcgagaacacccttcg

SEQ ID NO: 40404 - DNA, 30 bp, Homo sapiens
  misc_feature 1..30: note = chr5:601155-601185
  misc_feature 1..30: note = hypo
  source 1..30: mol_type = genomic DNA
gaccagcagtgcatgcggctctggattcat

SEQ ID NO: 40405 - DNA, 47 bp, Homo sapiens
  misc_feature 1..47: note = chr5:676852-676899
  misc_feature 1..47: note = hypo
  source 1..47: mol_type = genomic DNA
agaaaacagacaatgcgtgacacggcaacagacgtgtgcacacatga

SEQ ID NO: 40406 - DNA, 195 bp, Homo sapiens
  misc_feature 1..195: note = chr5:677865-678060
  misc_feature 1..195: note = hypo
  source 1..195: mol_type = genomic DNA
tgatcttgctgaagacgatgtccacgtcagtgacggtcacgttcctgccgtcgatcacctggcagtccttgcacagcttcgaccagttcttgccgtgcatctccctcccggtggccctggcgtccccgtgcacggcaaagcgccggaaggcctcctccagggcactgagctcaggggatgcggctgccccctcac

SEQ ID NO: 40407 - DNA, 54 bp, Homo sapiens
  misc_feature 1..54: note = chr5:684241-684295
  misc_feature 1..54: note = hypo
  source 1..54: mol_type = genomic DNA
ccctccaatgtcccacggccacagtttccaccttgacgccgaagccctgggatg

SEQ ID NO: 40408 - DNA, 30 bp, Homo sapiens
  misc_feature 1..30: note = chr5:891092-891122
  misc_feature 1..30: note = hypo
  source 1..30: mol_type = genomic DNA
gacattcagagacaccggaggaaacctcag

SEQ ID NO: 40409 - DNA, 36 bp, Homo sapiens
  misc_feature 1..36: note = chr5:891651-891687
  misc_feature 1..36: note = hypo
  source 1..36: mol_type = genomic DNA
cccctcctccagccacgcaggcgcactctgcctggg

SEQ ID NO: 40410 - DNA, 95 bp, Homo sapiens
  misc_feature 1..95: note = chr5:1003105-1003200
  misc_feature 1..95: note = hypo
  source 1..95: mol_type = genomic DNA
gtttcacatgttcaccggtgtgtacgcccgggtgtgcttcgaactgagaagccaggagcccagggcttctctgctgcccacgaatcatgccttct

SEQ ID NO: 40411 - DNA, 135 bp, Homo sapiens
  misc_feature 1..135: note = chr5:1021355-1021490
  misc_feature 1..135: note = hypo
  source 1..135: mol_type = genomic DNA
cagatatggaggctccgtctgaatgtatctagggcttatgtgggaagcccggctcccctgcccggtccccccggccccccacctcccagcccctttgctcctcccgctgacccggccccccgcccctccacccac

SEQ ID NO: 40412 - DNA, 423 bp, Homo sapiens
  misc_feature 1..423: note = chr5:1034312-1034735
  misc_feature 1..423: note = hypo
  source 1..423: mol_type = genomic DNA
taggaggcgaggtcccggcccccacgtccccccacaggcactccagtgcgatgtctcggtggaggaggacgaccgccaggagtggacgttcacgctctatgactttgacaactgcgggaaggtcaccagggaggtaggtgagcttgtgtttgcgtcaggtccacagtagtagacagacggggcagacagactgtgctggcctcgcgatacctcagggggcaggaggggacctgcctgctgcgaggtcctcatgccagctgggcttgcgtctccccagggcccagttcacgtgtgtttctgggccgagcctgcgccgcccatttctgcggctgtgcttcccacactgcaaggctgccctcagggcactggaggcgctcacagggccacctgggcagacccaggctgctccgagaagatgcctgt

SEQ ID NO: 40413 - DNA, 30 bp, Homo sapiens
  misc_feature 1..30: note = chr5:1039154-1039184
  misc_feature 1..30: note = hypo
  source 1..30: mol_type = genomic DNA
ggtagcccctggtcccggagccacagcagc

SEQ ID NO: 40414 - DNA, 836 bp, Homo sapiens
  misc_feature 1..836: note = chr5:1073480-1074316
  misc_feature 1..836: note = hypo
  source 1..836: mol_type = genomic DNA
ggggctcacccatggcgggaggaggcggtcccagggttcgcccttggaaagctaatggccctcacacctcccaagcttcccggggtgcggctggtgctcccaggccttagcgcgctgctctgagctcaaagccaccgccacggctaaaacacagcagcgccacgcacagcaccgtgttgacacgctgcgatgaggacatgccagggcacgtttcctgtgcagctggggtgggaaagaggcctggcccccagaccccgcccggcccacctcctcggcccgctgagcctccatgtgcttgtccaggtacgtcccctccagcaccgagcccacgatggtcaggcccttgccggccttcagctgcgacgtgaaggacagcaggcgggggtgcttcacggcctgctccgcgtccaggttcagcatcaccagcacctggggcctgcagccagggtggggcggctgttaccacggcaacgcttaccagggcacggcccatcaacaggcagggcagatgggacgggcggggcacacgacacaggtgggacgggagatacatgacaggcgggacaggggacaaaaggggcaggtgacagatgggatggggaaacgtgacacacgtggggtaagttgaacaggtgacaggtgagacaggccacagaagccaggtgggacaggcagggccgatggacaggtgggcactagccaggcaggacaggagaacaggtaggttagacaggtgggacaggtgacatgctagacaggtgagacaatggcccaggacacacacctgaagcccccaccgaggccctgaggggacaatggcccggggcacacccgag

SEQ ID NO: 40415 - DNA, 39 bp, Homo sapiens
  misc_feature 1..39: note = chr5:1131348-1131387
  misc_feature 1..39: note = hypo
  source 1..39: mol_type = genomic DNA
gatgtgcagggacaccgtccctcccggccgtcctgctcc

SEQ ID NO: 40416 - DNA, 125 bp, Homo sapiens; identical to SEQ ID NO: 5026
  misc_feature 1..125: note = chr5:1174263-1174388
  misc_feature 1..125: note = hypo
  source 1..125: mol_type = genomic DNA

SEQ ID NO: 40417 - DNA, 70 bp, Homo sapiens
  misc_feature 1..70: note = chr5:1189557-1189627
  misc_feature 1..70: note = hypo
  source 1..70: mol_type = genomic DNA
tcaaggccaggaggccgccatggggaccccacccagcactgtgctggacacaacgcggcaagacaagaaa

SEQ ID NO: 40418 - DNA, 30 bp, Homo sapiens
  misc_feature 1..30: note = chr5:1193360-1193390
  misc_feature 1..30: note = hypo
  source 1..30: mol_type = genomic DNA
agaggagggacaggccgtgagttgagggag

SEQ ID NO: 40419 - DNA, 215 bp, Homo sapiens
  misc_feature 1..215: note = chr5:1193772-1193987
  misc_feature 1..215: note = hypo
  source 1..215: mol_type = genomic DNA
tacctcggagaactccgggcatgaatgtgcgaaaggcaggaacagacgtccacggcggctttcatcctcatggcgcaaacgggacccctaccgtcagcaatggagccgtgaaggagctgcagccgtggacctggagcaggcacagcgagccagggtgcgaggcccggacagctctgagcggaacagcgagccacctgcagcgtccagctcgagac

SEQ ID NO: 40420 - DNA, 165 bp, Homo sapiens
  misc_feature 1..165: note = chr5:1221142-1221307
  misc_feature 1..165: note = hypo
  source 1..165: mol_type = genomic DNA
ctggcaaggggaggccgggcacctcgcagcacaccatctgttcgggtagcagaacgtacagaaagcttagcgagttgaagcccagctggtagcagcagtgacagctgtctctggccttggcaggttcaataaggacatcgagttcatgatcggccacaagcccaa

SEQ ID NO: 40421 - DNA, 37 bp, Homo sapiens
  misc_feature 1..37: note = chr5:1223271-1223308
  misc_feature 1..37: note = hypo
  source 1..37: mol_type = genomic DNA
tctctgcgttctggccgcttcccggcttaatgaatgc

SEQ ID NO: 40422 - DNA, 343 bp, Homo sapiens
  misc_feature 1..343: note = chr5:1232902-1233245
  misc_feature 1..343: note = hypo
  source 1..343: mol_type = genomic DNA
gtactacaacaccatcgtggcgtgggtgctgtggtacctcctcaactccttccagcacccgctgccctggagctcctgcccaccggacctcaacagaacaggtgagctgggcgccgcctgctgtgtgggtccgtgcacggccgagagaggcatgtgctgcagcgtgtccagcatcagagcagctgcgggtggcggatgctcaccgcggggggagggccggggaaccggttgctctgtgtgcacatgcacgcgcctcggtctccccaggagcacacgtgcagtccagttcttatgacctccacgctgtgctgtgcttccctgccaggtccggaccaccgaggtc

SEQ ID NO: 40423 - DNA, 886 bp, Homo sapiens; identical to SEQ ID NO: 29363
  misc_feature 1..886: note = chr5:1294557-1295443
  misc_feature 1..886: note = hypo
  source 1..886: mol_type = genomic DNA

SEQ ID NO: 40424 - DNA, 50 bp, Homo sapiens
  misc_feature 1..50: note = chr5:1346659-1346709
  misc_feature 1..50: note = hypo
  source 1..50: mol_type = genomic DNA
gggtggattgtctcacggcatccagaggcagggaccgaggcagggaccta

SEQ ID NO: 40425 - DNA, 30 bp, Homo sapiens
  misc_feature 1..30: note = chr5:1362773-1362803
  misc_feature 1..30: note = hypo
  source 1..30: mol_type = genomic DNA
tatccacaaaaaaagcgagttttcattccc

SEQ ID NO: 40426 - DNA, 27 bp, Homo sapiens
  misc_feature 1..27: note = chr5:1381058-1381085
  misc_feature 1..27: note = hypo
  source 1..27: mol_type = genomic DNA
atgggacgccacatccgccagcaccct

SEQ ID NO: 40427 - DNA, 87 bp, Homo sapiens
  misc_feature 1..87: note = chr5:1381145-1381232
  misc_feature 1..87: note = hypo
  source 1..87: mol_type = genomic DNA
tcaggcttaggcgtgttgtcacagcagcccgaatggactccagcagcagagcagccagggctgcacgtggtgcgtgaacacacccgc

SEQ ID NO: 40428 - DNA, 41 bp, Homo sapiens
  misc_feature 1..41: note = chr5:1384936-1384977
  misc_feature 1..41: note = hypo
  source 1..41: mol_type = genomic DNA
gagcaaaccaggcctcggcatgggcacgggatgaactcagg

SEQ ID NO: 40429 - DNA, 40 bp, Homo sapiens
  misc_feature 1..40: note = chr5:1406427-1406467
  misc_feature 1..40: note = hypo
  source 1..40: mol_type = genomic DNA
tgtccatcagggcagcgcattcccccgatgctggacacgt

SEQ ID NO: 40430 - DNA, 30 bp, Homo sapiens
  misc_feature 1..30: note = chr5:1422106-1422136
  misc_feature 1..30: note = hypo
  source 1..30: mol_type = genomic DNA
ggtggaggtgcagcacgccacgtctgcaga

SEQ ID NO: 40431 - DNA, 30 bp, Homo sapiens
  misc_feature 1..30: note = chr5:1662561-1662591
  misc_feature 1..30: note = hypo
  source 1..30: mol_type = genomic DNA
ctctgcctgcccagccgcccctctgcgccg

SEQ ID NO: 40432 - DNA, 90 bp, Homo sapiens
  misc_feature 1..90: note = chr5:1662801-1662891
  misc_feature 1..90: note = hypo
  source 1..90: mol_type = genomic DNA
cgtgtcccacactcccgcaggctggggacacgcagacaaagtgtgtccctgtgtctgtgtgtatctgtctgtgtgcgtccctgtgtctgt

SEQ ID NO: 40433 - DNA, 30 bp, Homo sapiens
  misc_feature 1..30: note = chr5:1704607-1704637
  misc_feature 1..30: note = hypo
  source 1..30: mol_type = genomic DNA
gattgtgggccgatccggctccagccccgt

SEQ ID NO: 40434 - DNA, 35 bp, Homo sapiens
  misc_feature 1..35: note = chr5:1746022-1746057
  misc_feature 1..35: note = hypo
  source 1..35: mol_type = genomic DNA
tccctgagccgagcacgccccgtccacttggtggg

SEQ ID NO: 40435 - DNA, 724 bp, Homo sapiens
  misc_feature 1..724: note = chr5:1746453-1747177
  misc_feature 1..724: note = hypo
  source 1..724: mol_type = genomic DNA
ccaaggagggcagttcgctccggggcacctgtcaggggccccacacggctgcttttaggccaggggtggcaaagacgctgctgccgcctgctctgggctcggctcccatggctgtgaaggaccctcgtcactccccgtcgcctgcctgggctgcccggggaccctcctgctgcgtcagcacagagcctggaaccgcggccaaggcaggaagctcccctgtgaaggcaccaagcacggcagacgccctcacatcgccggggcccgtttccctgtggacgggaagtgggaacgtgacgtggacgtgacgtgggaacgtaacgtgacgtgacgtgacgtgacgtggcatggcgcgaggacagcgcggcgggagcggcgcctcagatccagcagggagggagacgaaaggcggatggaagaggggcccccggaccccgcccctcgaggcttgtgtgccgccctggctgcggcgttctgggcgacgggaaacagagtcaggacacagaccagggagggccggggcagagccagggcacctgcgggcgaggacggctgggtgctgggtccccggcgtcagggcgcaatgccgcctgctgggcgtcaccctttcccagggctgctgggacacgtggccgcagctgcttggctcaccacagcggaagtcggtctctctcatcctggagtccgcgcggctgagggcgaggtgtccttccgggggccctgaggg

SEQ ID NO: 40436 - DNA, 86 bp, Homo sapiens
  misc_feature 1..86: note = chr5:1749854-1749940
  misc_feature 1..86: note = hypo
  source 1..86: mol_type = genomic DNA
gaggcagtggaggaccggaaccatgaccacagtgctgtggacacacatatgtacatacactgtaaaaagaaacgctgggaggctaa

SEQ ID NO: 40437 - DNA, 30 bp, Homo sapiens
  misc_feature 1..30: note = chr5:1750588-1750618
  misc_feature 1..30: note = hypo
  source 1..30: mol_type = genomic DNA
gcatcacacggttatcgtcacacggacatt

SEQ ID NO: 40438 - DNA, 30 bp, Homo sapiens
  misc_feature 1..30: note = chr5:1780761-1780791
  misc_feature 1..30: note = hypo
  source 1..30: mol_type = genomic DNA
ggacaaatcagtttccgttgataaaagaaa

SEQ ID NO: 40439 - DNA, 30 bp, Homo sapiens
  misc_feature 1..30: note = chr5:1794613-1794643
  misc_feature 1..30: note = hypo
  source 1..30: mol_type = genomic DNA
gcatgctcatctgtccgggctgcaataaca

SEQ ID NO: 40440 - DNA, 228 bp, Homo sapiens
  misc_feature 1..228: note = chr5:1795233-1795461
  misc_feature 1..228: note = hypo
  source 1..228: mol_type = genomic DNA
acagccatgcccactcgcagggaggcagggaagccccagcccccaccggtccggcacaggaaggagacctggaccctgggagtgccggtctcgcctcccactctcctgggtgagtgacagcgacgctgccaggtgggtggtccatcagttagacctggtccgtgagtagcctcctaggtggatacaaacatgacagcgtcccacagagcacctcgcctccttctggaa

SEQ ID NO: 40441 - DNA, 194 bp, Homo sapiens
  misc_feature 1..194: note = chr5:1865547-1865741
  misc_feature 1..194: note = hypo
  source 1..194: mol_type = genomic DNA
gaaaaacgaagccaccgcgattatgattatgggaacatagggtttacacgggggagttgctggggagggcatttcaggacagccttgatcaaagggctggggagatggtccaggcgatgccaaccggaagccccagaggaggagaggaaagccatccactaggggaccatcgctggccccgagctctgggtggg

SEQ ID NO: 40442 - DNA, 34 bp, Homo sapiens
  misc_feature 1..34: note = chr5:1869209-1869243
  misc_feature 1..34: note = hypo
  source 1..34: mol_type = genomic DNA
ccagacacctggaaccgtccgcgtgcacaggctc

SEQ ID NO: 40443 - DNA, 39 bp, Homo sapiens
  misc_feature 1..39: note = chr5:1923035-1923074
  misc_feature 1..39: note = hypo
  source 1..39: mol_type = genomic DNA
ggtctccagtgaatgcggcgtccacgcctgatcggggct

SEQ ID NO: 40444 - DNA, 138 bp, Homo sapiens
  misc_feature 1..138: note = chr5:1949531-1949669
  misc_feature 1..138: note = hypo
  source 1..138: mol_type = genomic DNA
tcagtaccctgtctgcggggtggggcgatgcgaacctacaccctgggatgggggtgcccgcccagggcagtgctgtctgtgatcttgccatgcccagggcacccactccatgacgctggctgtcggtgctttccaggg

SEQ ID NO: 40445 - DNA, 471 bp, Homo sapiens
  misc_feature 1..471: note = chr5:1950766-1951237
  misc_feature 1..471: note = hypo
  source 1..471: mol_type = genomic DNA
tctgaaacagcccctcggcagcttcacgacctcaccaagtgcccgccgctctcacgagagaggtggttatggttgcgcattgaatatgcttgggagaggcaaagatggatggcgtagtctctaccctcacacccagtgctgagcgcgagtcgtccgctgtgtgtgcatcatctgctgtgcgtgtgtcatctgctgtgcatgcctgcgtcatctgctgtgtatgtgtcatctgttgtgcatgcgtgtgtcgtctgctgtgggcgcgtgagtcatctgctctgtgtgcttgtgccgtctgctgtgcctgcgtcatcgtctgctgtgcgtgtgtcatctgtgcgtgtgtcatctgctgtgcgtgagtcatctgctgtgcgtgtgtcatctgtgcgtgtgtcatctgctgtgcgtgcgtgtgccctctactgtgggtgtgttcatcatctgctgtgcgtgcgttgtctgctgtgc

SEQ ID NO: 40446 - DNA, 110 bp, Homo sapiens
  misc_feature 1..110: note = chr5:1951574-1951684
  misc_feature 1..110: note = hypo
  source 1..110: mol_type = genomic DNA
gcatcgtctgctctgcgtgcgtgcgtcatctgctgtgcgtgtgtcatctgctgtgcgtgtgccatctgctgcgggtgcatcatctgctgtgcgtgcgtgtgccatctgtg

SEQ ID NO: 40447 - DNA, 35 bp, Homo sapiens
  misc_feature 1..35: note = chr5:2112239-2112274
  misc_feature 1..35: note = hypo
  source 1..35: mol_type = genomic DNA
tgtcaatattaattccgccgcggagattacttgtt

SEQ ID NO: 40448 - DNA, 408 bp, Homo sapiens
  misc_feature 1..408: note = chr5:2136910-2137318
  misc_feature 1..408: note = hypo
  source 1..408: mol_type = genomic DNA
agaggtgactgggcccgtgtgtgtgcgtgggcagaagtgactgggcgtgcgtgtgtggacagaagtgaccgggcgcgcctgtgtgggcgggcagaggtgactgggccagcatgcgtgggtgggcagaggtgaccgggcatgcgtgcgtgggcgggcagaggtgaccgggcgtgcgtgggtggacagaggtgactaggcattgcttgcgtgggtgggcagaggtgaccgggcttgcgtgcgtgggtggacagaggtgaccaggcgtgcgtgcgtgggcagaggtgactgggcattgcgtgcgtgggtggacagacgtgactaggcgcgagtgcgtgggtggacagaagtgagtaggcgtgcatgcgtgggtggacagaagtgactaggcacgtgcgtgggtggacagaa

SEQ ID NO: 40449 - DNA, 37 bp, Homo sapiens
  misc_feature 1..37: note = chr5:2180638-2180675
  misc_feature 1..37: note = hypo
  source 1..37: mol_type = genomic DNA
gctcgcgtcctctcacgagatacggggctgctctccc

SEQ ID NO: 40450 - DNA, 30 bp, Homo sapiens
  misc_feature 1..30: note = chr5:2199933-2199963
  misc_feature 1..30: note = hypo
  source 1..30: mol_type = genomic DNA
ccctggtcagtcctgcgtggggtggccatg

SEQ ID NO: 40451 - DNA, 127 bp, Homo sapiens
  misc_feature 1..127: note = chr5:2261622-2261749
  misc_feature 1..127: note = hypo
  source 1..127: mol_type = genomic DNA
ccacgaggccctggtcggacacaggctgcccgcagccccttcccacaggagcaccaccagtaaggcctttactgtccccttatcccttgctgtttccccaccgacaccctgacgctgagcagccgga

SEQ ID NO: 40452 - DNA, 30 bp, Homo sapiens
  misc_feature 1..30: note = chr5:2324383-2324413
  misc_feature 1..30: note = hypo
  source 1..30: mol_type = genomic DNA
tgtgtgcatcaggaccgagagctggggtag

SEQ ID NO: 40453 - DNA, 68 bp, Homo sapiens; identical to SEQ ID NO: 14739
  misc_feature 1..68: note = chr5:2369614-2369682
  misc_feature 1..68: note = hypo
  source 1..68: mol_type = genomic DNA

SEQ ID NO: 40454 - DNA, 164 bp, Homo sapiens
  misc_feature 1..164: note = chr5:2374826-2374990
  misc_feature 1..164: note = hypo
  source 1..164: mol_type = genomic DNA
cctggcctccttttacgcggctcctgtgaaagcagagatgggggccagggctctatttggccttcgcaagctcaagaaagccacctatgggagcacgttgtttgtgtaaaccccctgctcatctctacagggctgccggcgaggggagccgctctctctgcagg

SEQ ID NO: 40455 - DNA, 30 bp, Homo sapiens
  misc_feature 1..30: note = chr5:2493697-2493727
  misc_feature 1..30: note = hypo
  source 1..30: mol_type = genomic DNA
gggtatagatgtcagcgcctgactgtgcat

SEQ ID NO: 40456 - DNA, 184 bp, Homo sapiens
  misc_feature 1..184: note = chr5:2523567-2523751
  misc_feature 1..184: note = hypo
  source 1..184: mol_type = genomic DNA
ggccacatgcgtgcccgaaagggaaagcataggctgtctccgcggcctcacttgtttctacttccctgacctgtttgtcccactgacttaccgcctctggaatgaacacccgacagcatggaagggagattcctgtccagtgcctgggctgtactctgcatgccgctctcggttccactttcag

SEQ ID NO: 40457 - DNA, 162 bp, Homo sapiens
  misc_feature 1..162: note = chr5:2541481-2541643
  misc_feature 1..162: note = hypo
  source 1..162: mol_type = genomic DNA
gtgtgcctgtgtgcacgcatgcgtgtgcaggctctgctgtgtgtgtgtggtgtgtgcctgtgtgcacgcatgcatgtgcgggctctgctgtgcatgtctgtgtatcgtgtgactgcgtgcatgcttgcatgtgccgactctgatgtgcgtgtctatgtattg

SEQ ID NO: 40458 - DNA, 30 bp, Homo sapiens
  misc_feature 1..30: note = chr5:2547162-2547192
  misc_feature 1..30: note = hypo
  source 1..30: mol_type = genomic DNA
tttaattagctctggcgtcctcttcataat

SEQ ID NO: 40459 - DNA, 30 bp, Homo sapiens
  misc_feature 1..30: note = chr5:2865625-2865655
  misc_feature 1..30: note = hypo
  source 1..30: mol_type = genomic DNA
gttgctattggtgtacgccattttgtttgt

SEQ ID NO: 40460 - DNA, 50 bp, Homo sapiens
  misc_feature 1..50: note = chr5:2890843-2890893
  misc_feature 1..50: note = hypo
  source 1..50: mol_type = genomic DNA
ctaccttacacaccacgcacaggccgcaaggccaccgggaaatgatgaaa

SEQ ID NO: 40461 - DNA, 30 bp, Homo sapiens
  misc_feature 1..30: note = chr5:3027341-3027371
  misc_feature 1..30: note = hypo
  source 1..30: mol_type = genomic DNA
cacgtctcagtccaccggtgaggggcagtg

SEQ ID NO: 40462 - DNA, 86 bp, Homo sapiens
  misc_feature 1..86: note = chr5:3031843-3031929
  misc_feature 1..86: note = hypo
  source 1..86: mol_type = genomic DNA
ctgccaggggttcagcggggaggcagtgagcaggccaagcaccgagggtttcgagggtggtgaaactgttccaagcgacaggtaat

SEQ ID NO: 40463 - DNA, 85 bp, Homo sapiens
  misc_feature 1..85: note = chr5:3031989-3032074
  misc_feature 1..85: note = hypo
  source 1..85: mol_type = genomic DNA
ccgcatgtgcactgcggcctttgggtgacaatcacccgtcactgtggctcatcccttgtgaccaagctgccgcacagagcagggt

SEQ ID NO: 40464 - DNA, 134 bp, Homo sapiens
  misc_feature 1..134: note = chr5:3221047-3221181
  misc_feature 1..134: note = hypo
  source 1..134: mol_type = genomic DNA
cctttccagcctgcccggcgctagggctccatggaaccccaagctctctggcttcagaactgctccaggcaaatgcgtggcatcattcataaggaggcagcgtcttgcggtgctgagaccgagcccctggctgc

SEQ ID NO: 40465 - DNA, 30 bp, Homo sapiens
  misc_feature 1..30: note = chr5:3269777-3269807
  misc_feature 1..30: note = hypo
  source 1..30: mol_type = genomic DNA
aatgtggctgtgagacgtcagaagggcgtc

SEQ ID NO: 40466 - DNA, 275 bp, Homo sapiens; identical to SEQ ID NO: 5028
  misc_feature 1..275: note = chr5:3324844-3325119
  misc_feature 1..275: note = hypo
  source 1..275: mol_type = genomic DNA

SEQ ID NO: 40467 - DNA, 30 bp, Homo sapiens
  misc_feature 1..30: note = chr5:3422389-3422419
  misc_feature 1..30: note = hypo
  source 1..30: mol_type = genomic DNA
ccttacctggctgctcggtgccaagctgta

SEQ ID NO: 40468 - DNA, 75 bp, Homo sapiens
  misc_feature 1..75: note = chr5:3454354-3454429
  misc_feature 1..75: note = hypo
  source 1..75: mol_type = genomic DNA
acgctcccgctagcacggcgggcgtcacccactaacacacgctcccgctagcacggtgggcgtcacccactaaca

SEQ ID NO: 40469 - DNA, 176 bp, Homo sapiens; identical to SEQ ID NO: 14743
  misc_feature 1..176: note = chr5:3674048-3674224
  misc_feature 1..176: note = hypo
  source 1..176: mol_type = genomic DNA

SEQ ID NO: 40470 - DNA, 225 bp, Homo sapiens
  misc_feature 1..225: note = chr5:3740792-3741017
  misc_feature 1..225: note = hypo
  source 1..225: mol_type = genomic DNA
ctccacaatcttcagcgccgcgtccctgcaggtccacatgtcccccgcgggccctcccctggtttccgatgcccatcacccaacctcttctgtgtcctcagcccggggtgggggtgcagcccctgcaggtgcctcagggtgtctgtgctcccagccctacccactgctcggtcaaaccttcacatcgccttctctcctgcgcgcagctggcggcttctatcttct

SEQ ID NO: 40471 - DNA, 30 bp, Homo sapiens
  misc_feature 1..30: note = chr5:3761119-3761149
  misc_feature 1..30: note = hypo
  source 1..30: mol_type = genomic DNA
gagccagaacatgcccgctgaatgcggctc

SEQ ID NO: 40472 - DNA, 30 bp, Homo sapiens
  misc_feature 1..30: note = chr5:3761593-3761623
  misc_feature 1..30: note = hypo
  source 1..30: mol_type = genomic DNA
tctccgtgggctttgcgtctctgtgtgggt

SEQ ID NO: 40473 - DNA, 64 bp, Homo sapiens
  misc_feature 1..64: note = chr5:3775375-3775439
  misc_feature 1..64: note = hypo
  source 1..64: mol_type = genomic DNA
ggaaggtggccagctcgccatcccctcaggctgacctgccgacctctcccgtggcggttgcctg

SEQ ID NO: 40474 - DNA, 165 bp, Homo sapiens; identical to SEQ ID NO: 14745
  misc_feature 1..165: note = chr5:3806428-3806593
  misc_feature 1..165: note = hypo
  source 1..165: mol_type = genomic DNA

SEQ ID NO: 40475 - DNA, 149 bp, Homo sapiens
  misc_feature 1..149: note = chr5:3856433-3856582
  misc_feature 1..149: note = hypo
  source 1..149: mol_type = genomic DNA
ttctagaaaaggagccggggacttgcagaaaaggcgctcagggcatttcccctgggcaggagggagagaagcagagggcaggagtgaagtctccgccaacacatgctactgacaaagggtatgaagggcacctgcgcagcaaggaagcc

SEQ ID NO: 40476 - DNA, 165 bp, Homo sapiens
  misc_feature 1..165: note = chr5:3859680-3859845
  misc_feature 1..165: note = hypo
  source 1..165: mol_type = genomic DNA
gaatggaagagtgatcgctgattgtttgggctcagagaggcctaccagcctgactgttggaaaagcacattagacagatgggatgtagcggctagaagagcaggtgccagacggaaaatccactcatgaagtcagagctacctgtggcaccggtaccctgttgga

SEQ ID NO: 40477 - DNA, 19 bp, Homo sapiens
  misc_feature 1..19: note = chr5:3945363-3945382
  misc_feature 1..19: note = hypo
  source 1..19: mol_type = genomic DNA
taatcccagcagtttcgga

SEQ ID NO: 40478 - DNA, 186 bp, Homo sapiens
  misc_feature 1..186: note = chr5:4083874-4084060
  misc_feature 1..186: note = hypo
  source 1..186: mol_type = genomic DNA
cctctcacgctttcccggggtagacaccttgaacgccaacaagcgattgtcacctggaggctgagtgtggcaccctgacaggctttttctggggtcctgaacacctggaaggcacaagtccctctgcagtggaggtgccattaggtgggtacagtgagagtcagggagaaacgccctgcaggctga

SEQ ID NO: 40479 - DNA, 217 bp, Homo sapiens
  misc_feature 1..217: note = chr5:4144299-4144516
  misc_feature 1..217: note = hypo
  source 1..217: mol_type = genomic DNA
tcctctcaaagccgtgatattctatgcaagcaacattcatagaagcacagcttactacatgtgttctgtgtgccgtgctcttgcgtgcacctggaatgccaactgcacagtttactgtgtcctgtgtgccgtgctcttgtgtgcatgcagaatgctgaccgcacagttactaagtgttctgtgttccgtgctctcgtgtgcacgtggaatgtggacc

SEQ ID NO: 40480 - DNA, 34 bp, Homo sapiens
  misc_feature 1..34: note = chr5:4278472-4278506
  misc_feature 1..34: note = hypo
  source 1..34: mol_type = genomic DNA
tttgaaaaggcaaatcggacgacattcagagaag

SEQ ID NO: 40481 - DNA, 31 bp, Homo sapiens
  misc_feature 1..31: note = chr5:4279105-4279136
  misc_feature 1..31: note = hypo
  source 1..31: mol_type = genomic DNA
cgtgagccaccgcgcccggccacaaattctt

SEQ ID NO: 40482 - DNA, 33 bp, Homo sapiens
  misc_feature 1..33: note = chr5:4581296-4581329
  misc_feature 1..33: note = hypo
  source 1..33: mol_type = genomic DNA
caggcacacacacagcgacgctcttggagagca

SEQ ID NO: 40483 - DNA, 35 bp, Homo sapiens
  misc_feature 1..35: note = chr5:4629575-4629610
  misc_feature 1..35: note = hypo
  source 1..35: mol_type = genomic DNA
catcctttaaccctccgcgccgtacaccacccttt

SEQ ID NO: 40484 - DNA, 30 bp, Homo sapiens
  misc_feature 1..30: note = chr5:4630470-4630500
  misc_feature 1..30: note = hypo
  source 1..30: mol_type = genomic DNA
gtcctgacaccttgacgagttctgctctgt

SEQ ID NO: 40485 - DNA, 30 bp, Homo sapiens
  misc_feature 1..30: note = chr5:4866871-4866901
  misc_feature 1..30: note = hypo
  source 1..30: mol_type = genomic DNA
tcattgtgacgaggtcgaggctgtaagggg

SEQ ID NO: 40486 - DNA, 30 bp, Homo sapiens
  misc_feature 1..30: note = chr5:4867541-4867571
  misc_feature 1..30: note = hypo
  source 1..30: mol_type = genomic DNA
acggctcctggctggcgatggggctgtcag

SEQ ID NO: 40487 - DNA, 178 bp, Homo sapiens
  misc_feature 1..178: note = chr5:5296474-5296652
  misc_feature 1..178: note = hypo
  source 1..178: mol_type = genomic DNA
gaggaatcggttgaccggactccccgccctccccagtttttttattgccacatcctagttagtcctcataatgggtaaaaaataaaattagtacaactttaatacaagaaattgacgccacaaaggggaagggagggtagctcagaactttcttggccagtctcggggattttctgaa

SEQ ID NO: 40488 - DNA, 30 bp, Homo sapiens
  misc_feature 1..30: note = chr5:5303702-5303732
  misc_feature 1..30: note = hypo
  source 1..30: mol_type = genomic DNA
aaggggtggaggaagcgggcagtggcctgt

SEQ ID NO: 40489 - DNA, 30 bp, Homo sapiens
  misc_feature 1..30: note = chr5:5571405-5571435
  misc_feature 1..30: note = hypo
  source 1..30: mol_type = genomic DNA
aagcaggatgtgtgccggctcttcccggtg

SEQ ID NO: 40490 - DNA, 30 bp, Homo sapiens
  misc_feature 1..30: note = chr5:5577581-5577611
  misc_feature 1..30: note = hypo
  source 1..30: mol_type = genomic DNA
gagtgtgtttgcacgcggtattgatgaagg

SEQ ID NO: 40491 - DNA, 30 bp, Homo sapiens
  misc_feature 1..30: note = chr5:5652506-5652536
  misc_feature 1..30: note = hypo
  source 1..30: mol_type = genomic DNA
tcccatcagctcagccgcagccttaggttc

SEQ ID NO: 40492 - DNA, 211 bp, Homo sapiens
  misc_feature 1..211: note = chr5:5719870-5720081
  misc_feature 1..211: note = hypo
  source 1..211: mol_type = genomic DNA
tcagccatcttcatccgaagggcctggtatctctttactctgactgtgataacaaagtgccacaggccgggtgacctcaacaatcaaaatctgtttttgcacatttctggaggctggaagttggagattaaggtgttggcaggtgcgatttcctctgagacctgtctcctggccttgcagatggcagcctcctcgccgtgtcctcccacgg

SEQ ID NO: 40493 - DNA, 30 bp, Homo sapiens
  misc_feature 1..30: note = chr5:6219037-6219067
  misc_feature 1..30: note = hypo
  source 1..30: mol_type = genomic DNA
caggcaagctccacacgtcccactgccgct

SEQ ID NO: 40494 - DNA, 30 bp, Homo sapiens
  misc_feature 1..30: note = chr5:6478603-6478633
  misc_feature 1..30: note = hypo
  source 1..30: mol_type = genomic DNA
ctttttggtcaaagtcgtgaagctcctgct

SEQ ID NO: 40495 - DNA, 15 bp, Homo sapiens
  misc_feature 1..15: note = chr5:9011746-9011761
  misc_feature 1..15: note = hypo
  source 1..15: mol_type = genomic DNA
cgatagggggagact

SEQ ID NO: 40496 - DNA, 86 bp, Homo sapiens
  misc_feature 1..86: note = chr5:10248731-10248817
  misc_feature 1..86: note = hypo
  source 1..86: mol_type = genomic DNA
cgcactgtaaactgaactcctgggctccacccatcctcctgcctcagccccagagtagatgggaacacagtcgccaagtctgttct

SEQ ID NO: 40497 - DNA, 167 bp, Homo sapiens; identical to SEQ ID NO: 14749
  misc_feature 1..167: note = chr5:10267279-10267446
  misc_feature 1..167: note = hypo
  source 1..167: mol_type = genomic DNA

SEQ ID NO: 40498 - DNA, 30 bp, Homo sapiens
  misc_feature 1..30: note = chr5:10269033-10269063
  misc_feature 1..30: note = hypo
  source 1..30: mol_type = genomic DNA
ccaggcatgggctgtcgcatacacagtggc

SEQ ID NO: 40499 - DNA, 30 bp, Homo sapiens
  misc_feature 1..30: note = chr5:10652405-10652435
  misc_feature 1..30: note = hypo
  source 1..30: mol_type = genomic DNA
agcgccctaaagctccgcaggtaactgcac

SEQ ID NO: 40500 - DNA, 45 bp, Homo sapiens
  misc_feature 1..45: note = chr5:10675402-10675447
  misc_feature 1..45: note = hypo
  source 1..45: mol_type = genomic DNA
gaacataagcctttacggtgacactgcctgcgtgcaagtcccaag

SEQ ID NO: 40501 - DNA, 30 bp, Homo sapiens
  misc_feature 1..30: note = chr5:10864262-10864292
  misc_feature 1..30: note = hypo
  source 1..30: mol_type = genomic DNA
gtgtgggaggtatttcgaatttcactttac

SEQ ID NO: 40502 - DNA, 30 bp, Homo sapiens
  misc_feature 1..30: note = chr5:14501805-14501835
  misc_feature 1..30: note = hypo
  source 1..30: mol_type = genomic DNA
aggtgaggaagcccacgtgaagatagggat

SEQ ID NO: 40503 - DNA, 32 bp, Homo sapiens
  misc_feature 1..32: note = chr5:14732032-14732064
  misc_feature 1..32: note = hypo
  source 1..32: mol_type = genomic DNA
aggcccagggagctgcgcgagtgtcacgtgaa

SEQ ID NO: 40504 - DNA, 30 bp, Homo sapiens
  misc_feature 1..30: note = chr5:14756455-14756485
  misc_feature 1..30: note = hypo
  source 1..30: mol_type = genomic DNA
tattacagtcattaccggtgctcactgact

SEQ ID NO: 40505 - DNA, 83 bp, Homo sapiens
  misc_feature 1..83: note = chr5:14764724-14764807
  misc_feature 1..83: note = hypo
  source 1..83: mol_type = genomic DNA
gggtggttttttacacgacaataaattgtgagactatactggcactgtctgttcgctcccagcaccctcgttggtttaaatta

SEQ ID NO: 40506 - DNA, 19 bp, Homo sapiens
  misc_feature 1..19: note = chr5:14774559-14774578
  misc_feature 1..19: note = hypo
  source 1..19: mol_type = genomic DNA
tcctcaagacacagtcgcg

SEQ ID NO: 40507 - DNA, 19 bp, Homo sapiens
  misc_feature 1..19: note = chr5:14774698-14774717
  misc_feature 1..19: note = hypo
  source 1..19: mol_type = genomic DNA
acaacgcctggctaatcat

SEQ ID NO: 40508 - DNA, 27 bp, Homo sapiens
  misc_feature 1..27: note = chr5:15503239-15503266
  misc_feature 1..27: note = hypo
  source 1..27: mol_type = genomic DNA
atagctgaggtcgggcgcggtggccca

SEQ ID NO: 40509 - DNA, 79 bp, Homo sapiens
  misc_feature 1..79: note = chr5:16032731-16032810
  misc_feature 1..79: note = hypo
  source 1..79: mol_type = genomic DNA
actttcaaaaatagacgtcgatcacagtttcaatatcctgatattcatgtagcatctttattaccgcactctaaaccac

SEQ ID NO: 40510 - DNA, 78 bp, Homo sapiens; identical to SEQ ID NO: 14754
  misc_feature 1..78: note = chr5:16436327-16436405
  misc_feature 1..78: note = hypo
  source 1..78: mol_type = genomic DNA

SEQ ID NO: 40511 - DNA, 30 bp, Homo sapiens
  misc_feature 1..30: note = chr5:16744496-16744526
  misc_feature 1..30: note = hypo
  source 1..30: mol_type = genomic DNA
gtgatgaggcctgggcgaaacctgggtgca

SEQ ID NO: 40512 - DNA, 182 bp, Homo sapiens
  misc_feature 1..182: note = chr5:16809241-16809423
  misc_feature 1..182: note = hypo
  source 1..182: mol_type = genomic DNA
atcatcttttggctacgagtcttgatttcatgtggaaaaaaaaaaaagccaaaaaaacccagaaagtcctgactgtgttcatctgccccaagtgtgttcaaactgcactgcgttcatctgtcccaagggcaccccaatgccaaggcagtgctaaccaaccaaccacgcggccttcaggccac

SEQ ID NO: 40513 - DNA, 141 bp, Homo sapiens
  misc_feature 1..141: note = chr5:17203036-17203177
  misc_feature 1..141: note = hypo
  source 1..141: mol_type = genomic DNA
ccgcgcccggctgggagttcttttttttttactgttggtgatgacaggactgtgaagcagtgggaattggagggctcaggctatggagaaggggaagtccttttgcatatggtattaagaaggcggcggacactgggactg

SEQ ID NO: 40514 - DNA, 30 bp, Homo sapiens
  misc_feature 1..30: note = chr5:17327404-17327434
  misc_feature 1..30: note = hypo
  source 1..30: mol_type = genomic DNA
aggtgtcagcggaggcggggggggctgggg

SEQ ID NO: 40515 - DNA, 30 bp, Homo sapiens
  misc_feature 1..30: note = chr5:17492138-17492168
  misc_feature 1..30: note = hypo
  source 1..30: mol_type = genomic DNA
gccaggagtctccctcgcaggcagtctgtt

SEQ ID NO: 40516 - DNA, 68 bp, Homo sapiens
  misc_feature 1..68: note = chr5:17502391-17502459
  misc_feature 1..68: note = hypo
  source 1..68: mol_type = genomic DNA
gtgcccttttgctggcggctttagtggccagggtcttcgtggcgcctgccaggcggtggctttgctgg

SEQ ID NO: 40517 - DNA, 30 bp, Homo sapiens
  misc_feature 1..30: note = chr5:17512058-17512088
  misc_feature 1..30: note = hypo
  source 1..30: mol_type = genomic DNA
ctgttctcctgaagtcgccagtggccgcac

SEQ ID NO: 40518 - DNA, 30 bp, Homo sapiens
  misc_feature 1..30: note = chr5:30694338-30694368
  misc_feature 1..30: note = hypo
  source 1..30: mol_type = genomic DNA
gtataatttttataacgttgccctctaatt

SEQ ID NO: 40519 - DNA, 147 bp, Homo sapiens
  misc_feature 1..147: note = chr5:31111601-31111748
  misc_feature 1..147: note = hypo
  source 1..147: mol_type = genomic DNA
atatgatgtcatatgcgctactaccgacagattggttagggagagcctctctgcaaatgtgacgatgtaatcaacaggtatgtgacagtggagggtgggcacggagtgaatggaggaatgagcagtgcccaccgaggaacaggcctg

SEQ ID NO: 40520 - DNA, 105 bp, Homo sapiens
  misc_feature 1..105: note = chr5:31572171-31572276
  misc_feature 1..105: note = hypo
  source 1..105: mol_type = genomic DNA
cacagagcatgtgaccgaaatgagcaaacaggaagaagagggtgtgaaaaaatgcaaagtatgaaagagttaactatgccgggcgcggtggctcacgcctgtaat

SEQ ID NO: 40521 - DNA, 87 bp, Homo sapiens
  misc_feature 1..87: note = chr5:31691593-31691680
  misc_feature 1..87: note = hypo
  source 1..87: mol_type = genomic DNA
ttattctcttatctggcgccacctgcttttattctcttatctggcgccacctgcttttattctcttatctggcgccacctgctttta

SEQ ID NO: 40522 - DNA, 30 bp, Homo sapiens
  misc_feature 1..30: note = chr5:31889103-31889133
  misc_feature 1..30: note = hypo
  source 1..30: mol_type = genomic DNA
cttgatgctcctccccgagccccctcccct

SEQ ID NO: 40523 - DNA, 30 bp, Homo sapiens
  misc_feature 1..30: note = chr5:31982994-31983024
  misc_feature 1..30: note = hypo
  source 1..30: mol_type = genomic DNA
caactcctgatcctacggtacttaaattag

SEQ ID NO: 40524 - DNA, 21 bp, Homo sapiens
  misc_feature 1..21: note = chr5:32526565-32526586
  misc_feature 1..21: note = hypo
  source 1..21: mol_type = genomic DNA
cttctccacgccgggcgcggt

SEQ ID NO: 40525 - DNA, 79 bp, Homo sapiens
  misc_feature 1..79: note = chr5:32750220-32750299
  misc_feature 1..79: note = hypo
  source 1..79: mol_type = genomic DNA
gtcagttaccttttccgaacttccaacattttgttgatatttctcactctgtcacccaggctggagtgcggtggcgcga

SEQ ID NO: 40526 - DNA, 30 bp, Homo sapiens
  misc_feature 1..30: note = chr5:32855659-32855689
  misc_feature 1..30: note = hypo
  source 1..30: mol_type = genomic DNA
ctttaagtatgttttcgttattgtgagcaa

SEQ ID NO: 40527 - DNA, 59 bp, Homo sapiens
  misc_feature 1..59: note = chr5:33162543-33162602
  misc_feature 1..59: note = hypo
  source 1..59: mol_type = genomic DNA
aataatgagctggttcgtaccaagaccctggtgaagaattgcatcgtgctcatcgacag

SEQ ID NO: 40528 - DNA, 25 bp, Homo sapiens
  misc_feature 1..25: note = chr5:33234426-33234451
  misc_feature 1..25: note = hypo
  source 1..25: mol_type = genomic DNA
tgagctgacacgcctggctgaattt

SEQ ID NO: 40529 - DNA, 38 bp, Homo sapiens
  misc_feature 1..38: note = chr5:33298113-33298151
  misc_feature 1..38: note = hypo
  source 1..38: mol_type = genomic DNA
accctgctggcgcaccctgctggcgcaccctgctggcg

SEQ ID NO: 40530 - DNA, 30 bp, Homo sapiens
  misc_feature 1..30: note = chr5:33443001-33443031
  misc_feature 1..30: note = hypo
  source 1..30: mol_type = genomic DNA
caaacccagtatccccgtttttttccttcc

SEQ ID NO: 40531 - DNA, 197 bp, Homo sapiens
  misc_feature 1..197: note = chr5:33550087-33550284
  misc_feature 1..197: note = hypo
  source 1..197: mol_type = genomic DNA
tgtccttgcctccaccgtcaccattcctcctgcagcaccatcacgtgcagccatcactgagagtcttctcagcacttgcccccgatagccactacacaggccctactcactcccttcctctctgaccccaccccttgtgcagcagcccaggttcaccagcaggctgctgatttcccttggaccgtgataaacactga

SEQ ID NO: 40532 - DNA, 190 bp, Homo sapiens
  misc_feature 1..190: note = chr5:33880065-33880255
  misc_feature 1..190: note = hypo
  source 1..190: mol_type = genomic DNA
ccaaggccaaaaacacggactcctccataaccactttcgagactctgggattccttcccctgcagtcactcactccctaaacacacacctcaaaaaatctcaacagaattcctgagcattgtttgccctgcagttgctggtggggccatcactgttgctgcattttgagatatagcgtataatgatagaa

SEQ ID NO: 40533 - DNA, 105 bp, Homo sapiens
  misc_feature 1..105: note = chr5:34839939-34840044
  misc_feature 1..105: note = hypo
  source 1..105: mol_type = genomic DNA
ttcgttttgtgcttccgaggtttctcctatcatctaacagcaacaactaaaacagacacatgaatttcattttattgttttattttattttgagacggagtctcg

SEQ ID NO: 40534 - DNA, 35 bp, Homo sapiens; identical to SEQ ID NO: 14761
  misc_feature 1..35: note = chr5:37255512-37255547
  misc_feature 1..35: note = hypo
  source 1..35: mol_type = genomic DNA

SEQ ID NO: 40535 - DNA, 36 bp, Homo sapiens
  misc_feature 1..36: note = chr5:39343165-39343201
  misc_feature 1..36: note = hypo
  source 1..36: mol_type = genomic DNA
tgaacaggaacagctcgtttacagctcccagcgtga

SEQ ID NO: 40536 - DNA, 23 bp, Homo sapiens
  misc_feature 1..23: note = chr5:40190552-40190575
  misc_feature 1..23: note = hypo
  source 1..23: mol_type = genomic DNA
agccgagacggcaccagtatact

SEQ ID NO: 40537 - DNA, 30 bp, Homo sapiens
  misc_feature 1..30: note = chr5:40861757-40861787
  misc_feature 1..30: note = hypo
  source 1..30: mol_type = genomic DNA
agagagaattcttggcggggcgcggtggct

SEQ ID NO: 40538 - DNA, 19 bp, Homo sapiens
  misc_feature 1..19: note = chr5:41777231-41777250
  misc_feature 1..19: note = hypo
  source 1..19: mol_type = genomic DNA
aaaaggggccgggtgcggt

SEQ ID NO: 40539 - DNA, 25 bp, Homo sapiens
  misc_feature 1..25: note = chr5:43105351-43105376
  misc_feature 1..25: note = hypo
  source 1..25: mol_type = genomic DNA
agcaagactccgtcccccccaaaaa

SEQ ID NO: 40540 - DNA, 17 bp, Homo sapiens
  misc_feature 1..17: note = chr5:43402630-43402647
  misc_feature 1..17: note = hypo
  source 1..17: mol_type = genomic DNA
aaaattggtgtgtgccg

SEQ ID NO: 40541 - DNA, 106 bp, Homo sapiens
  misc_feature 1..106: note = chr5:44492896-44493002
  misc_feature 1..106: note = hypo
  source 1..106: mol_type = genomic DNA
ggcagtgggaatgaacgagagctgtaatacttcctgggttctcagatcttgggactccccaagcagaagctgtaacacctcttggggtctgcggttgctggtgtct

SEQ ID NO: 40542 - DNA, 43 bp, Homo sapiens
  misc_feature 1..43: note = chr5:44637083-44637126
  misc_feature 1..43: note = hypo
  source 1..43: mol_type = genomic DNA
aaaaaaaaaaaaaaaaatgggcaattatcgtaaaaggagttca

SEQ ID NO: 40543 - DNA, 21 bp, Homo sapiens
  misc_feature 1..21: note = chr5:44939696-44939717
  misc_feature 1..21: note = hypo
  source 1..21: mol_type = genomic DNA
gaaggtggtgctgggcgcggt

SEQ ID NO: 40544 - DNA, 33 bp, Homo sapiens
  misc_feature 1..33: note = chr5:45225683-45225716
  misc_feature 1..33: note = hypo
  source 1..33: mol_type = genomic DNA
tggactggccgaggacggagctggctccctctg

SEQ ID NO: 40545 - DNA, 39 bp, Homo sapiens
  misc_feature 1..39: note = chr5:52888052-52888091
  misc_feature 1..39: note = hypo
  source 1..39: mol_type = genomic DNA
attacaggtgtgagccgctgcgcccggcattgttgagtt

SEQ ID NO: 40546 - DNA, 30 bp, Homo sapiens
  misc_feature 1..30: note = chr5:55309328-55309358
  misc_feature 1..30: note = hypo
  source 1..30: mol_type = genomic DNA
ggttgttgttagcagcggcaacaactggta

SEQ ID NO: 40547 - DNA, 21 bp, Homo sapiens
  misc_feature 1..21: note = chr5:63373765-63373786
  misc_feature 1..21: note = hypo
  source 1..21: mol_type = genomic DNA
taatttctggccgggcgagtt

SEQ ID NO: 40548 - DNA, 37 bp, Homo sapiens
  misc_feature 1..37: note = chr5:64860574-64860611
  misc_feature 1..37: note = hypo
  source 1..37: mol_type = genomic DNA
cattctaaaatcactcgagaatcggtcttgtactttt

SEQ ID NO: 40549 - DNA, 32 bp, Homo sapiens
  misc_feature 1..32: note = chr5:65181746-65181778
  misc_feature 1..32: note = hypo
  source 1..32: mol_type = genomic DNA
gcgtgagccaccgcgcccggttgcaagttatt

SEQ ID NO: 40550 - DNA, 33 bp, Homo sapiens
  misc_feature 1..33: note = chr5:67573348-67573381
  misc_feature 1..33: note = hypo
  source 1..33: mol_type = genomic DNA
gactcactttcggaacgtcggcctacctagtgg

SEQ ID NO: 40551 - DNA, 226 bp, Homo sapiens
  misc_feature 1..226: note = chr5:67840329-67840555
  misc_feature 1..226: note = hypo
  source 1..226: mol_type = genomic DNA
cttgctacagcttaacgtttcagcacattttgccttgcctaatgatggagttgcggtttgccaggaaggtacttttaacgctttcttcctagaactgggtagaactatccccatgcaaacctcagctagttcaaacaaagcttctgtaatggcgaagggagagaaaagctgctataaatacttttataggctgcataggtgatttacaacccgctttattaatcct

SEQ ID NO: 40552 - DNA, 17 bp, Homo sapiens
  misc_feature 1..17: note = chr5:68391002-68391019
  misc_feature 1..17: note = hypo
  source 1..17: mol_type = genomic DNA
gtaatagcattataacg

SEQ ID NO: 40553 - DNA, 17 bp, Homo sapiens
  misc_feature 1..17: note = chr5:68391319-68391336
  misc_feature 1..17: note = hypo
  source 1..17: mol_type = genomic DNA
cccgcccaacataagca

SEQ ID NO: 40554 - DNA, 35 bp, Homo sapiens
  misc_feature 1..35: note = chr5:68481446-68481481
  misc_feature 1..35: note = hypo
  source 1..35: mol_type = genomic DNA
ggattaaaggtgtgagtcaccgcacctggccagtc

SEQ ID NO: 40555 - DNA, 30 bp, Homo sapiens
  misc_feature 1..30: note = chr5:72175493-72175523
  misc_feature 1..30: note = hypo
  source 1..30: mol_type = genomic DNA
cttttatatataaaacgcagctgtttttat

SEQ ID NO: 40556 - DNA, 240 bp, Homo sapiens
  misc_feature 1..240: note = chr5:72236805-72237045
  misc_feature 1..240: note = hypo
  source 1..240: mol_type = genomic DNA
ccatctcaaacaaacaaaacaaacttgaagacgtatttttcttcctgttgacgaaacatgagacagcagggcctagagagaagtgaaaagaatgttaaaattagcgaaagtgaacatgatgtacaagcagcacaaaggaaaacagacattgttgaaaacacagtgatgtacacagagggcaggatttttcttttttaaaaagaaaaacattttttaagtgacagaaactttttttttgtt

SEQ ID NO: 40557 - DNA, 21 bp, Homo sapiens
  misc_feature 1..21: note = chr5:74536034-74536055
  misc_feature 1..21: note = hypo
  source 1..21: mol_type = genomic DNA
aatttttttttgagacggagt

SEQ ID NO: 40558 - DNA, 30 bp, Homo sapiens
  misc_feature 1..30: note = chr5:75819580-75819610
  misc_feature 1..30: note = hypo
  source 1..30: mol_type = genomic DNA
ctcctgattaataatcgcatttcttttaat

SEQ ID NO: 40559 - DNA, 89 bp, Homo sapiens
  misc_feature 1..89: note = chr5:75963986-75964075
  misc_feature 1..89: note = hypo
  source 1..89: mol_type = genomic DNA
tgtgagccaccatgcccaagctttgccagtgtctttggacaccagattctactggctacccgccctgttttctgcgtctctacaataaa

SEQ ID NO: 40560 - DNA, 30 bp, Homo sapiens
  misc_feature 1..30: note = chr5:75969716-75969746
  misc_feature 1..30: note = hypo
  source 1..30: mol_type = genomic DNA
gttttttcctcactccgccttttttccatt

SEQ ID NO: 40561 - DNA, 30 bp, Homo sapiens
  misc_feature 1..30: note = chr5:76327167-76327197
  misc_feature 1..30: note = hypo
  source 1..30: mol_type = genomic DNA
tgtgaacttatataccgagtctcagttccc

SEQ ID NO: 40562 - DNA, 17 bp, Homo sapiens
  misc_feature 1..17: note = chr5:77047294-77047311
  misc_feature 1..17: note = hypo
  source 1..17: mol_type = genomic DNA
gccggccagcctgacca

SEQ ID NO: 40563 - DNA, 20 bp, Homo sapiens
  misc_feature 1..20: note = chr5:78469259-78469279
  misc_feature 1..20: note = hypo
  source 1..20: mol_type = genomic DNA
agtatttttctatttcgaaa

SEQ ID NO: 40564 - DNA, 115 bp, Homo sapiens
  misc_feature 1..115: note = chr5:78552615-78552730
  misc_feature 1..115: note = hypo
  source 1..115: mol_type = genomic DNA
tgacaggttctccatcgcctagggttgcgatcatagttcactgcagtctcaagtcttgagctcaattcatcctcccacctcagcctccctagtaactagccgatattacaggcat

SEQ ID NO: 40565 - DNA, 35 bp, Homo sapiens
  misc_feature 1..35: note = chr5:78881941-78881976
  misc_feature 1..35: note = hypo
  source 1..35: mol_type = genomic DNA
atgatctaattcggccgggtgcggtggctcatgcc

SEQ ID NO: 40566 - DNA, 95 bp, Homo sapiens
  misc_feature 1..95: note = chr5:78985096-78985191
  misc_feature 1..95: note = hypo
  source 1..95: mol_type = genomic DNA
cttttgagcagggcacgcctagctttgtttctcattgggtcattttactagcaatgacagcctgagctgctggagctcttcggagtctcagtttc

SEQ ID NO: 40567 - DNA, 16 bp, Homo sapiens
  misc_feature 1..16: note = chr5:79783240-79783256
  misc_feature 1..16: note = hypo
  source 1..16: mol_type = genomic DNA
acagtctagctctatc

SEQ ID NO: 40568 - DNA, 287 bp, Homo sapiens
  misc_feature 1..287: note = chr5:79947497-79947784
  misc_feature 1..287: note = hypo
  source 1..287: mol_type = genomic DNA
cgttaaagccactttcgtagtttattttgtatcaactggagttttttacaactcaggtgaattttagctttattgaggggaattgatctaaaacactctttacgccggtttctattgacttgggttaatcgtgtgaccgcggtggctggcacgaacttgacgaaccctagggttagtatagcttagttaaactttcgtttattgctaaaggtttatcactgctgtctcccgtgggggtgtggctaggctaagcgttttgagctgcgttgctgcgtgcttgatacttg

SEQ ID NO: 40569 - DNA, 32 bp, Homo sapiens
  misc_feature 1..32: note = chr5:81266658-81266690
  misc_feature 1..32: note = hypo
  source 1..32: mol_type = genomic DNA
ttttcatctgtgaaatacgtttttaaggtaaa

SEQ ID NO: 40570 - DNA, 16 bp, Homo sapiens
  misc_feature 1..16: note = chr5:81575049-81575065
  misc_feature 1..16: note = hypo
  source 1..16: mol_type = genomic DNA
gcgcctggccatttaa

SEQ ID NO: 40571 - DNA, 23 bp, Homo sapiens
  misc_feature 1..23: note = chr5:88304080-88304103
  misc_feature 1..23: note = hypo
  source 1..23: mol_type = genomic DNA
cgagagtccgtctcaaaaaaaaa

SEQ ID NO: 40572 - DNA, 19 bp, Homo sapiens
  misc_feature 1..19: note = chr5:88371483-88371502
  misc_feature 1..19: note = hypo
  source 1..19: mol_type = genomic DNA
cggatctcctgaggtcggg

SEQ ID NO: 40573 - DNA, 90 bp, Homo sapiens
  misc_feature 1..90: note = chr5:94982142-94982232
  misc_feature 1..90: note = hypo
  source 1..90: mol_type = genomic DNA
tacatgggttaccagcatcgcgacgaccttctgcaaatatttttatagggtaaataactgaatgaagtcgctgggcgcatctaaaatttg

SEQ ID NO: 40574 - DNA, 21 bp, Homo sapiens
  misc_feature 1..21: note = chr5:95117541-95117562
  misc_feature 1..21: note = hypo
  source 1..21: mol_type = genomic DNA
agactccgtctcaaaaaaaga

SEQ ID NO: 40575 - DNA, 30 bp, Homo sapiens; identical to SEQ ID NO: 14774
  misc_feature 1..30: note = chr5:98201074-98201104
  misc_feature 1..30: note = hypo
  source 1..30: mol_type = genomic DNA

SEQ ID NO: 40576 - DNA, 23 bp, Homo sapiens
  misc_feature 1..23: note = chr5:102048048-102048071
  misc_feature 1..23: note = hypo
  source 1..23: mol_type = genomic DNA
aagtgtggccgggcgcggtggct

SEQ ID NO: 40577 - DNA, 17 bp, Homo sapiens
  misc_feature 1..17: note = chr5:111306228-111306245
  misc_feature 1..17: note = hypo
  source 1..17: mol_type = genomic DNA
gaagtcttactgggtcg

SEQ ID NO: 40578 - DNA, 128 bp, Homo sapiens
  misc_feature 1..128: note = chr5:111813766-111813894
  misc_feature 1..128: note = hypo
  source 1..128: mol_type = genomic DNA
aattttgattgtcatcgatagaaactgcgaaacacccacatttgatgcccgtggccccgtgctgtaattttaatagtgaaatgtagcaatgtaaacctcgattgaaattttctcgggtggcatttact

SEQ ID NO: 40579 - DNA, 79 bp, Homo sapiens
  misc_feature 1..79: note = chr5:111875281-111875360
  misc_feature 1..79: note = hypo
  source 1..79: mol_type = genomic DNA
cacagtgctcaagctctgctaagggacagccttcctcctcaaggggttccctgactccccgtgccgcctgactgagaca

SEQ ID NO: 40580 - DNA, 22 bp, Homo sapiens
  misc_feature 1..22: note = chr5:111987796-111987818
  misc_feature 1..22: note = hypo
  source 1..22: mol_type = genomic DNA
ccgcgcccggcctccaggtcac

SEQ ID NO: 40581 - DNA, 206 bp, Homo sapiens
  misc_feature 1..206: note = chr5:112198294-112198500
  misc_feature 1..206: note = hypo
  source 1..206: mol_type = genomic DNA
tggcaccttgatcctcgagggaatggggggtgtcatcctggtcgggccacgtaatcttgttagagccgcagggggttctcttcactgcatttatttagggcttgagaacacagccaagaattggggtgcgttcctcagtgttggtgaaaccagaaaggcattaattcatagctgaagggatatttttttaacgtctcttaatgagc

SEQ ID NO: 40582 - DNA, 32 bp, Homo sapiens
  misc_feature 1..32: note = chr5:115176272-115176304
  misc_feature 1..32: note = hypo
  source 1..32: mol_type = genomic DNA
gagtgagccaccgcgcccggccagagaccact

SEQ ID NO: 40583 - DNA, 39 bp, Homo sapiens
  misc_feature 1..39: note = chr5:117258279-117258318
  misc_feature 1..39: note = hypo
  source 1..39: mol_type = genomic DNA
attacaggcgtgagccaccgcgcccggccaaaatatccc

SEQ ID NO: 40584 - DNA, 30 bp, Homo sapiens; identical to SEQ ID NO: 14777
  misc_feature 1..30: note = chr5:126200056-126200086
  misc_feature 1..30: note = hypo
  source 1..30: mol_type = genomic DNA

SEQ ID NO: 40585 - DNA, 30 bp, Homo sapiens
  misc_feature 1..30: note = chr5:126409452-126409482
  misc_feature 1..30: note = hypo
  source 1..30: mol_type = genomic DNA
ccgagccattttaaccgctctgcatgcatc

SEQ ID NO: 40586 - DNA, 30 bp, Homo sapiens
  misc_feature 1..30: note = chr5:126851264-126851294
  misc_feature 1..30: note = hypo
  source 1..30: mol_type = genomic DNA
gctcaaaaccctccacgtgcttctcatttc

SEQ ID NO: 40587 - DNA, 92 bp, Homo sapiens
  misc_feature 1..92: note = chr5:131305994-131306086
  misc_feature 1..92: note = hypo
  source 1..92: mol_type = genomic DNA
gcttcatgatcagggcgatggagggagggaggtgctctggaggtagataactccaggtgaaactgaacacagacaacaagcatggccacatt

SEQ ID NO: 40588 - DNA, 193 bp, Homo sapiens
  misc_feature 1..193: note = chr5:131610019-131610212
  misc_feature 1..193: note = hypo
  source 1..193: mol_type = genomic DNA
tgcccaccctgcctccgctgacttggtcccagccccacccagtcataggtgggagaggagaggatgactggcacccaggaaagcagggaagcattattaagcacaggagtgggtggaaaaataccgggagccatgggccctggcccccacctctcactcccactcacccgcagaaactcgactctcccactgg

SEQ ID NO: 40589 - DNA, 30 bp, Homo sapiens
  misc_feature 1..30: note = chr5:131787174-131787204
  misc_feature 1..30: note = hypo
  source 1..30: mol_type = genomic DNA
atgattggcacctcccgggagagctccagg

SEQ ID NO: 40590 - DNA, 83 bp, Homo sapiens
  misc_feature 1..83: note = chr5:132083881-132083964
  misc_feature 1..83: note = hypo
  source 1..83: mol_type = genomic DNA
cgctgcgccggggggcgcttactcccagcgggcatgcagaggaagggacttctcactgccccaccccccgcaccttaagcagg

SEQ ID NO: 40591 - DNA, 30 bp, Homo sapiens
  misc_feature 1..30: note = chr5:132201467-132201497
  misc_feature 1..30: note = hypo
  source 1..30: mol_type = genomic DNA
caagacacctcagggcgagctgtacattga

SEQ ID NO: 40592 - DNA, 24 bp, Homo sapiens
  misc_feature 1..24: note = chr5:133820020-133820044
  misc_feature 1..24: note = hypo
  source 1..24: mol_type = genomic DNA
caacgcgcccggcccgtgttttgt

SEQ ID NO: 40593 - DNA, 46 bp, Homo sapiens
  misc_feature 1..46: note = chr5:134242196-134242242
  misc_feature 1..46: note = hypo
  source 1..46: mol_type = genomic DNA
ggaagataggcactccgccgcttcttgtccacgaaggggagaacac

SEQ ID NO: 40594 - DNA, 30 bp, Homo sapiens
  misc_feature 1..30: note = chr5:134583042-134583072
  misc_feature 1..30: note = hypo
  source 1..30: mol_type = genomic DNA
agagcaaatgccttacgtttagcggatgcg

SEQ ID NO: 40595 - DNA, 33 bp, Homo sapiens
  misc_feature 1..33: note = chr5:137548023-137548056
  misc_feature 1..33: note = hypo
  source 1..33: mol_type = genomic DNA
tttgagacagtgtcccgctctgccctcgggctg

SEQ ID NO: 40596 - DNA, 18 bp, Homo sapiens
  misc_feature 1..18: note = chr5:137769720-137769738
  misc_feature 1..18: note = hypo
  source 1..18: mol_type = genomic DNA
gcccgtccaacattggtg

SEQ ID NO: 40597 - DNA, 30 bp, Homo sapiens
  misc_feature 1..30: note = chr5:138273660-138273690
  misc_feature 1..30: note = hypo
  source 1..30: mol_type = genomic DNA
gagaaggagctgccacgtgctgggcacctc

SEQ ID NO: 40598 - DNA, 105 bp, Homo sapiens
  misc_feature 1..105: note = chr5:138676299-138676404
  misc_feature 1..105: note = hypo
  source 1..105: mol_type = genomic DNA
cacccatttcctagtcggtcatttgccctctccaaagggaagaaattagtttgtgtccctttttcaaagatagtatctacacatttgaacatccagatttgtaaa

SEQ ID NO: 40599 - DNA, 91 bp, Homo sapiens
  misc_feature 1..91: note = chr5:139556302-139556393
  misc_feature 1..91: note = hypo
  source 1..91: mol_type = genomic DNA
gtggggcattggattcgctgaaaggagtcccatactatttgttgattgtagatcaaagatctctagacctggcctggtgcggtggctcaca

SEQ ID NO: 40600 - DNA, 29 bp, Homo sapiens
  misc_feature 1..29: note = chr5:139779106-139779135
  misc_feature 1..29: note = hypo
  source 1..29: mol_type = genomic DNA
tgagccactgcgcccggccattttttttt

SEQ ID NO: 40601 - DNA, 23 bp, Homo sapiens
  misc_feature 1..23: note = chr5:139779848-139779871
  misc_feature 1..23: note = hypo
  source 1..23: mol_type = genomic DNA
acggcgcccgctatagaatctga

SEQ ID NO: 40602 - DNA, 95 bp, Homo sapiens
  misc_feature 1..95: note = chr5:142070580-142070675
  misc_feature 1..95: note = hypo
  source 1..95: mol_type = genomic DNA
tgcagcctgaccacccgttctaaatcagccccttatcactgtctttttacatctcccactttctttttcctcatactacttactactttctcaaa

SEQ ID NO: 40603 - DNA, 158 bp, Homo sapiens
  misc_feature 1..158: note = chr5:142625575-142625733
  misc_feature 1..158: note = hypo
  source 1..158: mol_type = genomic DNA
ttcaggggcttagaccgccacttggaatgcgtgcattctggcaggtgcggtgcatgcaggggtcagacccctatggtttgatgagataagagcctcctgcacagaatctcattttttctccatctgcaccgccatttgggcctcgggcctcatgactc

SEQ ID NO: 40604 - DNA, 30 bp, Homo sapiens
  misc_feature 1..30: note = chr5:142689842-142689872
  misc_feature 1..30: note = hypo
  source 1..30: mol_type = genomic DNA
ctctgtctttgtttccggtggaatataacc

SEQ ID NO: 40605 - DNA, 21 bp, Homo sapiens
  misc_feature 1..21: note = chr5:147003406-147003427
  misc_feature 1..21: note = hypo
  source 1..21: mol_type = genomic DNA
gttttgtttttgaaacggaat

SEQ ID NO: 40606 - DNA, 149 bp, Homo sapiens
  misc_feature 1..149: note = chr5:149014648-149014797
  misc_feature 1..149: note = hypo
  source 1..149: mol_type = genomic DNA
aatggacacccttcacgcctcagggagctggcctgagctgctgggggatacagaaagaaatcagacagatgaggcccggtcttccagatcccagtctctaaggcaggcagatgaggcacccatcaattacgtgccgtgtaagtgtcagg

SEQ ID NO: 40607 - DNA, 30 bp, Homo sapiens
  misc_feature 1..30: note = chr5:149624264-149624294
  misc_feature 1..30: note = hypo
  source 1..30: mol_type = genomic DNA
gctgtccatcctccacgagctttctgggtg

SEQ ID NO: 40608 - DNA, 30 bp, Homo sapiens
  misc_feature 1..30: note = chr5:150901687-150901717
  misc_feature 1..30: note = hypo
  source 1..30: mol_type = genomic DNA
cagtgctcttgcgcccgactgaggctgggc

SEQ ID NO: 40609 - DNA, 144 bp, Homo sapiens
  misc_feature 1..144: note = chr5:150911238-150911382
  misc_feature 1..144: note = hypo
  source 1..144: mol_type = genomic DNA
cagctgcagcacctccgtgccaggtggggcgtcctcgggcacctgcacgctgtgctcggtgttcaggaacacgggcaggtagtcttctaggcccaccaccgagactgtgacggtgcccagcgtggacagcggtattggggtgcc

SEQ ID NO: 40610 - DNA, 30 bp, Homo sapiens; identical to SEQ ID NO: 14784
  misc_feature 1..30: note = chr5:151383730-151383760
  misc_feature 1..30: note = hypo
  source 1..30: mol_type = genomic DNA

SEQ ID NO: 40611 - DNA, 21 bp, Homo sapiens
  misc_feature 1..21: note = chr5:153118296-153118317
  misc_feature 1..21: note = hypo
  source 1..21: mol_type = genomic DNA
ttggagaaggcatttcgctct

SEQ ID NO: 40612 - DNA, 78 bp, Homo sapiens
  misc_feature 1..78: note = chr5:153785990-153786068
  misc_feature 1..78: note = hypo
  source 1..78: mol_type = genomic DNA
tgcctgaatcaggtgcggccttttattatggtgactaacaaccctcaattacttgcagaccacatttaaaatatttgt

SEQ ID NO: 40613 - DNA, 254 bp, Homo sapiens
  misc_feature 1..254: note = chr5:154209733-154209987
  misc_feature 1..254: note = hypo
  source 1..254: mol_type = genomic DNA
ttgtgtaggaaaaggcgagccagactcagggaacagtgggacccacttcccggcgctgtgcaagtcagagttccttgtaagcagggtctgggcctcacttatcatggatttgccctggtgcctttcactattggtcgaattgagtatttcggaaggagaacttgtttaaaagacagccaccgcccacacattcagaatccatactatccgtctattacagtggagttatccattgttttcgcagctgtctccct

SEQ ID NO: 40614 - DNA, 95 bp, Homo sapiens
  misc_feature 1..95: note = chr5:154318088-154318183
  misc_feature 1..95: note = hypo
  source 1..95: mol_type = genomic DNA
ccaacgttttttgagcgctatgtgccagggcactttgctagttgtggaggtgttttaaagatatgcacaagaggccgggtgcggtggctcacgcc

SEQ ID NO: 40615 - DNA, 172 bp, Homo sapiens
  misc_feature 1..172: note = chr5:156874508-156874680
  misc_feature 1..172: note = hypo
  source 1..172: mol_type = genomic DNA
tatccaggccaggcccgcaaaccagaatttccagtgtgaccgtgttggcagagagttaatgagcagccaaggaagctgtggctgttgctgttgtagacttgccccagagggaaggacagaagaacgccaggtccttccttagcctctctgcttggaacgaggcaggtgggaa

SEQ ID NO: 40616 - DNA, 30 bp, Homo sapiens; identical to SEQ ID NO: 14788
  misc_feature 1..30: note = chr5:157078407-157078437
  misc_feature 1..30: note = hypo
  source 1..30: mol_type = genomic DNA

SEQ ID NO: 40617 - DNA, 39 bp, Homo sapiens; identical to SEQ ID NO: 14789
  misc_feature 1..39: note = chr5:158612937-158612976
  misc_feature 1..39: note = hypo
  source 1..39: mol_type = genomic DNA

SEQ ID NO: 40618 - DNA, 28 bp, Homo sapiens
  misc_feature 1..28: note = chr5:159672080-159672108
  misc_feature 1..28: note = hypo
  source 1..28: mol_type = genomic DNA
ggtaggggctgggtgcggtggctcacgc

SEQ ID NO: 40619 - DNA, 30 bp, Homo sapiens
  misc_feature 1..30: note = chr5:159776532-159776562
  misc_feature 1..30: note = hypo
  source 1..30: mol_type = genomic DNA
atgggcagccgctcccgtgggtagctcttg

SEQ ID NO: 40620 - DNA, 17 bp, Homo sapiens
  misc_feature 1..17: note = chr5:160498400-160498417
  misc_feature 1..17: note = hypo
  source 1..17: mol_type = genomic DNA
agtgccaagcatgagcg

SEQ ID NO: 40621 - DNA, 18 bp, Homo sapiens
  misc_feature 1..18: note = chr5:166363611-166363629
  misc_feature 1..18: note = hypo
  source 1..18: mol_type = genomic DNA
gcaagcagagggagccgg

SEQ ID NO: 40622 - DNA, 146 bp, Homo sapiens
  misc_feature 1..146: note = chr5:166461205-166461351
  misc_feature 1..146: note = hypo
  source 1..146: mol_type = genomic DNA
gaggcatgatagattcgcttatacatgttagaatgagatgataaactaattcattgtcctgcattggtatcccaatattgtactccttccaatggtcagtaacaaaagatagctaagagaaaaataggtgtacatgtgaaattatt

SEQ ID NO: 40623 - DNA, 38 bp, Homo sapiens
  misc_feature 1..38: note = chr5:166865441-166865479
  misc_feature 1..38: note = hypo
  source 1..38: mol_type = genomic DNA
gctggagtgcagtggcgccatctcggctcactgcaagc

SEQ ID NO: 40624 - DNA, 141 bp, Homo sapiens; identical to SEQ ID NO: 14792
  misc_feature 1..141: note = chr5:168192180-168192321
  misc_feature 1..141: note = hypo
  source 1..141: mol_type = genomic DNA

SEQ ID NO: 40625 - DNA, 30 bp, Homo sapiens
  misc_feature 1..30: note = chr5:168231749-168231779
  misc_feature 1..30: note = hypo
  source 1..30: mol_type = genomic DNA
tgaagaaagaagaagcgaagtctccactcc

SEQ ID NO: 40626 - DNA, 181 bp, Homo sapiens
  misc_feature 1..181: note = chr5:168233348-168233529
  misc_feature 1..181: note = hypo
  source 1..181: mol_type = genomic DNA
tccagcagccccacacgctgatggcctagtgggtgatgggctgggacagggagctgaattctccggcgacagttgttgggggtgtcagacaggtgcacttacatttcgacgatgccctccggcaagttggcaggaatctccatcaagccctttcctcgacagtccacgatgttattgctgc

SEQ ID NO: 40627 - DNA, 30 bp, Homo sapiens
  misc_feature 1..30: note = chr5:168253336-168253366
  misc_feature 1..30: note = hypo
  source 1..30: mol_type = genomic DNA
agacgctgattgctacgacagctacagttt

SEQ ID NO: 40628 - DNA, 30 bp, Homo sapiens; identical to SEQ ID NO: 14793
  misc_feature 1..30: note = chr5:168268106-168268136
  misc_feature 1..30: note = hypo
  source 1..30: mol_type = genomic DNA

SEQ ID NO: 40629 - DNA, 23 bp, Homo sapiens
  misc_feature 1..23: note = chr5:168289195-168289218
  misc_feature 1..23: note = hypo
  source 1..23: mol_type = genomic DNA
tggactttggggactcgggggaa

SEQ ID NO: 40630 - DNA, 33 bp, Homo sapiens
  misc_feature 1..33: note = chr5:168337451-168337484
  misc_feature 1..33: note = hypo
  source 1..33: mol_type = genomic DNA
aaccatcacaattgccgccgggcgtggtggctc

SEQ ID NO: 40631 - DNA, 30 bp, Homo sapiens; identical to SEQ ID NO: 14795
  misc_feature 1..30: note = chr5:169157436-169157466
  misc_feature 1..30: note = hypo
  source 1..30: mol_type = genomic DNA

SEQ ID NO: 40632 - DNA, 85 bp, Homo sapiens
  misc_feature 1..85: note = chr5:169532927-169533012
  misc_feature 1..85: note = hypo
  source 1..85: mol_type = genomic DNA
ccaggcaggtggctccggccagcccagccccagcatgagctccttcgacctgccggcgccctccccacctcgctgcagcccccag

SEQ ID NO: 40633 - DNA, 143 bp, Homo sapiens
  misc_feature 1..143: note = chr5:169658356-169658499
  misc_feature 1..143: note = hypo
  source 1..143: mol_type = genomic DNA
cactgcaactggttgcgagcgtatatacatgattaaaatatgccttattttcactgtctttatttttccaatgactttatgagttttgtttgtttgttttgggatggagtctcactctgtcacctggactagagtgcagtggt

SEQ ID NO: 40634 - DNA, 51 bp, Homo sapiens
  misc_feature 1..51: note = chr5:169660169-169660220
  misc_feature 1..51: note = hypo
  source 1..51: mol_type = genomic DNA
gggccgagaaggggacggttggctgggtgggcctggcggctggtggctgtc

SEQ ID NO: 40635 - DNA, 30 bp, Homo sapiens
  misc_feature 1..30: note = chr5:169932029-169932059
  misc_feature 1..30: note = hypo
  source 1..30: mol_type = genomic DNA
cacactcctcctaggcggctatgccaggtg

SEQ ID NO: 40636 - DNA, 41 bp, Homo sapiens
  misc_feature 1..41: note = chr5:170811632-170811673
  misc_feature 1..41: note = hypo
  source 1..41: mol_type = genomic DNA
ggattacaggcgtgagtcaccacacccggccaggaacatgt

SEQ ID NO: 40637 - DNA, 71 bp, Homo sapiens
  misc_feature 1..71: note = chr5:170919575-170919646
  misc_feature 1..71: note = hypo
  source 1..71: mol_type = genomic DNA
gttagtttcttcctgcgcctggccgggagaaatgccctatttgcaaggaggactggcggctctcacatgag

SEQ ID NO: 40638 - DNA, 66 bp, Homo sapiens
  misc_feature 1..66: note = chr5:171247586-171247652
  misc_feature 1..66: note = hypo
  source 1..66: mol_type = genomic DNA
aatatcaagtgaacacgcaaccagaactgcccgtcatgatccatcaagtcacgaagttggacaggc

SEQ ID NO: 40639 - DNA, 39 bp, Homo sapiens
  misc_feature 1..39: note = chr5:171533619-171533658
  misc_feature 1..39: note = hypo
  source 1..39: mol_type = genomic DNA
tcaccacttagagggcgtgagcagcgtgggagggtccga

SEQ ID NO: 40640 - DNA, 85 bp, Homo sapiens
  misc_feature 1..85: note = chr5:172235687-172235772
  misc_feature 1..85: note = hypo
  source 1..85: mol_type = genomic DNA
agcccctaaattctttttttatttgatttttgttttgttttgttttcttttcttttcccagatggggtatcgctgtgttgtccag

SEQ ID NO: 40641 - DNA, 21 bp, Homo sapiens
  misc_feature 1..21: note = chr5:172384977-172384998
  misc_feature 1..21: note = hypo
  source 1..21: mol_type = genomic DNA
tattagtaggccaggcgcagt

SEQ ID NO: 40642 - DNA, 81 bp, Homo sapiens
  misc_feature 1..81: note = chr5:172385298-172385379
  misc_feature 1..81: note = hypo
  source 1..81: mol_type = genomic DNA
taaacgcaggtgtttaacaatgtcaccactacatgtcagggaacactgataaactaagagagagcacgggacctgcctggg

SEQ ID NO: 40643 - DNA, 196 bp, Homo sapiens
  misc_feature 1..196: note = chr5:172704334-172704530
  misc_feature 1..196: note = hypo
  source 1..196: mol_type = genomic DNA
tcaatctctatctcacgtgagcactcgatgcctcctatttctgagccttttctggggctctgtagaacaatttgtgggccctgccacccaaccctgaagacgcttgtgtttgccttgctacttctccgctgagtcatttacatttttccagtgctttttatctttctatgttggaattaagcgttatagacgccac

SEQ ID NO: 40644 - DNA, 30 bp, Homo sapiens
  misc_feature 1..30: note = chr5:174110957-174110987
  misc_feature 1..30: note = hypo
  source 1..30: mol_type = genomic DNA
ggctattataacagccgggcgcggtgactc

SEQ ID NO: 40645 - DNA, 30 bp, Homo sapiens
  misc_feature 1..30: note = chr5:175115079-175115109
  misc_feature 1..30: note = hypo
  source 1..30: mol_type = genomic DNA
ttgcttccaaggtcacgtcaccttctgctc

SEQ ID NO: 40646 - DNA, 136 bp, Homo sapiens
  misc_feature 1..136: note = chr5:175605006-175605142
  misc_feature 1..136: note = hypo
  source 1..136: mol_type = genomic DNA
atgaacccatcatgccgccaaaaccccctgagctctgcaagtgtgcctcacattaatgaccacgccagattccactgtaaaatgtagctattcctacgcggtgttaggtgaccactaagaccgtcctgtaatgaca

SEQ ID NO: 40647 - DNA, 30 bp, Homo sapiens; identical to SEQ ID NO: 14798
  misc_feature 1..30: note = chr5:175610717-175610747
  misc_feature 1..30: note = hypo
  source 1..30: mol_type = genomic DNA

SEQ ID NO: 40648 - DNA, 17 bp, Homo sapiens
  misc_feature 1..17: note = chr5:175876289-175876306
  misc_feature 1..17: note = hypo
  source 1..17: mol_type = genomic DNA
cccccaggccaggagcg

SEQ ID NO: 40649 - DNA, 17 bp, Homo sapiens
  misc_feature 1..17: note = chr5:175876606-175876623
  misc_feature 1..17: note = hypo
  source 1..17: mol_type = genomic DNA
ttcgggagatcaaatgg

SEQ ID NO: 40650 - DNA, 19 bp, Homo sapiens
  misc_feature 1..19: note = chr5:175879322-175879341
  misc_feature 1..19: note = hypo
  source 1..19: mol_type = genomic DNA
tgctcggattacaggcgtg

SEQ ID NO: 40651 - DNA, 30 bp, Homo sapiens; identical to SEQ ID NO: 14801
  misc_feature 1..30: note = chr5:175924856-175924886
  misc_feature 1..30: note = hypo
  source 1..30: mol_type = genomic DNA

SEQ ID NO: 40652 - DNA, 20 bp, Homo sapiens
  misc_feature 1..20: note = chr5:175971447-175971467
  misc_feature 1..20: note = hypo
  source 1..20: mol_type = genomic DNA
ctttcctttttttgacggag

SEQ ID NO: 40653 - DNA, 64 bp, Homo sapiens
  misc_feature 1..64: note = chr5:175971806-175971870
  misc_feature 1..64: note = hypo
  source 1..64: mol_type = genomic DNA
tgtctgtaagagcaacgaagggactttgtaccctgcaaagtgcaacttccggggatgattggga

SEQ ID NO: 40654 - DNA, 30 bp, Homo sapiens; identical to SEQ ID NO: 14803
  misc_feature 1..30: note = chr5:175975036-175975066
  misc_feature 1..30: note = hypo
  source 1..30: mol_type = genomic DNA

SEQ ID NO: 40655 - DNA, 32 bp, Homo sapiens
  misc_feature 1..32: note = chr5:175978988-175979020
  misc_feature 1..32: note = hypo
  source 1..32: mol_type = genomic DNA
gcgtgagtcaccgcgcccggttaatagttccc

SEQ ID NO: 40656 - DNA, 106 bp, Homo sapiens
  misc_feature 1..106: note = chr5:176225880-176225986
  misc_feature 1..106: note = hypo
  source 1..106: mol_type = genomic DNA
tctccttctaattaccggtttaattaaccttggcacacagtatgtaccagacccgagggacagagtcagaatggctgctctgggtgaacatcgcccatctgctctg

SEQ ID NO: 40657 - DNA, 30 bp, Homo sapiens
  misc_feature 1..30: note = chr5:176289703-176289733
  misc_feature 1..30: note = hypo
  source 1..30: mol_type = genomic DNA
cgaggatgtgtacatcgtcaagaacaagcc

SEQ ID NO: 40658 - DNA, 30 bp, Homo sapiens
  misc_feature 1..30: note = chr5:176295217-176295247
  misc_feature 1..30: note = hypo
  source 1..30: mol_type = genomic DNA
tggcatggagctcctcgggcaccaccaaga

SEQ ID NO: 40659 - DNA, 188 bp, Homo sapiens
  misc_feature 1..188: note = chr5:176315326-176315514
  misc_feature 1..188: note = hypo
  source 1..188: mol_type = genomic DNA
caatacctggggtgccgctcacacactcggcctccggtggccacagcaacctggagtgtttgttgctcccggctgtgctggaggcaggagagaacagcggccagggcggcagcacagagctgggcagcccgcgtgcacacggccgcacagacgtgctgcacaagctcaacatccgaagccccagggct

SEQ ID NO: 40660 - DNA, 34 bp, Homo sapiens
  misc_feature 1..34: note = chr5:176558851-176558885
  misc_feature 1..34: note = hypo
  source 1..34: mol_type = genomic DNA
gcggaatttttatggcggccggatccggctttct

SEQ ID NO: 40661 - DNA, 163 bp, Homo sapiens
  misc_feature 1..163: note = chr5:176795125-176795288
  misc_feature 1..163: note = hypo
  source 1..163: mol_type = genomic DNA
gctgttcgcgttcatcgctccctcttcactagagctgggcgggactgcaaacgccgccttgcgccgagagtctcagggctccctcaactcctccgccagcctggaccttggcttcctagccttcgtcagcagcaaatctgaggtgagccgactgttggggaag

SEQ ID NO: 40662 - DNA, 99 bp, Homo sapiens
  misc_feature 1..99: note = chr5:177019952-177020051
  misc_feature 1..99: note = hypo
  source 1..99: mol_type = genomic DNA
gtaaggatattaaaacgaacggcaaaacccttcagctctcaccttctgtcacttttcgttaaaaaactcatggcggggtgtggtggctcttgcctgtaa

SEQ ID NO: 40663 - DNA, 237 bp, Homo sapiens
  misc_feature 1..237: note = chr5:177031167-177031404
  misc_feature 1..237: note = hypo
  source 1..237: mol_type = genomic DNA
cgcttgctccaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgtgcctgccccccagagccgccccctgagcactgggaagaagacgcatcctggggccc

SEQ ID NO: 40664 - DNA, 25 bp, Homo sapiens
  misc_feature 1..25: note = chr5:177513856-177513881
  misc_feature 1..25: note = hypo
  source 1..25: mol_type = genomic DNA
tatttttttttgagacggagtctgt

SEQ ID NO: 40665 - DNA, 30 bp, Homo sapiens
  misc_feature 1..30: note = chr5:177673744-177673774
  misc_feature 1..30: note = hypo
  source 1..30: mol_type = genomic DNA
ggcccagccacacagcgggaggcagcagag

SEQ ID NO: 40666 - DNA, 43 bp, Homo sapiens; identical to SEQ ID NO: 14809
  misc_feature 1..43: note = chr5:177713462-177713505
  misc_feature 1..43: note = hypo
  source 1..43: mol_type = genomic DNA

SEQ ID NO: 40667 - DNA, 181 bp, Homo sapiens
  misc_feature 1..181: note = chr5:177851456-177851637
  misc_feature 1..181: note = hypo
  source 1..181: mol_type = genomic DNA
ctctgctgctgcccccggacagacagtaaaatgtgcacatcagttggagagagaacacttcatgctcttctctggagctgaacaaagagggaggcagtgctagggccaggacaagacacaccggcaacgctcagaactggaatataagggcagttgtagtcattcgcggttctgcaggtca

SEQ ID NO: 40668 - DNA, 55 bp, Homo sapiens
  misc_feature 1..55: note = chr5:177890891-177890946
  misc_feature 1..55: note = hypo
  source 1..55: mol_type = genomic DNA
agaaaccagcctgggcgtgcagagacctcaggctgcagaacgaacctcttgttgt

SEQ ID NO: 40669 - DNA, 30 bp, Homo sapiens; identical to SEQ ID NO: 14810
  misc_feature 1..30: note = chr5:177982679-177982709
  misc_feature 1..30: note = hypo
  source 1..30: mol_type = genomic DNA

SEQ ID NO: 40670 - DNA, 139 bp, Homo sapiens
  misc_feature 1..139: note = chr5:177984059-177984198
  misc_feature 1..139: note = hypo
  source 1..139: mol_type = genomic DNA
agtccaaggtgtctgcggggcgggctcctcagggagagtccctcccacacccctccatagctctggtggctgcaggcattttggtgtttcttggctggcacacgcagcacgccaatccccactccgctgtcacctagcc

SEQ ID NO: 40671 - DNA, 153 bp, Homo sapiens
  misc_feature 1..153: note = chr5:178112320-178112473
  misc_feature 1..153: note = hypo
  source 1..153: mol_type = genomic DNA
aatcacaaacggtcccgagtctaagcagcttacgttagacaggttttatttctcttacctgctacttgtgagctgcagctccgttcctgtgtaacacacatgtcttctttaccccagtctgaggtattccagtacctgcgctgaatgagcaaa

SEQ ID NO: 40672 - DNA, 165 bp, Homo sapiens
  misc_feature 1..165: note = chr5:178288343-178288508
  misc_feature 1..165: note = hypo
  source 1..165: mol_type = genomic DNA
gtcactaagagcaaacgtacacacgtgggaaaaatccctgcctcctccactcacccatgtctccgttcctgtccttcgcaggaatactttctcttttcacccctgagaatcctcataacaccaccccttccccaggcttctccaacgcatcgttgttagtttttt

SEQ ID NO: 40673 - DNA, 30 bp, Homo sapiens
  misc_feature 1..30: note = chr5:178373124-178373154
  misc_feature 1..30: note = hypo
  source 1..30: mol_type = genomic DNA
gagaaagcctatcttcgccaccatatatgt

SEQ ID NO: 40674 - DNA, 53 bp, Homo sapiens
  misc_feature 1..53: note = chr5:178409990-178410043
  misc_feature 1..53: note = hypo
  source 1..53: mol_type = genomic DNA
cgatgggcttggcctcgttgaaggtctcgggcacgccacgggccttgatggcg

SEQ ID NO: 40675 - DNA, 110 bp, Homo sapiens
  misc_feature 1..110: note = chr5:178411620-178411730
  misc_feature 1..110: note = hypo
  source 1..110: mol_type = genomic DNA
aggagcacctcaggccgggacgtagagggcaccttctcaggatgtgcggcacacggagaccctgggcctgaccaggggacactcaggccctgttacgtggaggaagacgg

SEQ ID NO: 40676 - DNA, 143 bp, Homo sapiens
  misc_feature 1..143: note = chr5:178416053-178416196
  misc_feature 1..143: note = hypo
  source 1..143: mol_type = genomic DNA
ggcaatggcgtacaccgcatcaatcacaaactgcaccttgccctcctgctcgtaggtggagtcccggccgatgcgttcctcgcctgtcctagggatgcccagagaaagtgtgcccggcccccatgcaccgaacccggcctccc

SEQ ID NO: 40677 - DNA, 99 bp, Homo sapiens
  misc_feature 1..99: note = chr5:178478886-178478985
  misc_feature 1..99: note = hypo
  source 1..99: mol_type = genomic DNA
ccacttgaagatcttcaaagggagctgctccacaggcttgtgtgccgggaggaacaggggaccttgctttgcattgtgcatcgccgcgctactgtttta

SEQ ID NO: 40678 - DNA, 90 bp, Homo sapiens
  misc_feature 1..90: note = chr5:178481810-178481900
  misc_feature 1..90: note = hypo
  source 1..90: mol_type = genomic DNA
cagtctccttcagtctagcagcccttcggccagattgcacaaagtcccttggtctttatctgtggtcttttgctccgcatcaccttgctt

SEQ ID NO: 40679 - DNA, 130 bp, Homo sapiens
  misc_feature 1..130: note = chr5:178561609-178561739
  misc_feature 1..130: note = hypo
  source 1..130: mol_type = genomic DNA
ctgttcttgttttggcgtatttggtgtcgccatctctgagccagctgtatagcccagcctcccggccctgccgaagtcacaggagcaaatgcagagcagccctcgagcaccctcccggctccagctccag

SEQ ID NO: 40680 - DNA, 41 bp, Homo sapiens
  misc_feature 1..41: note = chr5:178565442-178565483
  misc_feature 1..41: note = hypo
  source 1..41: mol_type = genomic DNA
ttggcacaaagcagacgcatcacggccgctgggttttctcc

SEQ ID NO: 40681 - DNA, 145 bp, Homo sapiens
  misc_feature 1..145: note = chr5:178576381-178576526
  misc_feature 1..145: note = hypo
  source 1..145: mol_type = genomic DNA
ggctctgttgtgtaagccacccagtctgcggtatttctgttagagcagccgaagctgaggaagatggagtgtgagctgtcctggcaccgtggaaggctgcggccggggcagactctaagtcactggtggccgcaggaaccaggag

SEQ ID NO: 40682 - DNA, 210 bp, Homo sapiens
  misc_feature 1..210: note = chr5:178655698-178655908
  misc_feature 1..210: note = hypo
  source 1..210: mol_type = genomic DNA
actaaccaaagccagcggacatccactgcctgcggagcatctggggaaggctcctgtggggctccagacccggggcggtgccttcaccacggcctcctcatccagcatccacaactctggagctaggaagcccggtgctccttcccagaggagggagccgaagctctgccagtctgcactgaagtctgtggtgtgcggtcacctgagaac

SEQ ID NO: 40683 - DNA, 78 bp, Homo sapiens
  misc_feature 1..78: note = chr5:178665413-178665491
  misc_feature 1..78: note = hypo
  source 1..78: mol_type = genomic DNA
gtgctctgagtatgccggagggcagtgagtgctgcgggaaggggctggagggcacagggtctgcgagtgccagggcag

SEQ ID NO: 40684 - DNA, 30 bp, Homo sapiens
  misc_feature 1..30: note = chr5:178737203-178737233
  misc_feature 1..30: note = hypo
  source 1..30: mol_type = genomic DNA
gtgggggcctgtggacggccctcctccccc

SEQ ID NO: 40685 - DNA, 49 bp, Homo sapiens
  misc_feature 1..49: note = chr5:178854790-178854839
  misc_feature 1..49: note = hypo
  source 1..49: mol_type = genomic DNA
cacacaacaaaagctcgccatggagagggcgaggcgccaagagggaccc

SEQ ID NO: 40686 - DNA, 30 bp, Homo sapiens; identical to SEQ ID NO: 14816
  misc_feature 1..30: note = chr5:178878685-178878715
  misc_feature 1..30: note = hypo
  source 1..30: mol_type = genomic DNA

SEQ ID NO: 40687 - DNA, 30 bp, Homo sapiens
  misc_feature 1..30: note = chr5:178882544-178882574
  misc_feature 1..30: note = hypo
  source 1..30: mol_type = genomic DNA
tctgaagaagacttccgatattaggttgcc

SEQ ID NO: 40688 - DNA, 27 bp, Homo sapiens
  misc_feature 1..27: note = chr5:178969579-178969606
  misc_feature 1..27: note = hypo
  source 1..27: mol_type = genomic DNA
agaatgggccaggtgcggtggctcacg

SEQ ID NO: 40689 - DNA, 35 bp, Homo sapiens
  misc_feature 1..35: note = chr5:178987430-178987465
  misc_feature 1..35: note = hypo
  source 1..35: mol_type = genomic DNA
ttagatgaggctgggcgcggtggctcacgcctgta

SEQ ID NO: 40690 - DNA, 374 bp, Homo sapiens
  misc_feature 1..374: note = chr5:179213904-179214278
  misc_feature 1..374: note = hypo
  source 1..374: mol_type = genomic DNA
ctgggcccaacgaaacgcaaatgatccctagcagctgacagcagtctgctgcaaacacagcaaagttgagtcccagttgcagctgcagtgaccaccagccagcctctgtcatggcccccgagtgctgggcccagcaaggcgggctcaagagcagtaagcagcagtggcaggggtggggcccagcgggatcccagcatcgtggctctggctcacccagacaaacccggatctgccacccaagtgcccaagtctccagcctgccagtgacagagaccagcgttggtctcctcaagggactgagtgaggagaccagtcaccacccggtgcaaactgagtcccttccacgcgggaaagggccacgagcaattcatgtt

SEQ ID NO: 40691 - DNA, 50 bp, Homo sapiens
  misc_feature 1..50: note = chr5:179401725-179401775
  misc_feature 1..50: note = hypo
  source 1..50: mol_type = genomic DNA
ctggactgggaaatgcgagtgtcacgagatgccggcgagtggagacagaa

SEQ ID NO: 40692 - DNA, 230 bp, Homo sapiens
  misc_feature 1..230: note = chr5:179564509-179564739
  misc_feature 1..230: note = hypo
  source 1..230: mol_type = genomic DNA
cccgagaggctgatgcgttgagggcatggcagggcagtgctggtacactctgagaccccctggcctgccctccgcctcaccttgtccagcaccggcttgtccagctgctgctgctcgatgcacaggtggcagacccgggccaggagctcccggggctcgatgaagaggcgagagctcagcaggaaggtgaagatgtaggctttctgggggacacacgagaaagagggcac

SEQ ID NO: 40693 - DNA, 30 bp, Homo sapiens
  misc_feature 1..30: note = chr5:180021394-180021424
  misc_feature 1..30: note = hypo
  source 1..30: mol_type = genomic DNA
tggctctgggggccacggctggcgaagcct

SEQ ID NO: 40694 - DNA, 30 bp, Homo sapiens
  misc_feature 1..30: note = chr5:180028510-180028540
  misc_feature 1..30: note = hypo
  source 1..30: mol_type = genomic DNA
aacacacacaaagaccggcatcagatttat

SEQ ID NO: 40695 - DNA, 47 bp, Homo sapiens
  misc_feature 1..47: note = chr5:180041104-180041151
  misc_feature 1..47: note = hypo
  source 1..47: mol_type = genomic DNA
ccacacgtcactctgcgtggtgtacaccttgtcgaagatgctttcag

SEQ ID NO: 40696 - DNA, 30 bp, Homo sapiens
  misc_feature 1..30: note = chr5:180042128-180042158
  misc_feature 1..30: note = hypo
  source 1..30: mol_type = genomic DNA
ccaatcggagcactgcggccccgctggtca

SEQ ID NO: 40697 - DNA, 81 bp, Homo sapiens
  misc_feature 1..81: note = chr5:180057500-180057581
  misc_feature 1..81: note = hypo
  source 1..81: mol_type = genomic DNA
tgggccccagctgcccgggaccctgctccagcctggcccgcctccaagtctcacctctcacgaacacgtaggagctggcgg

SEQ ID NO: 40698 - DNA, 88 bp, Homo sapiens
  misc_feature 1..88: note = chr5:180111814-180111902
  misc_feature 1..88: note = hypo
  source 1..88: mol_type = genomic DNA
cctgagagctggcagcgctcgctcgatgaaggccgccgaatgacctggaagccaccctgatgggcagggccctcgaggttaatgagac

SEQ ID NO: 40699 - DNA, 30 bp, Homo sapiens
  misc_feature 1..30: note = chr5:180326126-180326156
  misc_feature 1..30: note = hypo
  source 1..30: mol_type = genomic DNA
atgacagctgtgtctcgatggagtagactc

SEQ ID NO: 40700 - DNA, 90 bp, Homo sapiens
  misc_feature 1..90: note = chr5:180661538-180661628
  misc_feature 1..90: note = hypo
  source 1..90: mol_type = genomic DNA
ggcaccaacggcaaacgctatcaggcccagagctccacagaacagacgctgctgagccccagtgagaaaccaaggcgctttggtgtgtac

SEQ ID NO: 40701 - DNA, 37 bp, Homo sapiens
  misc_feature 1..37: note = chr5:180708092-180708129
  misc_feature 1..37: note = hypo
  source 1..37: mol_type = genomic DNA
tgcagggaggccagccgcggtgcgcaaactacagcct

SEQ ID NO: 40702 - DNA, 213 bp, Homo sapiens
  misc_feature 1..213: note = chr5:180708822-180709035
  misc_feature 1..213: note = hypo
  source 1..213: mol_type = genomic DNA
ggagcagtaagagggcggcctgagcggtaggaggggggctggagcagtaagagggcggcctgagccgtaggagggtgggtggcagctggagatgctcttgaccggctagaggtctaggagaaggtggggaccgtgtccaacactcgtggctggagccttggccaccgcggttctcctggctgtggttggtggtggcgacggagactgcatctc

SEQ ID NO: 40703 - DNA, 30 bp, Homo sapiens
  misc_feature 1..30: note = chr6:304250-304280
  misc_feature 1..30: note = hypo
  source 1..30: mol_type = genomic DNA
gcctgcagtgggcaccgtgtgtgcagtggc

SEQ ID NO: 40704 - DNA, 35 bp, Homo sapiens; identical to SEQ ID NO: 14822
  misc_feature 1..35: note = chr6:348724-348759
  misc_feature 1..35: note = hypo
  source 1..35: mol_type = genomic DNA

SEQ ID NO: 40705 - DNA, 48 bp, Homo sapiens
  misc_feature 1..48: note = chr6:448927-448975
  misc_feature 1..48: note = hypo
  source 1..48: mol_type = genomic DNA
tgtgttgctgaagcccggagtgcacgcccagcgcgtggtgctcgttaa

SEQ ID NO: 40706 - DNA, 17 bp, Homo sapiens
  misc_feature 1..17: note = chr6:736009-736026
  misc_feature 1..17: note = hypo
  source 1..17: mol_type = genomic DNA
aacgtattagctggccg

SEQ ID NO: 40707 - DNA, 49 bp, Homo sapiens
  misc_feature 1..49: note = chr6:1004242-1004291
  misc_feature 1..49: note = hypo
  source 1..49: mol_type = genomic DNA
ctgctcccggcaccccgcaagaccctcactcgcccgcctgctcacccac

SEQ ID NO: 40708 - DNA, 30 bp, Homo sapiens
  misc_feature 1..30: note = chr6:1637278-1637308
  misc_feature 1..30: note = hypo
  source 1..30: mol_type = genomic DNA
tgcctcctagcccagcgccaggcatggctc

SEQ ID NO: 40709 - DNA, 30 bp, Homo sapiens
  misc_feature 1..30: note = chr6:1708613-1708643
  misc_feature 1..30: note = hypo
  source 1..30: mol_type = genomic DNA
tagggggcttgcactcgaaaccacctctga

SEQ ID NO: 40710 - DNA, 175 bp, Homo sapiens
  misc_feature 1..175: note = chr6:1726684-1726859
  misc_feature 1..175: note = hypo
  source 1..175: mol_type = genomic DNA
tcacgtgaactttgccggtctctttacatctgcccacttcattttcattctttccttcccacctgtaaggaagataaacactgaatcagctcctaattgcttgggaacatttggccatgctgtagcaccttgggatgccccagccctctccccgcaggagcgcttaagctcatta

SEQ ID NO: 40711 - DNA, 30 bp, Homo sapiens
  misc_feature 1..30: note = chr6:2244454-2244484
  misc_feature 1..30: note = hypo
  source 1..30: mol_type = genomic DNA
ctggacacttcccagcggtttaacctcagg

SEQ ID NO: 40712 - DNA, 30 bp, Homo sapiens
  misc_feature 1..30: note = chr6:2684333-2684363
  misc_feature 1..30: note = hypo
  source 1..30: mol_type = genomic DNA
acaattataacaacacgccagctgcactac

SEQ ID NO: 40713 - DNA, 72 bp, Homo sapiens
  misc_feature 1..72: note = chr6:2737187-2737259
  misc_feature 1..72: note = hypo
  source 1..72: mol_type = genomic DNA
tgacatactgagttgcgttcctccaataaaatagtctctgccttctctcatgttctacgaagcctatgttgc

SEQ ID NO: 40714 - DNA, 30 bp, Homo sapiens
  misc_feature 1..30: note = chr6:2920829-2920859
  misc_feature 1..30: note = hypo
  source 1..30: mol_type = genomic DNA
cttggcaagaggggacgtccattcagatgg

SEQ ID NO: 40715 - DNA, 30 bp, Homo sapiens
  misc_feature 1..30: note = chr6:2939086-2939116
  misc_feature 1..30: note = hypo
  source 1..30: mol_type = genomic DNA
catctaatgggcatgcgcacaacttcagta

SEQ ID NO: 40716 - DNA, 52 bp, Homo sapiens; identical to SEQ ID NO: 14824
  misc_feature 1..52: note = chr6:3053334-3053386
  misc_feature 1..52: note = hypo
  source 1..52: mol_type = genomic DNA

SEQ ID NO: 40717 - DNA, 32 bp, Homo sapiens
  misc_feature 1..32: note = chr6:3065559-3065591
  misc_feature 1..32: note = hypo
  source 1..32: mol_type = genomic DNA
gggggtggctgggggtgcgggttgtgttcatt

SEQ ID NO: 40718 - DNA, 94 bp, Homo sapiens
  misc_feature 1..94: note = chr6:3104457-3104551
  misc_feature 1..94: note = hypo
  source 1..94: mol_type = genomic DNA
gaaagagtattcaaacgaaaatgcagttgtgaagagaatgcagtctcttcaacttgattgtgtggcagtaccttcaagccggtcaaattcaggt

SEQ ID NO: 40719 - DNA, 35 bp, Homo sapiens
  misc_feature 1..35: note = chr6:3225962-3225997
  misc_feature 1..35: note = hypo
  source 1..35: mol_type = genomic DNA
caccacatccaggaccgagtcgaccagctcggctc

SEQ ID NO: 40720 - DNA, 350 bp, Homo sapiens
  misc_feature 1..350: note = chr6:3285139-3285489
  misc_feature 1..350: note = hypo
  source 1..350: mol_type = genomic DNA
gaatacaaatgtatccgtatagtgtccaacctacggccaacttcagctgcagttcttggagggcaacggggagaaagagaaaatggaaaccacaggtccgtgagtcttcgagaaaacacccatttagatgtaatatgagacgaggaagcacagcccacgcgcttgggactcacctgagtctgggtgctggctgtactttccaatcactggacccgcagacatgatcgcacccacacggacaagggccaagcaagcgagaagagagaagagagcacattaggtgtggagttagcctagcgtgttcccatgcgacttggttcaagcaaactcccttccgtgtctgggatggc

SEQ ID NO: 40721 - DNA, 30 bp, Homo sapiens
  misc_feature 1..30: note = chr6:3298330-3298360
  misc_feature 1..30: note = hypo
  source 1..30: mol_type = genomic DNA
tcacacccttgatgtcgccctcagggttca

SEQ ID NO: 40722 - DNA, 158 bp, Homo sapiens
  misc_feature 1..158: note = chr6:3307337-3307495
  misc_feature 1..158: note = hypo
  source 1..158: mol_type = genomic DNA
tgagcagacggcatacggcagcgctacgacatgcacaggtggcacttggttactgacaagctgagggtaggcacaaaacctgcactctcagtggcatgtccaggcaggtgtcctcactggctccgggtctcagttcatctcgacgctctgacccccca

SEQ ID NO: 40723 - DNA, 30 bp, Homo sapiens
  misc_feature 1..30: note = chr6:3333125-3333155
  misc_feature 1..30: note = hypo
  source 1..30: mol_type = genomic DNA
tttatgtgactgtcccgtgatgtcgttcac

SEQ ID NO: 40724 - DNA, 197 bp, Homo sapiens
  misc_feature 1..197: note = chr6:3363773-3363970
  misc_feature 1..197: note = hypo
  source 1..197: mol_type = genomic DNA
acaggctgctgcctgcggctggccctgggcccagtgtgggcacctggcagtcacgcccaaactaggatgtggcaccttcagcactaaggtgcctgcttgcaattctccagaggacaatgccaccccaaaaagggaaaagcacagcgttccagcctggtccttcctggcttcaaccgctgccacgttctggagagaaa

SEQ ID NO: 40725 - DNA, 43 bp, Homo sapiens
  misc_feature 1..43: note = chr6:4020326-4020369
  misc_feature 1..43: note = hypo
  source 1..43: mol_type = genomic DNA
caccgcgcccggccctaacatttcaaaacgtttggaattcagg

SEQ ID NO: 40726 - DNA, 181 bp, Homo sapiens
  misc_feature 1..181: note = chr6:4804543-4804724
  misc_feature 1..181: note = hypo
  source 1..181: mol_type = genomic DNA
tgttgaagtgcggggcgctgcctaagaacctagctcctaggctccccacatcactgcagggcaggcattagtcaccacttttagagctgaagagaatgagtctttggttaagtgttgaaatagaagtacagttcagatctcaaaataaagacctttgtcttacgaccgcatctccaggcca

SEQ ID NO: 40727 - DNA, 18 bp, Homo sapiens
  misc_feature 1..18: note = chr6:4836440-4836458
  misc_feature 1..18: note = hypo
  source 1..18: mol_type = genomic DNA
attcggccatcttggctc

SEQ ID NO: 40728 - DNA, 33 bp, Homo sapiens
  misc_feature 1..33: note = chr6:4920708-4920741
  misc_feature 1..33: note = hypo
  source 1..33: mol_type = genomic DNA
ctgctgccaagcctccggcgggtcatgcaaaca

SEQ ID NO: 40729 - DNA, 137 bp, Homo sapiens
  misc_feature 1..137: note = chr6:4951182-4951319
  misc_feature 1..137: note = hypo
  source 1..137: mol_type = genomic DNA
cttgcaaaccctcatgaggagcctgtccccagccctgttttccagcctctgcctgcatgggaggggcagtgagtcagccacgtgtttgctttgccgcctctgcctgtgtgctctccaagctgcgggtttcacatgca

SEQ ID NO: 40730 - DNA, 61 bp, Homo sapiens
  misc_feature 1..61: note = chr6:5783294-5783355
  misc_feature 1..61: note = hypo
  source 1..61: mol_type = genomic DNA
agcctccctgcctcacgcctcggggctgactggctctgacgtggttcggctgtgctgttcc

SEQ ID NO: 40731 - DNA, 181 bp, Homo sapiens
  misc_feature 1..181: note = chr6:5892797-5892978
  misc_feature 1..181: note = hypo
  source 1..181: mol_type = genomic DNA
acttttgacactgagcgtgaaaggaactcattgaaccaaaatcttccaaaaagactggaacataagagagcggatgaagagcataatagaagagaagtgccagggaggaggattatcttaggcagagcacactgaggatggagagttaccagccctcccgagctgtcgttggcactgaacc

SEQ ID NO: 40732 - DNA, 30 bp, Homo sapiens; identical to SEQ ID NO: 14827
  misc_feature 1..30: note = chr6:6045657-6045687
  misc_feature 1..30: note = hypo
  source 1..30: mol_type = genomic DNA

SEQ ID NO: 40733 - DNA, 30 bp, Homo sapiens
  misc_feature 1..30: note = chr6:6055082-6055112
  misc_feature 1..30: note = hypo
  source 1..30: mol_type = genomic DNA
ctgaagtatttttcccgatggtatttagct

SEQ ID NO: 40734 - DNA, 37 bp, Homo sapiens; identical to SEQ ID NO: 14828
  misc_feature 1..37: note = chr6:6367079-6367116
  misc_feature 1..37: note = hypo
  source 1..37: mol_type = genomic DNA

SEQ ID NO: 40735 - DNA, 130 bp, Homo sapiens
  misc_feature 1..130: note = chr6:6534781-6534911
  misc_feature 1..130: note = hypo
  source 1..130: mol_type = genomic DNA
cccgtgggacccaggcgtccaggcaccgcgcccaggagagccagctctgagcatccccggggggccactccttctgccaggagcctgaaacccaaacgcgagagatcaggacccccgagtgcagcctctt

SEQ ID NO: 40736 - DNA, 198 bp, Homo sapiens
  misc_feature 1..198: note = chr6:6891420-6891618
  misc_feature 1..198: note = hypo
  source 1..198: mol_type = genomic DNA
tgggggaggaggcagcggcacaacaggttcccacatcacctggagagcaggcgcattacttcctccagcagggctgggcttccaggtacaagagaccagaggtcactgtggtccaatgggctgagccgtagattaggaactcaattgttctttgtttaaatccagctgagacacccaaccttgcgtgaccttgagcca

SEQ ID NO: 40737 - DNA, 30 bp, Homo sapiens
  misc_feature 1..30: note = chr6:7132823-7132853
  misc_feature 1..30: note = hypo
  source 1..30: mol_type = genomic DNA
ctgtttcacaggtggcgatattgacacaga

SEQ ID NO: 40738 - DNA, 95 bp, Homo sapiens
  misc_feature 1..95: note = chr6:7204204-7204299
  misc_feature 1..95: note = hypo
  source 1..95: mol_type = genomic DNA
ggtggctgcagtgtccggtgcatttcaccaggagcatcctgcgagccctgggagctgcctggctgacggcattcccacagcgagcctacagactg

SEQ ID NO: 40739 - DNA, 27 bp, Homo sapiens
  misc_feature 1..27: note = chr6:7237769-7237796
  misc_feature 1..27: note = hypo
  source 1..27: mol_type = genomic DNA
tttaagcgctcgcgttggggcttgcag

SEQ ID NO: 40740 - DNA, 22 bp, Homo sapiens
  misc_feature 1..22: note = chr6:7279451-7279473
  misc_feature 1..22: note = hypo
  source 1..22: mol_type = genomic DNA
aatctatcttggggccgggtgc

SEQ ID NO: 40741 - DNA, 30 bp, Homo sapiens
  misc_feature 1..30: note = chr6:7911626-7911656
  misc_feature 1..30: note = hypo
  source 1..30: mol_type = genomic DNA
gaaagaaagtcaaagcggcctcttctagac

SEQ ID NO: 40742 - DNA, 32 bp, Homo sapiens
  misc_feature 1..32: note = chr6:7911956-7911988
  misc_feature 1..32: note = hypo
  source 1..32: mol_type = genomic DNA
cttggcaacaggggacgcgcccactgtctcac

SEQ ID NO: 40743 - DNA, 30 bp, Homo sapiens
  misc_feature 1..30: note = chr6:7920126-7920156
  misc_feature 1..30: note = hypo
  source 1..30: mol_type = genomic DNA
ctctgagagctgtagcgaggaatgcgaagg

SEQ ID NO: 40744 - DNA, 38 bp, Homo sapiens
  misc_feature 1..38: note = chr6:10595814-10595852
  misc_feature 1..38: note = hypo
  source 1..38: mol_type = genomic DNA
tgggttgctttcttttcttaagccgtaccatgttccag

SEQ ID NO: 40745 - DNA, 30 bp, Homo sapiens
  misc_feature 1..30: note = chr6:10776300-10776330
  misc_feature 1..30: note = hypo
  source 1..30: mol_type = genomic DNA
gtaagccaccacacccgacccaacatgaca

SEQ ID NO: 40746 - DNA, 81 bp, Homo sapiens
  misc_feature 1..81: note = chr6:12287998-12288079
  misc_feature 1..81: note = hypo
  source 1..81: mol_type = genomic DNA
gcgcgcgcaggcacacgtcttgcaaattcaggattcaaagagacaggggcaccattatatttggcacggtggggcccttcc

SEQ ID NO: 40747 - DNA, 349 bp, Homo sapiens
  misc_feature 1..349: note = chr6:12288379-12288728
  misc_feature 1..349: note = hypo
  source 1..349: mol_type = genomic DNA
tggggagggcatgggcggtggtttccgggtaggggccttgagaacatgttggtcctgactgttgtcagtgtttggtcaaagttgccaaaaggttaaaaaaaaaaaagtagggggagtccctgccaagacatatttcccaggccacctttcttccgcgggagtgttgggggggaggcgctgcttggaacctgtgaatgtgacatcagctctcctctcctctcccaaggtcggctttggagagggaggtcagggcacccttgcctggcacaggcggcagcgctggcttccggctcagtgccgcctgtcctccgggagctgtggcctccctgggccccggggctaggctgag

SEQ ID NO: 40748 - DNA, 159 bp, Homo sapiens
  misc_feature 1..159: note = chr6:13288514-13288673
  misc_feature 1..159: note = hypo
  source 1..159: mol_type = genomic DNA
catgatgccagggagcgtgactgtgggtgtgtctctgactgggacacccaggatagggtgtgcgatgaggccaggaccctcctaaaccctaacagcatcctaacgaggcccattgcagctttcgatttccttcataacagagctcgcaggccctcagtt

SEQ ID NO: 40749 - DNA, 30 bp, Homo sapiens; identical to SEQ ID NO: 14834
  misc_feature 1..30: note = chr6:13293172-13293202
  misc_feature 1..30: note = hypo
  source 1..30: mol_type = genomic DNA

SEQ ID NO: 40750 - DNA, 156 bp, Homo sapiens
  misc_feature 1..156: note = chr6:14203256-14203412
  misc_feature 1..156: note = hypo
  source 1..156: mol_type = genomic DNA
cccacagggacaggacgggatttcccaagaaacaagtctgtacctgccttgtttatgttttatacacaaaggatgctcagatacaaagaatatccttgttttagcctgtctgtccacatggcaaatcattacgcaccaactcgtcactctccgacg

SEQ ID NO: 40751 - DNA, 30 bp, Homo sapiens
  misc_feature 1..30: note = chr6:14999193-14999223
  misc_feature 1..30: note = hypo
  source 1..30: mol_type = genomic DNA
cactggctgaagccacggtgtcagctgggg

SEQ ID NO: 40752 - DNA, 75 bp, Homo sapiens
  misc_feature 1..75: note = chr6:15073578-15073653
  misc_feature 1..75: note = hypo
  source 1..75: mol_type = genomic DNA
ttcaatgtaaatacacggggaagcagaaacccttggttggtctgagtcaactgggcagctcgctgacaaagaaag

SEQ ID NO: 40753 - DNA, 40 bp, Homo sapiens
  misc_feature 1..40: note = chr6:15456031-15456071
  misc_feature 1..40: note = hypo
  source 1..40: mol_type = genomic DNA
tacaggcatgagtcaccatgcccggcgaagccaggttctt

SEQ ID NO: 40754 - DNA, 51 bp, Homo sapiens
  misc_feature 1..51: note = chr6:16197009-16197060
  misc_feature 1..51: note = hypo
  source 1..51: mol_type = genomic DNA
agtagaaaacaaaagcgggctgaaccaagccgaggccgctccacagagaaa

SEQ ID NO: 40755 - DNA, 151 bp, Homo sapiens
  misc_feature 1..151: note = chr6:16218420-16218571
  misc_feature 1..151: note = hypo
  source 1..151: mol_type = genomic DNA
gctgcctgccagtcccgcaccgtgtgcctgcacaccggggctgtaaatggagctgcctgccagtcctgcatcatgtgctaagtccctcattgcctggggctagccgggccagccaagcccacgcccacccggaactgcagctggcccacaa

SEQ ID NO: 40756 - DNA, 145 bp, Homo sapiens
  misc_feature 1..145: note = chr6:16249815-16249960
  misc_feature 1..145: note = hypo
  source 1..145: mol_type = genomic DNA
agtgctgggattacaggcgtaagccaccatgcctgggcaacttaaactgcttaagctccatttatgcccacgaagctaataatgctgttcaaagttgttccaaaaattaaatgaaacgactgacacaaagcgggtcataaatgct

SEQ ID NO: 40757 - DNA, 22 bp, Homo sapiens
  misc_feature 1..22: note = chr6:16288325-16288347
  misc_feature 1..22: note = hypo
  source 1..22: mol_type = genomic DNA
agccctcacagccctcgcttgc

SEQ ID NO: 40758 - DNA, 158 bp, Homo sapiens
  misc_feature 1..158: note = chr6:16293407-16293565
  misc_feature 1..158: note = hypo
  source 1..158: mol_type = genomic DNA
agtaccttcattttacggatgagcagacttaagcatcagcaaaaaaggaatttgtaaaaggcgacaccaccacttagcagagaagcaacagtgagaatctagaaatttccaagaagccccaggaaggccatggaaatatcttacgaaaatgaaatgtc

SEQ ID NO: 40759 - DNA, 47 bp, Homo sapiens
  misc_feature 1..47: note = chr6:18035850-18035897
  misc_feature 1..47: note = hypo
  source 1..47: mol_type = genomic DNA
gtcctcaccactctccgtggagaacactggtacgttctgtcgtctct

SEQ ID NO: 40760 - DNA, 92 bp, Homo sapiens; identical to SEQ ID NO: 14840
  misc_feature 1..92: note = chr6:20239485-20239577
  misc_feature 1..92: note = hypo
  source 1..92: mol_type = genomic DNA

SEQ ID NO: 40761 - DNA, 30 bp, Homo sapiens
  misc_feature 1..30: note = chr6:20691518-20691548
  misc_feature 1..30: note = hypo
  source 1..30: mol_type = genomic DNA
gcagaccctgagcagcgactgctgctgaga

SEQ ID NO: 40762 - DNA, 86 bp, Homo sapiens
  misc_feature 1..86: note = chr6:20702857-20702943
  misc_feature 1..86: note = hypo
  source 1..86: mol_type = genomic DNA
ctctggacgtcctctcgatatccagccacctgtgttttcttcgccgatgtgttcctcatgatgtccagccacttgtgtgttggcct

SEQ ID NO: 40763 - DNA, 16 bp, Homo sapiens
  misc_feature 1..16: note = chr6:21687666-21687682
  misc_feature 1..16: note = hypo
  source 1..16: mol_type = genomic DNA
ccgcctcaaaacaaaa

SEQ ID NO: 40764 - DNA, 30 bp, Homo sapiens
  misc_feature 1..30: note = chr6:24465059-24465089
  misc_feature 1..30: note = hypo
  source 1..30: mol_type = genomic DNA
acccacatctcaacccggttcaggtcagta

SEQ ID NO: 40765 - DNA, 21 bp, Homo sapiens
  misc_feature 1..21: note = chr6:24647342-24647363
  misc_feature 1..21: note = hypo
  source 1..21: mol_type = genomic DNA
aaaaccagctgggtgcggtgg

SEQ ID NO: 40766 - DNA, 30 bp, Homo sapiens
  misc_feature 1..30: note = chr6:25218551-25218581
  misc_feature 1..30: note = hypo
  source 1..30: mol_type = genomic DNA
ggggcatggtgggggcgcctttctcacccc

SEQ ID NO: 40767 - DNA, 61 bp, Homo sapiens
  misc_feature 1..61: note = chr6:25668982-25669043
  misc_feature 1..61: note = hypo
  source 1..61: mol_type = genomic DNA
gctttcccatcatgtcgggtctcttagaagtcctttcactttcttgcgatctatgctatgt

SEQ ID NO: 40768 - DNA, 30 bp, Homo sapiens
  misc_feature 1..30: note = chr6:25710967-25710997
  misc_feature 1..30: note = hypo
  source 1..30: mol_type = genomic DNA
atcttgactctattccgttatgttaaatta

SEQ ID NO: 40769 - DNA, 74 bp, Homo sapiens
  misc_feature 1..74: note = chr6:25727962-25728036
  misc_feature 1..74: note = hypo
  source 1..74: mol_type = genomic DNA
atccttgctaggcaccgtgactcgcctgtaatcccagcacttgcagaggtcgaggctggcggttcatgaggtta

SEQ ID NO: 40770 - DNA, 23 bp, Homo sapiens
  misc_feature 1..23: note = chr6:26047695-26047718
  misc_feature 1..23: note = hypo
  source 1..23: mol_type = genomic DNA
accgcgcccggcctccttgaagc

SEQ ID NO: 40771 - DNA, 27 bp, Homo sapiens
  misc_feature 1..27: note = chr6:26053446-26053473
  misc_feature 1..27: note = hypo
  source 1..27: mol_type = genomic DNA
cgtgagccaccgcgcccagcctttttt

SEQ ID NO: 40772 - DNA, 36 bp, Homo sapiens
  misc_feature 1..36: note = chr6:26214612-26214648
  misc_feature 1..36: note = hypo
  source 1..36: mol_type = genomic DNA
gccggcgtgagccaccgcgcccggccaagagaaaaa

SEQ ID NO: 40773 - DNA, 31 bp, Homo sapiens
  misc_feature 1..31: note = chr6:27102699-27102730
  misc_feature 1..31: note = hypo
  source 1..31: mol_type = genomic DNA
agtaatcttaagaagacgttaactcattttt

SEQ ID NO: 40774 - DNA, 30 bp, Homo sapiens
  misc_feature 1..30: note = chr6:27719898-27719928
  misc_feature 1..30: note = hypo
  source 1..30: mol_type = genomic DNA
ggctgagatggagcacgcaagtattctctt

SEQ ID NO: 40775 - DNA, 51 bp, Homo sapiens
  misc_feature 1..51: note = chr6:27934894-27934945
  misc_feature 1..51: note = hypo
  source 1..51: mol_type = genomic DNA
tggacgaggggaatgcggtggcgcctgaaaacttgacgatgccacaatgtc

SEQ ID NO: 40776 - DNA, 30 bp, Homo sapiens
  misc_feature 1..30: note = chr6:28395568-28395598
  misc_feature 1..30: note = hypo
  source 1..30: mol_type = genomic DNA
gtatccagctgggcacggtggctccaacct

SEQ ID NO: 40777 - DNA, 245 bp, Homo sapiens
  misc_feature 1..245: note = chr6:33955486-33955731
  misc_feature 1..245: note = hypo
  source 1..245: mol_type = genomic DNA
cgcatgtcaccctcacggccactctggaggcaggcgcttttgtcatcaaacccatttcacatgtgagggcgctgaagcccaaagaaagcagcgcctcactctgctgcctcatactctgttaaaaggagaatcatgccaacctccagaaatgaggcgggaaaatgactgcgctccgtgacctgtcaattaccccctggagacagccagcagctgtcctcatccctaggctgcggtcagagaaacat

SEQ ID NO: 40778 - DNA, 150 bp, Homo sapiens
  misc_feature 1..150: note = chr6:33995975-33996125
  misc_feature 1..150: note = hypo
  source 1..150: mol_type = genomic DNA
ggacatggtggccgccgtaacgacggctttgaggctgcgcttgcgcttgggcacgttctgctccgggtggaagaggatgatgtagactttgggcatgtagagcattcccagggacaccgaggcgctcagactcaccgagaccgtcagcgt

SEQ ID NO: 40779 - DNA, 30 bp, Homo sapiens
  misc_feature 1..30: note = chr6:34034624-34034654
  misc_feature 1..30: note = hypo
  source 1..30: mol_type = genomic DNA
gtgccgcggtcctcacgtggtgccgcctga

SEQ ID NO: 40780 - DNA, 120 bp, Homo sapiens; identical to SEQ ID NO: 5043
  misc_feature 1..120: note = chr6:34170868-34170988
  misc_feature 1..120: note = hypo
  source 1..120: mol_type = genomic DNA

SEQ ID NO: 40781 - DNA, 31 bp, Homo sapiens; identical to SEQ ID NO: 5044
  misc_feature 1..31: note = chr6:34171048-34171079
  misc_feature 1..31: note = hypo
  source 1..31: mol_type = genomic DNA

SEQ ID NO: 40782 - DNA, 30 bp, Homo sapiens
  misc_feature 1..30: note = chr6:34392006-34392036
  misc_feature 1..30: note = hypo
  source 1..30: mol_type = genomic DNA
catatcctttcacatcgtggtatacaccat

SEQ ID NO: 40783 - DNA, 30 bp, Homo sapiens; identical to SEQ ID NO: 14846
  misc_feature 1..30: note = chr6:34514348-34514378
  misc_feature 1..30: note = hypo
  source 1..30: mol_type = genomic DNA

SEQ ID NO: 40784 - DNA, 29 bp, Homo sapiens
  misc_feature 1..29: note = chr6:34535577-34535606
  misc_feature 1..29: note = hypo
  source 1..29: mol_type = genomic DNA
gccctgccatcatagcgctgacagcggct

SEQ ID NO: 40785 - DNA, 29 bp, Homo sapiens
  misc_feature 1..29: note = chr6:34535906-34535935
  misc_feature 1..29: note = hypo
  source 1..29: mol_type = genomic DNA
ggcgtgagtcactgcgcccagccatatcc

SEQ ID NO: 40786 - DNA, 70 bp, Homo sapiens
  misc_feature 1..70: note = chr6:34671603-34671673
  misc_feature 1..70: note = hypo
  source 1..70: mol_type = genomic DNA
gcaagcaaatgtctgcgggcttactatgagaaaggctgagttggggacagtggtccggaaagagaaccct

SEQ ID NO: 40787 - DNA, 19 bp, Homo sapiens
  misc_feature 1..19: note = chr6:34723890-34723909
  misc_feature 1..19: note = hypo
  source 1..19: mol_type = genomic DNA
gggcgcggtgggtcacgcc

SEQ ID NO: 40788 - DNA, 19 bp, Homo sapiens
  misc_feature 1..19: note = chr6:34724209-34724228
  misc_feature 1..19: note = hypo
  source 1..19: mol_type = genomic DNA
aagacgagataacctttct

SEQ ID NO: 40789 - DNA, 23 bp, Homo sapiens
  misc_feature 1..23: note = chr6:34854786-34854809
  misc_feature 1..23: note = hypo
  source 1..23: mol_type = genomic DNA
tgggtccctgatcaccgggtgcg

SEQ ID NO: 40790 - DNA, 33 bp, Homo sapiens
  misc_feature 1..33: note = chr6:35026986-35027019
  misc_feature 1..33: note = hypo
  source 1..33: mol_type = genomic DNA
aggcaacacttcagacggcgtgctggcccagga

SEQ ID NO: 40791 - DNA, 297 bp, Homo sapiens
  misc_feature 1..297: note = chr6:35149810-35150107
  misc_feature 1..297: note = hypo
  source 1..297: mol_type = genomic DNA
caaatgtttcttgagcgctggcaacgtgccaggctccttgctgggccccaaggagggagccacaaacacggacaaattccaggacctgctggagctgttctcgggctctaacgtgaggcaaaactgtgcacaaatcctggggcactctggacactgagctccggaccccgtgcaggcggtagtcgcctctgcgcggagtaggagctttgtgggcctcccacccagcatcaggagaatcagggcccacgtggcgggcgagggatctgcgacgcagccaccgggcgcccagctggggtc

SEQ ID NO: 40792 - DNA, 139 bp, Homo sapiens
  misc_feature 1..139: note = chr6:35309516-35309655
  misc_feature 1..139: note = hypo
  source 1..139: mol_type = genomic DNA
ctaggtgtggcctaaggagcttgcggcctacggaaggtgtggccgaaggagaggggaggggtcatctttaatgatgatggaggggaggcattggtcatatacctgagagtcaagctttgttcatcgtcagatgaaagcc

SEQ ID NO: 40793 - DNA, 30 bp, Homo sapiens
  misc_feature 1..30: note = chr6:35454542-35454572
  misc_feature 1..30: note = hypo
  source 1..30: mol_type = genomic DNA
ctcctatcccacagccgctggctctggagc

SEQ ID NO: 40794 - DNA, 22 bp, Homo sapiens
  misc_feature 1..22: note = chr6:35895206-35895228
  misc_feature 1..22: note = hypo
  source 1..22: mol_type = genomic DNA
tgagccacggtgcccggccccc

SEQ ID NO: 40795 - DNA, 85 bp, Homo sapiens
  misc_feature 1..85: note = chr6:36165588-36165673
  misc_feature 1..85: note = hypo
  source 1..85: mol_type = genomic DNA
tctagagtttctccccggtgtctggaggcgtgggtgggacaaaacacgtctgtgtagagtcttgcatggtcgagagatgcttgag

SEQ ID NO: 40796 - DNA, 130 bp, Homo sapiens
  misc_feature 1..130: note = chr6:36214662-36214792
  misc_feature 1..130: note = hypo
  source 1..130: mol_type = genomic DNA
atatgtcttcttgaacgccatcgccccatcccagactcaggaccagcctccccgcgctcactgctgtcactgctttccgcactccctgcggattttaggattttagctcccatctcgcgtcctctctcca

SEQ ID NO: 40797 - DNA, 101 bp, Homo sapiens
  misc_feature 1..101: note = chr6:36238341-36238442
  misc_feature 1..101: note = hypo
  source 1..101: mol_type = genomic DNA
cgggacctggccccccggatgctggaaacagcccaccgctttgcggggacatcggcaggtgctgtgatcgccgccctggccatctgcgggattgaaatggg

SEQ ID NO: 40798 - DNA, 30 bp, Homo sapiens; identical to SEQ ID NO: 14852
  misc_feature 1..30: note = chr6:36831576-36831606
  misc_feature 1..30: note = hypo
  source 1..30: mol_type = genomic DNA

SEQ ID NO: 40799 - DNA, 30 bp, Homo sapiens
  misc_feature 1..30: note = chr6:36881595-36881625
  misc_feature 1..30: note = hypo
  source 1..30: mol_type = genomic DNA
accttaccttttcagcggtctccagtgctt

SEQ ID NO: 40800 - DNA, 42 bp, Homo sapiens
  misc_feature 1..42: note = chr6:36949243-36949285
  misc_feature 1..42: note = hypo
  source 1..42: mol_type = genomic DNA
atgccagctcgactgcgtgccatgctgcgcagtgagttcccc

SEQ ID NO: 40801 - DNA, 46 bp, Homo sapiens
  misc_feature 1..46: note = chr6:37004177-37004223
  misc_feature 1..46: note = hypo
  source 1..46: mol_type = genomic DNA
tgcaaactgagcattcgaggggtctaggctgcgcgctctttatgag

SEQ ID NO: 40802 - DNA, 267 bp, Homo sapiens
  misc_feature 1..267: note = chr6:37024382-37024649
  misc_feature 1..267: note = hypo
  source 1..267: mol_type = genomic DNA
ggtctccaggagaggcgggcacttcctccgccccagcccagggtcctgttcaatccttattgaggagtttcctggcgacaggcagtgacctgtcggctgcctgtgtgggaagccgcttggcgtggccctccccatctcattagtggtgattcacctggactcacctggctgtcagggacctgtcccactgcccgctggaaccagctcagcaggcaccctctgaggggcagagacctcgttccctcagctccccgtcctccatggtgt

SEQ ID NO: 40803 - DNA, 44 bp, Homo sapiens
  misc_feature 1..44: note = chr6:37053276-37053320
  misc_feature 1..44: note = hypo
  source 1..44: mol_type = genomic DNA
tgataaaacccctaccgatggctgatgactaaaccaatccgcat

SEQ ID NO: 40804 - DNA, 30 bp, Homo sapiens
  misc_feature 1..30: note = chr6:37275453-37275483
  misc_feature 1..30: note = hypo
  source 1..30: mol_type = genomic DNA
gtattcttatgagtccggttcaacaacaac

SEQ ID NO: 40805 - DNA, 30 bp, Homo sapiens
  misc_feature 1..30: note = chr6:37358523-37358553
  misc_feature 1..30: note = hypo
  source 1..30: mol_type = genomic DNA
gattgttctgaagaccgtgctctaagggca

SEQ ID NO: 40806 - DNA, 180 bp, Homo sapiens
  misc_feature 1..180: note = chr6:37391410-37391590
  misc_feature 1..180: note = hypo
  source 1..180: mol_type = genomic DNA
tacctgggtggggttcgtcatctcacgctgagaagattaacaacactgtcacgcactcatgatgtgggttaaggagtggaaagtttaataggcaggagaaaggagagaggagagcaggtctgtcttttgtgagagagaggtgtccaaaagggaaaaggtggcctgcggcagaatgcagca

SEQ ID NO: 40807 - DNA, 30 bp, Homo sapiens
  misc_feature 1..30: note = chr6:37557743-37557773
  misc_feature 1..30: note = hypo
  source 1..30: mol_type = genomic DNA
tttcccttctcttatcgcctcccagtgcga

SEQ ID NO: 40808 - DNA, 30 bp, Homo sapiens
  misc_feature 1..30: note = chr6:37776410-37776440
  misc_feature 1..30: note = hypo
  source 1..30: mol_type = genomic DNA
ctggggaaacccaaacgaacacaccaatct

SEQ ID NO: 40809 - DNA, 30 bp, Homo sapiens
  misc_feature 1..30: note = chr6:37791835-37791865
  misc_feature 1..30: note = hypo
  source 1..30: mol_type = genomic DNA
gccaccgcgcctggccggtatatattaacg

SEQ ID NO: 40810 - DNA, 34 bp, Homo sapiens
  misc_feature 1..34: note = chr6:38018000-38018034
  misc_feature 1..34: note = hypo
  source 1..34: mol_type = genomic DNA
gattacaagcgtgagtcaccgtgcctggccaaga

SEQ ID NO: 40811 - DNA, 30 bp, Homo sapiens
  misc_feature 1..30: note = chr6:38137726-38137756
  misc_feature 1..30: note = hypo
  source 1..30: mol_type = genomic DNA
ttctgactggaagctcgctgggtgcagcag

SEQ ID NO: 40812 - DNA, 30 bp, Homo sapiens
  misc_feature 1..30: note = chr6:38183151-38183181
  misc_feature 1..30: note = hypo
  source 1..30: mol_type = genomic DNA
gtcggcctccgggctcgctaagcaaatagt

SEQ ID NO: 40813 - DNA, 30 bp, Homo sapiens
  misc_feature 1..30: note = chr6:38684078-38684108
  misc_feature 1..30: note = hypo
  source 1..30: mol_type = genomic DNA
aaatgcctctccctccggcttatttcccgt

SEQ ID NO: 40814 - DNA, 43 bp, Homo sapiens
  misc_feature 1..43: note = chr6:40244038-40244081
  misc_feature 1..43: note = hypo
  source 1..43: mol_type = genomic DNA
gacttccttagcctgcgttctgcatatgcgttatggctctgcc

SEQ ID NO: 40815 - DNA, 133 bp, Homo sapiens
  misc_feature 1..133: note = chr6:41709850-41709983
  misc_feature 1..133: note = hypo
  source 1..133: mol_type = genomic DNA
ggctgggagaggattcgagaggaagcccaggaaggaaggccctggagcaagactgactggagccagatgcccgctgggatgcctccaaaccccaaagcattgagcactgagcctcagtcgtccagggcggccg

SEQ ID NO: 40816 - DNA, 35 bp, Homo sapiens
  misc_feature 1..35: note = chr6:41715572-41715607
  misc_feature 1..35: note = hypo
  source 1..35: mol_type = genomic DNA
attcctggcatctaccgactcgatgccaggagcag

SEQ ID NO: 40817 - DNA, 185 bp, Homo sapiens
  misc_feature 1..185: note = chr6:41773575-41773760
  misc_feature 1..185: note = hypo
  source 1..185: mol_type = genomic DNA
gagcatggcgaagggcgacactagggcccacttcccggaccacatgactcggaagagggtgtgcagttcacggcagagggaaatgtgctttgaactcggctccttgttctggatgagctccagactccgactaatggaggccctgccgttccagcagaagccctcccgctcgcatgcctcggccc

SEQ ID NO: 40818 - DNA, 17 bp, Homo sapiens
  misc_feature 1..17: note = chr6:42062066-42062083
  misc_feature 1..17: note = hypo
  source 1..17: mol_type = genomic DNA
gcctgagcaacacagcg

SEQ ID NO: 40819 - DNA, 29 bp, Homo sapiens
  misc_feature 1..29: note = chr6:42090829-42090858
  misc_feature 1..29: note = hypo
  source 1..29: mol_type = genomic DNA
gagggacaggccgggcgcggtggctcacg

SEQ ID NO: 40820 - DNA, 88 bp, Homo sapiens
  misc_feature 1..88: note = chr6:42110870-42110958
  misc_feature 1..88: note = hypo
  source 1..88: mol_type = genomic DNA
gagaatgtgggatgacgaaatcttggcattctgtgtctgtacatcacattgtttttctttttcttttcttttcttttctttttttttt

SEQ ID NO: 40821 - DNA, 36 bp, Homo sapiens
  misc_feature 1..36: note = chr6:42184577-42184613
  misc_feature 1..36: note = hypo
  source 1..36: mol_type = genomic DNA
tctcaaagtgtagtctgaggacgtctgtggggtctg

SEQ ID NO: 40822 - DNA, 176 bp, Homo sapiens
  misc_feature 1..176: note = chr6:42190336-42190512
  misc_feature 1..176: note = hypo
  source 1..176: mol_type = genomic DNA
gagcacatctcagctcgctggcggtggctgaggatggtagatagggagtaaatggaattcaggatttacacacacattctctctctgccaaatgcacacatggatgagcgtacctggaggactggcgagttaactcattgaacaaatagttgctgagcacccgctataaattgctg

SEQ ID NO: 40823 - DNA, 41 bp, Homo sapiens
  misc_feature 1..41: note = chr6:42773440-42773481
  misc_feature 1..41: note = hypo
  source 1..41: mol_type = genomic DNA
aaagaggacaaggaacgggccaggtgcggtggctcacacct

SEQ ID NO: 40824 - DNA, 224 bp, Homo sapiens
  misc_feature 1..224: note = chr6:42813314-42813538
  misc_feature 1..224: note = hypo
  source 1..224: mol_type = genomic DNA
ctctgggcctcttcacgacagcatggccttttagctctccttcattgttctccctccttgttctcctggactaaaatgattgccccaggctatctttacattattccaaaccaagcatttaacagccactggcaggtgcgccggtttccaatacttaacaatacatcagaatcaactggaaagctttaaaaagttatagattcctggccgggcgcggtggctca

SEQ ID NO: 40825 - DNA, 37 bp, Homo sapiens
  misc_feature 1..37: note = chr6:42846392-42846429
  misc_feature 1..37: note = hypo
  source 1..37: mol_type = genomic DNA
tttttgagactgtctcgctctgtcgcccaggctggag

SEQ ID NO: 40826 - DNA, 96 bp, Homo sapiens
  misc_feature 1..96: note = chr6:42846609-42846705
  misc_feature 1..96: note = hypo
  source 1..96: mol_type = genomic DNA
attacaggtgaaagccaccggcccgacctactgtttttcaggattctatatagactgggagggaagaacgcaaattccgggcgatgagagctgcat

SEQ ID NO: 40827 - DNA, 156 bp, Homo sapiens
  misc_feature 1..156: note = chr6:43424451-43424607
  misc_feature 1..156: note = hypo
  source 1..156: mol_type = genomic DNA
cccccgcccccccccaaaaaaagacaaggacccagaacataatttctagtttgtgcaggacaacagggcagaggtcaggaacgctagcgcccatctctagtccttcagattgagatttcaccatctttaaattcaaaacatcggaaggagcagtcg

SEQ ID NO: 40828 - DNA, 69 bp, Homo sapiens
  misc_feature 1..69: note = chr6:43478676-43478745
  misc_feature 1..69: note = hypo
  source 1..69: mol_type = genomic DNA
acaccttctcaggtacgcagggcactgttgacatctgagggtgtgtccgtgccgcgagactggggcagc

SEQ ID NO: 40829 - DNA, 30 bp, Homo sapiens; identical to SEQ ID NO: 14862
  misc_feature 1..30: note = chr6:43486338-43486368
  misc_feature 1..30: note = hypo
  source 1..30: mol_type = genomic DNA

SEQ ID NO: 40830 - DNA, 111 bp, Homo sapiens
  misc_feature 1..111: note = chr6:43639599-43639710
  misc_feature 1..111: note = hypo
  source 1..111: mol_type = genomic DNA
tgtagatgggcttgacggagccaggagcccagcgcgtcaggtacctgtggagggagaacaaagaggtgcctgtgagggctgggggcccaagctggacgtgggagagtggag

SEQ ID NO: 40831 - DNA, 72 bp, Homo sapiens
  misc_feature 1..72: note = chr6:43748463-43748535
  misc_feature 1..72: note = hypo
  source 1..72: mol_type = genomic DNA
tccagaaaatcagttcgaggaaagggaaaggggcaaaaacgaaagcgcaagaaatcccggtataagtcctgg

SEQ ID NO: 40832 - DNA, 30 bp, Homo sapiens; identical to SEQ ID NO: 14864
  misc_feature 1..30: note = chr6:44241078-44241108
  misc_feature 1..30: note = hypo
  source 1..30: mol_type = genomic DNA

SEQ ID NO: 40833 - DNA, 41 bp, Homo sapiens; identical to SEQ ID NO: 14865
  misc_feature 1..41: note = chr6:44437145-44437186
  misc_feature 1..41: note = hypo
  source 1..41: mol_type = genomic DNA

SEQ ID NO: 40834 - DNA, 30 bp, Homo sapiens
  misc_feature 1..30: note = chr6:44443992-44444022
  misc_feature 1..30: note = hypo
  source 1..30: mol_type = genomic DNA
agcctgggtctggcacggtgaatcctcctt

SEQ ID NO: 40835 - DNA, 119 bp, Homo sapiens
  misc_feature 1..119: note = chr6:45609047-45609166
  misc_feature 1..119: note = hypo
  source 1..119: mol_type = genomic DNA
caagcatttggagagcgcctcagaactgcagatgaagccccggattgactttattgggtgatttcagcacggccaaatatttgtagtgtaaagaaatcataaaacgtgctggtggtccg

SEQ ID NO: 40836 - DNA, 26 bp, Homo sapiens
  misc_feature 1..26: note = chr6:47924456-47924482
  misc_feature 1..26: note = hypo
  source 1..26: mol_type = genomic DNA
ctgctcctggccgagagtatggtttt

SEQ ID NO: 40837 - DNA, 172 bp, Homo sapiens
  misc_feature 1..172: note = chr6:49464924-49465096
  misc_feature 1..172: note = hypo
  source 1..172: mol_type = genomic DNA
cacctatcaaattgacgaagacgggaaaaagctgaaagaaaattgctgaacatactgaaaaatgggcaccgagtacttgtgctaaaggaaggtgaattggtagaactgttttgagaggcagactttacagatatgttgcagaaccttagtgtaatgtcggccacttcaaatt

SEQ ID NO: 40838 - DNA, 164 bp, Homo sapiens
  misc_feature 1..164: note = chr6:49590413-49590577
  misc_feature 1..164: note = hypo
  source 1..164: mol_type = genomic DNA
ccagcagtgtgaaaacgaactaatacaccaactaattcaagaaattgttttatctaatttcataatttctgttagtggaacaattattctgcagatttcaccccccttcccctttgatggaaaaccagactttttttttttttgttttgttttgagacggagtc

SEQ ID NO: 40839 - DNA, 43 bp, Homo sapiens
  misc_feature 1..43: note = chr6:49590817-49590860
  misc_feature 1..43: note = hypo
  source 1..43: mol_type = genomic DNA
tgggactacaggcgtgagccaccgcgcccggccattgagacat

SEQ ID NO: 40840 - DNA, 39 bp, Homo sapiens
  misc_feature 1..39: note = chr6:50207691-50207730
  misc_feature 1..39: note = hypo
  source 1..39: mol_type = genomic DNA
cacgcctgccaagggcgagcgaggcgtggagcagtgacg

SEQ ID NO: 40841 - DNA, 30 bp, Homo sapiens
  misc_feature 1..30: note = chr6:52102871-52102901
  misc_feature 1..30: note = hypo
  source 1..30: mol_type = genomic DNA
catatcttcccagttcgaggcagggggcac

SEQ ID NO: 40842 - DNA, 88 bp, Homo sapiens
  misc_feature 1..88: note = chr6:52156845-52156933
  misc_feature 1..88: note = hypo
  source 1..88: mol_type = genomic DNA
agtctcccaaaacatcggtagtcaaaggaagaattcaaccttgacatttagtttcaaaactttggcgccgggcgcggtggctgacgcc

SEQ ID NO: 40843 - DNA, 107 bp, Homo sapiens
  misc_feature 1..107: note = chr6:52268182-52268289
  misc_feature 1..107: note = hypo
  source 1..107: mol_type = genomic DNA
acggggcacgagtggcgctactacttcttcagcctctttcagaaacacaacgaggtggtcaacgtctggacccatttactggcagccctggccgtcctcttgcgatt

SEQ ID NO: 40844 - DNA, 180 bp, Homo sapiens
  misc_feature 1..180: note = chr6:52928856-52929036
  misc_feature 1..180: note = hypo
  source 1..180: mol_type = genomic DNA
ccagcctgggctacagcgagactctgtctcagcaaaacaaaacacggcatttggacttccttattgtagctcgttctctctccccttcactctctcgctctctcccctccctcagcactttcacctccatttctgtgccaaagatgtactacaattttttttttttttgagacggagtct

SEQ ID NO: 40845 - DNA, 34 bp, Homo sapiens
  misc_feature 1..34: note = chr6:52929276-52929310
  misc_feature 1..34: note = hypo
  source 1..34: mol_type = genomic DNA
cgtgggccaccgcgcccagcggatatactgcatt

SEQ ID NO: 40846 - DNA, 30 bp, Homo sapiens
  misc_feature 1..30: note = chr6:57979515-57979545
  misc_feature 1..30: note = hypo
  source 1..30: mol_type = genomic DNA
ggtgtactccctcttcgatattgggtgtaa

SEQ ID NO: 40847 - DNA, 35 bp, Homo sapiens
  misc_feature 1..35: note = chr6:58504069-58504104
  misc_feature 1..35: note = hypo
  source 1..35: mol_type = genomic DNA
attttaggcgtgagccaccacgccctgcccattta

SEQ ID NO: 40848 - DNA, 148 bp, Homo sapiens
  misc_feature 1..148: note = chr6:64150678-64150826
  misc_feature 1..148: note = hypo
  source 1..148: mol_type = genomic DNA
cgcagatagcgagggcggaaacctccgccaccagctggacagcaacaaacaggacctgagcctcagcaacctggatgaagacccggtcaaggagctggctgcccttccaaagactaccacactggatctgtcttgtaataaatgacta

SEQ ID NO: 40849 - DNA, 20 bp, Homo sapiens
  misc_feature 1..20: note = chr6:71277673-71277693
  misc_feature 1..20: note = hypo
  source 1..20: mol_type = genomic DNA
caccgcgcccggtccgcaaa

SEQ ID NO: 40850 - DNA, 179 bp, Homo sapiens
  misc_feature 1..179: note = chr6:73764839-73765018
  misc_feature 1..179: note = hypo
  source 1..179: mol_type = genomic DNA
gcagatccagcacagcgagagtgagtggaacctggagaaccacttcagcggctggtacgacgccatcctgagcccagcgggccatgaggcggcaaagcaggcacggcgagatgctggctatgagtttgacatctgcttcacctcattgcagaagagagcgatcccgaccttctggacag

SEQ ID NO: 40851 - DNA, 103 bp, Homo sapiens
  misc_feature 1..103: note = chr6:74234126-74234229
  misc_feature 1..103: note = hypo
  source 1..103: mol_type = genomic DNA
taccatggcttgccacgtgaaaatgatttttaaatcttttcatctgctgtagctacctctgaagaaaagatgatggcccggtgcggtggctcacgcctgtaat

SEQ ID NO: 40852 - DNA, 104 bp, Homo sapiens
  misc_feature 1..104: note = chr6:74698077-74698181
  misc_feature 1..104: note = hypo
  source 1..104: mol_type = genomic DNA
cctttaccttaaaagcgggaaacaaaagattagcattatctctttttggtactaaagagaaaagataacttgtttcaaaaacatttctgacaaattcttttttt

SEQ ID NO: 40853 - DNA, 30 bp, Homo sapiens
  misc_feature 1..30: note = chr6:79699310-79699340
  misc_feature 1..30: note = hypo
  source 1..30: mol_type = genomic DNA
ttttgcgaccacagacgctaaaaatatgtg

SEQ ID NO: 40854 - DNA, 23 bp, Homo sapiens
  misc_feature 1..23: note = chr6:82958631-82958654
  misc_feature 1..23: note = hypo
  source 1..23: mol_type = genomic DNA
gggcgcggtggctcacgcctgta

SEQ ID NO: 40855 - DNA, 79 bp, Homo sapiens
  misc_feature 1..79: note = chr6:84513478-84513557
  misc_feature 1..79: note = hypo
  source 1..79: mol_type = genomic DNA
gctcctcctcctaagctgtaactctattcatttcttatatacgtggctggttctgggtcccttgcggtaaaatgatgta

SEQ ID NO: 40856 - DNA, 77 bp, Homo sapiens
  misc_feature 1..77: note = chr6:86302345-86302422
  misc_feature 1..77: note = hypo
  source 1..77: mol_type = genomic DNA
tcaattttaacctttcggaatatttcaggtttttttggggagggtggcatcaagtcctcttaagaatattataggga

SEQ ID NO: 40857 - DNA, 30 bp, Homo sapiens
  misc_feature 1..30: note = chr6:86415082-86415112
  misc_feature 1..30: note = hypo
  source 1..30: mol_type = genomic DNA
cttgtgctattggcccggatcccacacctg

SEQ ID NO: 40858 - DNA, 38 bp, Homo sapiens
  misc_feature 1..38: note = chr6:89857352-89857390
  misc_feature 1..38: note = hypo
  source 1..38: mol_type = genomic DNA
gtcaagaatgaagagcggtgggcagatcagttgaggtc

SEQ ID NO: 40859 - DNA, 111 bp, Homo sapiens
  misc_feature 1..111: note = chr6:90367322-90367433
  misc_feature 1..111: note = hypo
  source 1..111: mol_type = genomic DNA
ttctgaaaaacaacacgaacctgattctcccatctagagctaccagtctaacaactttttcttattatgcacaccacttaaatacagccgatattccggggtttgtcctgg

SEQ ID NO: 40860 - DNA, 51 bp, Homo sapiens
  misc_feature 1..51: note = chr6:90644578-90644629
  misc_feature 1..51: note = hypo
  source 1..51: mol_type = genomic DNA
caaggaacaggtctccgacacgggagctgcatgtgccgtaacatgaatgca

SEQ ID NO: 40861 - DNA, 185 bp, Homo sapiens
  misc_feature 1..185: note = chr6:90661223-90661408
  misc_feature 1..185: note = hypo
  source 1..185: mol_type = genomic DNA
ctgctacggggatggcggcggcctcaaagctgatgggctctggaagcatctggtccctggggcaagccatcttggccgtctctgaatccatcgtctcctcctcttcatcctcctcctctcctgcagagttctcgcagtcctcgtgtgggcgctggcacgcagcatccttccggcacacaaacagg

SEQ ID NO: 40862 - DNA, 16 bp, Homo sapiens
  misc_feature 1..16: note = chr6:97299315-97299331
  misc_feature 1..16: note = hypo
  source 1..16: mol_type = genomic DNA
ccgtctcaaaaaaaaa

SEQ ID NO: 40863 - DNA, 149 bp, Homo sapiens
  misc_feature 1..149: note = chr6:99396329-99396478
  misc_feature 1..149: note = hypo
  source 1..149: mol_type = genomic DNA
tcatttccataccaacgttcagaagcctctgaccattacctctgatgaagaagatggtctggcagcctctcttactcattttgatttatttttggtagattcagtatggcactttatttatttatttatgtattttttgagacggagtc

SEQ ID NO: 40864 - DNA, 29 bp, Homo sapiens
  misc_feature 1..29: note = chr6:99396718-99396747
  misc_feature 1..29: note = hypo
  source 1..29: mol_type = genomic DNA
tgagccaccgcgcccgcccttggcacttt

SEQ ID NO: 40865 - DNA, 30 bp, Homo sapiens; identical to SEQ ID NO: 14876
  misc_feature 1..30: note = chr6:105750542-105750572
  misc_feature 1..30: note = hypo
  source 1..30: mol_type = genomic DNA

SEQ ID NO: 40866 - DNA, 44 bp, Homo sapiens
  misc_feature 1..44: note = chr6:107075561-107075605
  misc_feature 1..44: note = hypo
  source 1..44: mol_type = genomic DNA
aacaaagaatacaaacgtagacttcatgagacaatcacagtaaa

SEQ ID NO: 40867 - DNA, 76 bp, Homo sapiens
  misc_feature 1..76: note = chr6:108274499-108274575
  misc_feature 1..76: note = hypo
  source 1..76: mol_type = genomic DNA
cccaaaactgtactacgggggtcctcatcttttacttaaaatccttaagaacaaatgtgcttcagaatttttcaga

SEQ ID NO: 40868 - DNA, 94 bp, Homo sapiens
  misc_feature 1..94: note = chr6:108280326-108280420
  misc_feature 1..94: note = hypo
  source 1..94: mol_type = genomic DNA
tgagaccggatcgctctccactgggcgacagatttgaatctacgctgtgcccatcttgcagatgaagatttccccaagccgttacagatggttc

SEQ ID NO: 40869 - DNA, 38 bp, Homo sapiens
  misc_feature 1..38: note = chr6:109038585-109038623
  misc_feature 1..38: note = hypo
  source 1..38: mol_type = genomic DNA
cccgaagagggtgcccgaggcttcggtgtgctgaggcc

SEQ ID NO: 40870 - DNA, 24 bp, Homo sapiens
  misc_feature 1..24: note = chr6:109057736-109057760
  misc_feature 1..24: note = hypo
  source 1..24: mol_type = genomic DNA
tgttaggaatattctcggcccggt

SEQ ID NO: 40871 - DNA, 82 bp, Homo sapiens; identical to SEQ ID NO: 14879
  misc_feature 1..82: note = chr6:109059835-109059917
  misc_feature 1..82: note = hypo
  source 1..82: mol_type = genomic DNA

SEQ ID NO: 40872 - DNA, 137 bp, Homo sapiens
  misc_feature 1..137: note = chr6:116574057-116574194
  misc_feature 1..137: note = hypo
  source 1..137: mol_type = genomic DNA
tctctgcaattctgtcgaattctagaaggctgtggtctgaaaaccagttgaagaaactagggatagtgttcccttcccggtttctgtggatatgagcctgggggtcttggcctcggtgccagcggattggagtggaa

SEQ ID NO: 40873 - DNA, 30 bp, Homo sapiens
  misc_feature 1..30: note = chr6:118113403-118113433
  misc_feature 1..30: note = hypo
  source 1..30: mol_type = genomic DNA
atggacaaatattaacgtggaaaatttata

SEQ ID NO: 40874 - DNA, 30 bp, Homo sapiens
  misc_feature 1..30: note = chr6:119240714-119240744
  misc_feature 1..30: note = hypo
  source 1..30: mol_type = genomic DNA
gcccttcaatatatacgtgttttctttact

SEQ ID NO: 40875 - DNA, 30 bp, Homo sapiens
  misc_feature 1..30: note = chr6:119254223-119254253
  misc_feature 1..30: note = hypo
  source 1..30: mol_type = genomic DNA
aaggggcaaataaaacgaaacagtgcacta

SEQ ID NO: 40876 - DNA, 42 bp, Homo sapiens
  misc_feature 1..42: note = chr6:119254674-119254716
  misc_feature 1..42: note = hypo
  source 1..42: mol_type = genomic DNA
aaaaaaaaaagagagaaacacttatttcgtttggaaagagat

SEQ ID NO: 40877 - DNA, 20 bp, Homo sapiens
  misc_feature 1..20: note = chr6:119560062-119560082
  misc_feature 1..20: note = hypo
  source 1..20: mol_type = genomic DNA
ttattatttttgagacggag

SEQ ID NO: 40878 - DNA, 42 bp, Homo sapiens
  misc_feature 1..42: note = chr6:119689647-119689689
  misc_feature 1..42: note = hypo
  source 1..42: mol_type = genomic DNA
tctagctttgctgagcgctgtttttttcgtttttgtttttgt

SEQ ID NO: 40879 - DNA, 30 bp, Homo sapiens
  misc_feature 1..30: note = chr6:119824210-119824240
  misc_feature 1..30: note = hypo
  source 1..30: mol_type = genomic DNA
ggtgtgaaggctgtccgggattaggtgtat

SEQ ID NO: 40880 - DNA, 28 bp, Homo sapiens
  misc_feature 1..28: note = chr6:119888174-119888202
  misc_feature 1..28: note = hypo
  source 1..28: mol_type = genomic DNA
tgtctataaaatccggtgcactctgctg

SEQ ID NO: 40881 - DNA, 30 bp, Homo sapiens
  misc_feature 1..30: note = chr6:119888428-119888458
  misc_feature 1..30: note = hypo
  source 1..30: mol_type = genomic DNA
ctctgagaatttcttcgtaaaacacttatt

SEQ ID NO: 40882 - DNA, 30 bp, Homo sapiens
  misc_feature 1..30: note = chr6:119989053-119989083
  misc_feature 1..30: note = hypo
  source 1..30: mol_type = genomic DNA
aacccaaaaagttttcgttgtctttaatgc

SEQ ID NO: 40883 - DNA, 30 bp, Homo sapiens
  misc_feature 1..30: note = chr6:121370471-121370501
  misc_feature 1..30: note = hypo
  source 1..30: mol_type = genomic DNA
ctgctggccagatcccgcaataataaataa

SEQ ID NO: 40884 - DNA, 17 bp, Homo sapiens
  misc_feature 1..17: note = chr6:125013694-125013711
  misc_feature 1..17: note = hypo
  source 1..17: mol_type = genomic DNA
gttcacacctgtaatcg

SEQ ID NO: 40885 - DNA, 77 bp, Homo sapiens
  misc_feature 1..77: note = chr6:125081173-125081250
  misc_feature 1..77: note = hypo
  source 1..77: mol_type = genomic DNA
aacagtgaaagcttccgctcagagaatggccctgttaaaaatgggcagtttcataaaaaagaatgagatcatgttct

SEQ ID NO: 40886 - DNA, 36 bp, Homo sapiens
  misc_feature 1..36: note = chr6:125286431-125286467
  misc_feature 1..36: note = hypo
  source 1..36: mol_type = genomic DNA
attattggccgggtgcggtggctcacgcctgtaatc

SEQ ID NO: 40887 - DNA, 105 bp, Homo sapiens
  misc_feature 1..105: note = chr6:125397724-125397829
  misc_feature 1..105: note = hypo
  source 1..105: mol_type = genomic DNA
gtttcataaaatttgcgattttgctttttaaaaactcagctaactctttccttctccttccctctcttgctgatacagatccacatccagcgaactgaaggatgt

SEQ ID NO: 40888 - DNA, 30 bp, Homo sapiens
  misc_feature 1..30: note = chr6:129480603-129480633
  misc_feature 1..30: note = hypo
  source 1..30: mol_type = genomic DNA
gccgggaggatctgccggggagagcggctt

SEQ ID NO: 40889 - DNA, 30 bp, Homo sapiens
  misc_feature 1..30: note = chr6:130182604-130182634
  misc_feature 1..30: note = hypo
  source 1..30: mol_type = genomic DNA
tgtttttagatagtgcggcaaataggcagg

SEQ ID NO: 40890 - DNA, 30 bp, Homo sapiens
  misc_feature 1..30: note = chr6:130241934-130241964
  misc_feature 1..30: note = hypo
  source 1..30: mol_type = genomic DNA
aggttgagcttctgccgctggtgcccaagt

SEQ ID NO: 40891 - DNA, 149 bp, Homo sapiens
  misc_feature 1..149: note = chr6:130530028-130530177
  misc_feature 1..149: note = hypo
  source 1..149: mol_type = genomic DNA
tattctaggggatgccgtgacctccgtatcatatcttacctatgaccatctcagcaccaaatcctacatgtggttctctaagtctacagtttttcctttgtttagttgtaatccatatattgaaatatacattacgtaaaacccagtgt

SEQ ID NO: 40892 - DNA, 30 bp, Homo sapiens
  misc_feature 1..30: note = chr6:130808098-130808128
  misc_feature 1..30: note = hypo
  source 1..30: mol_type = genomic DNA
ccctggagagaagggcgtgaacctggaagg

SEQ ID NO: 40893 - DNA, 32 bp, Homo sapiens
  misc_feature 1..32: note = chr6:131389791-131389823
  misc_feature 1..32: note = hypo
  source 1..32: mol_type = genomic DNA
ctatagtctcagctcctcgggaggctgaggca

SEQ ID NO: 40894 - DNA, 30 bp, Homo sapiens
  misc_feature 1..30: note = chr6:131455819-131455849
  misc_feature 1..30: note = hypo
  source 1..30: mol_type = genomic DNA
gagtaactagtttgccgacttctagtgtgc

SEQ ID NO: 40895 - DNA, 61 bp, Homo sapiens
  misc_feature 1..61: note = chr6:131616389-131616450
  misc_feature 1..61: note = hypo
  source 1..61: mol_type = genomic DNA
tcacgccctttgcagcggggaggagcctggcatctctctcctgttccggggtgtggtacct

SEQ ID NO: 40896 - DNA, 93 bp, Homo sapiens
  misc_feature 1..93: note = chr6:134067455-134067548
  misc_feature 1..93: note = hypo
  source 1..93: mol_type = genomic DNA
gcgcccagcctgcctggagctctttaaagggctctgagcctgggattcttgggagagttccattgcattgtatggtcacggagattgacacag

SEQ ID NO: 40897 - DNA, 86 bp, Homo sapiens
  misc_feature 1..86: note = chr6:134589500-134589586
  misc_feature 1..86: note = hypo
  source 1..86: mol_type = genomic DNA
caactgtttgtgaagcgcattgtaaacaaacatagacggggtgagacatcctctttatcctgaataaatcaagaattcccaggccg

SEQ ID NO: 40898 - DNA, 86 bp, Homo sapiens
  misc_feature 1..86: note = chr6:134589886-134589972
  misc_feature 1..86: note = hypo
  source 1..86: mol_type = genomic DNA
cacttggggtttataggagactgttctccaaaccacaccagacttttagaagcaactacctctacagataccggggtgaaccagta

SEQ ID NO: 40899 - DNA, 137 bp, Homo sapiens
  misc_feature 1..137: note = chr6:137144480-137144617
  misc_feature 1..137: note = hypo
  source 1..137: mol_type = genomic DNA
cctgtagttgtctaacgaggaatgcacacattcgcaagtaggtgttacagactccagttaattgtctcccgtcgcgcgcattggctcagcctgtggttaaagctgctcaggaggctgaggcgggaggatcgcttgag

SEQ ID NO: 40900 - DNA, 150 bp, Homo sapiens
  misc_feature 1..150: note = chr6:138790432-138790582
  misc_feature 1..150: note = hypo
  source 1..150: mol_type = genomic DNA
ttcgcacatgagttacgtagagggacctgcaggaagcggtagagaaaacataaggcttatgcgtttaatttccacaccaatttcaggatctttgtcactgacagcagcactaagacttgttaactttatatagttaagaagaacaaggct

SEQ ID NO: 40901 - DNA, 60 bp, Homo sapiens
  misc_feature 1..60: note = chr6:143557423-143557483
  misc_feature 1..60: note = hypo
  source 1..60: mol_type = genomic DNA
gggcagggcctctgccgtgagtttgcagatgcctcattcggactccgagtctgtgactca

SEQ ID NO: 40902 - DNA, 30 bp, Homo sapiens
  misc_feature 1..30: note = chr6:144522041-144522071
  misc_feature 1..30: note = hypo
  source 1..30: mol_type = genomic DNA
agatcttgtagatgtcggaaaacatctcat

SEQ ID NO: 40903 - DNA, 30 bp, Homo sapiens
  misc_feature 1..30: note = chr6:147981884-147981914
  misc_feature 1..30: note = hypo
  source 1..30: mol_type = genomic DNA
cttcgcgttctacctcgattgaaaattttc

SEQ ID NO: 40904 - DNA, 99 bp, Homo sapiens
  misc_feature 1..99: note = chr6:149177471-149177570
  misc_feature 1..99: note = hypo
  source 1..99: mol_type = genomic DNA
tattatgtaaggtaaataggggaaacgttcacaaagatgattcatgctaaacaaataaaaccagagccacatccatcagcataacgtagtgcaataaaa

SEQ ID NO: 40905 - DNA, 30 bp, Homo sapiens
  misc_feature 1..30: note = chr6:149460105-149460135
  misc_feature 1..30: note = hypo
  source 1..30: mol_type = genomic DNA
aggttaaatgctcagcgcatctggccagag

SEQ ID NO: 40906 - DNA, 23 bp, Homo sapiens
  misc_feature 1..23: note = chr6:149498669-149498692
  misc_feature 1..23: note = hypo
  source 1..23: mol_type = genomic DNA
aattctccatccaatcgagtctt

SEQ ID NO: 40907 - DNA, 34 bp, Homo sapiens
  misc_feature 1..34: note = chr6:149772982-149773016
  misc_feature 1..34: note = hypo
  source 1..34: mol_type = genomic DNA
gccaggcttagggagcgggcggtagggagtgggt

SEQ ID NO: 40908 - DNA, 30 bp, Homo sapiens
  misc_feature 1..30: note = chr6:149786129-149786159
  misc_feature 1..30: note = hypo
  source 1..30: mol_type = genomic DNA
tgctgtgctctctctcgtatgtgacctttc

SEQ ID NO: 40909 - DNA, 30 bp, Homo sapiens
  misc_feature 1..30: note = chr6:150985942-150985972
  misc_feature 1..30: note = hypo
  source 1..30: mol_type = genomic DNA
tcataccacattcatcgcagaattggggga

SEQ ID NO: 40910 - DNA, 151 bp, Homo sapiens
  misc_feature 1..151: note = chr6:152520849-152521000
  misc_feature 1..151: note = hypo
  source 1..151: mol_type = genomic DNA
ggcaatggcaattagcggtgctgtctgaggctaacttcccaagcaatttaggcaaacaagattttagcctgaattttccaggtaattgccttgttttgctgctaagggcagtttggggaagagtagcaggactagacgaaaatacattttt

SEQ ID NO: 40911 - DNA, 103 bp, Homo sapiens
  misc_feature 1..103: note = chr6:154970495-154970598
  misc_feature 1..103: note = hypo
  source 1..103: mol_type = genomic DNA
gtgtaagcatctaaacgccaaaatgcctcaacttcctacctgagctcaagaagtacaagaagtgaaaaatggcattaccggccgggcgcggtggctcacgccc

SEQ ID NO: 40912 - DNA, 26 bp, Homo sapiens
  misc_feature 1..26: note = chr6:155568751-155568777
  misc_feature 1..26: note = hypo
  source 1..26: mol_type = genomic DNA
gcacctggccacgcttcatggctttt

SEQ ID NO: 40913 - DNA, 50 bp, Homo sapiens
  misc_feature 1..50: note = chr6:155569275-155569325
  misc_feature 1..50: note = hypo
  source 1..50: mol_type = genomic DNA
gacggaccaggagagcgaggagcactaccacctgacgggtgaggcggcgg

SEQ ID NO: 40914 - DNA, 30 bp, Homo sapiens; identical to SEQ ID NO: 14887
  misc_feature 1..30: note = chr6:155988231-155988261
  misc_feature 1..30: note = hypo
  source 1..30: mol_type = genomic DNA

SEQ ID NO: 40915 - DNA, 30 bp, Homo sapiens
  misc_feature 1..30: note = chr6:157283403-157283433
  misc_feature 1..30: note = hypo
  source 1..30: mol_type = genomic DNA
gcctgggcgacagggcgaggctctgtctca

SEQ ID NO: 40916 - DNA, 30 bp, Homo sapiens
  misc_feature 1..30: note = chr6:157455406-157455436
  misc_feature 1..30: note = hypo
  source 1..30: mol_type = genomic DNA
ttacagcttgaaaagcgagttattatcttg

SEQ ID NO: 40917 - DNA, 39 bp, Homo sapiens; identical to SEQ ID NO: 14888
  misc_feature 1..39: note = chr6:157478299-157478338
  misc_feature 1..39: note = hypo
  source 1..39: mol_type = genomic DNA

SEQ ID NO: 40918 - DNA, 48 bp, Homo sapiens
  misc_feature 1..48: note = chr6:157505817-157505865
  misc_feature 1..48: note = hypo
  source 1..48: mol_type = genomic DNA
atcaaaacaggctttcgaattctaagccatatacgtttattgcttata

SEQ ID NO: 40919 - DNA, 27 bp, Homo sapiens
  misc_feature 1..27: note = chr6:157637384-157637411
  misc_feature 1..27: note = hypo
  source 1..27: mol_type = genomic DNA
cagcttcctgtagctcgtcccaaggtc

SEQ ID NO: 40920 - DNA, 84 bp, Homo sapiens
  misc_feature 1..84: note = chr6:157638362-157638446
  misc_feature 1..84: note = hypo
  source 1..84: mol_type = genomic DNA
gcacagggcagcagccggcttggcccgcagtgctcctcccgagcctgcttcattaatgggctggtgcttcgtcaacacgacagc

SEQ ID NO: 40921 - DNA, 105 bp, Homo sapiens
  misc_feature 1..105: note = chr6:157913083-157913188
  misc_feature 1..105: note = hypo
  source 1..105: mol_type = genomic DNA
tgccggtgttggttgcggcacctcaggtgctccatccagcagccctccaggcaggtgctgtcactgtcccctctcaccggggaggaaacccggccttttcccttg

SEQ ID NO: 40922 - DNA, 50 bp, Homo sapiens
  misc_feature 1..50: note = chr6:158093775-158093825
  misc_feature 1..50: note = hypo
  source 1..50: mol_type = genomic DNA
tcagagcaccaaattcgttttgcaggctgcagccacgcccctgctgcaga

SEQ ID NO: 40923 - DNA, 30 bp, Homo sapiens; identical to SEQ ID NO: 14891
  misc_feature 1..30: note = chr6:158119028-158119058
  misc_feature 1..30: note = hypo
  source 1..30: mol_type = genomic DNA

SEQ ID NO: 40924 - DNA, 184 bp, Homo sapiens
  misc_feature 1..184: note = chr6:158489608-158489792
  misc_feature 1..184: note = hypo
  source 1..184: mol_type = genomic DNA
ggagccccatgaactcgtaatgcgggacttggcggttctgacttctgtcatctcttgccttgctccccagatgacagcagcccagctgacatatttgctgtggggtttgaagagatggtggaattgagcgcagggaatattgtcaatgccaggtaaggggccaggtgtgcggggccaggcaggg

SEQ ID NO: 40925 - DNA, 30 bp, Homo sapiens
  misc_feature 1..30: note = chr6:158978998-158979028
  misc_feature 1..30: note = hypo
  source 1..30: mol_type = genomic DNA
agaaaacgagtatgacgggagaagaggagc

SEQ ID NO: 40926 - DNA, 48 bp, Homo sapiens
  misc_feature 1..48: note = chr6:158982731-158982779
  misc_feature 1..48: note = hypo
  source 1..48: mol_type = genomic DNA
ggaggacaagcaaaacgcagcttgaattttgtgcgagtttgaggcctc

SEQ ID NO: 40927 - DNA, 100 bp, Homo sapiens
  misc_feature 1..100: note = chr6:159049783-159049883
  misc_feature 1..100: note = hypo
  source 1..100: mol_type = genomic DNA
acccagagaggctggcgctctggagcgtgcccacgccacgctgctttccacccagaggggcaggtgctgtgaggtaaatgaggtgcggttgcctctccac

SEQ ID NO: 40928 - DNA, 30 bp, Homo sapiens
  misc_feature 1..30: note = chr6:159113607-159113637
  misc_feature 1..30: note = hypo
  source 1..30: mol_type = genomic DNA
acagggttatgaggacggcatcagattggc

SEQ ID NO: 40929 - DNA, 28 bp, Homo sapiens
  misc_feature 1..28: note = chr6:159151645-159151673
  misc_feature 1..28: note = hypo
  source 1..28: mol_type = genomic DNA
actctcagcaacgcggaaagaaagcagc

SEQ ID NO: 40930 - DNA, 30 bp, Homo sapiens
  misc_feature 1..30: note = chr6:159194759-159194789
  misc_feature 1..30: note = hypo
  source 1..30: mol_type = genomic DNA
ctcctgggaaggtcacgtgggggaagcgtc

SEQ ID NO: 40931 - DNA, 30 bp, Homo sapiens
  misc_feature 1..30: note = chr6:159253019-159253049
  misc_feature 1..30: note = hypo
  source 1..30: mol_type = genomic DNA
cgtgagggtgactgtcgggcctctcctgga

SEQ ID NO: 40932 - DNA, 29 bp, Homo sapiens
  misc_feature 1..29: note = chr6:159270065-159270094
  misc_feature 1..29: note = hypo
  source 1..29: mol_type = genomic DNA
catgctggccaggcacggtggctcacacc

SEQ ID NO: 40933 - DNA, 30 bp, Homo sapiens
  misc_feature 1..30: note = chr6:159456960-159456990
  misc_feature 1..30: note = hypo
  source 1..30: mol_type = genomic DNA
ggagacggtcctcagcgggaggagctcagg

SEQ ID NO: 40934 - DNA, 154 bp, Homo sapiens
  misc_feature 1..154: note = chr6:159569256-159569410
  misc_feature 1..154: note = hypo
  source 1..154: mol_type = genomic DNA
aaacagcgaaatcaccaacaatgaccacaaaaattgtgaaaaccatagcggtaaagaaatagtgaaaaggacacttgtttacactgtcagagctgggacaagaaggcagggtgtcaccttgttagacttcagccgagaacgtgccagttgggtg

SEQ ID NO: 40935 - DNA, 30 bp, Homo sapiens
  misc_feature 1..30: note = chr6:160450704-160450734
  misc_feature 1..30: note = hypo
  source 1..30: mol_type = genomic DNA
tgatcactaatgtggcgcacagtagcctgg

SEQ ID NO: 40936 - DNA, 55 bp, Homo sapiens; identical to SEQ ID NO: 14894
  misc_feature 1..55: note = chr6:160511899-160511954
  misc_feature 1..55: note = hypo
  source 1..55: mol_type = genomic DNA

SEQ ID NO: 40937 - DNA, 32 bp, Homo sapiens
  misc_feature 1..32: note = chr6:161259532-161259564
  misc_feature 1..32: note = hypo
  source 1..32: mol_type = genomic DNA
ttcattttgggaggccgaggcgggcggatcac

SEQ ID NO: 40938 - DNA, 100 bp, Homo sapiens
  misc_feature 1..100: note = chr6:161609814-161609914
  misc_feature 1..100: note = hypo
  source 1..100: mol_type = genomic DNA
gggttgagcagccagcggccgtcgaatggggcttccgtaaacatcattccctagaatcccgagagccacctggtgagatcggcatcgctatctcatttca

SEQ ID NO: 40939 - DNA, 63 bp, Homo sapiens
  misc_feature 1..63: note = chr6:161672733-161672796
  misc_feature 1..63: note = hypo
  source 1..63: mol_type = genomic DNA
gccaagcccacttcccgggccttacgtttcccattcaaacatgggagacgtgctcttgataca

SEQ ID NO: 40940 - DNA, 162 bp, Homo sapiens
  misc_feature 1..162: note = chr6:161685567-161685729
  misc_feature 1..162: note = hypo
  source 1..162: mol_type = genomic DNA
aggtggtccccctggcgtgcccgcgcatccctgccctgcaagtcttatccactgcgtgggaacccctcgctgaggcttccgtcttgccctctgggcagcaggctcctcaaaggcacttgcagggtcggctccctctttgtattcctgcgggctgaatgcacg

SEQ ID NO: 40941 - DNA, 32 bp, Homo sapiens; identical to SEQ ID NO: 14896
  misc_feature 1..32: note = chr6:161690517-161690549
  misc_feature 1..32: note = hypo
  source 1..32: mol_type = genomic DNA

SEQ ID NO: 40942 - DNA, 79 bp, Homo sapiens
  misc_feature 1..79: note = chr6:161780140-161780219
  misc_feature 1..79: note = hypo
  source 1..79: mol_type = genomic DNA
taggtgcatgccaatcccttcattttctaggagcactgctgcatgcaatggagtaataaggacacgctgggtaaattat

SEQ ID NO: 40943 - DNA, 25 bp, Homo sapiens
  misc_feature 1..25: note = chr6:161795264-161795289
  misc_feature 1..25: note = hypo
  source 1..25: mol_type = genomic DNA
tgtgttgtgtatatgcgtatgctgt

SEQ ID NO: 40944 - DNA, 24 bp, Homo sapiens
  misc_feature 1..24: note = chr6:161795349-161795373
  misc_feature 1..24: note = hypo
  source 1..24: mol_type = genomic DNA
tgtgtgtaacgcatggtgtgcatg

SEQ ID NO: 40945 - DNA, 36 bp, Homo sapiens
  misc_feature 1..36: note = chr6:161989335-161989371
  misc_feature 1..36: note = hypo
  source 1..36: mol_type = genomic DNA
taacactgggctgggcgtgatggctcacgcctgtaa

SEQ ID NO: 40946 - DNA, 166 bp, Homo sapiens
  misc_feature 1..166: note = chr6:162257865-162258031
  misc_feature 1..166: note = hypo
  source 1..166: mol_type = genomic DNA
ctcccgagcacaagccgtaaaatgacgggagctgtgtgaggtgccaaggtctcaaatgaatgcgggcagcagcacctgtgaagctgataaaacatcagtttgcatttggctcaccttgcaagagggggttttatgcctctcgttttcgctccgctcccacactcct

SEQ ID NO: 40947 - DNA, 30 bp, Homo sapiens
  misc_feature 1..30: note = chr6:162280335-162280365
  misc_feature 1..30: note = hypo
  source 1..30: mol_type = genomic DNA
ttctagaaatgagaacgcaggccagacgcg

SEQ ID NO: 40948 - DNA, 30 bp, Homo sapiens
  misc_feature 1..30: note = chr6:163673402-163673432
  misc_feature 1..30: note = hypo
  source 1..30: mol_type = genomic DNA
ggggggcgacatcatcggggaaacaaatca

SEQ ID NO: 40949 - DNA, 30 bp, Homo sapiens
  misc_feature 1..30: note = chr6:163915349-163915379
  misc_feature 1..30: note = hypo
  source 1..30: mol_type = genomic DNA
gcactggtagggaggcggtcctgggaccaa

SEQ ID NO: 40950 - DNA, 17 bp, Homo sapiens
  misc_feature 1..17: note = chr6:163945812-163945829
  misc_feature 1..17: note = hypo
  source 1..17: mol_type = genomic DNA
tacgatcatctattcta

SEQ ID NO: 40951 - DNA, 43 bp, Homo sapiens
  misc_feature 1..43: note = chr6:163946785-163946828
  misc_feature 1..43: note = hypo
  source 1..43: mol_type = genomic DNA
aggtagttgtcaggtcgtcaaaggcagacgagtgtcatctgaa

SEQ ID NO: 40952 - DNA, 30 bp, Homo sapiens
  misc_feature 1..30: note = chr6:164012441-164012471
  misc_feature 1..30: note = hypo
  source 1..30: mol_type = genomic DNA
tttttgagttgcagccgaagtcttgatctg

SEQ ID NO: 40953 - DNA, 117 bp, Homo sapiens
  misc_feature 1..117: note = chr6:164064007-164064124
  misc_feature 1..117: note = hypo
  source 1..117: mol_type = genomic DNA
aatggtgagtgggctcgggaaaaactccgctggtctgtcaatttccaggtggagaatttgcaatgacttttctggctgactcagctgatcaaagtaggtccacgttgttttcctttt

SEQ ID NO: 40954 - DNA, 18 bp, Homo sapiens
  misc_feature 1..18: note = chr6:164114295-164114313
  misc_feature 1..18: note = hypo
  source 1..18: mol_type = genomic DNA
ttatttttttgagaccga

SEQ ID NO: 40955 - DNA, 30 bp, Homo sapiens
  misc_feature 1..30: note = chr6:164121841-164121871
  misc_feature 1..30: note = hypo
  source 1..30: mol_type = genomic DNA
aaaaactggatccaacggcttgtttgtgaa

SEQ ID NO: 40956 - DNA, 30 bp, Homo sapiens
  misc_feature 1..30: note = chr6:164143599-164143629
  misc_feature 1..30: note = hypo
  source 1..30: mol_type = genomic DNA
gccaggaagctataacgctgctctccaggc

SEQ ID NO: 40957 - DNA, 30 bp, Homo sapiens
  misc_feature 1..30: note = chr6:164145369-164145399
  misc_feature 1..30: note = hypo
  source 1..30: mol_type = genomic DNA
tgggtgtgggcagcacgcataggaagagga

SEQ ID NO: 40958 - DNA, 30 bp, Homo sapiens
  misc_feature 1..30: note = chr6:164149978-164150008
  misc_feature 1..30: note = hypo
  source 1..30: mol_type = genomic DNA
ggaagccgctaacatcgtgcaatgcacagc

SEQ ID NO: 40959 - DNA, 92 bp, Homo sapiens
  misc_feature 1..92: note = chr6:164165801-164165893
  misc_feature 1..92: note = hypo
  source 1..92: mol_type = genomic DNA
tgtggagagtagccacgtcgggcatgcagacatgtgtctcagcagccgtcctcctgcacagcggggcgtatgacaggcgggcagagagtcag

SEQ ID NO: 40960 - DNA, 30 bp, Homo sapiens
  misc_feature 1..30: note = chr6:164173782-164173812
  misc_feature 1..30: note = hypo
  source 1..30: mol_type = genomic DNA
tcagaggtagaggaacggggctgccagtga

SEQ ID NO: 40961 - DNA, 77 bp, Homo sapiens
  misc_feature 1..77: note = chr6:164182851-164182928
  misc_feature 1..77: note = hypo
  source 1..77: mol_type = genomic DNA
aatcggtttcctttgcggatgctctcctaggtctttttttttttggaatcttgctattcgcctgcctcaggctcccg

SEQ ID NO: 40962 - DNA, 44 bp, Homo sapiens; identical to SEQ ID NO: 14900
  misc_feature 1..44: note = chr6:164183729-164183773
  misc_feature 1..44: note = hypo
  source 1..44: mol_type = genomic DNA

SEQ ID NO: 40963 - DNA, 23 bp, Homo sapiens
  misc_feature 1..23: note = chr6:164196995-164197018
  misc_feature 1..23: note = hypo
  source 1..23: mol_type = genomic DNA
cctaaaagcgtcttctgacaaac

SEQ ID NO: 40964 - DNA, 133 bp, Homo sapiens
  misc_feature 1..133: note = chr6:164228294-164228427
  misc_feature 1..133: note = hypo
  source 1..133: mol_type = genomic DNA
tcttgattggttggtcggaaaattggaggcagaggggcagtgggagtggccgtgcgggcctgctttgggaacagagggaccctccctgctgttctgttcacacggaagcgtgtctcagcgtctgggggcttgg

SEQ ID NO: 40965 - DNA, 30 bp, Homo sapiens
  misc_feature 1..30: note = chr6:164228847-164228877
  misc_feature 1..30: note = hypo
  source 1..30: mol_type = genomic DNA
cacaccaccggctttcgagtcacagaccct

SEQ ID NO: 40966 - DNA, 94 bp, Homo sapiens
  misc_feature 1..94: note = chr6:164241357-164241451
  misc_feature 1..94: note = hypo
  source 1..94: mol_type = genomic DNA
gtctgtgtcattcaccgctctgcctctgccgcctggagacgtgccgggcacgtaccgggtccttggtaactgcggaattcgctaatgaatgggt

SEQ ID NO: 40967 - DNA, 30 bp, Homo sapiens
  misc_feature 1..30: note = chr6:164243378-164243408
  misc_feature 1..30: note = hypo
  source 1..30: mol_type = genomic DNA
ggaagtcttgcttcccgggaggtggtaata

SEQ ID NO: 40968 - DNA, 24 bp, Homo sapiens
  misc_feature 1..24: note = chr6:164246119-164246143
  misc_feature 1..24: note = hypo
  source 1..24: mol_type = genomic DNA
gcaccgggccgatatggaatttct

SEQ ID NO: 40969 - DNA, 68 bp, Homo sapiens
  misc_feature 1..68: note = chr6:164283216-164283284
  misc_feature 1..68: note = hypo
  source 1..68: mol_type = genomic DNA
gggaggaggcattgccgggaagcatgtccccagcgtggcacagaaaccaggcacgaacctggtgctta

SEQ ID NO: 40970 - DNA, 30 bp, Homo sapiens; identical to SEQ ID NO: 14906
  misc_feature 1..30: note = chr6:164288079-164288109
  misc_feature 1..30: note = hypo
  source 1..30: mol_type = genomic DNA

SEQ ID NO: 40971 - DNA, 57 bp, Homo sapiens
  misc_feature 1..57: note = chr6:164314386-164314443
  misc_feature 1..57: note = hypo
  source 1..57: mol_type = genomic DNA
tggcctgacagtcaacgaggtggaaaccgtgacaaattcagacgccagggctttatc

SEQ ID NO: 40972 - DNA, 419 bp, Homo sapiens
  misc_feature 1..419: note = chr6:164322356-164322775
  misc_feature 1..419: note = hypo
  source 1..419: mol_type = genomic DNA
aagtagaagtcctcacgggcaactccctgccatccacaccaacctccccttcttgttctctccttctcatcttaaactttcgagaggaagaagggttggtcaagggtgaacgttcctgggcatggtgagaggctgctctgtggtgcccactcacactgagagggaccagctggggacgcctgatggtgccactgaggctttggggtcccctttcagaggggggcatcttaacgcgagtcttacggtctttcctgggttcccatgctcggcggcggctcctccacaggcctgtcttccctttgttctggagaatgttctgcctgggcggagcattcggtgcggttacgtgggtgcggttctccagggagagcgcgggggtctcttcagggtaatgccaacctcaccgccaaatgcagcta

SEQ ID NO: 40973 - DNA, 86 bp, Homo sapiens
  misc_feature 1..86: note = chr6:164323845-164323931
  misc_feature 1..86: note = hypo
  source 1..86: mol_type = genomic DNA
gccaggataagctggcgcctgagtacagctgggaccacccatgctaatgttttaggataaattcctaaaagcggaatttctgggtc

SEQ ID NO: 40974 - DNA, 108 bp, Homo sapiens
  misc_feature 1..108: note = chr6:164334224-164334332
  misc_feature 1..108: note = hypo
  source 1..108: mol_type = genomic DNA
tggagtgggacttagcggtgtgaggcagagctaggcaggaagaaatggaacgcccagtccagcctgggtcagaaatcactcagaagacacccacgctgcaagttgcat

SEQ ID NO: 40975 - DNA, 16 bp, Homo sapiens
  misc_feature 1..16: note = chr6:166487246-166487262
  misc_feature 1..16: note = hypo
  source 1..16: mol_type = genomic DNA
gcgcccggccgaagta

SEQ ID NO: 40976 - DNA, 46 bp, Homo sapiens
  misc_feature 1..46: note = chr6:166571891-166571937
  misc_feature 1..46: note = hypo
  source 1..46: mol_type = genomic DNA
ccgcggccgccccttcgtacagtggggatcccgaggaagagggcgc

SEQ ID NO: 40977 - DNA, 34 bp, Homo sapiens
  misc_feature 1..34: note = chr6:166635593-166635627
  misc_feature 1..34: note = hypo
  source 1..34: mol_type = genomic DNA
gtcggacaggcgtctcggtggacctgcttggttt

SEQ ID NO: 40978 - DNA, 127 bp, Homo sapiens
  misc_feature 1..127: note = chr6:166711375-166711502
  misc_feature 1..127: note = hypo
  source 1..127: mol_type = genomic DNA
agggacgagatgtgacggtgacagacgatggccaaggccatcttaccgagtgccaggcacgggcctcggcacctgctgtgctctgtctggggaagcgggcacagagatgaagcggccccacggcggt

SEQ ID NO: 40979 - DNA, 32 bp, Homo sapiens
  misc_feature 1..32: note = chr6:166888304-166888336
  misc_feature 1..32: note = hypo
  source 1..32: mol_type = genomic DNA
agcatcacccacaaccgcgagcctctcccatc

SEQ ID NO: 40980 - DNA, 191 bp, Homo sapiens
  misc_feature 1..191: note = chr6:166891668-166891859
  misc_feature 1..191: note = hypo
  source 1..191: mol_type = genomic DNA
gcagaggtggggtcgcggtgcctgccacctgaggcggcacgtcccttgcacatatgctcacgtgcttatgttataataagtgtccagatgtcatttgggtgcttgggaatgacaaggcagagactacacagatttccatcataaaagcttggtcttgaaagaggagtttcagccaccggcaaggttcctgg

SEQ ID NO: 40981 - DNA, 156 bp, Homo sapiens
  misc_feature 1..156: note = chr6:166944356-166944512
  misc_feature 1..156: note = hypo
  source 1..156: mol_type = genomic DNA
aaaaccgagtgaggccgtcggcctgccggtatcgaggctggtttgtcaggccccatccagcccaacagcctgctcgcagcctgctgctctgctttcccaatgccgctccacggcagaacatatgtgggagaatggtatttacgcaatacagctctt

SEQ ID NO: 40982 - DNA, 30 bp, Homo sapiens
  misc_feature 1..30: note = chr6:166982961-166982991
  misc_feature 1..30: note = hypo
  source 1..30: mol_type = genomic DNA
gccctggcctgtcatcggatgcctctgccc

SEQ ID NO: 40983 - DNA, 79 bp, Homo sapiens
  misc_feature 1..79: note = chr6:167038238-167038317
  misc_feature 1..79: note = hypo
  source 1..79: mol_type = genomic DNA
ttacatatgctaccccgattttcacaagtatcaaataatagaaagctggggaatgcatttgtaaaaaagagagcattgt

SEQ ID NO: 40984 - DNA, 210 bp, Homo sapiens
  misc_feature 1..210: note = chr6:167139240-167139450
  misc_feature 1..210: note = hypo
  source 1..210: mol_type = genomic DNA
tcgggccagcgtggacgttcccgacctgccccacagcacagagactggctccaggtatgccgggcagggaggctcctggcggcgcaggcccagagggaaagcagtgtcagctgaggggtggggaggaggcagagggcgcatcacttgtgattccccagctttgagaggagctcacagaggcagcttttggggaaccgacagatttactaa

SEQ ID NO: 40985 - DNA, 159 bp, Homo sapiens
  misc_feature 1..159: note = chr6:167140362-167140521
  misc_feature 1..159: note = hypo
  source 1..159: mol_type = genomic DNA
aggcctggaatctaccgtcctgggtgctgtctcctccaccacgtaagccaaacctgatttccgtgaagaatttcccacttgcactcatgaagacatggccattcccaggtatctaggtgttcctccactgatcagaaacttacacgactttatcagaag

SEQ ID NO: 40986 - DNA, 79 bp, Homo sapiens
  misc_feature 1..79: note = chr6:167835047-167835126
  misc_feature 1..79: note = hypo
  source 1..79: mol_type = genomic DNA
cttgctatgccagggcggtgctagagatagactttgccctgggctgggctgttttccccccacgcggatcctcacctcc

SEQ ID NO: 40987 - DNA, 33 bp, Homo sapiens
  misc_feature 1..33: note = chr6:168122617-168122650
  misc_feature 1..33: note = hypo
  source 1..33: mol_type = genomic DNA
gtcaaatattgattccgccgcgtattaacatga

SEQ ID NO: 40988 - DNA, 62 bp, Homo sapiens
  misc_feature 1..62: note = chr6:168376121-168376183
  misc_feature 1..62: note = hypo
  source 1..62: mol_type = genomic DNA
gggggattctcacggcgatgcagacttgaggctgagttgaaaaagggcgtggagaagcccag

SEQ ID NO: 40989 - DNA, 131 bp, Homo sapiens
  misc_feature 1..131: note = chr6:168377422-168377553
  misc_feature 1..131: note = hypo
  source 1..131: mol_type = genomic DNA
gcctctgggaagggccggtccaggagctccgcaagttgcgggagaacctggcgggtccgtggtccagcgaggcctgggattcagaagggatgaaacgttcctcgacgcttgaacaccggcctcctgcccct

SEQ ID NO: 40990 - DNA, 33 bp, Homo sapiens
  misc_feature 1..33: note = chr6:168399961-168399994
  misc_feature 1..33: note = hypo
  source 1..33: mol_type = genomic DNA
ttttgatagtgaatccgacgatccagttttgca

SEQ ID NO: 40991 - DNA, 196 bp, Homo sapiens
  misc_feature 1..196: note = chr6:168453289-168453485
  misc_feature 1..196: note = hypo
  source 1..196: mol_type = genomic DNA
gtccagttcctgctgcgtgcactggtttgtgacagcagcagtggctgaatggagagaaccacacccctgccagcgggaggcctggctggtcacctgagcacagatgccagggcagagccaggaggggactcaggatgaacactgccaccctggggcggctggagaaccaggcatgggccggcggcgagccgggagg

SEQ ID NO: 40992 - DNA, 30 bp, Homo sapiens
  misc_feature 1..30: note = chr6:168760650-168760680
  misc_feature 1..30: note = hypo
  source 1..30: mol_type = genomic DNA
gtcctcccagggtcccgtaattactttaat

SEQ ID NO: 40993 - DNA, 192 bp, Homo sapiens
  misc_feature 1..192: note = chr6:168858122-168858314
  misc_feature 1..192: note = hypo
  source 1..192: mol_type = genomic DNA
ctgcagtgacttcatcgccttgtgtttcccgtcgggtgcccagtaatcacaaagtggcctggagtcactgtttgtaaatacacaggagcctgcacccatcatatgtatgcggcagagtaatcctcccagaacatgagccccgcgtcacgtccttccagccgtgcttgtgatcactgccggggtgggagcctg

SEQ ID NO: 40994 - DNA, 157 bp, Homo sapiens
  misc_feature 1..157: note = chr6:168947642-168947799
  misc_feature 1..157: note = hypo
  source 1..157: mol_type = genomic DNA
ctgcaggcagcatcgcgttgggtctgtgtggggttgctgttgtggttgatctgtggggactgagtgcaagtcctcagcatccacccgtatgcacacttacttaacttactctcataattgtagtctccttgcaaatcttttccgttctgaattcaga

SEQ ID NO: 40995 - DNA, 30 bp, Homo sapiens
  misc_feature 1..30: note = chr6:169400246-169400276
  misc_feature 1..30: note = hypo
  source 1..30: mol_type = genomic DNA
gccccggtgcctctgcggtggaggagctag

SEQ ID NO: 40996 - DNA, 50 bp, Homo sapiens
  misc_feature 1..50: note = chr6:169562391-169562441
  misc_feature 1..50: note = hypo
  source 1..50: mol_type = genomic DNA
ccaggtcctccttcacgttctcgccaccccaaatgcgggcaccgcggcgc

SEQ ID NO: 40997 - DNA, 30 bp, Homo sapiens
  misc_feature 1..30: note = chr6:169562792-169562822
  misc_feature 1..30: note = hypo
  source 1..30: mol_type = genomic DNA
tcaattgatcaatgccgaggatggggagca

SEQ ID NO: 40998 - DNA, 415 bp, Homo sapiens
  misc_feature 1..415: note = chr6:169632421-169632836
  misc_feature 1..415: note = hypo
  source 1..415: mol_type = genomic DNA
agggctttctggacacgcacttgaggtgctgttcgttcctgaggctccgtttgtgactcagccatcgtttctgagcctcggctgcagctcaccaagggctgcgctaacagcggagaggtggcggcctgaccctcacaggcccggctgagcacgccccgcaccccgcgcggagagcagcggcccagccgagcaggtgctcagcttccccgggccagcccctcccatgcctctcccgggccacgccaccccttcctctccttcctcctgctgcttttctgagctcatctgatttttccaaagccgctcgcaacacacaaggaaggccggccttgcgtacttgcttttccgtcttggctgcttccaggccgaccccgacgggctggttccctctgtatcggggcgggcagggcaggca

SEQ ID NO: 40999 - DNA, 35 bp, Homo sapiens
  misc_feature 1..35: note = chr6:169637816-169637851
  misc_feature 1..35: note = hypo
  source 1..35: mol_type = genomic DNA
ggtcccagagccacacgtcacggagcactgggtcc

SEQ ID NO: 41000 - DNA, 30 bp, Homo sapiens
  misc_feature 1..30: note = chr6:169713660-169713690
  misc_feature 1..30: note = hypo
  source 1..30: mol_type = genomic DNA
ctccgcgcaccatgccgagggcattgtcct

SEQ ID NO: 41001 - DNA, 30 bp, Homo sapiens
  misc_feature 1..30: note = chr6:169740776-169740806
  misc_feature 1..30: note = hypo
  source 1..30: mol_type = genomic DNA
gggccgagccaacagcgagcttcgtgcaga

SEQ ID NO: 41002 - DNA, 30 bp, Homo sapiens
  misc_feature 1..30: note = chr6:170065367-170065397
  misc_feature 1..30: note = hypo
  source 1..30: mol_type = genomic DNA
cagacccagctcctccgcagaccagggggc

SEQ ID NO: 41003 - DNA, 30 bp, Homo sapiens
  misc_feature 1..30: note = chr6:170201723-170201753
  misc_feature 1..30: note = hypo
  source 1..30: mol_type = genomic DNA
aagagccccaggccccgggggcttctctgg

SEQ ID NO: 41004 - DNA, 30 bp, Homo sapiens
  misc_feature 1..30: note = chr6:170240081-170240111
  misc_feature 1..30: note = hypo
  source 1..30: mol_type = genomic DNA
atcatgcccactccacgccatgcccacatc

SEQ ID NO: 41005 - DNA, 30 bp, Homo sapiens
  misc_feature 1..30: note = chr6:170263220-170263250
  misc_feature 1..30: note = hypo
  source 1..30: mol_type = genomic DNA
agggtcccttccctccgtccctgccaccct

SEQ ID NO: 41006 - DNA, 30 bp, Homo sapiens
  misc_feature 1..30: note = chr6:170361487-170361517
  misc_feature 1..30: note = hypo
  source 1..30: mol_type = genomic DNA
cctgggcttcactcccgtttaactttgcat

SEQ ID NO: 41007 - DNA, 30 bp, Homo sapiens
  misc_feature 1..30: note = chr6:170368767-170368797
  misc_feature 1..30: note = hypo
  source 1..30: mol_type = genomic DNA
agctgcatttgcaagcgctggtgtccacac

SEQ ID NO: 41008 - DNA, 30 bp, Homo sapiens
  misc_feature 1..30: note = chr6:170402505-170402535
  misc_feature 1..30: note = hypo
  source 1..30: mol_type = genomic DNA
ctcagcaggggaggccgagtgtggaggttt

SEQ ID NO: 41009 - DNA, 30 bp, Homo sapiens
  misc_feature 1..30: note = chr6:170408290-170408320
  misc_feature 1..30: note = hypo
  source 1..30: mol_type = genomic DNA
ccgcacagctcccaacggcaccgcgcagct

SEQ ID NO: 41010 - DNA, 40 bp, Homo sapiens
  misc_feature 1..40: note = chr6:170454160-170454200
  misc_feature 1..40: note = hypo
  source 1..40: mol_type = genomic DNA
tgagcacctggagaacggcagtgcccgtgagcacctggag

SEQ ID NO: 41011 - DNA, 596 bp, Homo sapiens
  misc_feature 1..596: note = chr6:170475028-170475624
  misc_feature 1..596: note = hypo
  source 1..596: mol_type = genomic DNA
ttcttgggtgacaatcgaggggtcctgacccagcacccgtgggcacacccttatttggaaattgggcctagcccggagtgatcatgaggccacgtgacatgggcgtgccagtctcaccaacgtgtgttttcacgggcaccacagagtctgttttctatgggtggggcagcggtgaacatatccctcttaatagcggtacgggtacggccagggaggcggcagaacgtagacagaacccgggcactgagagaccggtgccgccccccgccgtccacacaacccgggcctcgggcagcaccagcaggacttttattcctcaccccgcacgccgccgtccatctcctaggccagcgtgattcttctgagtgcagctgggtctcctcctgggagatccggtggctctagcagcgtgggtgctgggaacaggaccagcctcgccggcggacagtgtggacgcctgagggcaaaccctggaccactctctccccgggggactccgttcccgcctccagggagctgcgaacgctccttctgggacacctgttggcaagaaaccagttcaatcgtctcacttccagaaacgattctgtgttttg

SEQ ID NO: 41012 - DNA, 118 bp, Homo sapiens
  misc_feature 1..118: note = chr6:170493059-170493177
  misc_feature 1..118: note = hypo
  source 1..118: mol_type = genomic DNA
cctggggcctttgcacggcggctgctgccatctgctcctccctggcgctgtggggccagctcctttcttcgagttctctcactggacgcattgccacctcacacgggacccctgaccc

SEQ ID NO: 41013 - DNA, 30 bp, Homo sapiens
  misc_feature 1..30: note = chr6:170569817-170569847
  misc_feature 1..30: note = hypo
  source 1..30: mol_type = genomic DNA
taacttccagtgacacggttttttcaatct

SEQ ID NO: 41014 - DNA, 19 bp, Homo sapiens
  misc_feature 1..19: note = chr6:170894820-170894839
  misc_feature 1..19: note = hypo
  source 1..19: mol_type = genomic DNA
tttgagatggagtctcgct

SEQ ID NO: 41015 - DNA, 167 bp, Homo sapiens
  misc_feature 1..167: note = chr7:131076-131243
  misc_feature 1..167: note = hypo
  source 1..167: mol_type = genomic DNA
agggtctgcagctggcgcacgaggtgaacacaatgctaaggacaaaattacacaaggaatgtgcaagagttccactgttcacagtgggaatcacctaattcacacacaaccagcttcacaaaatgagctccaggcggccggctggagggacgcggaggccagcaggt

SEQ ID NO: 41016 - DNA, 159 bp, Homo sapiens
  misc_feature 1..159: note = chr7:171340-171499
  misc_feature 1..159: note = hypo
  source 1..159: mol_type = genomic DNA
gcactgctgccatctcgcaatttacataaagtctcagctctgtgcgtgggacagcagcgtttgaagctgtccccatcaagggcctgtacaaccacctccttcacagttaggggttggccgtcctgaggctgcccgaccccctcccggctccccgacccc

SEQ ID NO: 41017 - DNA, 30 bp, Homo sapiens
  misc_feature 1..30: note = chr7:306966-306996
  misc_feature 1..30: note = hypo
  source 1..30: mol_type = genomic DNA
ggtgcccgctgggcccgtaccagccatacc

SEQ ID NO: 41018 - DNA, 30 bp, Homo sapiens
  misc_feature 1..30: note = chr7:322785-322815
  misc_feature 1..30: note = hypo
  source 1..30: mol_type = genomic DNA
cccatcctgtctgcccggggccctgttaac

SEQ ID NO: 41019 - DNA, 44 bp, Homo sapiens
  misc_feature 1..44: note = chr7:328564-328608
  misc_feature 1..44: note = hypo
  source 1..44: mol_type = genomic DNA
gtgctggccgcgtttttagttttgacatccgattaaggggacaa

SEQ ID NO: 41020 - DNA, 136 bp, Homo sapiens
  misc_feature 1..136: note = chr7:369844-369980
  misc_feature 1..136: note = hypo
  source 1..136: mol_type = genomic DNA
gacaagttagcacaacgtttatggccacgaagttggcaacatcaataaaaatgtaaatgcatctgccctttggcccggcaattctgcttatcctatagataccattgcgcacaggtgaggccgtctatgtgtgaaa

SEQ ID NO: 41021 - DNA, 30 bp, Homo sapiens
  misc_feature 1..30: note = chr7:381568-381598
  misc_feature 1..30: note = hypo
  source 1..30: mol_type = genomic DNA
tggtccagagctgcccgaggagacaggaca

SEQ ID NO: 41022 - DNA, 30 bp, Homo sapiens
  misc_feature 1..30: note = chr7:389663-389693
  misc_feature 1..30: note = hypo
  source 1..30: mol_type = genomic DNA
accagcagggtgtcacggggcaagtacctc

SEQ ID NO: 41023 - DNA, 179 bp, Homo sapiens
  misc_feature 1..179: note = chr7:409602-409781
  misc_feature 1..179: note = hypo
  source 1..179: mol_type = genomic DNA
ggccgcctaccccagcggtgccaccaaggccgctctcaggctgccccacagctgcgtgccaagcccctgacgggcactttatggcacgttatctcgcctgtgccccacaacaacccggccgggtgggaattccgctcccattaaacagataaggaaccgggattcggagaggcgagggc

SEQ ID NO: 41024 - DNA, 30 bp, Homo sapiens
  misc_feature 1..30: note = chr7:410011-410041
  misc_feature 1..30: note = hypo
  source 1..30: mol_type = genomic DNA
ccaggcctggcctcccgactcccaccacca

SEQ ID NO: 41025 - DNA, 37 bp, Homo sapiens
  misc_feature 1..37: note = chr7:430257-430294
  misc_feature 1..37: note = hypo
  source 1..37: mol_type = genomic DNA
aagggagacacaaggcggaaggcgtgagggcaggagg

SEQ ID NO: 41026 - DNA, 291 bp, Homo sapiens
  misc_feature 1..291: note = chr7:431429-431720
  misc_feature 1..291: note = hypo
  source 1..291: mol_type = genomic DNA
tgaagccaccaggcacggggctgtgtgtgcagaagcagccaggcagggcggcccagcagacgcagggagcggccgccagccgctaggatcccgatgccgccgcaagtaaggacaggcccgggtgctgccgcaggaggccaggcctgcgctcgccgctgtggaatgtgtgtttgtctgatgagcatccctgcagggccccagatggagggtgtgacaaggatgggggctgagtctccagggcccgggggcacctgcacgctgcccctggcaggggcccgggcatcccacctg

SEQ ID NO: 41027 - DNA, 45 bp, Homo sapiens
  misc_feature 1..45: note = chr7:476438-476483
  misc_feature 1..45: note = hypo
  source 1..45: mol_type = genomic DNA
caaggctgcaggaaccgtctctgctggtcacgtctggagtgtgag

SEQ ID NO: 41028 - DNA, 30 bp, Homo sapiens
  misc_feature 1..30: note = chr7:494982-495012
  misc_feature 1..30: note = hypo
  source 1..30: mol_type = genomic DNA
gggctgcagatgggacggtgccctggggac

SEQ ID NO: 41029 - DNA, 167 bp, Homo sapiens
  misc_feature 1..167: note = chr7:497742-497909
  misc_feature 1..167: note = hypo
  source 1..167: mol_type = genomic DNA
ctgggttaagagcagcgacaactgttcctattcataccgcctggcctcaggtccacggctgcggccacagagcccatccaggaattctgctgctctcagtttacatttaaaataaatgtttccttaactcgcatctcatggccggcggtgaacggcaggaattgtga

SEQ ID NO: 41030 - DNA, 30 bp, Homo sapiens
  misc_feature 1..30: note = chr7:502286-502316
  misc_feature 1..30: note = hypo
  source 1..30: mol_type = genomic DNA
ccgcccgcagtgggacggagccggccccac

SEQ ID NO: 41031 - DNA, 279 bp, Homo sapiens
  misc_feature 1..279: note = chr7:502708-502987
  misc_feature 1..279: note = hypo
  source 1..279: mol_type = genomic DNA
ctgatacagcggggtcgtgggtgctctggcgggacggcccccaggcagccccgggccaggccagcccagaagggcctaggaggcagccgcgtggttaaagtgggggtgctgtttttgttgcgggatgtctgtgggtttgaacccccttgccctcatcacactggtggtgtgagccttgctcggaaagctggatttgaacgtcgtctgggtttggcgttggccctcagggcccggcgtccttccccggcgctgggacccagcctccggggagccgtgaag

SEQ ID NO: 41032 - DNA, 232 bp, Homo sapiens
  misc_feature 1..232: note = chr7:503676-503908
  misc_feature 1..232: note = hypo
  source 1..232: mol_type = genomic DNA
cagcccgggagggagcgtgaagtggaggatctcggcaggcgtggctgtgtccaggcaggcgggtgctgccgcgtccccggctgcagggtcttggttccccggagccacaggacggcagggcttcacggctccccggaggctgggtcccagcgctggggaaggacaccgggccctgagggccaacgccaaacccagacgacgttcaaatccagctttccgagcaaggctcaca

SEQ ID NO: 41033 - DNA, 30 bp, Homo sapiens
  misc_feature 1..30: note = chr7:543015-543045
  misc_feature 1..30: note = hypo
  source 1..30: mol_type = genomic DNA
aggctagaaaggaaacggaggccgggtcac

SEQ ID NO: 41034 - DNA, 112 bp, Homo sapiens
  misc_feature 1..112: note = chr7:551572-551684
  misc_feature 1..112: note = hypo
  source 1..112: mol_type = genomic DNA
caccagttcagcagccggcgcaggagcacgatgcccacactgcgaattggaaattaggcgcgaccacgtttccggcaaggctcctggggacaggccccgacaagacagggcg

SEQ ID NO: 41035 - DNA, 47 bp, Homo sapiens
  misc_feature 1..47: note = chr7:551972-552019
  misc_feature 1..47: note = hypo
  source 1..47: mol_type = genomic DNA
gcctcctggactcaccgatgcttctcttcctccgaatgggcaggggc

SEQ ID NO: 41036 - DNA, 126 bp, Homo sapiens
  misc_feature 1..126: note = chr7:578922-579048
  misc_feature 1..126: note = hypo
  source 1..126: mol_type = genomic DNA
accacctctgggggccggtgtgaagccagactcctagccagccctgcagcctgtcccaggggccagtagaaccgggagggggccgggtgtgtaactgcctcctgaggccggcgagtagattcctga

SEQ ID NO: 41037 - DNA, 70 bp, Homo sapiens
  misc_feature 1..70: note = chr7:803490-803560
  misc_feature 1..70: note = hypo
  source 1..70: mol_type = genomic DNA
tgccaggacctctaccgcaagcacattggtcccctcctggagcgggtgaccgcgtcgcaccttgactgga

SEQ ID NO: 41038 - DNA, 30 bp, Homo sapiens
  misc_feature 1..30: note = chr7:808547-808577
  misc_feature 1..30: note = hypo
  source 1..30: mol_type = genomic DNA
gttctcgtggcagggcggcacttggcccaa

SEQ ID NO: 41039 - DNA, 75 bp, Homo sapiens
  misc_feature 1..75: note = chr7:819623-819698
  misc_feature 1..75: note = hypo
  source 1..75: mol_type = genomic DNA
tgtgaggatggcagccgcctccaccttggtcacctggctgcagtgtgtcaagggtgccaacgcaaaatcctacta

SEQ ID NO: 41040 - DNA, 520 bp, Homo sapiens
  misc_feature 1..520: note = chr7:834330-834850
  misc_feature 1..520: note = hypo
  source 1..520: mol_type = genomic DNA
cagagatgtgggatgcggaagggttccccgcagggatccaggtccgggggcaggaggagcccagagggtggcaccatcacgcaaaggcctccagaggcgtggcccgggacaagcacagcgccagccgcctgcgctgccagggcagggtccacacccacagactgtaacctggacccgggcagggcggggtccacacccacagactgtaacctggacccaggtggggtccacacccgcggactgtaacctggacctgggcagggcagggtccacacccgcggactgtaacctggacccgggcagggcggggtccacacccttggactgtaacctggacccgggcagggcggggtccgcacccgcggactgtaacctggacccgggcagggcggggtccgcacccgcggactctaacctggacccaggcagggcagggtccatccacacccacagaatctaacctggactggggcagggcctaaacccagggactctaacctggacccgggcaggggaaggg

SEQ ID NO: 41041 - DNA, 30 bp, Homo sapiens
  misc_feature 1..30: note = chr7:907656-907686
  misc_feature 1..30: note = hypo
  source 1..30: mol_type = genomic DNA
ttcaaggctcagctccgtcttcacagcgcg

SEQ ID NO: 41042 - DNA, 59 bp, Homo sapiens
  misc_feature 1..59: note = chr7:915323-915382
  misc_feature 1..59: note = hypo
  source 1..59: mol_type = genomic DNA
cagggaaggaccgcaggtggcctttcaaagaggaggaacgcccctcagcgatcctaaga

SEQ ID NO: 41043 - DNA, 68 bp, Homo sapiens
  misc_feature 1..68: note = chr7:959576-959644
  misc_feature 1..68: note = hypo
  source 1..68: mol_type = genomic DNA
aggccccaccccacccgggtggcctcacctgccgagtagggctcctgcttctccgggtagatgaactc

SEQ ID NO: 41044 - DNA, 73 bp, Homo sapiens
  misc_feature 1..73: note = chr7:959899-959972
  misc_feature 1..73: note = hypo
  source 1..73: mol_type = genomic DNA
tgtgcgttcggcccccggagcatcaggcctcacgttctgcacaagcgttcccggtggacgggctggtgcctcc

SEQ ID NO: 41045 - DNA, 44 bp, Homo sapiens
  misc_feature 1..44: note = chr7:966875-966919
  misc_feature 1..44: note = hypo
  source 1..44: mol_type = genomic DNA
gctgcaggaggctgtcgttccaggaggctcgtgctccaggaggc

SEQ ID NO: 41046 - DNA, 60 bp, Homo sapiens
  misc_feature 1..60: note = chr7:986276-986336
  misc_feature 1..60: note = hypo
  source 1..60: mol_type = genomic DNA
ggacccaccctgtcccggagcccactctctggggcccccaccccgcgcccctccaggctc

SEQ ID NO: 41047 - DNA, 34 bp, Homo sapiens
  misc_feature 1..34: note = chr7:1022042-1022076
  misc_feature 1..34: note = hypo
  source 1..34: mol_type = genomic DNA
tgtgcaaagcaggcccggccgcttctgctgccag

SEQ ID NO: 41048 - DNA, 48 bp, Homo sapiens
  misc_feature 1..48: note = chr7:1022919-1022967
  misc_feature 1..48: note = hypo
  source 1..48: mol_type = genomic DNA
ccctccccagctgcccggtggcccccggggcctcgcccgctgccgctc

SEQ ID NO: 41049 - DNA, 30 bp, Homo sapiens
  misc_feature 1..30: note = chr7:1023349-1023379
  misc_feature 1..30: note = hypo
  source 1..30: mol_type = genomic DNA
agggcctgggcctgtcggctgcctgctcag

SEQ ID NO: 41050 - DNA, 54 bp, Homo sapiens
  misc_feature 1..54: note = chr7:1026923-1026977
  misc_feature 1..54: note = hypo
  source 1..54: mol_type = genomic DNA
ggggacccccagggacgagggatggcgctgccacccaagcggcccaccctttgc

SEQ ID NO: 41051 - DNA, 190 bp, Homo sapiens
  misc_feature 1..190: note = chr7:1027200-1027390
  misc_feature 1..190: note = hypo
  source 1..190: mol_type = genomic DNA
ctctggggtaggcctcggcgggggtccaggggcactgggacggctgagcgtctggtgggtgcctgatggcccagcgctccccgaccggaggcaataaagggcgtccagccaggagcaggagggaggcagccctctcaccccacagcccagcacttggcctggccagcagacctggcgcctccctgcatgt

SEQ ID NO: 41052 - DNA, 214 bp, Homo sapiens
  misc_feature 1..214: note = chr7:1030005-1030219
  misc_feature 1..214: note = hypo
  source 1..214: mol_type = genomic DNA
tggcgcgtgtgctgggggcggtgtgatgggacacctgctgtctgagacggccctggcccccgtcccagcgctgaccatgcacgtgagcggcaggcggcccctcaccgagaagagaggataagccgtggcacattcccacctgcgccacgtgaagcggcgccccaaggccaggacgtggtggccgggacacacgggtgcacggcaggcctcacac

SEQ ID NO: 41053 - DNA, 72 bp, Homo sapiens
  misc_feature 1..72: note = chr7:1037234-1037306
  misc_feature 1..72: note = hypo
  source 1..72: mol_type = genomic DNA
agcggccccgccccgcgctgaacccactaggagagcagctgcagcacctgtcggatgcgctgggccctcccc

SEQ ID NO: 41054 - DNA, 252 bp, Homo sapiens
  misc_feature 1..252: note = chr7:1054444-1054696
  misc_feature 1..252: note = hypo
  source 1..252: mol_type = genomic DNA
gccacggcagcgttccggttggtgtcaccctgtcccggcctgagcccagctctcagatccgagcaccaattctgtctacagccccttcctgcctgcgggccctccctgccctgcagggacggtgcagtgagcacaggtgtgcaggctgtgcggtgagagccccagggctgggaggagcaggcagccttggtccagcaggtcctgtgtgggggccgcgttgccgggcagggcctgacacggctgctgtgggct

SEQ ID NO: 41055 - DNA, 350 bp, Homo sapiens
  misc_feature 1..350: note = chr7:1066042-1066392
  misc_feature 1..350: note = hypo
  source 1..350: mol_type = genomic DNA
gctccctgccaggcccgtgtccttcctagctgtgagaacactaacctgcctgggcttcacctgtggaagccaccgctaactagcagtcggaggcggcgttgtttctaagacaggcaggcagctccggcaggagcagccgctaagcacaaggacggccaaccacacaaagcctgcttctcaaccactcgcaggaaatcggctcacagttgctccccattcttcaatgctgatcctgccactttactgaaaatcacattattaacgtttaaaaaacgtatgggaaccatgcaaagacatccacgcccctcagttgctgccgctccagcacctggctccgaagtctgtgcaga

SEQ ID NO: 41056 - DNA, 53 bp, Homo sapiens; identical to SEQ ID NO: 14929
  misc_feature 1..53: note = chr7:1086266-1086319
  misc_feature 1..53: note = hypo
  source 1..53: mol_type = genomic DNA

SEQ ID NO: 41057 - DNA, 30 bp, Homo sapiens
  misc_feature 1..30: note = chr7:1115722-1115752
  misc_feature 1..30: note = hypo
  source 1..30: mol_type = genomic DNA
cccatccatgcccagcgccttgtcaaaaac

SEQ ID NO: 41058 - DNA, 37 bp, Homo sapiens
  misc_feature 1..37: note = chr7:1303471-1303508
  misc_feature 1..37: note = hypo
  source 1..37: mol_type = genomic DNA
ttcactccagaatggcgctgcccgtgcctgtacagac

SEQ ID NO: 41059 - DNA, 184 bp, Homo sapiens
  misc_feature 1..184: note = chr7:1308351-1308535
  misc_feature 1..184: note = hypo
  source 1..184: mol_type = genomic DNA
ccaccctggcccttccggctgccggctggggacgcgggcgtggtgcggcaggcctgccttgattgtgtcgatgggagatgattttcaaggtgaaatttctagttcactagagtcactttcgttcaaggcgacgcacaaaatgtcatcccggcctgttccgcgtgcaacgcgctgttctcccatc

SEQ ID NO: 41060 - DNA, 30 bp, Homo sapiens
  misc_feature 1..30: note = chr7:1313980-1314010
  misc_feature 1..30: note = hypo
  source 1..30: mol_type = genomic DNA
ggggtatgtgagccccgctggaggacagct

SEQ ID NO: 41061 - DNA, 68 bp, Homo sapiens
  misc_feature 1..68: note = chr7:1315892-1315960
  misc_feature 1..68: note = hypo
  source 1..68: mol_type = genomic DNA
ccctggcatgatcatcgcaccggcctgcggggtcagcagccccactggctcgccggggcctgggcctg

SEQ ID NO: 41062 - DNA, 30 bp, Homo sapiens
  misc_feature 1..30: note = chr7:1318952-1318982
  misc_feature 1..30: note = hypo
  source 1..30: mol_type = genomic DNA
gcaactctatctctacgaaaaatacaaaga

SEQ ID NO: 41063 - DNA, 298 bp, Homo sapiens
  misc_feature 1..298: note = chr7:1325643-1325941
  misc_feature 1..298: note = hypo
  source 1..298: mol_type = genomic DNA
tcgcctggggacacacgtggtgcgtgtggcttttcagctgctcaacactcacttctgaggcccccgcggcgtggcacggcctgggcgttggatgcagcagtgaacgggacccacgcggggactcagggtatgacgggcagaggggtaggtggggtgggggcaggtgaggcgggggtgcccagcggtcagggaggggctctcgggaggtgacattcggccgagaccgagtgacggtgtggaacccgggcgcactgggaggcacgatccaggcggagggagcagccgtgccagggccctg

SEQ ID NO: 41064 - DNA, 33 bp, Homo sapiens
  misc_feature 1..33: note = chr7:1331244-1331277
  misc_feature 1..33: note = hypo
  source 1..33: mol_type = genomic DNA
cctccagagcgggaacgccgagctccttctgag

SEQ ID NO: 41065 - DNA, 82 bp, Homo sapiens
  misc_feature 1..82: note = chr7:1333580-1333662
  misc_feature 1..82: note = hypo
  source 1..82: mol_type = genomic DNA
gggaaggatgctcctcgccgtcataaacccgcgtgcaccgcgtcactccccgggcgccgagttccgccggcctggcacgggc

SEQ ID NO: 41066 - DNA, 83 bp, Homo sapiens
  misc_feature 1..83: note = chr7:1351523-1351606
  misc_feature 1..83: note = hypo
  source 1..83: mol_type = genomic DNA
ggcctgctgttgtggcgtctggccgcggcccagcaccgccgtcatctgggctcagctctctctgtccgcggggctgtctccct

SEQ ID NO: 41067 - DNA, 34 bp, Homo sapiens
  misc_feature 1..34: note = chr7:1363593-1363627
  misc_feature 1..34: note = hypo
  source 1..34: mol_type = genomic DNA
gggcggcaggtaccccgtccggtagcgcgaagcc

SEQ ID NO: 41068 - DNA, 144 bp, Homo sapiens
  misc_feature 1..144: note = chr7:1365367-1365511
  misc_feature 1..144: note = hypo
  source 1..144: mol_type = genomic DNA
tggtgtggcccagggcgtgggtaccagggccccccatgcaggtcagtgtgaggccagctgcgatgcgcgatgcactgccctccgccccatccaggtgccccaagggtacggccggcatttaagggccctcgcttcctgggggtg

SEQ ID NO: 41069 - DNA, 81 bp, Homo sapiens
  misc_feature 1..81: note = chr7:1368971-1369052
  misc_feature 1..81: note = hypo
  source 1..81: mol_type = genomic DNA
tagaccaggcccacccggctaaccagggtcatttcctggacctaaagtcgccggaccgtaggtgtccgccgtatctacagg

SEQ ID NO: 41070 - DNA, 61 bp, Homo sapiens
  misc_feature 1..61: note = chr7:1384815-1384876
  misc_feature 1..61: note = hypo
  source 1..61: mol_type = genomic DNA
ttctggataggggcacggtggatgggcaggctgcgccgggctgatccgctgtgaacagcgg

SEQ ID NO: 41071 - DNA, 185 bp, Homo sapiens
  misc_feature 1..185: note = chr7:1395730-1395915
  misc_feature 1..185: note = hypo
  source 1..185: mol_type = genomic DNA
ctccttgctgcctcccgccttgtcctcaacagccctgaagtccgtcctccactcagcttctcaggtggttctcaaaggttaacacaaccatgtccctcctgctccaaaccctccatggctcctgagtgcccctggaatagagcccaggctcctccgggatctgcaggtgccgcctgcctctgcca

SEQ ID NO: 41072 - DNA, 200 bp, Homo sapiens
  misc_feature 1..200: note = chr7:1416020-1416220
  misc_feature 1..200: note = hypo
  source 1..200: mol_type = genomic DNA
gtggtgggttcgggacgttcaccgcagtgttgtttgtaacagccaaaggctggaaatcagctggcagcccatcagaggacttgggtaagtaaatggcggccatccaccagcagggcatcgtgcaggcactaaactcaatgctacaggagaattcctcgtggcacaggaaaggtctcatcgtataccgttgcgggaaaagg

SEQ ID NO: 41073 - DNA, 30 bp, Homo sapiens
  misc_feature 1..30: note = chr7:1423606-1423636
  misc_feature 1..30: note = hypo
  source 1..30: mol_type = genomic DNA
ttgctgccttccccccgcccagtccctgct

SEQ ID NO: 41074 - DNA, 79 bp, Homo sapiens
  misc_feature 1..79: note = chr7:1451244-1451323
  misc_feature 1..79: note = hypo
  source 1..79: mol_type = genomic DNA
tcttttctgctggggcgcccggcgggccctgcctgtggttcgccctgtgtgcgggcggtgtgggcgtctttgccgcagg

SEQ ID NO: 41075 - DNA, 30 bp, Homo sapiens
  misc_feature 1..30: note = chr7:1453817-1453847
  misc_feature 1..30: note = hypo
  source 1..30: mol_type = genomic DNA
gtggggaggccttgccgggggccctggggc

SEQ ID NO: 41076 - DNA, 121 bp, Homo sapiens
  misc_feature 1..121: note = chr7:1458959-1459080
  misc_feature 1..121: note = hypo
  source 1..121: mol_type = genomic DNA
cagctcccataaccccgtctcctcctcctcctcgccctcctcctcctcgctgtctctgcaccacttccacctgcccgggcctttgcacctgcaggttcgtaccctacggggtgtgccctgc

SEQ ID NO: 41077 - DNA, 63 bp, Homo sapiens
  misc_feature 1..63: note = chr7:1460807-1460870
  misc_feature 1..63: note = hypo
  source 1..63: mol_type = genomic DNA
ggactgtgcagaaggcggctctgtgcctcggaaggcagggtgcagaggcgtgcagcgctcacc

SEQ ID NO: 41078 - DNA, 30 bp, Homo sapiens
  misc_feature 1..30: note = chr7:1503320-1503350
  misc_feature 1..30: note = hypo
  source 1..30: mol_type = genomic DNA
catggcctgaggcatcgctcatttcagtcc

SEQ ID NO: 41079 - DNA, 201 bp, Homo sapiens
  misc_feature 1..201: note = chr7:1503566-1503767
  misc_feature 1..201: note = hypo
  source 1..201: mol_type = genomic DNA
cgggaatgcagagggcgtgagagagaaccaagggaggtgtcctggccgagtggtgtttcccgcgggacttctcagagccttcatcacctgatacgcacctccactcttccagggagaggacacactgcacagtggttcccaaactgacttgcccacaggacccctgtggacggttgtggggcaccacgtcagcccccctgc

SEQ ID NO: 41080 - DNA, 63 bp, Homo sapiens
  misc_feature 1..63: note = chr7:1516637-1516700
  misc_feature 1..63: note = hypo
  source 1..63: mol_type = genomic DNA
agccactcagagagccgaggcttggggtgctgccggtaacaccggccccgtcatggtgctgga

SEQ ID NO: 41081 - DNA, 42 bp, Homo sapiens
  misc_feature 1..42: note = chr7:1532979-1533021
  misc_feature 1..42: note = hypo
  source 1..42: mol_type = genomic DNA
gtagggaggtgaggacgggggtgtggccggcagggtggggac

SEQ ID NO: 41082 - DNA, 197 bp, Homo sapiens
  misc_feature 1..197: note = chr7:1547262-1547459
  misc_feature 1..197: note = hypo
  source 1..197: mol_type = genomic DNA
gggcaggaccacaggcgttccgtcatcctgggggggtgtgcagggtctgccctgtgctcttcatcggcgtctccctgatgagtaatgatgagcgttttctcatctttttttgtcatccgtgtatctgcattattggtgtctgttcaaattgtttgctcactttttgaaaatattttttatggccaggcgcgatggct

SEQ ID NO: 41083 - DNA, 58 bp, Homo sapiens
  misc_feature 1..58: note = chr7:1598639-1598697
  misc_feature 1..58: note = hypo
  source 1..58: mol_type = genomic DNA
agtcgggaggttgaccgctctgccacctgctcacagggctcgccggctgatcgaggcc

SEQ ID NO: 41084 - DNA, 30 bp, Homo sapiens; identical to SEQ ID NO: 14938
  misc_feature 1..30: note = chr7:1598982-1599012
  misc_feature 1..30: note = hypo
  source 1..30: mol_type = genomic DNA

SEQ ID NO: 41085 - DNA, 159 bp, Homo sapiens
  misc_feature 1..159: note = chr7:1600538-1600697
  misc_feature 1..159: note = hypo
  source 1..159: mol_type = genomic DNA
tgggtacagctggcacggaccacaccctccaccttcccccctgcccggattttgggacccacatctgtccacgtgccacccctgcctcctgccatcccagcgggtgtgagcctggaccaatctccctgtccggtggatttcagacgtgggaccacaagt

SEQ ID NO: 41086 - DNA, 30 bp, Homo sapiens
  misc_feature 1..30: note = chr7:1607585-1607615
  misc_feature 1..30: note = hypo
  source 1..30: mol_type = genomic DNA
cacaccaccattaaccgccacataagtcca

SEQ ID NO: 41087 - DNA, 30 bp, Homo sapiens; identical to SEQ ID NO: 14939
  misc_feature 1..30: note = chr7:1607971-1608001
  misc_feature 1..30: note = hypo
  source 1..30: mol_type = genomic DNA

SEQ ID NO: 41088 - DNA, 73 bp, Homo sapiens
  misc_feature 1..73: note = chr7:1624815-1624888
  misc_feature 1..73: note = hypo
  source 1..73: mol_type = genomic DNA
gggtgccaccaggcacgacttcctaaacacccacagagcaaaaacctggaaattcagccgaggcactgggacc

SEQ ID NO: 41089 - DNA, 249 bp, Homo sapiens
  misc_feature 1..249: note = chr7:1641708-1641957
  misc_feature 1..249: note = hypo
  source 1..249: mol_type = genomic DNA
ctcgggatgcacctccgcactgtggggccatctgggtcagcccggacgcaccggcctctgtctgggtcccagtcttctcaccgccaggcgggcaggtcagcagaccaggcaggaccgagcccgtcgcccggggctcttgttgtctgtgccatttcggtgccttttgtccttgcttcccgccgctccttgaggatgtttaccggctgctggggccgtgccttccaggtgaggcctcggtcattccaggtg

SEQ ID NO: 41090 - DNA, 30 bp, Homo sapiens
  misc_feature 1..30: note = chr7:1680203-1680233
  misc_feature 1..30: note = hypo
  source 1..30: mol_type = genomic DNA
tggcagcagagccagcgcgctgcagccctc

SEQ ID NO: 41091 - DNA, 30 bp, Homo sapiens
  misc_feature 1..30: note = chr7:1681209-1681239
  misc_feature 1..30: note = hypo
  source 1..30: mol_type = genomic DNA
cccagctctttccatcgcattgccatggtt

SEQ ID NO: 41092 - DNA, 100 bp, Homo sapiens
  misc_feature 1..100: note = chr7:1684968-1685068
  misc_feature 1..100: note = hypo
  source 1..100: mol_type = genomic DNA
caggctgatgggctccgggaacagcacgttctctctgattcttctttccaatgctccattgtgtggggacaaagccgagaagctccggttccccaggggt

SEQ ID NO: 41093 - DNA, 158 bp, Homo sapiens
  misc_feature 1..158: note = chr7:1688950-1689108
  misc_feature 1..158: note = hypo
  source 1..158: mol_type = genomic DNA
cctccctggatctcacgtcctcatttggcaaacagggatagtcgtgatccctcccttagggccggtgcttggaaagaatgaacgaacatgggtaaggtgtgcctggtgagcgctgtctgggctgaaggaggagtttgagaaggcggctttatgaaggg

SEQ ID NO: 41094 - DNA, 65 bp, Homo sapiens
  misc_feature 1..65: note = chr7:1694007-1694072
  misc_feature 1..65: note = hypo
  source 1..65: mol_type = genomic DNA
gctgtttgctgagggcgtgctttgaggaagagcatacccgggttccaaagcgcctacagtgaaca

SEQ ID NO: 41095 - DNA, 34 bp, Homo sapiens
  misc_feature 1..34: note = chr7:1694952-1694986
  misc_feature 1..34: note = hypo
  source 1..34: mol_type = genomic DNA
ccggggctacacacccgcacggcaggtgactgca

SEQ ID NO: 41096 - DNA, 50 bp, Homo sapiens
  misc_feature 1..50: note = chr7:1714947-1714997
  misc_feature 1..50: note = hypo
  source 1..50: mol_type = genomic DNA
tggcggccgagggctcgggggcgggggtctgtccacgtgacaggtgcaca

SEQ ID NO: 41097 - DNA, 57 bp, Homo sapiens
  misc_feature 1..57: note = chr7:1718027-1718084
  misc_feature 1..57: note = hypo
  source 1..57: mol_type = genomic DNA
gttgtgggtaaggcccgcgccactgggaatcttcacacagcccggagggaggtgctg

SEQ ID NO: 41098 - DNA, 206 bp, Homo sapiens
  misc_feature 1..206: note = chr7:1731744-1731950
  misc_feature 1..206: note = hypo
  source 1..206: mol_type = genomic DNA
gctatttcctgccttcgtgaccttcgacgagacactttttgctgctgggcctcagtttctccactttcactgtggtctgtgtgccaagtagcactcctatttttagaagcagaagctggttataaactgcacagatctgtctggcctgccctgccaaggccggattgccagagggttctgtgagtaccgatcgtggctgcagggac

SEQ ID NO: 41099 - DNA, 271 bp, Homo sapiens
  misc_feature 1..271: note = chr7:1733166-1733437
  misc_feature 1..271: note = hypo
  source 1..271: mol_type = genomic DNA
gcaagaacacatacacgcctgtggacgtagccttgctgggtgtgtgcacatctgcagaggggtcggtgtacaccgctgtgtgaacacctccggcggtgcccagtccgtgtgaacacatgcaggtgagcacagacacatgcgtgcatgccctctgtgtgtctacagacagctgtgtgcgccacactcaccctcccgctcgtccccatggcaaccccagagcaggtgtctgggagaccctgatcagtgctgacagacacggggtgcgggacac

SEQ ID NO: 41100 - DNA, 286 bp, Homo sapiens
  misc_feature 1..286: note = chr7:1734709-1734995
  misc_feature 1..286: note = hypo
  source 1..286: mol_type = genomic DNA
acggctccggatgcacgtggctgtgccaggcagcagacgtggccgacaggcacatggtgggacctgctctgtggctccagagctcatgcgcagcccgctggggctgtgagggttctgtccatccaccaggaaggccaccaggaccctgctcctgcctgagaaccccaggaagtagtagcgtgccaggtgcgtggccggcctcccagcccttcccagcaccagctgcgtcctcctcctccagggctgcagctcagggctcaggtgtccgcgtcgagggcactcccta

SEQ ID NO: 41101 - DNA, 210 bp, Homo sapiens
  misc_feature 1..210: note = chr7:1775651-1775861
  misc_feature 1..210: note = hypo
  source 1..210: mol_type = genomic DNA
cagcaggtgcacaggcgggccccccacctgctcctagctgggccgggtcaccgtggcaggccttgcggctcgaggcccaactgccctgatatgcctatcacagcctcatgggctctgcggcagagcccagggagacagacagggcgagagccaagctgcagaggcaggcagacgttagcagtaaacatgatctatcggcaaaacattgga

SEQ ID NO: 41102 - DNA, 30 bp, Homo sapiens
  misc_feature 1..30: note = chr7:1779654-1779684
  misc_feature 1..30: note = hypo
  source 1..30: mol_type = genomic DNA
gagccacaggggacccgtggccaccctgtt

SEQ ID NO: 41103 - DNA, 90 bp, Homo sapiens
  misc_feature 1..90: note = chr7:1783212-1783302
  misc_feature 1..90: note = hypo
  source 1..90: mol_type = genomic DNA
gccagggacacagggcgggcgagctcagaccgagacctggcagacacgagtccccggacaggccagaatacctcccggtgcctccctccc

SEQ ID NO: 41104 - DNA, 69 bp, Homo sapiens
  misc_feature 1..69: note = chr7:1784330-1784399
  misc_feature 1..69: note = hypo
  source 1..69: mol_type = genomic DNA
gggcgacaagggcttcgtgtggctggccatctgcagccagaaccaacccccctacgaggccatcccaca

SEQ ID NO: 41105 - DNA, 186 bp, Homo sapiens
  misc_feature 1..186: note = chr7:1784690-1784876
  misc_feature 1..186: note = hypo
  source 1..186: mol_type = genomic DNA
ggagtgtcccaacatcgtcaacatcgacctgtccatgaaccgcatccagcagctcaacagcggcaccttcgccggcctggccaagctgtcggtgtgcgagctctacagcaaccccttctactgctcctgcgagctgctgggcttcctgcgctggctggccgccttcaccaacgccacacagacgta

SEQ ID NO: 41106 - DNA, 489 bp, Homo sapiens
  misc_feature 1..489: note = chr7:1786410-1786899
  misc_feature 1..489: note = hypo
  source 1..489: mol_type = genomic DNA
cacgagggcctggggcgcaaggcgtccatcctggagccactcacccggccgcggccccgcgacctcgcctactcgcagctgtccccgcagtaccacagcctgagctactcctccagccccgagtacacctgccgggcctcccagagcatctgggagcgcttcagactgagccgccggcggcacaaggaggaagaggagttcatggccgcgggccatgccctgcgcaagaaggttcagttcgccaaagacgaggatctgcacgacatcctggactactggaagggcgtgtcggcccagcacaagtcctgagccccccaagaccggcgatgcccactggaccaaaaaggatgcaggatccacccagagactcagcaccaaacccaacacacgcacgccaccacagcaactgtgacagcggggggccctgcagaggcgaggggggagcgagtggggacagacaagggggacacgtcccgagctcctgtggcc

SEQ ID NO: 41107 - DNA, 267 bp, Homo sapiens
  misc_feature 1..267: note = chr7:1787152-1787419
  misc_feature 1..267: note = hypo
  source 1..267: mol_type = genomic DNA
cgtggggggtgtggccggcgtggccacctcggggcccctcacgtgatctcctcggtccgtggttttctgtggattctctgtccagtccgtctcttcattgccgcctccggagtccactgcagaggggcagagtgaatgccggcggccaagtggcctccgggacaggtcctggagccctgctggactcagggtgggtggaggctgtgcctgtggacggccggggtggccaggacggccaagggctgggaggcacgtcccccagcccag

SEQ ID NO: 41108 - DNA, 30 bp, Homo sapiens
  misc_feature 1..30: note = chr7:1795180-1795210
  misc_feature 1..30: note = hypo
  source 1..30: mol_type = genomic DNA
taagtccaaagtgttcgtgattcttccttt

SEQ ID NO: 41109 - DNA, 30 bp, Homo sapiens
  misc_feature 1..30: note = chr7:1800882-1800912
  misc_feature 1..30: note = hypo
  source 1..30: mol_type = genomic DNA
ccagagactaaacgccggcagcggtgaaga

SEQ ID NO: 41110 - DNA, 30 bp, Homo sapiens
  misc_feature 1..30: note = chr7:1838908-1838938
  misc_feature 1..30: note = hypo
  source 1..30: mol_type = genomic DNA
gaggacatggaggaccggcattcccaaaca

SEQ ID NO: 41111 - DNA, 42 bp, Homo sapiens
  misc_feature 1..42: note = chr7:1849747-1849789
  misc_feature 1..42: note = hypo
  source 1..42: mol_type = genomic DNA
gccaggactgtcaggcgccagctccctcggtgaacgtgacaa

SEQ ID NO: 41112 - DNA, 53 bp, Homo sapiens
  misc_feature 1..53: note = chr7:1931869-1931922
  misc_feature 1..53: note = hypo
  source 1..53: mol_type = genomic DNA
tgcggcccaagggtgcgggaggctgcacggcccaggctcgtacaagtcattct

SEQ ID NO: 41113 - DNA, 138 bp, Homo sapiens
  misc_feature 1..138: note = chr7:1962373-1962511
  misc_feature 1..138: note = hypo
  source 1..138: mol_type = genomic DNA
ctgcggtgagctgcacggtttctgcagatgctctttggcaaacttgggggttctcggcttctcctggtttgccgagtttccccatgaacgtgtgttgggcctcgctgactgcatttgtgcatccgttggtttggccat

SEQ ID NO: 41114 - DNA, 30 bp, Homo sapiens
  misc_feature 1..30: note = chr7:2024812-2024842
  misc_feature 1..30: note = hypo
  source 1..30: mol_type = genomic DNA
ctcagcagacggccccgggcagcatgggta

SEQ ID NO: 41115 - DNA, 113 bp, Homo sapiens
  misc_feature 1..113: note = chr7:2056573-2056686
  misc_feature 1..113: note = hypo
  source 1..113: mol_type = genomic DNA
gacgccgcgcaaggccggggcgggggacttcccttggtaaacaagctgtaattgtctcttttattgatcagtaaatctctgagagcttctcttcgtgacggctctcttcagcc

SEQ ID NO: 41116 - DNA, 104 bp, Homo sapiens
  misc_feature 1..104: note = chr7:2110154-2110258
  misc_feature 1..104: note = hypo
  source 1..104: mol_type = genomic DNA
gaagagaggccacaccggggagggtgcgagtccgcggagggagggcccatccctactcagacagcccaggcaggcgcagagcggaacggcgctggaacacggga

SEQ ID NO: 41117 - DNA, 65 bp, Homo sapiens
  misc_feature 1..65: note = chr7:2163332-2163397
  misc_feature 1..65: note = hypo
  source 1..65: mol_type = genomic DNA
tttcagagtgcacttcgcaggcggcgctgaatcgatagatcctccggcggcgtggtgctgcaggt

SEQ ID NO: 41118 - DNA, 135 bp, Homo sapiens
  misc_feature 1..135: note = chr7:2206533-2206668
  misc_feature 1..135: note = hypo
  source 1..135: mol_type = genomic DNA
ctgggcggcgcactccgctcacaaagcactcttccaggaagggccccgggctgctggagactgaaccggaatctgcctaactggtggaatccccttttacaaagaagtgcctgtagctcacggggctagaaccca

SEQ ID NO: 41119 - DNA, 30 bp, Homo sapiens
  misc_feature 1..30: note = chr7:2208778-2208808
  misc_feature 1..30: note = hypo
  source 1..30: mol_type = genomic DNA
ggcagaaaggacattcgggacctatgacgc

SEQ ID NO: 41120 - DNA, 132 bp, Homo sapiens
  misc_feature 1..132: note = chr7:2232918-2233050
  misc_feature 1..132: note = hypo
  source 1..132: mol_type = genomic DNA
agggccacccagctccgacagccaccacgtcctggagagaaagcgtccccgcccagaggacggtccttgtcctagaacagcaaggccctccaactcttggtcctcaaagcccttccccgcctccgcacccag

SEQ ID NO: 41121 - DNA, 96 bp, Homo sapiens
  misc_feature 1..96: note = chr7:2233318-2233414
  misc_feature 1..96: note = hypo
  source 1..96: mol_type = genomic DNA
aactccagattcctccggaaaacctcactgtgcactgccaaggctccagccagagcaggtgctgagccgcgatccgggagacgccagtctcaccct

SEQ ID NO: 41122 - DNA, 154 bp, Homo sapiens
  misc_feature 1..154: note = chr7:2238153-2238307
  misc_feature 1..154: note = hypo
  source 1..154: mol_type = genomic DNA
ggagcccgtgatggccgtccacccgggacagcaatcgcgctctgcggcacgaggctttcaacagaggcgagtgcttcctgggggtcaagagcatggaacacacacttcaggccccctctccaggctgcaggccaacaggcgtccatgagacaga

SEQ ID NO: 41123 - DNA, 85 bp, Homo sapiens
  misc_feature 1..85: note = chr7:2265530-2265615
  misc_feature 1..85: note = hypo
  source 1..85: mol_type = genomic DNA
aaaaatcaatgcagtcggccaggacatgttctcacgtggagctcagagatggagaatgaggtctccttcccgactggctgccagc

SEQ ID NO: 41124 - DNA, 16 bp, Homo sapiens
  misc_feature 1..16: note = chr7:2300787-2300803
  misc_feature 1..16: note = hypo
  source 1..16: mol_type = genomic DNA
ctgggcacagaggctc

SEQ ID NO: 41125 - DNA, 30 bp, Homo sapiens
  misc_feature 1..30: note = chr7:2349402-2349432
  misc_feature 1..30: note = hypo
  source 1..30: mol_type = genomic DNA
atgaattctgaccaacgtattcacacagag

SEQ ID NO: 41126 - DNA, 83 bp, Homo sapiens
  misc_feature 1..83: note = chr7:2420313-2420396
  misc_feature 1..83: note = hypo
  source 1..83: mol_type = genomic DNA
cgtgcaggttgtggccggttttctccgcaggttgaacatggaaataaaagcaaacttgtatgaaaaaccggtctttctcctct

SEQ ID NO: 41127 - DNA, 30 bp, Homo sapiens
  misc_feature 1..30: note = chr7:2480354-2480384
  misc_feature 1..30: note = hypo
  source 1..30: mol_type = genomic DNA
caagaagaatgccgccgctcaggtttatct

SEQ ID NO: 41128 - DNA, 30 bp, Homo sapiens
  misc_feature 1..30: note = chr7:2499688-2499718
  misc_feature 1..30: note = hypo
  source 1..30: mol_type = genomic DNA
ccgtgcctcggacaccggcctctgcagctt

SEQ ID NO: 41129 - DNA, 38 bp, Homo sapiens
  misc_feature 1..38: note = chr7:2544589-2544627
  misc_feature 1..38: note = hypo
  source 1..38: mol_type = genomic DNA
aagaggcggaggaaccggctgtgcgggacacctgagcc

SEQ ID NO: 41130 - DNA, 194 bp, Homo sapiens
  misc_feature 1..194: note = chr7:2564711-2564905
  misc_feature 1..194: note = hypo
  source 1..194: mol_type = genomic DNA
gggtgggggaggctacggccgccgggcccagcttgaactagggggcttttctcgagcccctgggccctgtggcgtcccccaggccaggcccctctctgggagccggctcagacctactcacagccgctcccctgtccacaggcaacgtggtcatcacaaactgctcggccgcccacagccgccaggcgctgtcc

SEQ ID NO: 41131 - DNA, 186 bp, Homo sapiens
  misc_feature 1..186: note = chr7:2566041-2566227
  misc_feature 1..186: note = hypo
  source 1..186: mol_type = genomic DNA
aggtgcaccatcctccgggccccgccaggactccgagagcacaggaagggacgtgtggctgccgagaggggcgcagtggggtggggcactgttctaaacagggaggccaggcagcactccactgtcagccagggggggtcactcctgccatgagctcaaagctgtttatggcgggttgttttcctg

SEQ ID NO: 41132 - DNA, 171 bp, Homo sapiens
  misc_feature 1..171: note = chr7:2566487-2566658
  misc_feature 1..171: note = hypo
  source 1..171: mol_type = genomic DNA
atgtttgaaaacaagcggaacgccgtccacgtgaaggggcccttctcggtggaggccgacccatccaggtaaggaaaccccggcccagatgggcttgcgtagggtggcctaggggcgtcagggggcctcgtggagctgcagcagggtctctctaagcggcatgactctaca

SEQ ID NO: 41133 - DNA, 372 bp, Homo sapiens
  misc_feature 1..372: note = chr7:2686448-2686820
  misc_feature 1..372: note = hypo
  source 1..372: mol_type = genomic DNA
ggtccacccctccagcgccgcttcctgcctgccctcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcaggtgagcgcggtggggcggggacggagggcggggccagagggggcggcccgagggggcggggctggagtggggtgtgtgtgggtgggcggggctacatctcacgggcccgccctctccagcgccggcatcgcagtgggattctacggcaacggggagaccagtga

SEQ ID NO: 41134 - DNA, 54 bp, Homo sapiens
  misc_feature 1..54: note = chr7:2700087-2700141
  misc_feature 1..54: note = hypo
  source 1..54: mol_type = genomic DNA
acgtgccggcgagcacgtgagcttctcccgctggccccacggtggtgcgggtgc

SEQ ID NO: 41135 - DNA, 182 bp, Homo sapiens
  misc_feature 1..182: note = chr7:2718487-2718669
  misc_feature 1..182: note = hypo
  source 1..182: mol_type = genomic DNA
tttagcctcaggattcgactccgagcctcttgcgagaccacgtcttgggcagcatcgtagacccggctgtgagcacagagtggctcttccagaaagtttgttgaatgactgactaagtcagcccctgtgccaggcagcccagagggaccagcccagagcctccttctcggggtgcaagcctg

SEQ ID NO: 41136 - DNA, 30 bp, Homo sapiens
  misc_feature 1..30: note = chr7:2720013-2720043
  misc_feature 1..30: note = hypo
  source 1..30: mol_type = genomic DNA
aggcactggagaccccgggagaccccggat

SEQ ID NO: 41137 - DNA, 28 bp, Homo sapiens
  misc_feature 1..28: note = chr7:2731870-2731898
  misc_feature 1..28: note = hypo
  source 1..28: mol_type = genomic DNA
gggttgaaagaggaccgagcttggccgg

SEQ ID NO: 41138 - DNA, 30 bp, Homo sapiens
  misc_feature 1..30: note = chr7:2747171-2747201
  misc_feature 1..30: note = hypo
  source 1..30: mol_type = genomic DNA
tccacactcatgctccggggaaccatgcta

SEQ ID NO: 41139 - DNA, 35 bp, Homo sapiens; identical to SEQ ID NO: 14955
  misc_feature 1..35: note = chr7:2798456-2798491
  misc_feature 1..35: note = hypo
  source 1..35: mol_type = genomic DNA

SEQ ID NO: 41140 - DNA, 30 bp, Homo sapiens
  misc_feature 1..30: note = chr7:2916072-2916102
  misc_feature 1..30: note = hypo
  source 1..30: mol_type = genomic DNA
ggcttcccagcggggcgctgcctgaggccc

SEQ ID NO: 41141 - DNA, 180 bp, Homo sapiens
  misc_feature 1..180: note = chr7:2923749-2923929
  misc_feature 1..180: note = hypo
  source 1..180: mol_type = genomic DNA
acacagcaagggagtcgggaagttggaaggaggaggatgtggaagacgcagtttgctcctgggtcctcagaaaggaggctgggtgtcaaattctacccttaggaattttagtgagcaggcggtgcctttgtgcatagaaaaagatgccccatcctctgggtggcccggcccagcaccagg

SEQ ID NO: 41142 - DNA, 30 bp, Homo sapiens
  misc_feature 1..30: note = chr7:2958507-2958537
  misc_feature 1..30: note = hypo
  source 1..30: mol_type = genomic DNA
gatgatgcttgccttcgaggactggcctga

SEQ ID NO: 41143 - DNA, 73 bp, Homo sapiens
  misc_feature 1..73: note = chr7:2966469-2966542
  misc_feature 1..73: note = hypo
  source 1..73: mol_type = genomic DNA
gtgtgtgtgtgcacacgcaggcaagggagagagaagcttctggaaggttccaggcttccgagtggccttgctt

SEQ ID NO: 41144 - DNA, 30 bp, Homo sapiens
  misc_feature 1..30: note = chr7:2976839-2976869
  misc_feature 1..30: note = hypo
  source 1..30: mol_type = genomic DNA
gtctgagcttcatctcgggagtggaaggcc

SEQ ID NO: 41145 - DNA, 46 bp, Homo sapiens
  misc_feature 1..46: note = chr7:3026293-3026339
  misc_feature 1..46: note = hypo
  source 1..46: mol_type = genomic DNA
cctcactcaaagtgtcgcccatcggccgcagcgtcagcaggtgctt

SEQ ID NO: 41146 - DNA, 321 bp, Homo sapiens
  misc_feature 1..321: note = chr7:3033477-3033798
  misc_feature 1..321: note = hypo
  source 1..321: mol_type = genomic DNA
gtctcccttctagctcgccaaatgctcagggttcctatattttaaaaaatcttgtcccatcaaactctgctttcaggaatggcacgaagagccgacacgcacggtgagcagctgccttctgcagatggaacgcctcacctgggacgcctcacctgggacgcctcacctgggacgcaggcgttcctgttcctagtcacgccctgagccctggattcctgcccaagctcacatagcagggactggcccagccccattcactcatgcatgtctgaccccaaggcagggctggtggcctctaaatcctcccgctagggtttcagc

SEQ ID NO: 41147 - DNA, 396 bp, Homo sapiens
  misc_feature 1..396: note = chr7:3283498-3283894
  misc_feature 1..396: note = hypo
  source 1..396: mol_type = genomic DNA
aatggagaaacagcccagagaggaaaagcgatttgcacagagtcacgcagctgaagactggcagatccaggctgtttgctgtcagtctgagctctcgaattctaagacgagccacttctctcgggaagccaggaaggctcctcgcaaatcctggtggagaagtggttacctcaaagccctttaagcacagtcataaacttaccttgaagggccaggtaatccgatcatagagtcggcgttcaaaaaaaaaatgaggtattgatatgtttatcctcaccctcataacctgttctattcaaataaattcagtgtgctcagttctgcagggagtgacagagctgccccgaatcagatggtgccacgcacatcccatttctcttgcgggatcattcctgg

SEQ ID NO: 41148 - DNA, 38 bp, Homo sapiens
  misc_feature 1..38: note = chr7:3727142-3727180
  misc_feature 1..38: note = hypo
  source 1..38: mol_type = genomic DNA
atctgtaatgtgggacgctgcttcgcactgaaaaggtg

SEQ ID NO: 41149 - DNA, 34 bp, Homo sapiens
  misc_feature 1..34: note = chr7:4096353-4096387
  misc_feature 1..34: note = hypo
  source 1..34: mol_type = genomic DNA
acgctgcaccccacacgcccgagcccagagcagc

SEQ ID NO: 41150 - DNA, 30 bp, Homo sapiens
  misc_feature 1..30: note = chr7:4187836-4187866
  misc_feature 1..30: note = hypo
  source 1..30: mol_type = genomic DNA
gctgatgaagtgagacgggagccctcctcc

SEQ ID NO: 41151 - DNA, 93 bp, Homo sapiens
  misc_feature 1..93: note = chr7:4214921-4215014
  misc_feature 1..93: note = hypo
  source 1..93: mol_type = genomic DNA
ctccctgggctctgtcgcaaaatcaaaacagcacagtagaagggccccgggatgcggctgggcttacgcacctggtcgcgcagctctccctga

SEQ ID NO: 41152 - DNA, 30 bp, Homo sapiens
  misc_feature 1..30: note = chr7:4260867-4260897
  misc_feature 1..30: note = hypo
  source 1..30: mol_type = genomic DNA
caggatccccgggctcgcctagagatgtcc

SEQ ID NO: 41153 - DNA, 30 bp, Homo sapiens
  misc_feature 1..30: note = chr7:4275488-4275518
  misc_feature 1..30: note = hypo
  source 1..30: mol_type = genomic DNA
cagggtgtcctgccccgtatgagagtcctc

SEQ ID NO: 41154 - DNA, 86 bp, Homo sapiens
  misc_feature 1..86: note = chr7:4342691-4342777
  misc_feature 1..86: note = hypo
  source 1..86: mol_type = genomic DNA
ttccaacccactgtgtctctgctcttctgtgcaaacaatcccagcaccaggaaggagccagccctgccccccgctgcggccctctc

SEQ ID NO: 41155 - DNA, 73 bp, Homo sapiens
  misc_feature 1..73: note = chr7:4751426-4751499
  misc_feature 1..73: note = hypo
  source 1..73: mol_type = genomic DNA
accgtagagaagcaacgcaaggtcagagagaaaagattgcggccggccggtgtcaaggcgggggacctgtgag

SEQ ID NO: 41156 - DNA, 30 bp, Homo sapiens
  misc_feature 1..30: note = chr7:4771572-4771602
  misc_feature 1..30: note = hypo
  source 1..30: mol_type = genomic DNA
aggccacacggaggccgggctggccagggc

SEQ ID NO: 41157 - DNA, 90 bp, Homo sapiens
  misc_feature 1..90: note = chr7:4781955-4782045
  misc_feature 1..90: note = hypo
  source 1..90: mol_type = genomic DNA
ctccctgctgatctgcgcactctgctgaaccccggccgcaccttggcttgcttttttctttttttcctcttgcagctgtaggagaagaaa

SEQ ID NO: 41158 - DNA, 87 bp, Homo sapiens; identical to SEQ ID NO: 14961
  misc_feature 1..87: note = chr7:4813783-4813870
  misc_feature 1..87: note = hypo
  source 1..87: mol_type = genomic DNA

SEQ ID NO: 41159 - DNA, 114 bp, Homo sapiens
  misc_feature 1..114: note = chr7:4839337-4839451
  misc_feature 1..114: note = hypo
  source 1..114: mol_type = genomic DNA
cgctgcggggctgcccgggagcagggtctggatgtagagcccgggggcgcccaggtgcgtgtgctggggacaagcagaggcctcagagctccgcaggcccgactggctgtcccc

SEQ ID NO: 41160 - DNA, 175 bp, Homo sapiens
  misc_feature 1..175: note = chr7:4840176-4840351
  misc_feature 1..175: note = hypo
  source 1..175: mol_type = genomic DNA
cagtcccaggacactcgcccctctgggggcggctgttttccagctccagggacccacgcggttctgtgccacctcctcagcaatctctgctcctcctcctcctccctccacacccagatgtggccatgtgcaccctgagggttcccaccgctgaccagaccggggccccaggccc

SEQ ID NO: 41161 - DNA, 30 bp, Homo sapiens
  misc_feature 1..30: note = chr7:4840692-4840722
  misc_feature 1..30: note = hypo
  source 1..30: mol_type = genomic DNA
gcatgcccatgcacacgtgcacttacaccc

SEQ ID NO: 41162 - DNA, 104 bp, Homo sapiens
  misc_feature 1..104: note = chr7:4841057-4841161
  misc_feature 1..104: note = hypo
  source 1..104: mol_type = genomic DNA
agtatctgcccaagacgtgtcagcgactgagcgaccgtgtggcccagctgctgggggctgagcagccctgagccctctccatctggccccgtctcaggttgcag

SEQ ID NO: 41163 - DNA, 205 bp, Homo sapiens
  misc_feature 1..205: note = chr7:4856843-4857048
  misc_feature 1..205: note = hypo
  source 1..205: mol_type = genomic DNA
tgcagaagcagagcccgtccgtgcaccttggagacatagtagacgcactgctggaaggcgtacagcaccacctcctccagcaccgccatggcctcctcgctggccgtcagcgtgcaggagaacagcgattccttcgagcctgccgggagacagccacgccaatggtcacaacgggcacagcgctcaggaacgcagcaactcagcc

SEQ ID NO: 41164 - DNA, 144 bp, Homo sapiens
  misc_feature 1..144: note = chr7:4858153-4858297
  misc_feature 1..144: note = hypo
  source 1..144: mol_type = genomic DNA
cagctggagggaccccggggtccggggcagtaaggggctctcgggctctgccaacctcaacactgtgcccagaagcctccaggcctgtggagacacacaaggtggcccgacggcgcccacagcgagtgccggcaaaggatattc

SEQ ID NO: 41165 - DNA, 59 bp, Homo sapiens
  misc_feature 1..59: note = chr7:4875008-4875067
  misc_feature 1..59: note = hypo
  source 1..59: mol_type = genomic DNA
acaccagaaccccgacggctctcaggaacccgcccctcgatgtccgggcccatcccaga

SEQ ID NO: 41166 - DNA, 30 bp, Homo sapiens
  misc_feature 1..30: note = chr7:4876594-4876624
  misc_feature 1..30: note = hypo
  source 1..30: mol_type = genomic DNA
atagcgcccatgtcccgggtccttctgagt

SEQ ID NO: 41167 - DNA, 111 bp, Homo sapiens
  misc_feature 1..111: note = chr7:4918378-4918489
  misc_feature 1..111: note = hypo
  source 1..111: mol_type = genomic DNA
ctggaaagtgctgggcgcagcgcccgtgtgcagtgagcatcaaggagcgccccacccggagccggccccagcaccatcacagccacagaagagcagcgggcagcccaaggg

SEQ ID NO: 41168 - DNA, 39 bp, Homo sapiens
  misc_feature 1..39: note = chr7:4931853-4931892
  misc_feature 1..39: note = hypo
  source 1..39: mol_type = genomic DNA
tatttcaaaacatcacgccatagacgataaatacaaaca

SEQ ID NO: 41169 - DNA, 22 bp, Homo sapiens
  misc_feature 1..22: note = chr7:4985877-4985899
  misc_feature 1..22: note = hypo
  source 1..22: mol_type = genomic DNA
cccaccccgtgcacacaatccc

SEQ ID NO: 41170 - DNA, 30 bp, Homo sapiens; identical to SEQ ID NO: 14965
  misc_feature 1..30: note = chr7:5316401-5316431
  misc_feature 1..30: note = hypo
  source 1..30: mol_type = genomic DNA

SEQ ID NO: 41171 - DNA, 30 bp, Homo sapiens
  misc_feature 1..30: note = chr7:5342905-5342935
  misc_feature 1..30: note = hypo
  source 1..30: mol_type = genomic DNA
aggacagcagacacccgccagagtgtgcgc

SEQ ID NO: 41172 - DNA, 30 bp, Homo sapiens
  misc_feature 1..30: note = chr7:5343856-5343886
  misc_feature 1..30: note = hypo
  source 1..30: mol_type = genomic DNA
ttggtttgtgggcagcgctgggtagtgggg

SEQ ID NO: 41173 - DNA, 142 bp, Homo sapiens
  misc_feature 1..142: note = chr7:5441304-5441446
  misc_feature 1..142: note = hypo
  source 1..142: mol_type = genomic DNA
tttacaaaaacaagacgtgggccacatttggctagactgctcaccccagcattactaggtatgctacgagttattttttattcctagtcctatgctgcacatcggaggtactcaagtagtatttacggtaggaactgggcac

SEQ ID NO: 41174 - DNA, 116 bp, Homo sapiens
  misc_feature 1..116: note = chr7:5529839-5529955
  misc_feature 1..116: note = hypo
  source 1..116: mol_type = genomic DNA
ccacctgcagggacacgaacactcagggcgttcatgtcctgctgcccccttggccgggcgcacgcctctctcaggagccctgatcactccagcagtcagcccgtcctcctgagagg

SEQ ID NO: 41175 - DNA, 34 bp, Homo sapiens
  misc_feature 1..34: note = chr7:5589502-5589536
  misc_feature 1..34: note = hypo
  source 1..34: mol_type = genomic DNA
agtaagtgaagaggccgggcgcggtggctcacgc

SEQ ID NO: 41176 - DNA, 30 bp, Homo sapiens
  misc_feature 1..30: note = chr7:5626228-5626258
  misc_feature 1..30: note = hypo
  source 1..30: mol_type = genomic DNA
cagaggcaggaggaccgttcaagactgagg

SEQ ID NO: 41177 - DNA, 30 bp, Homo sapiens
  misc_feature 1..30: note = chr7:5629903-5629933
  misc_feature 1..30: note = hypo
  source 1..30: mol_type = genomic DNA
ctcgtgccacgccctcgtaccaaggtggct

SEQ ID NO: 41178 - DNA, 201 bp, Homo sapiens
  misc_feature 1..201: note = chr7:5647869-5648070
  misc_feature 1..201: note = hypo
  source 1..201: mol_type = genomic DNA
gtcccaggtgagatgcgggtcgagggagccaggccacggttctccagactcgcgtggaggccacgagcgtcttctggaggagcgggcactgcgcggaccggcagactctggggcgctcaggctccccatctcctgaccttttcctaccttcagttccctcctgtcaggacaggttctggggctcgccggggcagggagcca

SEQ ID NO: 41179 - DNA, 56 bp, Homo sapiens; identical to SEQ ID NO: 14968
  misc_feature 1..56: note = chr7:5648363-5648419
  misc_feature 1..56: note = hypo
  source 1..56: mol_type = genomic DNA

SEQ ID NO: 41180 - DNA, 56 bp, Homo sapiens
  misc_feature 1..56: note = chr7:6060716-6060772
  misc_feature 1..56: note = hypo
  source 1..56: mol_type = genomic DNA
gcactcagagccccacgagttaacaccaagggcgtcaaagtcgtctacttgccccc

SEQ ID NO: 41181 - DNA, 37 bp, Homo sapiens
  misc_feature 1..37: note = chr7:6099217-6099254
  misc_feature 1..37: note = hypo
  source 1..37: mol_type = genomic DNA
tatgccacaaaaaaacgggagatgccgccgggcgcgg

SEQ ID NO: 41182 - DNA, 94 bp, Homo sapiens
  misc_feature 1..94: note = chr7:6124620-6124714
  misc_feature 1..94: note = hypo
  source 1..94: mol_type = genomic DNA
attacaggtgcgagccaccgcacccagccaaggactcttaagtgtaactgatccaccctacttttctccctggcatgaacgactgtgcccagcc

SEQ ID NO: 41183 - DNA, 36 bp, Homo sapiens
  misc_feature 1..36: note = chr7:6143243-6143279
  misc_feature 1..36: note = hypo
  source 1..36: mol_type = genomic DNA
gcatcaggtcttgggcggtggctccggagtgtaatc

SEQ ID NO: 41184 - DNA, 64 bp, Homo sapiens
  misc_feature 1..64: note = chr7:6241990-6242054
  misc_feature 1..64: note = hypo
  source 1..64: mol_type = genomic DNA
agctgaatatgacaacgtgggtgaacccagacaagagcagcacgtgaaccgccagccaacttgg

SEQ ID NO: 41185 - DNA, 157 bp, Homo sapiens
  misc_feature 1..157: note = chr7:6443279-6443436
  misc_feature 1..157: note = hypo
  source 1..157: mol_type = genomic DNA
gtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaa

SEQ ID NO: 41186 - DNA, 34 bp, Homo sapiens
  misc_feature 1..34: note = chr7:6443956-6443990
  misc_feature 1..34: note = hypo
  source 1..34: mol_type = genomic DNA
tccagaggctgagtgcgtggcttacgcctctaag

SEQ ID NO: 41187 - DNA, 93 bp, Homo sapiens
  misc_feature 1..93: note = chr7:6444050-6444143
  misc_feature 1..93: note = hypo
  source 1..93: mol_type = genomic DNA
ctggacaagaaagagacctacccaaaaaaaaaatgcaagagcctgaacttgtactacataaaggttcatgttagaattcgttttcttaatatt

SEQ ID NO: 41188 - DNA, 273 bp, Homo sapiens
  misc_feature 1..273: note = chr7:6499118-6499391
  misc_feature 1..273: note = hypo
  source 1..273: mol_type = genomic DNA
atatgtactatgttacgctgcaaatggcttttaaagtgcagggacaaaaggaattgtttcaaaactggagaaacacccacagcacttccagcagattccaggctacagattccagttaacccagatagttgtgaggatggctgggtggtacgaggacagaggcacacagaaaacacccacgcagatccaatcaagctagcctcagatgggtggctgcttttggaaggtaccaaggagtcaatttctttcttttttttttttttttttttgaga

SEQ ID NO: 41189 - DNA, 38 bp, Homo sapiens
  misc_feature 1..38: note = chr7:6524573-6524611
  misc_feature 1..38: note = hypo
  source 1..38: mol_type = genomic DNA
aggtagaaaagtgaacgtctgaccgggcgcggtggctc

SEQ ID NO: 41190 - DNA, 180 bp, Homo sapiens
  misc_feature 1..180: note = chr7:6524911-6525091
  misc_feature 1..180: note = hypo
  source 1..180: mol_type = genomic DNA
ttgaatatttctacgggatggggacgtcacaagaaattgcaaacaaaaaaagctgacaaacaggatctgctacataatttgcgggacggagtgcaaaacaaaaacgcacagttcgcagttcaaaaagcagggcgggggcgaggacctggtgcggtggctcatgcctgtagtcccaacact

SEQ ID NO: 41191 - DNA, 166 bp, Homo sapiens
  misc_feature 1..166: note = chr7:6545837-6546003
  misc_feature 1..166: note = hypo
  source 1..166: mol_type = genomic DNA
caagtaaggggctaccggaggtggctcaggggtctggctctgtcatcaggtctccttggagagcggtgagttcaccagggctgccctgggcagagtgagctggtgctgagagaactgcaactgtgacagcctaggggccagacgctggacacgtggctgtgatgaa

SEQ ID NO: 41192 - DNA, 228 bp, Homo sapiens
  misc_feature 1..228: note = chr7:6560173-6560401
  misc_feature 1..228: note = hypo
  source 1..228: mol_type = genomic DNA
agggcagggccccaccgcggctttggcccggccacctgtgctggaagaagctctcgagggcccggcagaccccatagcgctcaggaggtgtgagtaggtgctccagctgctggctgaaggtcctcccttggacccggatgctggacggcaggatctccgccacccactgcagggaggtgagcgccgacgacgggttgggtgagtccagagaatcggagtctgctggga

SEQ ID NO: 41193 - DNA, 30 bp, Homo sapiens; identical to SEQ ID NO: 14975
  misc_feature 1..30: note = chr7:7102938-7102968
  misc_feature 1..30: note = hypo
  source 1..30: mol_type = genomic DNA

SEQ ID NO: 41194 - DNA, 30 bp, Homo sapiens
  misc_feature 1..30: note = chr7:7105800-7105830
  misc_feature 1..30: note = hypo
  source 1..30: mol_type = genomic DNA
cccagtatcgaagggcgtgtaccccctctc

SEQ ID NO: 41195 - DNA, 61 bp, Homo sapiens
  misc_feature 1..61: note = chr7:7109343-7109404
  misc_feature 1..61: note = hypo
  source 1..61: mol_type = genomic DNA
caaggggggagatgacgttgctcccagagtcgcagagagtgtaacccgtctgtgatattgc

SEQ ID NO: 41196 - DNA, 52 bp, Homo sapiens
  misc_feature 1..52: note = chr7:7111788-7111840
  misc_feature 1..52: note = hypo
  source 1..52: mol_type = genomic DNA
tacttttaataatatcgtaaggggtgtaccccctctgcgagattcttcgtaa

SEQ ID NO: 41197 - DNA, 42 bp, Homo sapiens
  misc_feature 1..42: note = chr7:7113636-7113678
  misc_feature 1..42: note = hypo
  source 1..42: mol_type = genomic DNA
ctctgtgatattattcgtaacaatatccacgggaggagatga

SEQ ID NO: 41198 - DNA, 279 bp, Homo sapiens
  misc_feature 1..279: note = chr7:7605145-7605424
  misc_feature 1..279: note = hypo
  source 1..279: mol_type = genomic DNA
atctgaagactgcctcgaggtcagactcgtgacacctgaggcagcaccattcactcagttttgggaacaaaaaacttggaatcctctttcaccgtcattcacttggtcagtcaccaagctctgttcatcccgccttctaagtattccccagggcccccacttctctccatgcccactctccgtgccactggtaacctgcgtttctatcatccctcattctgatactctatccctccagctctctgcgcaaaaactgatcatactggccgggcacagtgg

SEQ ID NO: 41199 - DNA, 158 bp, Homo sapiens
  misc_feature 1..158: note = chr7:7605664-7605822
  misc_feature 1..158: note = hypo
  source 1..158: mol_type = genomic DNA
ggcgatatagccagactccgtctcaaaaaaaacaaaacaaaacaaaaaactgatcataccacttgcctgattaaaaactttcgatgactctaacattgcctttaggtaaatgccatccaaactcactaaactggtttccaacccgtttctgaaagcac

SEQ ID NO: 41200 - DNA, 32 bp, Homo sapiens
  misc_feature 1..32: note = chr7:8391330-8391362
  misc_feature 1..32: note = hypo
  source 1..32: mol_type = genomic DNA
aaacttaggattgggcggggggtgggggagga

SEQ ID NO: 41201 - DNA, 23 bp, Homo sapiens
  misc_feature 1..23: note = chr7:10730863-10730886
  misc_feature 1..23: note = hypo
  source 1..23: mol_type = genomic DNA
aaacatttgggaggccgggtgcg

SEQ ID NO: 41202 - DNA, 37 bp, Homo sapiens
  misc_feature 1..37: note = chr7:10819400-10819437
  misc_feature 1..37: note = hypo
  source 1..37: mol_type = genomic DNA
cggcctctgaggccacggaccacgctgccccatgctc

SEQ ID NO: 41203 - DNA, 30 bp, Homo sapiens
  misc_feature 1..30: note = chr7:10929379-10929409
  misc_feature 1..30: note = hypo
  source 1..30: mol_type = genomic DNA
cttgcccaactctgacgctcatcaagagtt

SEQ ID NO: 41204 - DNA, 37 bp, Homo sapiens
  misc_feature 1..37: note = chr7:12776917-12776954
  misc_feature 1..37: note = hypo
  source 1..37: mol_type = genomic DNA
ggattacagccatgagtcactgcgcctggccagtgtt

SEQ ID NO: 41205 - DNA, 43 bp, Homo sapiens
  misc_feature 1..43: note = chr7:16566510-16566553
  misc_feature 1..43: note = hypo
  source 1..43: mol_type = genomic DNA
tctcttcggtgccaccggcgggcgaggccggattaatcaccgc

SEQ ID NO: 41206 - DNA, 180 bp, Homo sapiens
  misc_feature 1..180: note = chr7:16844151-16844331
  misc_feature 1..180: note = hypo
  source 1..180: mol_type = genomic DNA
tccaagcgggcaatccgagctgaggtgtcatagtggagaagcctatggggctttgctttagcccgtgggaaagaaagctttagatggtgactgagacgaaaatccctggaccctgtcccaggcttgaaaaatcctaggattcacctactcttggaaattttgtttcgcaaaagagaaagc

SEQ ID NO: 41207 - DNA, 27 bp, Homo sapiens
  misc_feature 1..27: note = chr7:17413241-17413268
  misc_feature 1..27: note = hypo
  source 1..27: mol_type = genomic DNA
tgtgagccgccgcgcccaaccgcaaag

SEQ ID NO: 41208 - DNA, 24 bp, Homo sapiens
  misc_feature 1..24: note = chr7:20710238-20710262
  misc_feature 1..24: note = hypo
  source 1..24: mol_type = genomic DNA
aagaagcaagctggccgggtgcgg

SEQ ID NO: 41209 - DNA, 18 bp, Homo sapiens
  misc_feature 1..18: note = chr7:20719888-20719906
  misc_feature 1..18: note = hypo
  source 1..18: mol_type = genomic DNA
agagtgacttgaggccga

SEQ ID NO: 41210 - DNA, 139 bp, Homo sapiens
  misc_feature 1..139: note = chr7:20720174-20720313
  misc_feature 1..139: note = hypo
  source 1..139: mol_type = genomic DNA
agagccagactccgtctcaaaaaaaaaaaaaaaaaccgactgacttgaaaagagcatgagatggacttgtgggtgctggtaatgatgggattcttgacctggataccatgatacgggcaaattccgtttgaaatgcact

SEQ ID NO: 41211 - DNA, 43 bp, Homo sapiens
  misc_feature 1..43: note = chr7:20757794-20757837
  misc_feature 1..43: note = hypo
  source 1..43: mol_type = genomic DNA
gtcctgggattccaggcgtgagccacggcgcctggcccaaata

SEQ ID NO: 41212 - DNA, 173 bp, Homo sapiens
  misc_feature 1..173: note = chr7:22981026-22981199
  misc_feature 1..173: note = hypo
  source 1..173: mol_type = genomic DNA
aaaaatagccaaagtcgtcgtttattctttaggaatgtaaactctaggaatacaattagaaacaaatatatttactatgaaaagattagtatcactaaatgattagaaataaaggtaagaggtacacaataagttccatataagagaaagcaacaatacgtgaaataaaatct

SEQ ID NO: 41213 - DNA, 30 bp, Homo sapiens
  misc_feature 1..30: note = chr7:23220685-23220715
  misc_feature 1..30: note = hypo
  source 1..30: mol_type = genomic DNA
gaggctgcttctctgcgtcaaagagactta

SEQ ID NO: 41214 - DNA, 36 bp, Homo sapiens
  misc_feature 1..36: note = chr7:23525036-23525072
  misc_feature 1..36: note = hypo
  source 1..36: mol_type = genomic DNA
attgttggccgggcacggtggctcacgcctgtaatc

SEQ ID NO: 41215 - DNA, 30 bp, Homo sapiens
  misc_feature 1..30: note = chr7:23568103-23568133
  misc_feature 1..30: note = hypo
  source 1..30: mol_type = genomic DNA
cgtgagccaccgggccggccttgttttgtt

SEQ ID NO: 41216 - DNA, 30 bp, Homo sapiens
  misc_feature 1..30: note = chr7:23569271-23569301
  misc_feature 1..30: note = hypo
  source 1..30: mol_type = genomic DNA
ataaaaactaaaagacgaaaaataaaaaga

SEQ ID NO: 41217 - DNA, 16 bp, Homo sapiens
  misc_feature 1..16: note = chr7:23578805-23578821
  misc_feature 1..16: note = hypo
  source 1..16: mol_type = genomic DNA
ccgcacccagccattt

SEQ ID NO: 41218 - DNA, 48 bp, Homo sapiens
  misc_feature 1..48: note = chr7:23749757-23749805
  misc_feature 1..48: note = hypo
  source 1..48: mol_type = genomic DNA
aggccgtggctgccacgtgactcccgctaacaccggatgatggcgcag

SEQ ID NO: 41219 - DNA, 120 bp, Homo sapiens
  misc_feature 1..120: note = chr7:24099277-24099397
  misc_feature 1..120: note = hypo
  source 1..120: mol_type = genomic DNA
gagacagcctaagactactgagttcccagggggaggggcggctgccatcaccgcagctccgccattgacagagttggggaggctgggcagtatggactagggaggtattccccacagcac

SEQ ID NO: 41220 - DNA, 20 bp, Homo sapiens
  misc_feature 1..20: note = chr7:24580784-24580804
  misc_feature 1..20: note = hypo
  source 1..20: mol_type = genomic DNA
gccttcgcgcccagccacaa

SEQ ID NO: 41221 - DNA, 224 bp, Homo sapiens
  misc_feature 1..224: note = chr7:24761204-24761428
  misc_feature 1..224: note = hypo
  source 1..224: mol_type = genomic DNA
gccattagggtgtgccgagcacagagttaaatgccacacaaacactagctggctccgcccaccttcccgtgtccctctatgaggctcacaaaacaaagccacagtgtgtgccctgcatgggaattatggggcactgaattgaatcagaggtacgtttccacatcactcccttcttaaaagccttcaatggctatatcccatgtccagtgcgttcccaggctgag

SEQ ID NO: 41222 - DNA, 30 bp, Homo sapiens
  misc_feature 1..30: note = chr7:24799881-24799911
  misc_feature 1..30: note = hypo
  source 1..30: mol_type = genomic DNA
taccgggatttatttcgtaaatgaatacac

SEQ ID NO: 41223 - DNA, 30 bp, Homo sapiens
  misc_feature 1..30: note = chr7:24845483-24845513
  misc_feature 1..30: note = hypo
  source 1..30: mol_type = genomic DNA
catgagttgcagatacggacttctccgttt

SEQ ID NO: 41224 - DNA, 190 bp, Homo sapiens
  misc_feature 1..190: note = chr7:25495487-25495677
  misc_feature 1..190: note = hypo
  source 1..190: mol_type = genomic DNA
cgaactagtcagtcccgtggtgacgtcaggattatctttctctcacttcagtgcctctgggacttaataggtgcacgaagaatatttataggtgcctgagaaatgcttgccgagaaatgactggctgttccaaggcatttccagggcaaggcagtccagtctgtgccgggccgggcggttgtagaggagg

SEQ ID NO: 41225 - DNA, 84 bp, Homo sapiens
  misc_feature 1..84: note = chr7:25530809-25530893
  misc_feature 1..84: note = hypo
  source 1..84: mol_type = genomic DNA
taactcttttctgcacggttatatagcatgtttatttcttaaatcactctaggaattggccacttgcgtgctgctctgaggtgt

SEQ ID NO: 41226 - DNA, 186 bp, Homo sapiens
  misc_feature 1..186: note = chr7:25802276-25802462
  misc_feature 1..186: note = hypo
  source 1..186: mol_type = genomic DNA
ggttggaaatgcaaacgcatagccaattagtggaagacaaggtgagcttgccaatcgataatcaccacaccacctgttgcgctttgaaaaattacctcacaacattcttgggtccttaggtaaatccttaaacttcatcctgaagaaaatgaatcacatatgtgtcttcctcgccatgggatatgc

SEQ ID NO: 41227 - DNA, 42 bp, Homo sapiens
  misc_feature 1..42: note = chr7:26217181-26217223
  misc_feature 1..42: note = hypo
  source 1..42: mol_type = genomic DNA
agtccaggctcagcaatggagggagaccgtcgaaaggaggga

SEQ ID NO: 41228 - DNA, 17 bp, Homo sapiens
  misc_feature 1..17: note = chr7:26222458-26222475
  misc_feature 1..17: note = hypo
  source 1..17: mol_type = genomic DNA
gctggagtgtggcagcg

SEQ ID NO: 41229 - DNA, 78 bp, Homo sapiens
  misc_feature 1..78: note = chr7:26283775-26283853
  misc_feature 1..78: note = hypo
  source 1..78: mol_type = genomic DNA
taacagggaaaaattcgcatggcctctcggtttcttcggtccgaaaatccaacgttggtccaagaaggctctggtgtg

SEQ ID NO: 41230 - DNA, 129 bp, Homo sapiens
  misc_feature 1..129: note = chr7:26652555-26652684
  misc_feature 1..129: note = hypo
  source 1..129: mol_type = genomic DNA
caatgctaccccggccgcatgatgcagaaatgggagccaaagctgggacaaggtagagaggagggaaggagccccagtgcctgcagaaagagcagagggttggaagactactgtcggctagctcaggcc

SEQ ID NO: 41231 - DNA, 35 bp, Homo sapiens
  misc_feature 1..35: note = chr7:26762298-26762333
  misc_feature 1..35: note = hypo
  source 1..35: mol_type = genomic DNA
attacaggcgtgagccactgcgcccagcccattgc

SEQ ID NO: 41232 - DNA, 30 bp, Homo sapiens
  misc_feature 1..30: note = chr7:27531223-27531253
  misc_feature 1..30: note = hypo
  source 1..30: mol_type = genomic DNA
gagttgtctgagcagcggcctgaggtgctg

SEQ ID NO: 41233 - DNA, 170 bp, Homo sapiens
  misc_feature 1..170: note = chr7:27555618-27555788
  misc_feature 1..170: note = hypo
  source 1..170: mol_type = genomic DNA
tctctctggaaataccggtcttgccatctttcaagcaaatagcggctcactggtaggaatttcaaaacctgtgcttaaactgccaaattcctttcctctgctgttcccatttctctgtaatgatggccccagaagggaggcttggtgcaggctgacgctttctctgcctt

SEQ ID NO: 41234 - DNA, 16 bp, Homo sapiens
  misc_feature 1..16: note = chr7:27686784-27686800
  misc_feature 1..16: note = hypo
  source 1..16: mol_type = genomic DNA
gcgatatcacaacacc

SEQ ID NO: 41235 - DNA, 32 bp, Homo sapiens
  misc_feature 1..32: note = chr7:27903816-27903848
  misc_feature 1..32: note = hypo
  source 1..32: mol_type = genomic DNA
cctaattccatggcccgcgatttaatttgagg

SEQ ID NO: 41236 - DNA, 43 bp, Homo sapiens
  misc_feature 1..43: note = chr7:27907997-27908040
  misc_feature 1..43: note = hypo
  source 1..43: mol_type = genomic DNA
tgtggggttgactgccgcttgcttctcccgctcccatccccct

SEQ ID NO: 41237 - DNA, 93 bp, Homo sapiens
  misc_feature 1..93: note = chr7:27916674-27916767
  misc_feature 1..93: note = hypo
  source 1..93: mol_type = genomic DNA
agaagggcaggctaccgagagggcgctagactttggcagaggccgctgctggaaagccagcatccccagctttatcaccgaccacgtttattt

SEQ ID NO: 41238 - DNA, 30 bp, Homo sapiens
  misc_feature 1..30: note = chr7:28050662-28050692
  misc_feature 1..30: note = hypo
  source 1..30: mol_type = genomic DNA
gggtgtttctgcttacgatgctaatgagat

SEQ ID NO: 41239 - DNA, 30 bp, Homo sapiens
  misc_feature 1..30: note = chr7:28055637-28055667
  misc_feature 1..30: note = hypo
  source 1..30: mol_type = genomic DNA
tcttccagacagtgacggcattttaatgag

SEQ ID NO: 41240 - DNA, 30 bp, Homo sapiens
  misc_feature 1..30: note = chr7:28266792-28266822
  misc_feature 1..30: note = hypo
  source 1..30: mol_type = genomic DNA
aggcgtgagccatcgcgcctggcccagagt

SEQ ID NO: 41241 - DNA, 22 bp, Homo sapiens
  misc_feature 1..22: note = chr7:28988955-28988977
  misc_feature 1..22: note = hypo
  source 1..22: mol_type = genomic DNA
gggcgcagtggctcacgcctgt

SEQ ID NO: 41242 - DNA, 141 bp, Homo sapiens
  misc_feature 1..141: note = chr7:28989217-28989358
  misc_feature 1..141: note = hypo
  source 1..141: mol_type = genomic DNA
caaaaaaaaaaaaaaaagtacagctgaccttcctgagtctcggattatgtatctgtgaattcattttctcaccaaaatttgtttgtgaccctagaatcaacactccatagcactgtcatggtcattcgctgacatgcttag

SEQ ID NO: 41243 - DNA, 30 bp, Homo sapiens
  misc_feature 1..30: note = chr7:29482512-29482542
  misc_feature 1..30: note = hypo
  source 1..30: mol_type = genomic DNA
ccacttaatccccatcgctttcaatttcat

SEQ ID NO: 41244 - DNA, 38 bp, Homo sapiens
  misc_feature 1..38: note = chr7:29876677-29876715
  misc_feature 1..38: note = hypo
  source 1..38: mol_type = genomic DNA
aacacacattttggccgggcatggtggctcacacctgt

SEQ ID NO: 41245 - DNA, 30 bp, Homo sapiens
  misc_feature 1..30: note = chr7:30206504-30206534
  misc_feature 1..30: note = hypo
  source 1..30: mol_type = genomic DNA
ggatcatctctgccacgattttctccattc

SEQ ID NO: 41246 - DNA, 30 bp, Homo sapiens
  misc_feature 1..30: note = chr7:30603406-30603436
  misc_feature 1..30: note = hypo
  source 1..30: mol_type = genomic DNA
cgctgggggaggctccgtgtagtttctggg

SEQ ID NO: 41247 - DNA, 163 bp, Homo sapiens
  misc_feature 1..163: note = chr7:30687826-30687989
  misc_feature 1..163: note = hypo
  source 1..163: mol_type = genomic DNA
tgtatgggagggccccgaggcctaaacaaacaaatacctaagaggaaaatctggcagaaactcagtcaacacagggcagtgatgccctctgcccattcctcctgctaattaacatgtctaagtggcacagccccctcaggaaaattaacggcaccttcgaggc

SEQ ID NO: 41248 - DNA, 30 bp, Homo sapiens
  misc_feature 1..30: note = chr7:30699730-30699760
  misc_feature 1..30: note = hypo
  source 1..30: mol_type = genomic DNA
cattatgctgcatcccggtattcaccgctt

SEQ ID NO: 41249 - DNA, 133 bp, Homo sapiens
  misc_feature 1..133: note = chr7:30744677-30744810
  misc_feature 1..133: note = hypo
  source 1..133: mol_type = genomic DNA
gagtctaaggaaagccggcacctgtcgagaaacggacctctgccctgcatttggggccaccacacagaccacatctctgcctgtgactaagactgctcagacccagtgccataggagacgaggtgccttgggt

SEQ ID NO: 41250 - DNA, 92 bp, Homo sapiens
  misc_feature 1..92: note = chr7:30899935-30900027
  misc_feature 1..92: note = hypo
  source 1..92: mol_type = genomic DNA
ggggctctgtggcctcgtgcgccaggctgcctgctgcttgctgcttctgaccttattaaatgcgtgtgagtacacagcgctttccaacttct

SEQ ID NO: 41251 - DNA, 84 bp, Homo sapiens
  misc_feature 1..84: note = chr7:31116600-31116684
  misc_feature 1..84: note = hypo
  source 1..84: mol_type = genomic DNA
gcagctgtggggctgcgggtcttcgggggtgtggggcggtgtaaaaacaggtgagggctccctccttcccgacccaggagctcc

SEQ ID NO: 41252 - DNA, 238 bp, Homo sapiens
  misc_feature 1..238: note = chr7:31118297-31118535
  misc_feature 1..238: note = hypo
  source 1..238: mol_type = genomic DNA
gctggcgcacactcacgtttgctcagcagagcattttctgggccctagctgccctcaggcagttacacgggctcaagatgggaggagctggaccttgggctacctggggagagggtgccacacacggggagcagtgccacagtgctgtcggtgacttgtggacgtgggcttggaggcgcgggtgtgcgatggcgcctccctgagagggaaggctgggtgggtgcggtgtcctgcagac

SEQ ID NO: 41253 - DNA, 158 bp, Homo sapiens
  misc_feature 1..158: note = chr7:32128181-32128339
  misc_feature 1..158: note = hypo
  source 1..158: mol_type = genomic DNA
caatatcccatcagacgacgctttgctggcaacaattgcaattgatggcgctcgcaaggctgtgtgatgtcgctgggtgtttgcaaagcagaggaaaatccctctatgcacaagcggttctgacctcactccagtgagccactcgcctgtctttagtg

SEQ ID NO: 41254 - DNA, 15 bp, Homo sapiens
  misc_feature 1..15: note = chr7:32276919-32276934
  misc_feature 1..15: note = hypo
  source 1..15: mol_type = genomic DNA
cgatctcctgacctc

SEQ ID NO: 41255 - DNA, 30 bp, Homo sapiens
  misc_feature 1..30: note = chr7:32323599-32323629
  misc_feature 1..30: note = hypo
  source 1..30: mol_type = genomic DNA
cgggaagaagcatcccgaggacatttatta

SEQ ID NO: 41256 - DNA, 25 bp, Homo sapiens
  misc_feature 1..25: note = chr7:35190140-35190165
  misc_feature 1..25: note = hypo
  source 1..25: mol_type = genomic DNA
atcttttttttgagacggggtcttg

SEQ ID NO: 41257 - DNA, 88 bp, Homo sapiens
  misc_feature 1..88: note = chr7:36428640-36428728
  misc_feature 1..88: note = hypo
  source 1..88: mol_type = genomic DNA
gctactgaaggccaacgggctagcagcacctgaaacacaagggctctttgtctggctctgtagcccaggctggaatgcagtggtgtga

SEQ ID NO: 41258 - DNA, 26 bp, Homo sapiens
  misc_feature 1..26: note = chr7:37025520-37025546
  misc_feature 1..26: note = hypo
  source 1..26: mol_type = genomic DNA
tactcaccaagctcccgtaagtccat

SEQ ID NO: 41259 - DNA, 30 bp, Homo sapiens; identical to SEQ ID NO: 14984
  misc_feature 1..30: note = chr7:37264509-37264539
  misc_feature 1..30: note = hypo
  source 1..30: mol_type = genomic DNA

SEQ ID NO: 41260 - DNA, 181 bp, Homo sapiens; identical to SEQ ID NO: 14985
  misc_feature 1..181: note = chr7:37279183-37279364
  misc_feature 1..181: note = hypo
  source 1..181: mol_type = genomic DNA

SEQ ID NO: 41261 - DNA, 119 bp, Homo sapiens
  misc_feature 1..119: note = chr7:37399153-37399272
  misc_feature 1..119: note = hypo
  source 1..119: mol_type = genomic DNA
gccccgtgacaaaggcgctatcataatccccaccctaaacatgggtagatggagtcactgaggaaactggtcacttatttggctagtcagcaatctagcccatccgaaggcagtgttct

SEQ ID NO: 41262 - DNA, 17 bp, Homo sapiens
  misc_feature 1..17: note = chr7:37423714-37423731
  misc_feature 1..17: note = hypo
  source 1..17: mol_type = genomic DNA
gccgaaacatacaggtt

SEQ ID NO: 41263 - DNA, 146 bp, Homo sapiens
  misc_feature 1..146: note = chr7:37424328-37424474
  misc_feature 1..146: note = hypo
  source 1..146: mol_type = genomic DNA
aaaaaaaagaactttccagtttgtttatttgtcaagaaaacagtaagttctagatctacttgagaggttgcctcagaaatctgacctcaacaaattacttctttcactctaatctgcaataaaactagcaacggttgtacacacaa

SEQ ID NO: 41264 - DNA, 30 bp, Homo sapiens
  misc_feature 1..30: note = chr7:37446822-37446852
  misc_feature 1..30: note = hypo
  source 1..30: mol_type = genomic DNA
tggatgagggtctggcgcggtggctcacgt

SEQ ID NO: 41265 - DNA, 30 bp, Homo sapiens
  misc_feature 1..30: note = chr7:37686948-37686978
  misc_feature 1..30: note = hypo
  source 1..30: mol_type = genomic DNA
acttgagattgtcaacgaattaagagataa

SEQ ID NO: 41266 - DNA, 148 bp, Homo sapiens
  misc_feature 1..148: note = chr7:37770953-37771101
  misc_feature 1..148: note = hypo
  source 1..148: mol_type = genomic DNA
caagcaagtcatgcacgtggagaacgaggtgtctctctgaaagaaatgtagagagaaaattttaggtcaactaattaaaaattcccatcaatctctagaatagcatcccatatgcaaaggaatactctgtcgcccaggctggagtgca

SEQ ID NO: 41267 - DNA, 175 bp, Homo sapiens
  misc_feature 1..175: note = chr7:37868787-37868962
  misc_feature 1..175: note = hypo
  source 1..175: mol_type = genomic DNA
ctcagtagaaggctgcggtggttttgcttgccctcaggctgtatacccagttcttcatacctctcccaggctcctccagatctgcctcctgctgaccttgtacccagctgcagcgacaccgagctcctcacagcttcccaaagtgggctggcccctctcacgacagggtcatcgc

SEQ ID NO: 41268 - DNA, 30 bp, Homo sapiens
  misc_feature 1..30: note = chr7:37907440-37907470
  misc_feature 1..30: note = hypo
  source 1..30: mol_type = genomic DNA
ggatcaacctgaggtcgaagcccaggttac

SEQ ID NO: 41269 - DNA, 30 bp, Homo sapiens
  misc_feature 1..30: note = chr7:37969938-37969968
  misc_feature 1..30: note = hypo
  source 1..30: mol_type = genomic DNA
cacagctctgcctgacgcagcattgtcagc

SEQ ID NO: 41270 - DNA, 37 bp, Homo sapiens
  misc_feature 1..37: note = chr7:38170685-38170722
  misc_feature 1..37: note = hypo
  source 1..37: mol_type = genomic DNA
aaaatgaatgaaggccgggcacggtggctcacgcctg

SEQ ID NO: 41271 - DNA, 24 bp, Homo sapiens
  misc_feature 1..24: note = chr7:38508456-38508480
  misc_feature 1..24: note = hypo
  source 1..24: mol_type = genomic DNA
agtagaacatacagacggccgggc

SEQ ID NO: 41272 - DNA, 189 bp, Homo sapiens
  misc_feature 1..189: note = chr7:38740329-38740518
  misc_feature 1..189: note = hypo
  source 1..189: mol_type = genomic DNA
cttgttttctgagctcgctgggggattgatgctccacggagcgctgctgggaaacgctggaccagagccagttccaaagacttccttctgaaaatcctaggtttgttctgcaggtgtggcctaacagctccatcttttttgtgttcagaaacattcatcctgtgctatcacatgcggcatcgcctcagg

SEQ ID NO: 41273 - DNA, 30 bp, Homo sapiens
  misc_feature 1..30: note = chr7:39192698-39192728
  misc_feature 1..30: note = hypo
  source 1..30: mol_type = genomic DNA
ttctgcggtgatgtgcgttggacaaaggtg

SEQ ID NO: 41274 - DNA, 30 bp, Homo sapiens
  misc_feature 1..30: note = chr7:39317801-39317831
  misc_feature 1..30: note = hypo
  source 1..30: mol_type = genomic DNA
gcagagaaggcgtttcggaaaagctcctga

SEQ ID NO: 41275 - DNA, 101 bp, Homo sapiens
  misc_feature 1..101: note = chr7:39921805-39921906
  misc_feature 1..101: note = hypo
  source 1..101: mol_type = genomic DNA
tttgtcttggctaaagattaacaaccagctggtgttaatttctgcttacacttaacagcactcacattagaaacaacttttggtgccgcaaaagaaatagc

SEQ ID NO: 41276 - DNA, 91 bp, Homo sapiens
  misc_feature 1..91: note = chr7:40157087-40157178
  misc_feature 1..91: note = hypo
  source 1..91: mol_type = genomic DNA
tgataacatggtatacgtattgttatgaaagtgaccgtgtccataaataggagaaatcccataactcctactacatcggttctaccttttg

SEQ ID NO: 41277 - DNA, 93 bp, Homo sapiens
  misc_feature 1..93: note = chr7:40407726-40407819
  misc_feature 1..93: note = hypo
  source 1..93: mol_type = genomic DNA
ttcctgcttttccctcgtaagtcagatctcacattataacattttagtctatacttttttattttgtgattatttatttatttatttttgaga

SEQ ID NO: 41278 - DNA, 30 bp, Homo sapiens
  misc_feature 1..30: note = chr7:40943582-40943612
  misc_feature 1..30: note = hypo
  source 1..30: mol_type = genomic DNA
gctgcccaagcttggcgcagcttacatcac

SEQ ID NO: 41279 - DNA, 27 bp, Homo sapiens
  misc_feature 1..27: note = chr7:41814148-41814175
  misc_feature 1..27: note = hypo
  source 1..27: mol_type = genomic DNA
ggaggccgaggtgggcggatcacgagg

SEQ ID NO: 41280 - DNA, 30 bp, Homo sapiens
  misc_feature 1..30: note = chr7:41923780-41923810
  misc_feature 1..30: note = hypo
  source 1..30: mol_type = genomic DNA
aaatgtcccacactccgaagctctgctacc

SEQ ID NO: 41281 - DNA, 30 bp, Homo sapiens
  misc_feature 1..30: note = chr7:41943672-41943702
  misc_feature 1..30: note = hypo
  source 1..30: mol_type = genomic DNA
ttcatggattactgacggaaatacacaatg

SEQ ID NO: 41282 - DNA, 17 bp, Homo sapiens
  misc_feature 1..17: note = chr7:41981795-41981812
  misc_feature 1..17: note = hypo
  source 1..17: mol_type = genomic DNA
gggcgtggtggctcacg

SEQ ID NO: 41283 - DNA, 30 bp, Homo sapiens
  misc_feature 1..30: note = chr7:42005469-42005499
  misc_feature 1..30: note = hypo
  source 1..30: mol_type = genomic DNA
gggaggacagggggacgagtggaagtttcg

SEQ ID NO: 41284 - DNA, 177 bp, Homo sapiens
  misc_feature 1..177: note = chr7:43237814-43237991
  misc_feature 1..177: note = hypo
  source 1..177: mol_type = genomic DNA
cacacccaccatagtcgcacatcccacagtctctcacacacccactcacacacaccccacactcacacaccacacacattcgcacactcaccctacactgtcacttacacacacatcctacatacactcatcatagtcacacaccccacgctctcacacacacgtcttacacacact

SEQ ID NO: 41285 - DNA, 25 bp, Homo sapiens
  misc_feature 1..25: note = chr7:43767877-43767902
  misc_feature 1..25: note = hypo
  source 1..25: mol_type = genomic DNA
gtgaactctacggtaggtgaactat

SEQ ID NO: 41286 - DNA, 202 bp, Homo sapiens
  misc_feature 1..202: note = chr7:43865061-43865263
  misc_feature 1..202: note = hypo
  source 1..202: mol_type = genomic DNA
gtaaagatggaaaagcggctgtctagtagagaccacataattcaatcactcgatctgagtttactagccccagagagctaaggttactctgtttatttattaaagaacttttacaaccttaaactcactctggactttccagccttatgttgggggttacaagtggcgccccgaacagcaacaggatcgggtgctctgcatt

SEQ ID NO: 41287 - DNA, 25 bp, Homo sapiens
  misc_feature 1..25: note = chr7:44083435-44083460
  misc_feature 1..25: note = hypo
  source 1..25: mol_type = genomic DNA
ccaccgtgcccggcaggatttatat

SEQ ID NO: 41288 - DNA, 442 bp, Homo sapiens
  misc_feature 1..442: note = chr7:44151285-44151727
  misc_feature 1..442: note = hypo
  source 1..442: mol_type = genomic DNA
gcctcccgcctgttccggagcctctctggggattctggcttgtcttacagggccctaggagccccagctgtcccccagaccctcgggtatgaggtgggtctgggtccttcctcagctgccctgggcctcgggagactgagtgctcactgaggctcccgcccttgcaggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatggtgggttgaagggtgaggctggccagggtccaggcagctgggggttgtgggggtgtgggtagccgatgcctaccctgc

SEQ ID NO: 41289 - DNA, 61 bp, Homo sapiens
  misc_feature 1..61: note = chr7:44152191-44152252
  misc_feature 1..61: note = hypo
  source 1..61: mol_type = genomic DNA
ggagaagaaccccttcgtgctgggagcaaatctgaacggcggcgagcggctagtatcctac

SEQ ID NO: 41290 - DNA, 30 bp, Homo sapiens
  misc_feature 1..30: note = chr7:44193301-44193331
  misc_feature 1..30: note = hypo
  source 1..30: mol_type = genomic DNA
aaatgcagcccacagcgtgttggaggggtg

SEQ ID NO: 41291 - DNA, 183 bp, Homo sapiens
  misc_feature 1..183: note = chr7:44258471-44258654
  misc_feature 1..183: note = hypo
  source 1..183: mol_type = genomic DNA
tggggataccgggcacggaaaacccacacctagcccttcaggggatgaaaggaagggaagggaaagcaggaacaacagcaactctcaggcacaactagcgggaaaggaggcagcccagcgggcccccacagcccctcccaagagacagctgacagtcacgacagccagcgagcacaccacgtg

SEQ ID NO: 41292 - DNA, 53 bp, Homo sapiens
  misc_feature 1..53: note = chr7:44259286-44259339
  misc_feature 1..53: note = hypo
  source 1..53: mol_type = genomic DNA
actgggctctgggcccgctgcacccaccacctggggaacgcccatctggggct

SEQ ID NO: 41293 - DNA, 30 bp, Homo sapiens
  misc_feature 1..30: note = chr7:44275594-44275624
  misc_feature 1..30: note = hypo
  source 1..30: mol_type = genomic DNA
cagcagcagcagaatcgccctgtacagtca

SEQ ID NO: 41294 - DNA, 30 bp, Homo sapiens
  misc_feature 1..30: note = chr7:44431004-44431034
  misc_feature 1..30: note = hypo
  source 1..30: mol_type = genomic DNA
taatacgtgctgtaccggaaggtaagacta

SEQ ID NO: 41295 - DNA, 34 bp, Homo sapiens
  misc_feature 1..34: note = chr7:44517861-44517895
  misc_feature 1..34: note = hypo
  source 1..34: mol_type = genomic DNA
actttgggccgggcgcggtggctcacgcctgtaa

SEQ ID NO: 41296 - DNA, 30 bp, Homo sapiens
  misc_feature 1..30: note = chr7:44717883-44717913
  misc_feature 1..30: note = hypo
  source 1..30: mol_type = genomic DNA
cttggctaggacactcgcccaggcatttgg

SEQ ID NO: 41297 - DNA, 30 bp, Homo sapiens
  misc_feature 1..30: note = chr7:44801185-44801215
  misc_feature 1..30: note = hypo
  source 1..30: mol_type = genomic DNA
taatgaggtgagctccgcctggcccccacc

SEQ ID NO: 41298 - DNA, 264 bp, Homo sapiens; identical to SEQ ID NO: 1574
  misc_feature 1..264: note = chr7:44835120-44835384
  misc_feature 1..264: note = hypo
  source 1..264: mol_type = genomic DNA

SEQ ID NO: 41299 - DNA, 27 bp, Homo sapiens
  misc_feature 1..27: note = chr7:45027184-45027211
  misc_feature 1..27: note = hypo
  source 1..27: mol_type = genomic DNA
attgttaagggacgaaagggccaagag

SEQ ID NO: 41300 - DNA, 16 bp, Homo sapiens
  misc_feature 1..16: note = chr7:45038548-45038564
  misc_feature 1..16: note = hypo
  source 1..16: mol_type = genomic DNA
gggcgcggtggctcac

SEQ ID NO: 41301 - DNA, 34 bp, Homo sapiens
  misc_feature 1..34: note = chr7:45125675-45125709
  misc_feature 1..34: note = hypo
  source 1..34: mol_type = genomic DNA
ggatggtggtggcagcggccgcatcgcaggacag

SEQ ID NO: 41302 - DNA, 61 bp, Homo sapiens
  misc_feature 1..61: note = chr7:45222910-45222971
  misc_feature 1..61: note = hypo
  source 1..61: mol_type = genomic DNA
acgaggttctcatcccgctgatcgttatacccgtcgttctgactgtcgccatggctggcct

SEQ ID NO: 41303 - DNA, 44 bp, Homo sapiens
  misc_feature 1..44: note = chr7:45807457-45807501
  misc_feature 1..44: note = hypo
  source 1..44: mol_type = genomic DNA
aaaatgctgggattaggggcgtgagccaccgggcctggcccaat

SEQ ID NO: 41304 - DNA, 113 bp, Homo sapiens
  misc_feature 1..113: note = chr7:47394819-47394932
  misc_feature 1..113: note = hypo
  source 1..113: mol_type = genomic DNA
aggacaccgagcctgcgaggcaggaggacgctcagtcattccggccccacaggaggagctggggatggtggggcctcagccccaggtgcatcctatgacgtaccttatccaaa

SEQ ID NO: 41305 - DNA, 30 bp, Homo sapiens
  misc_feature 1..30: note = chr7:47409179-47409209
  misc_feature 1..30: note = hypo
  source 1..30: mol_type = genomic DNA
cgtaaaggctgccatcgacagggccctgcg

SEQ ID NO: 41306 - DNA, 203 bp, Homo sapiens
  misc_feature 1..203: note = chr7:47420119-47420322
  misc_feature 1..203: note = hypo
  source 1..203: mol_type = genomic DNA
tggacaagtcctgagcgacattccttcttgcccggttaaagcatccgttctgctgattattccactccataacgccctctcctcctggctagtaccagctcttttcctctggaagtcttggcaagttggtaaatctcagcaggcacacagctcagtttcaggtctttgtagcattacagaagccacacacatgcacacacaca

SEQ ID NO: 41307 - DNA, 142 bp, Homo sapiens
  misc_feature 1..142: note = chr7:47420382-47420524
  misc_feature 1..142: note = hypo
  source 1..142: mol_type = genomic DNA
acaaatgctctctgcttaccttccttcaaaacagcccagcggctctctcagtctgcacctctgagcccagttttccttgacacaggctttcacagcaggacagtggcatgccagaggagggcgggggcgtgccacctccctc

SEQ ID NO: 41308 - DNA, 30 bp, Homo sapiens
  misc_feature 1..30: note = chr7:47449194-47449224
  misc_feature 1..30: note = hypo
  source 1..30: mol_type = genomic DNA
caaacaagatgagggcgggtgcaaatccta

SEQ ID NO: 41309 - DNA, 61 bp, Homo sapiens
  misc_feature 1..61: note = chr7:47586473-47586534
  misc_feature 1..61: note = hypo
  source 1..61: mol_type = genomic DNA
gctcaacaggcgctgcggatggaatgactaaaatgacaaagacagacgccaggttttaagg

SEQ ID NO: 41310 - DNA, 30 bp, Homo sapiens
  misc_feature 1..30: note = chr7:47702782-47702812
  misc_feature 1..30: note = hypo
  source 1..30: mol_type = genomic DNA
gccaggtgtgaggctcggtgtttggattgt

SEQ ID NO: 41311 - DNA, 16 bp, Homo sapiens
  misc_feature 1..16: note = chr7:49700766-49700782
  misc_feature 1..16: note = hypo
  source 1..16: mol_type = genomic DNA
gcgcccccggccggtc

SEQ ID NO: 41312 - DNA, 171 bp, Homo sapiens
  misc_feature 1..171: note = chr7:49740620-49740791
  misc_feature 1..171: note = hypo
  source 1..171: mol_type = genomic DNA
ctggcagcgctgcggcgacgcatccccagaggagcagcagcctctgacagcaacaccaagtgcaggagcggagggcgggggaagtcacctgctgccagggttccaccgtggggatgataagagggaacagcatgcaccactaagtgtgggagtcaacgataggtaggtttc

SEQ ID NO: 41313 - DNA, 30 bp, Homo sapiens
  misc_feature 1..30: note = chr7:50241354-50241384
  misc_feature 1..30: note = hypo
  source 1..30: mol_type = genomic DNA
gcgatacagtgcctgcgtgggcattcctgc

SEQ ID NO: 41314 - DNA, 153 bp, Homo sapiens
  misc_feature 1..153: note = chr7:50243557-50243710
  misc_feature 1..153: note = hypo
  source 1..153: mol_type = genomic DNA
gtatgataggttcctcgccttcataatattctcagttgtaaccatacagtcatttatgtgatactttggttaatctccatctccctccacgaggctctatgctttctgcaaacaagcaccatggtcattttctctcagcgccctatttccagt

SEQ ID NO: 41315 - DNA, 30 bp, Homo sapiens
  misc_feature 1..30: note = chr7:50251382-50251412
  misc_feature 1..30: note = hypo
  source 1..30: mol_type = genomic DNA
tccacacgctggcatcgggaggcaggtatc

SEQ ID NO: 41316 - DNA, 80 bp, Homo sapiens
  misc_feature 1..80: note = chr7:50294401-50294481
  misc_feature 1..80: note = hypo
  source 1..80: mol_type = genomic DNA
agactccatctcaaaaaaaaaaaaaaaaaaagattcctagtttcctaagaatttttatcatgaatcggtattcaattgta

SEQ ID NO: 41317 - DNA, 30 bp, Homo sapiens
  misc_feature 1..30: note = chr7:50337681-50337711
  misc_feature 1..30: note = hypo
  source 1..30: mol_type = genomic DNA
tcctgagagaggtgacgtaactcagctgag

SEQ ID NO: 41318 - DNA, 17 bp, Homo sapiens
  misc_feature 1..17: note = chr7:50365076-50365093
  misc_feature 1..17: note = hypo
  source 1..17: mol_type = genomic DNA
tttctatttataggccg

SEQ ID NO: 41319 - DNA, 30 bp, Homo sapiens
  misc_feature 1..30: note = chr7:50423094-50423124
  misc_feature 1..30: note = hypo
  source 1..30: mol_type = genomic DNA
gtaccggccaacgcccgccttgaggcctgg

SEQ ID NO: 41320 - DNA, 166 bp, Homo sapiens
  misc_feature 1..166: note = chr7:50438618-50438784
  misc_feature 1..166: note = hypo
  source 1..166: mol_type = genomic DNA
aagcagttccagctccgagtaacagaggaaggagtgagcgatttaggaactcacagaagggcacggccaggcaactcgggccctggcaaatgttccatagagacagcatccatggggttgaaccaagcacaatgcctgcaaatcgggcaggcgggttcatggaatt

SEQ ID NO: 41321 - DNA, 139 bp, Homo sapiens
  misc_feature 1..139: note = chr7:50444259-50444398
  misc_feature 1..139: note = hypo
  source 1..139: mol_type = genomic DNA
gatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggca

SEQ ID NO: 41322 - DNA, 30 bp, Homo sapiens
  misc_feature 1..30: note = chr7:50471189-50471219
  misc_feature 1..30: note = hypo
  source 1..30: mol_type = genomic DNA
cgctgtgtcttgttccgccccctccctgac

SEQ ID NO: 41323 - DNA, 106 bp, Homo sapiens
  misc_feature 1..106: note = chr7:50560557-50560663
  misc_feature 1..106: note = hypo
  source 1..106: mol_type = genomic DNA
gcatcagctctgcagcgtctgcggcagcctcggggcatcagctctgcggcaggcactccacgtcccgaaaggctcaactccttctcaccaccgcactgactaagca

SEQ ID NO: 41324 - DNA, 19 bp, Homo sapiens
  misc_feature 1..19: note = chr7:52268638-52268657
  misc_feature 1..19: note = hypo
  source 1..19: mol_type = genomic DNA
tttgtttgtttgagacgga

SEQ ID NO: 41325 - DNA, 30 bp, Homo sapiens
  misc_feature 1..30: note = chr7:52499272-52499302
  misc_feature 1..30: note = hypo
  source 1..30: mol_type = genomic DNA
cccacgagggtcacacgcagcctctgttcc

SEQ ID NO: 41326 - DNA, 43 bp, Homo sapiens
  misc_feature 1..43: note = chr7:52736850-52736893
  misc_feature 1..43: note = hypo
  source 1..43: mol_type = genomic DNA
ccatgcctgaggagtcgggcaggcggcccgcccaggccacgct

SEQ ID NO: 41327 - DNA, 30 bp, Homo sapiens
  misc_feature 1..30: note = chr7:53364402-53364432
  misc_feature 1..30: note = hypo
  source 1..30: mol_type = genomic DNA
ctccaggccatggaccgatactgttaggaa

SEQ ID NO: 41328 - DNA, 58 bp, Homo sapiens
  misc_feature 1..58: note = chr7:54794734-54794792
  misc_feature 1..58: note = hypo
  source 1..58: mol_type = genomic DNA
accgatgcctccgcccggctctctccgtgtcctgcacacagtacgccactacccgggg

SEQ ID NO: 41329 - DNA, 30 bp, Homo sapiens
  misc_feature 1..30: note = chr7:54866907-54866937
  misc_feature 1..30: note = hypo
  source 1..30: mol_type = genomic DNA
cccagtggaatccagcggtgtgcatgctca

SEQ ID NO: 41330 - DNA, 37 bp, Homo sapiens; identical to SEQ ID NO: 15001
  misc_feature 1..37: note = chr7:55145943-55145980
  misc_feature 1..37: note = hypo
  source 1..37: mol_type = genomic DNA

SEQ ID NO: 41331 - DNA, 42 bp, Homo sapiens
  misc_feature 1..42: note = chr7:55410245-55410287
  misc_feature 1..42: note = hypo
  source 1..42: mol_type = genomic DNA
ctcaaaaactgatgccgccaaggagcccgccatggccagccc

SEQ ID NO: 41332 - DNA, 30 bp, Homo sapiens
  misc_feature 1..30: note = chr7:55838624-55838654
  misc_feature 1..30: note = hypo
  source 1..30: mol_type = genomic DNA
gcctcccaggcagggcggtgcctgttctgg

SEQ ID NO: 41333 - DNA, 360 bp, Homo sapiens
  misc_feature 1..360: note = chr7:56017856-56018216
  misc_feature 1..360: note = hypo
  source 1..360: mol_type = genomic DNA
gcagagcttgcagtgagccgagattgtgagcgagactccgtctgaaaaaaaaaaaaaaatctaattgtatagaatattgttacaaccacacagaagaaaaaaaaagaatcccaagaaatgttgaacacagtgctgtcattgtacactctaaggacaaaaagaaccacaaaaaataatctcacgcatcacttagaaagtttgtttttagtcgggatattgttagtacaactccaaaagcatatagtgtatactataggatttagcattaatcattgatgttgtcggggtagggaccagagttctaactgtggaagaaaggagataaaaatacggaactggtgaagcaaaagaagaaaccca

SEQ ID NO: 41334 - DNA, 30 bp, Homo sapiens
  misc_feature 1..30: note = chr7:56144506-56144536
  misc_feature 1..30: note = hypo
  source 1..30: mol_type = genomic DNA
cctccttgctctcctcgcaggtcaagttta

SEQ ID NO: 41335 - DNA, 42 bp, Homo sapiens
  misc_feature 1..42: note = chr7:57247720-57247762
  misc_feature 1..42: note = hypo
  source 1..42: mol_type = genomic DNA
agcacacagcaacagcggcccaaacgccgtgcaggccacacc

SEQ ID NO: 41336 - DNA, 21 bp, Homo sapiens
  misc_feature 1..21: note = chr7:57655640-57655661
  misc_feature 1..21: note = hypo
  source 1..21: mol_type = genomic DNA
ccaccgcgcctggcccatata

SEQ ID NO: 41337 - DNA, 30 bp, Homo sapiens
  misc_feature 1..30: note = chr7:63393332-63393362
  misc_feature 1..30: note = hypo
  source 1..30: mol_type = genomic DNA
gccactgtgcctggccggtttggaagaaat

SEQ ID NO: 41338 - DNA, 30 bp, Homo sapiens
  misc_feature 1..30: note = chr7:63574716-63574746
  misc_feature 1..30: note = hypo
  source 1..30: mol_type = genomic DNA
cagcatcaacaagcacgaggatgcggacct

SEQ ID NO: 41339 - DNA, 151 bp, Homo sapiens
  misc_feature 1..151: note = chr7:63666590-63666741
  misc_feature 1..151: note = hypo
  source 1..151: mol_type = genomic DNA
agaaccgggaaggtggggaggggagatgtgccacatttttaaaccatcgggtatcttgagagctcccttattatcccaagaacaggatgaggataatccaccccaatgatccaatcacctcttacacagtccctaccgtgacacatgggaa

SEQ ID NO: 41340 - DNA, 28 bp, Homo sapiens
  misc_feature 1..28: note = chr7:65236287-65236315
  misc_feature 1..28: note = hypo
  source 1..28: mol_type = genomic DNA
tgaggctccctgggccgtgctatcccgg

SEQ ID NO: 41341 - DNA, 42 bp, Homo sapiens
  misc_feature 1..42: note = chr7:65879595-65879637
  misc_feature 1..42: note = hypo
  source 1..42: mol_type = genomic DNA
gtaaagtaattgggccggccccgtggctcaggggcccttaat

SEQ ID NO: 41342 - DNA, 81 bp, Homo sapiens
  misc_feature 1..81: note = chr7:65880043-65880124
  misc_feature 1..81: note = hypo
  source 1..81: mol_type = genomic DNA
ttcagtttactgcttcgatatcttttcctaattgattgttaattaagttctgcctagcaagtataaaaacctctgcctcct

SEQ ID NO: 41343 - DNA, 30 bp, Homo sapiens
  misc_feature 1..30: note = chr7:65969625-65969655
  misc_feature 1..30: note = hypo
  source 1..30: mol_type = genomic DNA
gaaaatatcagttcccgagtctccatgcgt

SEQ ID NO: 41344 - DNA, 40 bp, Homo sapiens
  misc_feature 1..40: note = chr7:66215014-66215054
  misc_feature 1..40: note = hypo
  source 1..40: mol_type = genomic DNA
ataactggtgtctcacgagataatacgtttgggtcctgtt

SEQ ID NO: 41345 - DNA, 40 bp, Homo sapiens
  misc_feature 1..40: note = chr7:67161739-67161779
  misc_feature 1..40: note = hypo
  source 1..40: mol_type = genomic DNA
cacctgcagatcaaacgtgcacacccggtgccagtcaaaa

SEQ ID NO: 41346 - DNA, 49 bp, Homo sapiens
  misc_feature 1..49: note = chr7:68000342-68000391
  misc_feature 1..49: note = hypo
  source 1..49: mol_type = genomic DNA
ccctgccagggctggcggggctggctggtggctccgactgtggggccct

SEQ ID NO: 41347 - DNA, 190 bp, Homo sapiens
  misc_feature 1..190: note = chr7:68204758-68204948
  misc_feature 1..190: note = hypo
  source 1..190: mol_type = genomic DNA
ttcagaagtgactttcgaggaaatttggtcccgttcccaagcaataaagccgtcgcatcataatcagcttagaacaatttgccaatgatagttttctgtgttgcgccatcagagattctgattcagcaagtcctcgttggatctcatacatctcaattaaaaatcaacaatagatcgggcgtggtggctc

SEQ ID NO: 41348 - DNA, 27 bp, Homo sapiens
  misc_feature 1..27: note = chr7:68982718-68982745
  misc_feature 1..27: note = hypo
  source 1..27: mol_type = genomic DNA
tgtgagccaccgcgcctggccattgct

SEQ ID NO: 41349 - DNA, 100 bp, Homo sapiens
  misc_feature 1..100: note = chr7:69032251-69032351
  misc_feature 1..100: note = hypo
  source 1..100: mol_type = genomic DNA
tggataaataaaatacggtaaatatctatgacgaaatattatttggcaacaaaagggaattaagaatacatgctactgtatggatgaatcctgaaaacgc

SEQ ID NO: 41350 - DNA, 42 bp, Homo sapiens; identical to SEQ ID NO: 15004
  misc_feature 1..42: note = chr7:69036110-69036152
  misc_feature 1..42: note = hypo
  source 1..42: mol_type = genomic DNA

SEQ ID NO: 41351 - DNA, 179 bp, Homo sapiens; identical to SEQ ID NO: 15005
  misc_feature 1..179: note = chr7:69313694-69313873
  misc_feature 1..179: note = hypo
  source 1..179: mol_type = genomic DNA

SEQ ID NO: 41352 - DNA, 30 bp, Homo sapiens
  misc_feature 1..30: note = chr7:69698849-69698879
  misc_feature 1..30: note = hypo
  source 1..30: mol_type = genomic DNA
ctatactggctttaccgcaagggttaaatt

SEQ ID NO: 41353 - DNA, 18 bp, Homo sapiens
  misc_feature 1..18: note = chr7:70728615-70728633
  misc_feature 1..18: note = hypo
  source 1..18: mol_type = genomic DNA
cctcagtgatctggccgg

SEQ ID NO: 41354 - DNA, 19 bp, Homo sapiens
  misc_feature 1..19: note = chr7:71256983-71257002
  misc_feature 1..19: note = hypo
  source 1..19: mol_type = genomic DNA
actccgtctcaaaaaaaga

SEQ ID NO: 41355 - DNA, 30 bp, Homo sapiens
  misc_feature 1..30: note = chr7:71296085-71296115
  misc_feature 1..30: note = hypo
  source 1..30: mol_type = genomic DNA
gccactaactagttgcgtaccctgaagcag

SEQ ID NO: 41356 - DNA, 30 bp, Homo sapiens
  misc_feature 1..30: note = chr7:71880817-71880847
  misc_feature 1..30: note = hypo
  source 1..30: mol_type = genomic DNA
ctgcaggtaccaccacgctccttcacctag

SEQ ID NO: 41357 - DNA, 30 bp, Homo sapiens
  misc_feature 1..30: note = chr7:75975426-75975456
  misc_feature 1..30: note = hypo
  source 1..30: mol_type = genomic DNA
gtcgtcactgtcttccgaccccaggcatcc

SEQ ID NO: 41358 - DNA, 49 bp, Homo sapiens
  misc_feature 1..49: note = chr7:76106331-76106380
  misc_feature 1..49: note = hypo
  source 1..49: mol_type = genomic DNA
gatgatggaggcggccgtggctgcccgagagatgcgtgacacccaggag

SEQ ID NO: 41359 - DNA, 28 bp, Homo sapiens
  misc_feature 1..28: note = chr7:77309374-77309402
  misc_feature 1..28: note = hypo
  source 1..28: mol_type = genomic DNA
tggagtgcagtggtccgcctcccgggtt

SEQ ID NO: 41360 - DNA, 28 bp, Homo sapiens
  misc_feature 1..28: note = chr7:77309582-77309610
  misc_feature 1..28: note = hypo
  source 1..28: mol_type = genomic DNA
aggcgtgagccatcgtgcccggccagac

SEQ ID NO: 41361 - DNA, 28 bp, Homo sapiens
  misc_feature 1..28: note = chr7:77928410-77928438
  misc_feature 1..28: note = hypo
  source 1..28: mol_type = genomic DNA
aggcgtgagctaccgtgcctggctataa

SEQ ID NO: 41362 - DNA, 23 bp, Homo sapiens
  misc_feature 1..23: note = chr7:84936791-84936814
  misc_feature 1..23: note = hypo
  source 1..23: mol_type = genomic DNA
accgcgctcggccttgtttacca

SEQ ID NO: 41363 - DNA, 39 bp, Homo sapiens
  misc_feature 1..39: note = chr7:86228129-86228168
  misc_feature 1..39: note = hypo
  source 1..39: mol_type = genomic DNA
aggaggctgaatccacggggctgagcagcgaccatctgc

SEQ ID NO: 41364 - DNA, 42 bp, Homo sapiens
  misc_feature 1..42: note = chr7:86416083-86416125
  misc_feature 1..42: note = hypo
  source 1..42: mol_type = genomic DNA
gcctcccagcctgtccgccagttcgaccgctacttccagagc

SEQ ID NO: 41365 - DNA, 16 bp, Homo sapiens
  misc_feature 1..16: note = chr7:90269563-90269579
  misc_feature 1..16: note = hypo
  source 1..16: mol_type = genomic DNA
tcggccatcttggctc

SEQ ID NO: 41366 - DNA, 30 bp, Homo sapiens
  misc_feature 1..30: note = chr7:91510852-91510882
  misc_feature 1..30: note = hypo
  source 1..30: mol_type = genomic DNA
gttatcctcaggagacgatggtgatttggt

SEQ ID NO: 41367 - DNA, 30 bp, Homo sapiens
  misc_feature 1..30: note = chr7:93055830-93055860
  misc_feature 1..30: note = hypo
  source 1..30: mol_type = genomic DNA
gggcgcctcccccaacgctggttccactga

SEQ ID NO: 41368 - DNA, 83 bp, Homo sapiens
  misc_feature 1..83: note = chr7:94138070-94138153
  misc_feature 1..83: note = hypo
  source 1..83: mol_type = genomic DNA
aaccaacgttagtagcggggatgattgtcataagcacattaagaaaaattttttttggctaggcttggtggctcatgcctgta

SEQ ID NO: 41369 - DNA, 30 bp, Homo sapiens
  misc_feature 1..30: note = chr7:97591443-97591473
  misc_feature 1..30: note = hypo
  source 1..30: mol_type = genomic DNA
tatttcttatatcctcgggcaatgttgctt

SEQ ID NO: 41370 - DNA, 90 bp, Homo sapiens
  misc_feature 1..90: note = chr7:97600089-97600179
  misc_feature 1..90: note = hypo
  source 1..90: mol_type = genomic DNA
cttagctattgaaaacgctaagttcagtgtcgacctcttgtgtcgcacatgctaatgacaaaaccaaagaaaaaccggttttagaaaaac

SEQ ID NO: 41371 - DNA, 41 bp, Homo sapiens; identical to SEQ ID NO: 15007
  misc_feature 1..41: note = chr7:97797757-97797798
  misc_feature 1..41: note = hypo
  source 1..41: mol_type = genomic DNA

SEQ ID NO: 41372 - DNA, 30 bp, Homo sapiens
  misc_feature 1..30: note = chr7:97804272-97804302
  misc_feature 1..30: note = hypo
  source 1..30: mol_type = genomic DNA
catgcatttgcagaacgttctgtgagtagt

SEQ ID NO: 41373 - DNA, 30 bp, Homo sapiens
  misc_feature 1..30: note = chr7:97807742-97807772
  misc_feature 1..30: note = hypo
  source 1..30: mol_type = genomic DNA
atcgctctgctcatgcggccctgagtctca

SEQ ID NO: 41374 - DNA, 30 bp, Homo sapiens
  misc_feature 1..30: note = chr7:97834167-97834197
  misc_feature 1..30: note = hypo
  source 1..30: mol_type = genomic DNA
gctcttcagcaggctcgtaagagcacttga

SEQ ID NO: 41375 - DNA, 27 bp, Homo sapiens
  misc_feature 1..27: note = chr7:97869134-97869161
  misc_feature 1..27: note = hypo
  source 1..27: mol_type = genomic DNA
gtgactggccaggcacggtggctcatg

SEQ ID NO: 41376 - DNA, 266 bp, Homo sapiens
  misc_feature 1..266: note = chr7:97869401-97869667
  misc_feature 1..266: note = hypo
  source 1..266: mol_type = genomic DNA
cagagcgacactccgtctcaaaaaaaacaaacaaaagaaaaaccctgtgagtaatcggaaatcggctggttttattggacttgccgctgataagatgcaaaagacaagcagtgactagaggatggggaggcgcttggttaatcaagggcttcaggaaattcgcttccgattcttcgaaatgttgcagcctattaggtgatacttgcagttgctgcatttgggtaccagcgtgtgggtggaagaggattttacggcacaaaacgtcc

SEQ ID NO: 41377 - DNA, 42 bp, Homo sapiens
  misc_feature 1..42: note = chr7:97882348-97882390
  misc_feature 1..42: note = hypo
  source 1..42: mol_type = genomic DNA
aaaaaagaaagatgtcggccaggtgcggcggttcatacctgt

SEQ ID NO: 41378 - DNA, 48 bp, Homo sapiens
  misc_feature 1..48: note = chr7:97899729-97899777
  misc_feature 1..48: note = hypo
  source 1..48: mol_type = genomic DNA
ctgtccagttcctcccgggcctcccaacgcccccgatggctccttccc

SEQ ID NO: 41379 - DNA, 48 bp, Homo sapiens
  misc_feature 1..48: note = chr7:98121881-98121929
  misc_feature 1..48: note = hypo
  source 1..48: mol_type = genomic DNA
ttttgcttggagcatcgacttataaccccagcccgagagagccgtggc

SEQ ID NO: 41380 - DNA, 198 bp, Homo sapiens; identical to SEQ ID NO: 15009
  misc_feature 1..198: note = chr7:98183080-98183278
  misc_feature 1..198: note = hypo
  source 1..198: mol_type = genomic DNA

SEQ ID NO: 41381 - DNA, 30 bp, Homo sapiens
  misc_feature 1..30: note = chr7:98970776-98970806
  misc_feature 1..30: note = hypo
  source 1..30: mol_type = genomic DNA
actaccctagggggtcgaattcagtggaaa

SEQ ID NO: 41382 - DNA, 43 bp, Homo sapiens
  misc_feature 1..43: note = chr7:98971547-98971590
  misc_feature 1..43: note = hypo
  source 1..43: mol_type = genomic DNA
tcactggggtctcttccatctgcctggccgccaggccacgtat

SEQ ID NO: 41383 - DNA, 263 bp, Homo sapiens
  misc_feature 1..263: note = chr7:98991519-98991782
  misc_feature 1..263: note = hypo
  source 1..263: mol_type = genomic DNA
cccactacaccccctcggtacttctcactaaagcccgctccccaagaagtctgggagcgcctggtggacagggtgggcctgagcccagcgccagcacaggttgaattcataagctcctcttcctctttgcagccagatctcggtgctcagcggcggcaaggccaagtgctcgcagttctgcaccactggcatggatggcggcatgagtatctgggatgtgaaggtgaggcttgcccctcctggcttcccgccatgcctcccag

SEQ ID NO: 41384 - DNA, 389 bp, Homo sapiens
  misc_feature 1..389: note = chr7:99020748-99021137
  misc_feature 1..389: note = hypo
  source 1..389: mol_type = genomic DNA
tgcagtggcgcgatcttggctcacaacaaatctcaggtattcaccccagacaatgacaccacttcactgcctgcccagtccctgagcaagcgacaacctgtttggagtacccagcaacgtgcaggtgctggggacccagatgagcacagcagacagcctctgcctccagaagcctgatacagggaaggccagggctgcccatgagcacatgatccaagactgtaggacacggcataaaggaacagagtgggaagggggaggggagactttcatcccaggtcagagcggcagccagctgggcatgtctgagggccacttaagcagagacctccaggaaaagtgggtgccacctgaggcagcgggaacaccaatcccgaagcaggcaagag

SEQ ID NO: 41385 - DNA, 30 bp, Homo sapiens
  misc_feature 1..30: note = chr7:99591732-99591762
  misc_feature 1..30: note = hypo
  source 1..30: mol_type = genomic DNA
gcactccagcttgggcgacagagactctgg

SEQ ID NO: 41386 - DNA, 22 bp, Homo sapiens
  misc_feature 1..22: note = chr7:99649204-99649226
  misc_feature 1..22: note = hypo
  source 1..22: mol_type = genomic DNA
acggcgccgggccccctaggga

SEQ ID NO: 41387 - DNA, 43 bp, Homo sapiens
  misc_feature 1..43: note = chr7:99691859-99691902
  misc_feature 1..43: note = hypo
  source 1..43: mol_type = genomic DNA
ctagcccaagcctctcgcctcatctccacgtatgctgctgtga

SEQ ID NO: 41388 - DNA, 37 bp, Homo sapiens; identical to SEQ ID NO: 15013
  misc_feature 1..37: note = chr7:99700198-99700235
  misc_feature 1..37: note = hypo
  source 1..37: mol_type = genomic DNA

SEQ ID NO: 41389 - DNA, 87 bp, Homo sapiens
  misc_feature 1..87: note = chr7:99723146-99723233
  misc_feature 1..87: note = hypo
  source 1..87: mol_type = genomic DNA
gtttcaaacaacagccgggcacacatagctagctggtcgatgaggcagcacccagaatggccgctgtcttgttaagctcaagctcca

SEQ ID NO: 41390 - DNA, 41 bp, Homo sapiens
  misc_feature 1..41: note = chr7:99839918-99839959
  misc_feature 1..41: note = hypo
  source 1..41: mol_type = genomic DNA
ctgcaactggaagggcgatcctgaacaggagttattttgcc

SEQ ID NO: 41391 - DNA, 21 bp, Homo sapiens
  misc_feature 1..21: note = chr7:99934962-99934983
  misc_feature 1..21: note = hypo
  source 1..21: mol_type = genomic DNA
ccaccacgcccagctgccttg

SEQ ID NO: 41392 - DNA, 189 bp, Homo sapiens
  misc_feature 1..189: note = chr7:100088128-100088317
  misc_feature 1..189: note = hypo
  source 1..189: mol_type = genomic DNA
catcccagcagaggtcgaggacggtgcccgggcctggaatggcagtgccgagggtccaggcaaggtggagcgtgaggacaggggccctgggacatcggggatcccagtgagaagccagggggcagagggactgctggccaggatccaccatggagaccgaggagggagccgcaccgcgctgcccattcc

SEQ ID NO: 41393 - DNA, 89 bp, Homo sapiens
  misc_feature 1..89: note = chr7:100104071-100104160
  misc_feature 1..89: note = hypo
  source 1..89: mol_type = genomic DNA
agtgctgggattataggtttgagcactcgtgtccagccagtgttacaacttttattgaagcttcagtgcacagccgcagcaaaggtacg

SEQ ID NO: 41394 - DNA, 30 bp, Homo sapiens
  misc_feature 1..30: note = chr7:100118785-100118815
  misc_feature 1..30: note = hypo
  source 1..30: mol_type = genomic DNA
tatcttttggtttgccgatgtttctaggta

SEQ ID NO: 41395 - DNA, 89 bp, Homo sapiens
  misc_feature 1..89: note = chr7:100179713-100179802
  misc_feature 1..89: note = hypo
  source 1..89: mol_type = genomic DNA
gcttgttgttgctgacgatgaggaccctcaggggcagctggcagatgtagggtggcagcagcgacagctggtttcggctgtggaaggga

SEQ ID NO: 41396 - DNA, 83 bp, Homo sapiens
  misc_feature 1..83: note = chr7:100279918-100280001
  misc_feature 1..83: note = hypo
  source 1..83: mol_type = genomic DNA
ccacctcctgggagccgctcgcccaccgtccaggctgcccgtggcgctcagcgtgtgcagcatctgctcgcaccactgggtga

SEQ ID NO: 41397 - DNA, 39 bp, Homo sapiens
  misc_feature 1..39: note = chr7:100391505-100391544
  misc_feature 1..39: note = hypo
  source 1..39: mol_type = genomic DNA
caacctggcagaccccggggactgcgagggcccctgcgt

SEQ ID NO: 41398 - DNA, 300 bp, Homo sapiens
  misc_feature 1..300: note = chr7:100490045-100490345
  misc_feature 1..300: note = hypo
  source 1..300: mol_type = genomic DNA
tcccaaagatgaactcgatctcgtagccgtggggcacccccatccacaggggccaggagagcgtggaagcacggtgttcaaagacgtaggcgtagacccgggcaccctgggcagccagtcgcccagccagctgggccacggggcacacgacattgtggtcgcccaccacatcgctcagggcctccctcaggcgtgccgggtcctcgggatgcagccagtctgtgtaatgcaggaccacagcctcggctgccaggtcacttacctggggaaccccgacccgcaccccggccaggaactcgg

SEQ ID NO: 41399 - DNA, 22 bp, Homo sapiens
  misc_feature 1..22: note = chr7:100495308-100495330
  misc_feature 1..22: note = hypo
  source 1..22: mol_type = genomic DNA
agcactctgggaggccgagaca

SEQ ID NO: 41400 - DNA, 17 bp, Homo sapiens
  misc_feature 1..17: note = chr7:100723832-100723849
  misc_feature 1..17: note = hypo
  source 1..17: mol_type = genomic DNA
gtttgttttttgagacg

SEQ ID NO: 41401 - DNA, 145 bp, Homo sapiens
  misc_feature 1..145: note = chr7:100799106-100799251
  misc_feature 1..145: note = hypo
  source 1..145: mol_type = genomic DNA
caggcatttctttggcgtcggttactgtcgtcttgtcactgtgctaggcattttacttacctttagaaagcagaccagaaagcaagaggtcagggaatcatggtaataatagtaataactaacggccgggcgcagtggctcatgc

SEQ ID NO: 41402 - DNA, 30 bp, Homo sapiens
  misc_feature 1..30: note = chr7:100858230-100858260
  misc_feature 1..30: note = hypo
  source 1..30: mol_type = genomic DNA
aaccagccactcagacgcctgacaaaacca

SEQ ID NO: 41403 - DNA, 39 bp, Homo sapiens
  misc_feature 1..39: note = chr7:100894771-100894810
  misc_feature 1..39: note = hypo
  source 1..39: mol_type = genomic DNA
aaatacagcctaggccggccgtggtggctcacgcctgta

SEQ ID NO: 41404 - DNA, 34 bp, Homo sapiens
  misc_feature 1..34: note = chr7:100897086-100897120
  misc_feature 1..34: note = hypo
  source 1..34: mol_type = genomic DNA
attcattcattcattcgcccgttcatttagcaaa

SEQ ID NO: 41405 - DNA, 30 bp, Homo sapiens
  misc_feature 1..30: note = chr7:100967105-100967135
  misc_feature 1..30: note = hypo
  source 1..30: mol_type = genomic DNA
gcttcctcacctcagcgtttacttcattgc

SEQ ID NO: 41406 - DNA, 16 bp, Homo sapiens
  misc_feature 1..16: note = chr7:101056509-101056525
  misc_feature 1..16: note = hypo
  source 1..16: mol_type = genomic DNA
agacttgtggccgggc

SEQ ID NO: 41407 - DNA, 87 bp, Homo sapiens
  misc_feature 1..87: note = chr7:101131936-101132023
  misc_feature 1..87: note = hypo
  source 1..87: mol_type = genomic DNA
gtaagccaccgcgcccgaactttaaccagttttaagcgttcaattcagccgtgttaggtaccgtcacactgtcgtccagccatctcc

SEQ ID NO: 41408 - DNA, 177 bp, Homo sapiens
  misc_feature 1..177: note = chr7:101241846-101242023
  misc_feature 1..177: note = hypo
  source 1..177: mol_type = genomic DNA
cggaaactggcaagccgccggagggcctcgtcaaggctttgatgaccctgtgctgaggacgcaaatcctaggcctggccgacaccctgctccaaggaccaatgactgaggccagagagggtcccagatggagcctgggtaggggtgaaactgcacaggcggacgggcagagcgtcca

SEQ ID NO: 41409 - DNA, 30 bp, Homo sapiens
  misc_feature 1..30: note = chr7:101475790-101475820
  misc_feature 1..30: note = hypo
  source 1..30: mol_type = genomic DNA
caaacacaagtggggcgacaggacccacac

SEQ ID NO: 41410 - DNA, 30 bp, Homo sapiens
  misc_feature 1..30: note = chr7:101627816-101627846
  misc_feature 1..30: note = hypo
  source 1..30: mol_type = genomic DNA
ccctgcactctcaggcgagctgttgggtgc

SEQ ID NO: 41411 - DNA, 34 bp, Homo sapiens
  misc_feature 1..34: note = chr7:101630517-101630551
  misc_feature 1..34: note = hypo
  source 1..34: mol_type = genomic DNA
gcttgcacagaagtccgtgcgtgagccacgacgg

SEQ ID NO: 41412 - DNA, 115 bp, Homo sapiens
  misc_feature 1..115: note = chr7:101652590-101652705
  misc_feature 1..115: note = hypo
  source 1..115: mol_type = genomic DNA
gttaggatccctccacggatgtggccaggtgacacccctcacctaggccgcacagcaccctaatgtacacactgaagaaaggctgcgtggggctgcagagcggctcatttctaag

SEQ ID NO: 41413 - DNA, 78 bp, Homo sapiens; identical to SEQ ID NO: 15018
  misc_feature 1..78: note = chr7:101656381-101656459
  misc_feature 1..78: note = hypo
  source 1..78: mol_type = genomic DNA

SEQ ID NO: 41414 - DNA, 30 bp, Homo sapiens
  misc_feature 1..30: note = chr7:101707051-101707081
  misc_feature 1..30: note = hypo
  source 1..30: mol_type = genomic DNA
tgcagttggccattgcggaagatattaaaa

SEQ ID NO: 41415 - DNA, 38 bp, Homo sapiens
  misc_feature 1..38: note = chr7:101707502-101707540
  misc_feature 1..38: note = hypo
  source 1..38: mol_type = genomic DNA
agagtgtgtgtgaaacggagttttgctgtgttgcccag

SEQ ID NO: 41416 - DNA, 38 bp, Homo sapiens
  misc_feature 1..38: note = chr7:101707600-101707638
  misc_feature 1..38: note = hypo
  source 1..38: mol_type = genomic DNA
attacaggcatgagcaacggtgccggctctaaatggtt

SEQ ID NO: 41417 - DNA, 97 bp, Homo sapiens
  misc_feature 1..97: note = chr7:102097002-102097099
  misc_feature 1..97: note = hypo
  source 1..97: mol_type = genomic DNA
cctacttgttaacagcgttatggggctggaaggaggctctcagatttccctgccctcctcacatcccccaaccctccctgggcgtgggggtgtcaag

SEQ ID NO: 41418 - DNA, 29 bp, Homo sapiens
  misc_feature 1..29: note = chr7:102232246-102232275
  misc_feature 1..29: note = hypo
  source 1..29: mol_type = genomic DNA
acaacctggtaaggtcggatcaacttcct

SEQ ID NO: 41419 - DNA, 204 bp, Homo sapiens
  misc_feature 1..204: note = chr7:105279467-105279671
  misc_feature 1..204: note = hypo
  source 1..204: mol_type = genomic DNA
atacagggctttgggcgacccaatggcggccgccttgggtcagctgttcccctggccaccccggtgtggctggatcaggggcgcggcatatcatcctcccctccagggctgcctttcagggcgctgccgccgccgccgccgccgctgccgctgctcctgcatacattaaaacgtagcaggctttagaaccgcctgtgagtgcct

SEQ ID NO: 41420 - DNA, 30 bp, Homo sapiens
  misc_feature 1..30: note = chr7:105280417-105280447
  misc_feature 1..30: note = hypo
  source 1..30: mol_type = genomic DNA
ccacctgagacccaacgacccctttcctgg

SEQ ID NO: 41421 - DNA, 30 bp, Homo sapiens
  misc_feature 1..30: note = chr7:105288193-105288223
  misc_feature 1..30: note = hypo
  source 1..30: mol_type = genomic DNA
cttaaggcagccccacgagcacaggtgcac

SEQ ID NO: 41422 - DNA, 30 bp, Homo sapiens
  misc_feature 1..30: note = chr7:106123211-106123241
  misc_feature 1..30: note = hypo
  source 1..30: mol_type = genomic DNA
gtctgctggagctgccgtagtaaaatgcta

SEQ ID NO: 41423 - DNA, 90 bp, Homo sapiens
  misc_feature 1..90: note = chr7:106123301-106123391
  misc_feature 1..90: note = hypo
  source 1..90: mol_type = genomic DNA
caagatcaaggtgctggtgaggcaggttttattctgagttctcttctcttagccagtaggcagctgcgacctcaccgtgtgctcacgtga

SEQ ID NO: 41424 - DNA, 290 bp, Homo sapiens
  misc_feature 1..290: note = chr7:106508656-106508946
  misc_feature 1..290: note = hypo
  source 1..290: mol_type = genomic DNA
caactgcatcttcatcgtcattcaccgcagcaccaccagccagaccattaaggtctcacccgacgacacccccggcgccatcctgcagagcttcttcaccaagatggccaagaagaaatctctgatggatattcccgaaagccaaagcgaacaggattttgtgctgcgcgtctgtggccgggatgagtacctggtgggcgaaacgcccatcaaaaacttccagtgggtgaggcactgcctcaagaacggagaagagattcacgtggtactggacacgcctccagacccgg

SEQ ID NO: 41425 - DNA, 32 bp, Homo sapiens
  misc_feature 1..32: note = chr7:106609365-106609397
  misc_feature 1..32: note = hypo
  source 1..32: mol_type = genomic DNA
cgggtgcatggctcacgcctgtaatcccagca

SEQ ID NO: 41426 - DNA, 42 bp, Homo sapiens
  misc_feature 1..42: note = chr7:106651496-106651538
  misc_feature 1..42: note = hypo
  source 1..42: mol_type = genomic DNA
tgtcccatagtgggccgggcgtggtggctcacgcctgtaatc

SEQ ID NO: 41427 - DNA, 37 bp, Homo sapiens
  misc_feature 1..37: note = chr7:106748373-106748410
  misc_feature 1..37: note = hypo
  source 1..37: mol_type = genomic DNA
tacaggcgtgagatgctgtgcccggccaagagatgtt

SEQ ID NO: 41428 - DNA, 43 bp, Homo sapiens
  misc_feature 1..43: note = chr7:106796956-106796999
  misc_feature 1..43: note = hypo
  source 1..43: mol_type = genomic DNA
ctcttcatttagggccgggctcggtggctcacgcctgtaatcc

SEQ ID NO: 41429 - DNA, 41 bp, Homo sapiens
  misc_feature 1..41: note = chr7:106797653-106797694
  misc_feature 1..41: note = hypo
  source 1..41: mol_type = genomic DNA
tggtgcagtagaaatcgctcgatgctcgcggggacagtact

SEQ ID NO: 41430 - DNA, 24 bp, Homo sapiens
  misc_feature 1..24: note = chr7:106802882-106802906
  misc_feature 1..24: note = hypo
  source 1..24: mol_type = genomic DNA
gcgagactccgtccataaaacaaa

SEQ ID NO: 41431 - DNA, 121 bp, Homo sapiens
  misc_feature 1..121: note = chr7:106837489-106837610
  misc_feature 1..121: note = hypo
  source 1..121: mol_type = genomic DNA
ccagagttgtcaaaacggtgaacttaagagctgtcctcagtagaagctggaaataaaaatcaactcaagtccttcctactctgttgcctgtacccttactcatctccgagtcctctactgc

SEQ ID NO: 41432 - DNA, 90 bp, Homo sapiens
  misc_feature 1..90: note = chr7:107148303-107148393
  misc_feature 1..90: note = hypo
  source 1..90: mol_type = genomic DNA
ataatgcttctatgacgtatttggttttaagaatattctctcatggggtgggtggagctaagatggctgaacaggaacagctcccagcgt

SEQ ID NO: 41433 - DNA, 173 bp, Homo sapiens
  misc_feature 1..173: note = chr7:107483694-107483867
  misc_feature 1..173: note = hypo
  source 1..173: mol_type = genomic DNA
atttcagcagagacccgcaggtacaaggacaccacccaggcgaggagccagaaagagcagccgcagcaggtggagcgcatgggcagaggggcggtggtgggacacgcgactgtttgggattgagcgaggccacctaagcagattgcggtgagtgagcgcggaatgacgtcact

SEQ ID NO: 41434 - DNA, 150 bp, Homo sapiens
  misc_feature 1..150: note = chr7:108515007-108515157
  misc_feature 1..150: note = hypo
  source 1..150: mol_type = genomic DNA
gtgtacggtgcatggcggcttccctccttgccccctcccctcctggctcaggcacctgggcatacccgcagcatgcaacaaccacacccaattgtcacgaggggtgggagaaaactgaggctgccaatgggacctcgtgtggctggctgg

SEQ ID NO: 41435 - DNA, 30 bp, Homo sapiens
  misc_feature 1..30: note = chr7:111662581-111662611
  misc_feature 1..30: note = hypo
  source 1..30: mol_type = genomic DNA
gctacttattaacgacgtgagcccagccag

SEQ ID NO: 41436 - DNA, 33 bp, Homo sapiens
  misc_feature 1..33: note = chr7:115738436-115738469
  misc_feature 1..33: note = hypo
  source 1..33: mol_type = genomic DNA
tgaaccactgcgcccagccgcaaccaagaataa

SEQ ID NO: 41437 - DNA, 16 bp, Homo sapiens
  misc_feature 1..16: note = chr7:116492607-116492623
  misc_feature 1..16: note = hypo
  source 1..16: mol_type = genomic DNA
ccgagtagctggaact

SEQ ID NO: 41438 - DNA, 16 bp, Homo sapiens
  misc_feature 1..16: note = chr7:123175665-123175681
  misc_feature 1..16: note = hypo
  source 1..16: mol_type = genomic DNA
agagtcttgctctgtc

SEQ ID NO: 41439 - DNA, 30 bp, Homo sapiens
  misc_feature 1..30: note = chr7:127371129-127371159
  misc_feature 1..30: note = hypo
  source 1..30: mol_type = genomic DNA
gtctgggaggagctgcgtagccagggctcc

SEQ ID NO: 41440 - DNA, 102 bp, Homo sapiens
  misc_feature 1..102: note = chr7:128096987-128097089
  misc_feature 1..102: note = hypo
  source 1..102: mol_type = genomic DNA
ttacaggtatgagccaccgcgcctggcctaagaaagtaaaagttttaagaagtgttcttgaattagtccaagaagcaacactggctccgcagccatgaagtt

SEQ ID NO: 41441 - DNA, 30 bp, Homo sapiens; identical to SEQ ID NO: 1575
  misc_feature 1..30: note = chr7:128097589-128097619
  misc_feature 1..30: note = hypo
  source 1..30: mol_type = genomic DNA

SEQ ID NO: 41442 - DNA, 103 bp, Homo sapiens
  misc_feature 1..103: note = chr7:128315917-128316020
  misc_feature 1..103: note = hypo
  source 1..103: mol_type = genomic DNA
aggcttgagggagggcgggaagggatggaatgattgactgggatatgcattgctttgtagctggattttagatcaaaagaaaagatagcgttctttagtgcat

SEQ ID NO: 41443 - DNA, 30 bp, Homo sapiens
  misc_feature 1..30: note = chr7:128483019-128483049
  misc_feature 1..30: note = hypo
  source 1..30: mol_type = genomic DNA
cctgggtactcacagcgacatgcacctgcc

SEQ ID NO: 41444 - DNA, 54 bp, Homo sapiens
  misc_feature 1..54: note = chr7:128486164-128486218
  misc_feature 1..54: note = hypo
  source 1..54: mol_type = genomic DNA
gacagacaatggggacggcacctaccgagtgcagtacaccgcctacgaggaggg

SEQ ID NO: 41445 - DNA, 40 bp, Homo sapiens
  misc_feature 1..40: note = chr7:128493190-128493230
  misc_feature 1..40: note = hypo
  source 1..40: mol_type = genomic DNA
ttcctgaccagtctgcgtcaggattcgcattctggggccc

SEQ ID NO: 41446 - DNA, 30 bp, Homo sapiens
  misc_feature 1..30: note = chr7:128525170-128525200
  misc_feature 1..30: note = hypo
  source 1..30: mol_type = genomic DNA
tcatggggcccttggcggggctgggcgcaa

SEQ ID NO: 41447 - DNA, 47 bp, Homo sapiens
  misc_feature 1..47: note = chr7:128528840-128528887
  misc_feature 1..47: note = hypo
  source 1..47: mol_type = genomic DNA
ggaggaaagtggaatcggtgagaaaggcaccccgggagccccagcag

SEQ ID NO: 41448 - DNA, 30 bp, Homo sapiens; identical to SEQ ID NO: 15026
  misc_feature 1..30: note = chr7:128529102-128529132
  misc_feature 1..30: note = hypo
  source 1..30: mol_type = genomic DNA

SEQ ID NO: 41449 - DNA, 30 bp, Homo sapiens
  misc_feature 1..30: note = chr7:128533290-128533320
  misc_feature 1..30: note = hypo
  source 1..30: mol_type = genomic DNA
cctgggcagagctggcggccagaggcaggc

SEQ ID NO: 41450 - DNA, 27 bp, Homo sapiens
  misc_feature 1..27: note = chr7:129229604-129229631
  misc_feature 1..27: note = hypo
  source 1..27: mol_type = genomic DNA
agtcaccgcgcccggccagtcttttct

SEQ ID NO: 41451 - DNA, 30 bp, Homo sapiens
  misc_feature 1..30: note = chr7:129297274-129297304
  misc_feature 1..30: note = hypo
  source 1..30: mol_type = genomic DNA
tgtggctacttacaccgagcatagtatgct

SEQ ID NO: 41452 - DNA, 30 bp, Homo sapiens
  misc_feature 1..30: note = chr7:129330294-129330324
  misc_feature 1..30: note = hypo
  source 1..30: mol_type = genomic DNA
cagaacacgcccctgcgccacaggaggtta

SEQ ID NO: 41453 - DNA, 258 bp, Homo sapiens
  misc_feature 1..258: note = chr7:129381062-129381320
  misc_feature 1..258: note = hypo
  source 1..258: mol_type = genomic DNA
tcaggtcagggcttccggacagattcccaaggtccctgccatctggcagatggacaccactgactgtggtctcctctccatccacggtgtcctcaaggccaagttacatgcttctttgtctcattctccttccctttaggtccgcagatctttcggagtctttgtatgtaaaggcagattttggtcttagattattccagctccttataaaccaagactgaatcttgtgcctgtcattgtgagcgctattctgtaaag

SEQ ID NO: 41454 - DNA, 30 bp, Homo sapiens
  misc_feature 1..30: note = chr7:129782524-129782554
  misc_feature 1..30: note = hypo
  source 1..30: mol_type = genomic DNA
gggataggagaaaaacggcacagagggagg

SEQ ID NO: 41455 - DNA, 313 bp, Homo sapiens
  misc_feature 1..313: note = chr7:129794426-129794739
  misc_feature 1..313: note = hypo
  source 1..313: mol_type = genomic DNA
tccaagtgccagctgcgcagcctggcccagagtccgggcccaggagggcccgcagtgcctgcagctgcctggggaccacatgcgtgactggctggccccctgctcatcccgcctctctcctccgcctggcttcgcgccgcctgcctgccctcggggacaagcgtgcccatctgacacctcagcgcctgcccattccccgggaccaggccatctggcctcgctgctgcctctgctctgtgcaacccccatgccgcagcccgtcgcctcctgctccagcctccgccaggactgtcctgtgcgcccatcagggtgt

SEQ ID NO: 41456 - DNA, 30 bp, Homo sapiens
  misc_feature 1..30: note = chr7:129846079-129846109
  misc_feature 1..30: note = hypo
  source 1..30: mol_type = genomic DNA
ggagctcaaccccagcggaggcccacagat

SEQ ID NO: 41457 - DNA, 28 bp, Homo sapiens
  misc_feature 1..28: note = chr7:131011379-131011407
  misc_feature 1..28: note = hypo
  source 1..28: mol_type = genomic DNA
aggtgtgagccaccgtgccgggcctggc

SEQ ID NO: 41458 - DNA, 51 bp, Homo sapiens
  misc_feature 1..51: note = chr7:131041515-131041566
  misc_feature 1..51: note = hypo
  source 1..51: mol_type = genomic DNA
ggaatgtatccaaatcgtgtgcgccaaatatgttgccggtggcagataccc

SEQ ID NO: 41459 - DNA, 30 bp, Homo sapiens; identical to SEQ ID NO: 15029
  misc_feature 1..30: note = chr7:131231034-131231064
  misc_feature 1..30: note = hypo
  source 1..30: mol_type = genomic DNA

SEQ ID NO: 41460 - DNA, 35 bp, Homo sapiens
  misc_feature 1..35: note = chr7:132155933-132155968
  misc_feature 1..35: note = hypo
  source 1..35: mol_type = genomic DNA
tgcctgctctcgattcgccttctgccatgactgta

SEQ ID NO: 41461 - DNA, 34 bp, Homo sapiens
  misc_feature 1..34: note = chr7:132156088-132156122
  misc_feature 1..34: note = hypo
  source 1..34: mol_type = genomic DNA
cggtgtaatacaaatagaccgttgtgtgtgttgt

SEQ ID NO: 41462 - DNA, 117 bp, Homo sapiens
  misc_feature 1..117: note = chr7:132418949-132419066
  misc_feature 1..117: note = hypo
  source 1..117: mol_type = genomic DNA
acggtgagaggaacacgttggcggaagaagacaagcagctggatatcgaggggacatcgaggggagcatgctggcagaagaacacaccaacagagggacacccgcactctggctggt

SEQ ID NO: 41463 - DNA, 30 bp, Homo sapiens
  misc_feature 1..30: note = chr7:134116597-134116627
  misc_feature 1..30: note = hypo
  source 1..30: mol_type = genomic DNA
tggtcatagatctgccgaggagcacaagaa

SEQ ID NO: 41464 - DNA, 30 bp, Homo sapiens
  misc_feature 1..30: note = chr7:134880911-134880941
  misc_feature 1..30: note = hypo
  source 1..30: mol_type = genomic DNA
atgagtggtgttccccgtactcctcctgtc

SEQ ID NO: 41465 - DNA, 104 bp, Homo sapiens
  misc_feature 1..104: note = chr7:134885144-134885248
  misc_feature 1..104: note = hypo
  source 1..104: mol_type = genomic DNA
gagagtgaaagatgccggcagaactgtgtactctctagacaatgacacttgcacacagagaagcttgcacccttctggaagcttcttctactgtgaccctacct

SEQ ID NO: 41466 - DNA, 57 bp, Homo sapiens; identical to SEQ ID NO: 15030
  misc_feature 1..57: note = chr7:134918564-134918621
  misc_feature 1..57: note = hypo
  source 1..57: mol_type = genomic DNA

SEQ ID NO: 41467 - DNA, 30 bp, Homo sapiens
  misc_feature 1..30: note = chr7:134953117-134953147
  misc_feature 1..30: note = hypo
  source 1..30: mol_type = genomic DNA
cccaacacagagggtcggaataaacatccc

SEQ ID NO: 41468 - DNA, 37 bp, Homo sapiens
  misc_feature 1..37: note = chr7:135125375-135125412
  misc_feature 1..37: note = hypo
  source 1..37: mol_type = genomic DNA
tagaaaactgcaggccgggtgcagtggctcacgccta

SEQ ID NO: 41469 - DNA, 84 bp, Homo sapiens
  misc_feature 1..84: note = chr7:135196033-135196117
  misc_feature 1..84: note = hypo
  source 1..84: mol_type = genomic DNA
gcagttttaaatttacgaacttaatttcataataagccctcaattcattgttttttctttttttttttttttgagacggagtct

SEQ ID NO: 41470 - DNA, 24 bp, Homo sapiens
  misc_feature 1..24: note = chr7:135196357-135196381
  misc_feature 1..24: note = hypo
  source 1..24: mol_type = genomic DNA
gattacagacgtgagccagggcac

SEQ ID NO: 41471 - DNA, 37 bp, Homo sapiens
  misc_feature 1..37: note = chr7:135234576-135234613
  misc_feature 1..37: note = hypo
  source 1..37: mol_type = genomic DNA
atcttctttctctgccgggcacggtggctcatacctg

SEQ ID NO: 41472 - DNA, 30 bp, Homo sapiens
  misc_feature 1..30: note = chr7:135391578-135391608
  misc_feature 1..30: note = hypo
  source 1..30: mol_type = genomic DNA
gtcacagaagtgtcccgtgtcactgtgtgc

SEQ ID NO: 41473 - DNA, 135 bp, Homo sapiens; identical to SEQ ID NO: 15032
  misc_feature 1..135: note = chr7:135401363-135401498
  misc_feature 1..135: note = hypo
  source 1..135: mol_type = genomic DNA

SEQ ID NO: 41474 - DNA, 30 bp, Homo sapiens
  misc_feature 1..30: note = chr7:135898077-135898107
  misc_feature 1..30: note = hypo
  source 1..30: mol_type = genomic DNA
agggacacagacattcgaagcatagcaaga

SEQ ID NO: 41475 - DNA, 23 bp, Homo sapiens
  misc_feature 1..23: note = chr7:135965324-135965347
  misc_feature 1..23: note = hypo
  source 1..23: mol_type = genomic DNA
accatgcccggcatgactgctct

SEQ ID NO: 41476 - DNA, 36 bp, Homo sapiens
  misc_feature 1..36: note = chr7:137092635-137092671
  misc_feature 1..36: note = hypo
  source 1..36: mol_type = genomic DNA
atttcacaatctccccgttgccggttttagctgcgt

SEQ ID NO: 41477 - DNA, 30 bp, Homo sapiens; identical to SEQ ID NO: 15033
  misc_feature 1..30: note = chr7:137664095-137664125
  misc_feature 1..30: note = hypo
  source 1..30: mol_type = genomic DNA

SEQ ID NO: 41478 - DNA, 18 bp, Homo sapiens
  misc_feature 1..18: note = chr7:137693378-137693396
  misc_feature 1..18: note = hypo
  source 1..18: mol_type = genomic DNA
acacggcctcggtgtgtt

SEQ ID NO: 41479 - DNA, 32 bp, Homo sapiens
  misc_feature 1..32: note = chr7:138845459-138845491
  misc_feature 1..32: note = hypo
  source 1..32: mol_type = genomic DNA
gcatgagccactgcgcccggcccaagtcactt

SEQ ID NO: 41480 - DNA, 55 bp, Homo sapiens
  misc_feature 1..55: note = chr7:138912533-138912588
  misc_feature 1..55: note = hypo
  source 1..55: mol_type = genomic DNA
tcctgtatttaccaacgattccaacttcttggtttagccacgttgctgtgaacta

SEQ ID NO: 41481 - DNA, 18 bp, Homo sapiens
  misc_feature 1..18: note = chr7:138913068-138913086
  misc_feature 1..18: note = hypo
  source 1..18: mol_type = genomic DNA
gctgaggcaggagaacgg

SEQ ID NO: 41482 - DNA, 17 bp, Homo sapiens
  misc_feature 1..17: note = chr7:138913146-138913163
  misc_feature 1..17: note = hypo
  source 1..17: mol_type = genomic DNA
ggcgacagagcaagact

SEQ ID NO: 41483 - DNA, 30 bp, Homo sapiens
  misc_feature 1..30: note = chr7:138957222-138957252
  misc_feature 1..30: note = hypo
  source 1..30: mol_type = genomic DNA
tgagaagtgtatgtacgttatgtatgtatg

SEQ ID NO: 41484 - DNA, 38 bp, Homo sapiens
  misc_feature 1..38: note = chr7:139027295-139027333
  misc_feature 1..38: note = hypo
  source 1..38: mol_type = genomic DNA
cctcccaggttcaagcgattctcctgcctcagcctccc

SEQ ID NO: 41485 - DNA, 30 bp, Homo sapiens
  misc_feature 1..30: note = chr7:139112625-139112655
  misc_feature 1..30: note = hypo
  source 1..30: mol_type = genomic DNA
aatcctgtggttactcgaagggaccatatt

SEQ ID NO: 41486 - DNA, 30 bp, Homo sapiens
  misc_feature 1..30: note = chr7:139245499-139245529
  misc_feature 1..30: note = hypo
  source 1..30: mol_type = genomic DNA
cccagcaggatgtggcgtttcttaggcttg

SEQ ID NO: 41487 - DNA, 148 bp, Homo sapiens
  misc_feature 1..148: note = chr7:139650638-139650786
  misc_feature 1..148: note = hypo
  source 1..148: mol_type = genomic DNA
tctacgggaccccctcgccctccatctacgggaccccctcgccctccatctacaggacccactccttcagcagaggagttgggcccctggtaacacaattctttccttacacccagagcacgtaggactgactcggaggaaactgcag

SEQ ID NO: 41488 - DNA, 30 bp, Homo sapiens
  misc_feature 1..30: note = chr7:139919897-139919927
  misc_feature 1..30: note = hypo
  source 1..30: mol_type = genomic DNA
gaaccaaacctggatcgtatttcagcattc

SEQ ID NO: 41489 - DNA, 30 bp, Homo sapiens
  misc_feature 1..30: note = chr7:139939160-139939190
  misc_feature 1..30: note = hypo
  source 1..30: mol_type = genomic DNA
gtggctccttccttgcggggcagcctgaat

SEQ ID NO: 41490 - DNA, 68 bp, Homo sapiens
  misc_feature 1..68: note = chr7:140007275-140007343
  misc_feature 1..68: note = hypo
  source 1..68: mol_type = genomic DNA
agaatgaattcccatcgcacataggatagagaagcagggcagccggcaggtgccgcatgcacataaag

SEQ ID NO: 41491 - DNA, 21 bp, Homo sapiens
  misc_feature 1..21: note = chr7:140026923-140026944
  misc_feature 1..21: note = hypo
  source 1..21: mol_type = genomic DNA
acggagcgagattctgtctca

SEQ ID NO: 41492 - DNA, 31 bp, Homo sapiens
  misc_feature 1..31: note = chr7:140096707-140096738
  misc_feature 1..31: note = hypo
  source 1..31: mol_type = genomic DNA
gacagagtctgaggccgggcgcagtggctca

SEQ ID NO: 41493 - DNA, 30 bp, Homo sapiens
  misc_feature 1..30: note = chr7:140097278-140097308
  misc_feature 1..30: note = hypo
  source 1..30: mol_type = genomic DNA
acaccgcgcccaacccgaagctcaatttcc

SEQ ID NO: 41494 - DNA, 80 bp, Homo sapiens
  misc_feature 1..80: note = chr7:140156598-140156678
  misc_feature 1..80: note = hypo
  source 1..80: mol_type = genomic DNA
accatgtccttgctgcgctgcacggcaaatgagagctccatgtccttctcatgggcctcaatgcacgactagagaaggtg

SEQ ID NO: 41495 - DNA, 50 bp, Homo sapiens
  misc_feature 1..50: note = chr7:140192162-140192212
  misc_feature 1..50: note = hypo
  source 1..50: mol_type = genomic DNA
ccactggtgccactgcgagcccagcgggggcagagcgagattacagcccc

SEQ ID NO: 41496 - DNA, 30 bp, Homo sapiens
  misc_feature 1..30: note = chr7:144488206-144488236
  misc_feature 1..30: note = hypo
  source 1..30: mol_type = genomic DNA
ctactaccttatcaacgttcaatcatattt

SEQ ID NO: 41497 - DNA, 20 bp, Homo sapiens
  misc_feature 1..20: note = chr7:144565939-144565959
  misc_feature 1..20: note = hypo
  source 1..20: mol_type = genomic DNA
acaggcgtgagccaccgcgc

SEQ ID NO: 41498 - DNA, 22 bp, Homo sapiens
  misc_feature 1..22: note = chr7:146300226-146300248
  misc_feature 1..22: note = hypo
  source 1..22: mol_type = genomic DNA
gggcgaggtggctcacgcctgt

SEQ ID NO: 41499 - DNA, 30 bp, Homo sapiens
  misc_feature 1..30: note = chr7:148500594-148500624
  misc_feature 1..30: note = hypo
  source 1..30: mol_type = genomic DNA
attcctcacggtaagcgaaggtgagctgag

SEQ ID NO: 41500 - DNA, 95 bp, Homo sapiens; identical to SEQ ID NO: 5071
  misc_feature 1..95: note = chr7:148640241-148640336
  misc_feature 1..95: note = hypo
  source 1..95: mol_type = genomic DNA

SEQ ID NO: 41501 - DNA, 53 bp, Homo sapiens
  misc_feature 1..53: note = chr7:148842138-148842191
  misc_feature 1..53: note = hypo
  source 1..53: mol_type = genomic DNA
gtaaatcccaaattacggactgcatatgtagccacaggcgaaaagtaacttag

SEQ ID NO: 41502 - DNA, 149 bp, Homo sapiens
  misc_feature 1..149: note = chr7:148846075-148846224
  misc_feature 1..149: note = hypo
  source 1..149: mol_type = genomic DNA
cttaaattctctaggcgtcacgtttaaaaagtaaaaagccaggcgctgtgttgtgcacgcctgtagtcccagctaggccgggggctgaggcggaagaatcacttgagtccaggagttcgaggcagtccacaccgcgtctctaaaataaa

SEQ ID NO: 41503 - DNA, 38 bp, Homo sapiens
  misc_feature 1..38: note = chr7:148883975-148884013
  misc_feature 1..38: note = hypo
  source 1..38: mol_type = genomic DNA
gggattacaggagtgagccaccgcgcccggcccgcgta

SEQ ID NO: 41504 - DNA, 93 bp, Homo sapiens
  misc_feature 1..93: note = chr7:150049533-150049626
  misc_feature 1..93: note = hypo
  source 1..93: mol_type = genomic DNA
accagaatgtcttatcgttgaaattattttttacttccttttgaaatgcttgagtttttttgtttgttttggtttggtttttgagacggagtc

SEQ ID NO: 41505 - DNA, 56 bp, Homo sapiens
  misc_feature 1..56: note = chr7:150068969-150069025
  misc_feature 1..56: note = hypo
  source 1..56: mol_type = genomic DNA
ccccggcccaggggccgccccgcggtgaccgccccccggcccggtggagatgccgt

SEQ ID NO: 41506 - DNA, 82 bp, Homo sapiens
  misc_feature 1..82: note = chr7:150069445-150069527
  misc_feature 1..82: note = hypo
  source 1..82: mol_type = genomic DNA
ctccctctacagctgcgacgactgcggcaggagcttccggctggagcgcttcctgcgggcccaccagcggcagcacaccggg

SEQ ID NO: 41507 - DNA, 143 bp, Homo sapiens
  misc_feature 1..143: note = chr7:150070146-150070289
  misc_feature 1..143: note = hypo
  source 1..143: mol_type = genomic DNA
agaggggatggaagacgcggggagtgagctgggtgggccctgctagcgagagaggtcaaccccggtggccagggaacccacttccaagcgcagggacgccggcctccagctggtgtgtgctaaggctccgtcctgactgccct

SEQ ID NO: 41508 - DNA, 45 bp, Homo sapiens
  misc_feature 1..45: note = chr7:150081206-150081251
  misc_feature 1..45: note = hypo
  source 1..45: mol_type = genomic DNA
aactgcagcctgacccggtgcgcggagggccgggccagggccagg

SEQ ID NO: 41509 - DNA, 76 bp, Homo sapiens; identical to SEQ ID NO: 15042
  misc_feature 1..76: note = chr7:150746248-150746324
  misc_feature 1..76: note = hypo
  source 1..76: mol_type = genomic DNA

SEQ ID NO: 41510 - DNA, 193 bp, Homo sapiens
  misc_feature 1..193: note = chr7:150758966-150759159
  misc_feature 1..193: note = hypo
  source 1..193: mol_type = genomic DNA
ccctcccagggctctcgatggtgatcaggcctctcccccatccaggttatgcctccgcctcgttgccctgaaagccgcagcgacagcgaaaagggctaagattcggccatgagcagcgcccctcggcgccccgccaagggcgcagattctttctgtacggtgagtgtggcccccaggtcgccagcccaacctt

SEQ ID NO: 41511 - DNA, 142 bp, Homo sapiens
  misc_feature 1..142: note = chr7:150773923-150774065
  misc_feature 1..142: note = hypo
  source 1..142: mol_type = genomic DNA
ggggagaggagagggcggcaggttacccgcaggctgggagtgaggatgcgccacgggccaggccagggccactcaccggcaggagctggtagcccatcaggcctaggtgccgctccctcagggccctcgagcccagcagcac

SEQ ID NO: 41512 - DNA, 33 bp, Homo sapiens
  misc_feature 1..33: note = chr7:150774325-150774358
  misc_feature 1..33: note = hypo
  source 1..33: mol_type = genomic DNA
ggaggggagcagggccggcggccttagccaggg

SEQ ID NO: 41513 - DNA, 99 bp, Homo sapiens; identical to SEQ ID NO: 15043
  misc_feature 1..99: note = chr7:150774704-150774803
  misc_feature 1..99: note = hypo
  source 1..99: mol_type = genomic DNA

SEQ ID NO: 41514 - DNA, 73 bp, Homo sapiens
  misc_feature 1..73: note = chr7:150811286-150811359
  misc_feature 1..73: note = hypo
  source 1..73: mol_type = genomic DNA
aagacaggaccacctcgttgaagctcgcgtgctgcagacgaggacacgcgcgcagacccggcatggctgcctc

SEQ ID NO: 41515 - DNA, 330 bp, Homo sapiens
  misc_feature 1..330: note = chr7:150823565-150823895
  misc_feature 1..330: note = hypo
  source 1..330: mol_type = genomic DNA
tggggtgaggggagtcgggacgggggcggggagccgggtccatccctcacacttggttatttctttggtttgtgtgctgggggcggggcggggggtattggggatgactccaaggcatctccagagcctgagggacttagagccttcgagcacgctagtcccatggctggtcgcagcgggagggggaacagctgactgcttctgagctctcagtgcacctggcccctggccagtgacaggaataccacacccagaggcaggtcaccaaggcccagcctacctggaagactccttcgcagaccaagaggcagggcccgcttgccttgtgga

SEQ ID NO: 41516 - DNA, 383 bp, Homo sapiens
  misc_feature 1..383: note = chr7:150870816-150871199
  misc_feature 1..383: note = hypo
  source 1..383: mol_type = genomic DNA
ctccaaactctttcccgcaccagcgagcccgcactcgcatgatacccagacctgcgctcgacctggccccagatccccgtgccaagggccacagcctctgagatgcttcctaggcggctccagtgccatctccccagcaacggccttctgcttcccgttacttcctcgtcttccccatcttagcatctggcaccaccgtccaggggtccaagccaaaaacctgcgagtcgccctagacagcgctattctgcagccccctacatcccccccagcggcggccccccagttcttcccagggatcccgaatctcgcccgccgcgaccacctctggcctggaccaccgccgcaggtgccccccgacccacgcccgcagccaggacggt

SEQ ID NO: 41517 - DNA, 84 bp, Homo sapiens
  misc_feature 1..84: note = chr7:150872928-150873012
  misc_feature 1..84: note = hypo
  source 1..84: mol_type = genomic DNA
atccacacctgcctgcggagctgggcctcctgctgccagggctacctggcctgagttagtgcagaggcgcgccctctgcaggct

SEQ ID NO: 41518 - DNA, 47 bp, Homo sapiens
  misc_feature 1..47: note = chr7:151082165-151082212
  misc_feature 1..47: note = hypo
  source 1..47: mol_type = genomic DNA
tcacttacaggtgcccgcgtggtacttgagggcgctcacgttgcgtc

SEQ ID NO: 41519 - DNA, 151 bp, Homo sapiens
  misc_feature 1..151: note = chr7:151553602-151553753
  misc_feature 1..151: note = hypo
  source 1..151: mol_type = genomic DNA
ttcaattggcctcgccgtggcccttaggcaaacaactcattctatctgagcctccgtttctccaactgtaaaaaccgggtgaatactaggaacaggcagagttgctgatgagttaaatggcaaaatatgtgaaagacgttaagtctggcac

SEQ ID NO: 41520 - DNA, 30 bp, Homo sapiens
  misc_feature 1..30: note = chr7:151585396-151585426
  misc_feature 1..30: note = hypo
  source 1..30: mol_type = genomic DNA
tccttgccatcagaccgtcgaggagtctgt

SEQ ID NO: 41521 - DNA, 30 bp, Homo sapiens; identical to SEQ ID NO: 15047
  misc_feature 1..30: note = chr7:151591649-151591679
  misc_feature 1..30: note = hypo
  source 1..30: mol_type = genomic DNA

SEQ ID NO: 41522 - DNA, 30 bp, Homo sapiens
  misc_feature 1..30: note = chr7:152159631-152159661
  misc_feature 1..30: note = hypo
  source 1..30: mol_type = genomic DNA
tagccaagggtttctcgtgtttgatgccaa

SEQ ID NO: 41523 - DNA, 40 bp, Homo sapiens
  misc_feature 1..40: note = chr7:152337514-152337554
  misc_feature 1..40: note = hypo
  source 1..40: mol_type = genomic DNA
tactgggattacaggcgtgaaccaccgaccctggctgaaa

SEQ ID NO: 41524 - DNA, 175 bp, Homo sapiens; identical to SEQ ID NO: 15049
  misc_feature 1..175: note = chr7:152693809-152693984
  misc_feature 1..175: note = hypo
  source 1..175: mol_type = genomic DNA

SEQ ID NO: 41525 - DNA, 206 bp, Homo sapiens
  misc_feature 1..206: note = chr7:152782995-152783201
  misc_feature 1..206: note = hypo
  source 1..206: mol_type = genomic DNA
ggagttaagttaacccgaggtcttaattttattaaatgatcactgcggtgcagtgggttgaatatgggattcagaaatagaaggtttggcttcatttggtccacaaatagtcattgctgtgttcacagattggtacacagtgatgtataatagcggagacagacagattgcaagctctgtgacagcgatgacgaacgtgggacgtg

SEQ ID NO: 41526 - DNA, 34 bp, Homo sapiens
  misc_feature 1..34: note = chr7:152984071-152984105
  misc_feature 1..34: note = hypo
  source 1..34: mol_type = genomic DNA
gagcaaagtgcacatcgctcgtggaacagggaaa

SEQ ID NO: 41527 - DNA, 24 bp, Homo sapiens
  misc_feature 1..24: note = chr7:153041593-153041617
  misc_feature 1..24: note = hypo
  source 1..24: mol_type = genomic DNA
tttttttttttgagacggagtctc

SEQ ID NO: 41528 - DNA, 38 bp, Homo sapiens
  misc_feature 1..38: note = chr7:153102258-153102296
  misc_feature 1..38: note = hypo
  source 1..38: mol_type = genomic DNA
cagtgcccaaacaatcggctccccgttctcttacgtca

SEQ ID NO: 41529 - DNA, 80 bp, Homo sapiens
  misc_feature 1..80: note = chr7:153540019-153540099
  misc_feature 1..80: note = hypo
  source 1..80: mol_type = genomic DNA
ttattggaagaaaatcgatgcccccactcacccacctgcgcatgtgtgcatgtgtgtgtgcacgcacatacacacataca

SEQ ID NO: 41530 - DNA, 30 bp, Homo sapiens
  misc_feature 1..30: note = chr7:153641678-153641708
  misc_feature 1..30: note = hypo
  source 1..30: mol_type = genomic DNA
aggcctcacaacacacggggccttgcaggc

SEQ ID NO: 41531 - DNA, 30 bp, Homo sapiens
  misc_feature 1..30: note = chr7:153896397-153896427
  misc_feature 1..30: note = hypo
  source 1..30: mol_type = genomic DNA
tgctcctaaaatgcacgttaatattgatgc

SEQ ID NO: 41532 - DNA, 40 bp, Homo sapiens
  misc_feature 1..40: note = chr7:154088244-154088284
  misc_feature 1..40: note = hypo
  source 1..40: mol_type = genomic DNA
tcatacacagtgccacgcgtgggggcggttctcagtcaga

SEQ ID NO: 41533 - DNA, 30 bp, Homo sapiens
  misc_feature 1..30: note = chr7:154186455-154186485
  misc_feature 1..30: note = hypo
  source 1..30: mol_type = genomic DNA
tgagtatttgcaggacgctgttctgagatt

SEQ ID NO: 41534 - DNA, 39 bp, Homo sapiens; identical to SEQ ID NO: 15050
  misc_feature 1..39: note = chr7:154561150-154561189
  misc_feature 1..39: note = hypo
  source 1..39: mol_type = genomic DNA

SEQ ID NO: 41535 - DNA, 45 bp, Homo sapiens
  misc_feature 1..45: note = chr7:154665013-154665058
  misc_feature 1..45: note = hypo
  source 1..45: mol_type = genomic DNA
tctaggtgatgtccacgcgctgacaccgcacggggaggcagtgca

SEQ ID NO: 41536 - DNA, 41 bp, Homo sapiens
  misc_feature 1..41: note = chr7:154670093-154670134
  misc_feature 1..41: note = hypo
  source 1..41: mol_type = genomic DNA
ctcaaagaatgggagcgtgtggacaacggcaaagcttagag

SEQ ID NO: 41537 - DNA, 43 bp, Homo sapiens
  misc_feature 1..43: note = chr7:154922507-154922550
  misc_feature 1..43: note = hypo
  source 1..43: mol_type = genomic DNA
tggatgttgtgtcaccgtccacactccccgctggtcccaccaa

SEQ ID NO: 41538 - DNA, 30 bp, Homo sapiens
  misc_feature 1..30: note = chr7:155130764-155130794
  misc_feature 1..30: note = hypo
  source 1..30: mol_type = genomic DNA
gtgcagggaggccagcggctgggacagagg

SEQ ID NO: 41539 - DNA, 44 bp, Homo sapiens
  misc_feature 1..44: note = chr7:155133192-155133236
  misc_feature 1..44: note = hypo
  source 1..44: mol_type = genomic DNA
tcctctgctgcacagcgtgggttgggtcccgtggctgagcaccc

SEQ ID NO: 41540 - DNA, 30 bp, Homo sapiens
  misc_feature 1..30: note = chr7:155144931-155144961
  misc_feature 1..30: note = hypo
  source 1..30: mol_type = genomic DNA
cctcctgatgtgtaccggggcgaggcttac

SEQ ID NO: 41541 - DNA, 43 bp, Homo sapiens
  misc_feature 1..43: note = chr7:155202839-155202882
  misc_feature 1..43: note = hypo
  source 1..43: mol_type = genomic DNA
catgcggggagggggcgcggggagggggcgcaggacgggcctg

SEQ ID NO: 41542 - DNA, 216 bp, Homo sapiens
  misc_feature 1..216: note = chr7:155363288-155363504
  misc_feature 1..216: note = hypo
  source 1..216: mol_type = genomic DNA
tccacagaacacctccgggtcccgggcactccgggccagcgcaggccccagcagcagggccagcagagccagaggcagcagcatgggccccatgccagctgtgccgccgcacaccggcctccttccaggcccctcacaggcccctccgcgagtgctgggcgtgcagcagacaaatggcatacaaaggtcctcgggccgcaccgccctagatacccg

SEQ ID NO: 41543 - DNA, 165 bp, Homo sapiens
  misc_feature 1..165: note = chr7:155580762-155580927
  misc_feature 1..165: note = hypo
  source 1..165: mol_type = genomic DNA
caccatctgtgtccacgcagagggtcgggccgtgggagccgcgagtgtctggcccacacttctgttcttaacctcgcaatgtattcaggtttccccaggcggagcgctcagcatatcgacagctaaaaatccaaccaaggccgggcgcggtggttcacgcctgta

SEQ ID NO: 41544 - DNA, 547 bp, Homo sapiens
  misc_feature 1..547: note = chr7:155581330-155581877
  misc_feature 1..547: note = hypo
  source 1..547: mol_type = genomic DNA
ggtccactgcccagccggggatgcaaggacggccatggggctccagcacagggaccgggccccgcgggctttgagtgacgcggtaggccaggacgagccccatccacacttggacaatgagcaaccgcagccggccgcgcagcctgggggccgtctccctctccagcccccgtgtcctctggtccacgactggctcttgccctcattccgttggggctgagtcacagccagggaaagggctgaggcagagcaacgctgggtgaaccccgtcttcctgaggccacgtttgcaccgggaagagaacacagtgaaccccctgagcaccaacacgctcccacaccccccacgagcagcccagccctggggaggagcccgtccttctccctgcttgccacaccggccacgtccgtaaccctgcccagcatcccacccaggttgtgtgggtccccacgtggtcaccagcgtcctttcaggacaagagaaaactgagcaggaccagggcttccgcctgccgcattcatctgccccccttcggctgtgccaggtg

SEQ ID NO: 41545 - DNA, 84 bp, Homo sapiens
  misc_feature 1..84: note = chr7:155582232-155582316
  misc_feature 1..84: note = hypo
  source 1..84: mol_type = genomic DNA
gcggcctttgcttcccggtgctggctgtgcccagacgcctgggcttgtgcgtgtttaacccgcccagagactggtgctgccgca

SEQ ID NO: 41546 - DNA, 37 bp, Homo sapiens
  misc_feature 1..37: note = chr7:155752556-155752593
  misc_feature 1..37: note = hypo
  source 1..37: mol_type = genomic DNA
cctgactcagtgaagcggccagcgtgtcttccaatac

SEQ ID NO: 41547 - DNA, 105 bp, Homo sapiens
  misc_feature 1..105: note = chr7:155753582-155753687
  misc_feature 1..105: note = hypo
  source 1..105: mol_type = genomic DNA
tgcctgagcgtgtgtgtgtgtgtgtgtgtgtgtgtgtgtgttagaatcctgccctgagctggccttcaggaaggtgaattccggtttctgcgcactctgcactct

SEQ ID NO: 41548 - DNA, 34 bp, Homo sapiens
  misc_feature 1..34: note = chr7:155786790-155786824
  misc_feature 1..34: note = hypo
  source 1..34: mol_type = genomic DNA
ctgcatctcacctggcggccgtggggcaccttca

SEQ ID NO: 41549 - DNA, 52 bp, Homo sapiens
  misc_feature 1..52: note = chr7:155854343-155854395
  misc_feature 1..52: note = hypo
  source 1..52: mol_type = genomic DNA
gtcctcctggcccaccgtgattgttcagagaccgccgcgggtgcagagtgca

SEQ ID NO: 41550 - DNA, 30 bp, Homo sapiens
  misc_feature 1..30: note = chr7:155871902-155871932
  misc_feature 1..30: note = hypo
  source 1..30: mol_type = genomic DNA
tgtttccctctggcccgcagcgttgcccat

SEQ ID NO: 41551 - DNA, 175 bp, Homo sapiens
  misc_feature 1..175: note = chr7:155898977-155899152
  misc_feature 1..175: note = hypo
  source 1..175: mol_type = genomic DNA
cagcaggcagggcaccggtccggcgtaagctcactctcagctttcagttagatcgcagctcctggattgagctgtatacccaaacccagctatatgctctttacaagcacatacaataaagtgacagaaagggatccaaaaagtgtactgggtgcgtgcacggagggaagaggag

SEQ ID NO: 41552 - DNA, 24 bp, Homo sapiens
  misc_feature 1..24: note = chr7:155920548-155920572
  misc_feature 1..24: note = hypo
  source 1..24: mol_type = genomic DNA
acttcttacctggctcgctgcaaa

SEQ ID NO: 41553 - DNA, 38 bp, Homo sapiens
  misc_feature 1..38: note = chr7:156012968-156013006
  misc_feature 1..38: note = hypo
  source 1..38: mol_type = genomic DNA
cagagcatgtgaatgcggtgagccgcaggctgtgtgct

SEQ ID NO: 41554 - DNA, 173 bp, Homo sapiens
  misc_feature 1..173: note = chr7:156025663-156025836
  misc_feature 1..173: note = hypo
  source 1..173: mol_type = genomic DNA
aggtggagtggggaccgtagtgcccagtgtccacattagaaccctgctgttccgtgacccagaaccaggacaggagccacctgtggttcaggtgagggcaagagtccacggagcccggacaggagcggcagagcaggccgcacctcccgggcaccttccggggctgagcaccc

SEQ ID NO: 41555 - DNA, 44 bp, Homo sapiens
  misc_feature 1..44: note = chr7:156138347-156138391
  misc_feature 1..44: note = hypo
  source 1..44: mol_type = genomic DNA
ttccttgtttgccagcgagcggggaacagcggcctcgtgctctc

SEQ ID NO: 41556 - DNA, 102 bp, Homo sapiens
  misc_feature 1..102: note = chr7:156177626-156177728
  misc_feature 1..102: note = hypo
  source 1..102: mol_type = genomic DNA
aagggacgtgccagccgtgttgtgtactcattcgtctccactgctagcaaggtcctgggcacacaggcagcggtcagtaatgtttgtcgaaagaagaaaagt

SEQ ID NO: 41557 - DNA, 105 bp, Homo sapiens
  misc_feature 1..105: note = chr7:156744694-156744799
  misc_feature 1..105: note = hypo
  source 1..105: mol_type = genomic DNA
cggccggttttgatttttatcatataaacttagatattacttttaaacaagtttgaaattgtttttaggacactttccctccaaaattagcggtttgtttaattt

SEQ ID NO: 41558 - DNA, 33 bp, Homo sapiens; identical to SEQ ID NO: 15061
  misc_feature 1..33: note = chr7:156832223-156832256
  misc_feature 1..33: note = hypo
  source 1..33: mol_type = genomic DNA

SEQ ID NO: 41559 - DNA, 482 bp, Homo sapiens
  misc_feature 1..482: note = chr7:156832680-156833162
  misc_feature 1..482: note = hypo
  source 1..482: mol_type = genomic DNA
caagtgtgctgaagacgcaaacctaacacgcaggaggcaggaaccgtctgaggcagcccccggcaaacgtcaggctgtgtggctcagacccggcacagcctccgcgatgggagctccggggggggctggctggggacaaggacaagcggacttgggagcgacggggtttgggcatctgggagacgggaactccttcccgggaggaagaccgtgagggaggcgtggaagtggatgtgagccggtgtgcactgggctgcagtgcgcgctgctgggccggtccgggagcccacactgttgggtgctggctgctagaagcccacagcaggggcccgaggcccaccccctagcctcagggcacagcttcccctgtccagccaaggctgccttacccaagccctggtcctgcctgttccgtgccttctcccgcaaggcttcttcaacagcacaccgcgaaaacgtgcaggcatcgcccccagcacaag

SEQ ID NO: 41560 - DNA, 68 bp, Homo sapiens
  misc_feature 1..68: note = chr7:156880531-156880599
  misc_feature 1..68: note = hypo
  source 1..68: mol_type = genomic DNA
ccggcaactacaaggcggtgctcacggacagcacggccctcggcgtggatatccggaaggcagccacc

SEQ ID NO: 41561 - DNA, 50 bp, Homo sapiens
  misc_feature 1..50: note = chr7:156883354-156883404
  misc_feature 1..50: note = hypo
  source 1..50: mol_type = genomic DNA
ccccaaggtcaggggcgcctggcctgggccctggacgtcattctgaggac

SEQ ID NO: 41562 - DNA, 30 bp, Homo sapiens
  misc_feature 1..30: note = chr7:156924103-156924133
  misc_feature 1..30: note = hypo
  source 1..30: mol_type = genomic DNA
cggagctctgatgcccgcagacagaagatg

SEQ ID NO: 41563 - DNA, 21 bp, Homo sapiens
  misc_feature 1..21: note = chr7:156929628-156929649
  misc_feature 1..21: note = hypo
  source 1..21: mol_type = genomic DNA
ttatttattttgagacggagt

SEQ ID NO: 41564 - DNA, 81 bp, Homo sapiens
  misc_feature 1..81: note = chr7:157075212-157075293
  misc_feature 1..81: note = hypo
  source 1..81: mol_type = genomic DNA
ccatggcggataacccgcctgaccccttccactcggctgtcggtacccacctgtcagccccacctgcgtgtccccctggaa

SEQ ID NO: 41565 - DNA, 171 bp, Homo sapiens
  misc_feature 1..171: note = chr7:157084426-157084597
  misc_feature 1..171: note = hypo
  source 1..171: mol_type = genomic DNA
gcgcgcctggaggagcgtttggcatcactcaacactaaagtgcaaacgtgggctccaagagcaagtcaagggtgttaccagctgggctctgggagcaaagacaaaggccagtggcctcccacccgccgtggcaggacaagcagagtgtggtctccacgcaagaggctggag

SEQ ID NO: 41566 - DNA, 252 bp, Homo sapiens
  misc_feature 1..252: note = chr7:157085343-157085595
  misc_feature 1..252: note = hypo
  source 1..252: mol_type = genomic DNA
gggggaggccaggaccgtggagttctagagggggcaccaagggcccgtgtgtccgcgtggagctggacatgcttctgtgggccaggcaccctgaccctgatcctctccagtgaagaggccgggggcaggcggaactgggtcaggctccaggacacagcctcaccctatcagggcagcgagggctggggcggacaggggagccgtagacagcccgtccctgggtgggcctggccttcccggccctgactcagc

SEQ ID NO: 41567 - DNA, 221 bp, Homo sapiens
  misc_feature 1..221: note = chr7:157085926-157086147
  misc_feature 1..221: note = hypo
  source 1..221: mol_type = genomic DNA
gggagagctgctgcccggccgagcctctgctcccacggtctcaggccctccccgccctgatgagtctccgctcccaacacaagggccacgtggtctggagggaccttttgcccagctgcaggggccatctcagggagaccccgccttggaggacttgttctccggatctccagacgtttaggctgaaagtgcagagatttagaagtcggacagggagttgg

SEQ ID NO: 41568 - DNA, 71 bp, Homo sapiens
  misc_feature 1..71: note = chr7:157099869-157099940
  misc_feature 1..71: note = hypo
  source 1..71: mol_type = genomic DNA
caaactttgaaaagtcgattctgcacatatactatggttctgttccatcccatctccggagggtaggcagc

SEQ ID NO: 41569 - DNA, 30 bp, Homo sapiens
  misc_feature 1..30: note = chr7:157147812-157147842
  misc_feature 1..30: note = hypo
  source 1..30: mol_type = genomic DNA
gccttgagcctttagcgttcccgtagtttc

SEQ ID NO: 41570 - DNA, 48 bp, Homo sapiens
  misc_feature 1..48: note = chr7:157217366-157217414
  misc_feature 1..48: note = hypo
  source 1..48: mol_type = genomic DNA
gcagtgagtctcacccgtgccactgcactccagcgtgggagacaccgt

SEQ ID NO: 41571 - DNA, 46 bp, Homo sapiens
  misc_feature 1..46: note = chr7:157218481-157218527
  misc_feature 1..46: note = hypo
  source 1..46: mol_type = genomic DNA
gaggctcaattcagccggatgtttgtgctcacgtgctcacagcggc

SEQ ID NO: 41572 - DNA, 30 bp, Homo sapiens
  misc_feature 1..30: note = chr7:157220595-157220625
  misc_feature 1..30: note = hypo
  source 1..30: mol_type = genomic DNA
gcctggggggacccccgggggctgctgagg

SEQ ID NO: 41573 - DNA, 30 bp, Homo sapiens
  misc_feature 1..30: note = chr7:157233964-157233994
  misc_feature 1..30: note = hypo
  source 1..30: mol_type = genomic DNA
ccctccactgtggaccgcagagtaatggcc

SEQ ID NO: 41574 - DNA, 36 bp, Homo sapiens
  misc_feature 1..36: note = chr7:157235760-157235796
  misc_feature 1..36: note = hypo
  source 1..36: mol_type = genomic DNA
aggctctaatgcttgcggcaccgccactcacctcct

SEQ ID NO: 41575 - DNA, 261 bp, Homo sapiens
  misc_feature 1..261: note = chr7:157255061-157255322
  misc_feature 1..261: note = hypo
  source 1..261: mol_type = genomic DNA
catgacagtgggacacggggtctggggcgaggctggacgctgccatccagcacccagctcgtttcggcctgggctgccctcagcactgcgcagacccgcgagctcctcatttccccggaagatgaacgagaaggttcgcgcgagattctctgcaaagccctggcacaggccccgtccctgcagctgtttattgacgctgtggcggccgagacggcatgtttggaaatctgcttggcatggagactgcggtgccctgaccac

SEQ ID NO: 41576 - DNA, 892 bp, Homo sapiens
  misc_feature 1..892: note = chr7:157262579-157263471
  misc_feature 1..892: note = hypo
  source 1..892: mol_type = genomic DNA
actccagggtgaacccgggactcctgagtgggcgcccaggcccctctagtgctggccgcctctgcttccctctccaggcccacctgccggccaccacagtggcccccagcgcccagcccaggtcccccacgccggcttctctcggcccaggtcactctcttcacactgtcatctgccagtcacttgcacactctgattcccaaggcgactctgctgcaggcacacgccctcagcaagacctggctgagtgccgtctgtgcccgtggatgcacgcgcagctctcctggggacactggccctggctccactccctggacagatctgtgcccggcactgggtctgctccctgcacagacccacacctggtgctggcgccactccccggacacacctgcccctggcgctggcctgggttgggtgtgtccgtgtgtccagcgctggcctggattgggtgtgtccgtgtgtccggcactggcctgcgttgggtgtgtccgtgtgtccggcgctggcctgggttgggtgtgtccgtgtgtccggcgctggcctgggttgggtgtgtccatgtgtccggcgctggcctgggttgggtgtgtccgtgtgtccggcgctggcctgggttgggtgtgtccgtgtgtccggcgctggcctgggttgggtgtgtccgtgtgtccggcgctggcctgggttgggtgtgtccgtgtgtccggcgctggcctgggttgggtgtgtccgtgtgtccggtgttggcctgtgttgggtgtgtccggcgctggcctgcattgggtgtgtctgtgtgtccggcgctggcctgggttgggtgtgtccgtgtgcccggtgctggcctgcgttgggtgtgtctgtgtgtctggcgctccagcggggagtctgtggg

SEQ ID NO: 41577 - DNA, 30 bp, Homo sapiens
  misc_feature 1..30: note = chr7:157276023-157276053
  misc_feature 1..30: note = hypo
  source 1..30: mol_type = genomic DNA
gctgtttttaattcccgagcgttcttttgg

SEQ ID NO: 41578 - DNA, 143 bp, Homo sapiens
  misc_feature 1..143: note = chr7:157280216-157280359
  misc_feature 1..143: note = hypo
  source 1..143: mol_type = genomic DNA
agatgaagaccagggcgggcaggggcctggcccaggttctggagaagcaaggggtgcttctcggatatcacggtggatgagagtgacccagagtcgttaaccagagtgtctatgcggccgtgacgaggcgtggactcggctgt

SEQ ID NO: 41579 - DNA, 108 bp, Homo sapiens
  misc_feature 1..108: note = chr7:157280626-157280734
  misc_feature 1..108: note = hypo
  source 1..108: mol_type = genomic DNA
ggcacacgggagagccggggagggcacacgggagagccggggagggaacacgggagagccggggagagcacacgggagagccggggcggcacacgggagagcagatga

SEQ ID NO: 41580 - DNA, 30 bp, Homo sapiens
  misc_feature 1..30: note = chr7:157291421-157291451
  misc_feature 1..30: note = hypo
  source 1..30: mol_type = genomic DNA
tgggcctggtgaagacgggcacaaaacagc

SEQ ID NO: 41581 - DNA, 33 bp, Homo sapiens
  misc_feature 1..33: note = chr7:157294288-157294321
  misc_feature 1..33: note = hypo
  source 1..33: mol_type = genomic DNA
gcacacagcttttgccgtcgtttggagaattac

SEQ ID NO: 41582 - DNA, 30 bp, Homo sapiens
  misc_feature 1..30: note = chr7:157319640-157319670
  misc_feature 1..30: note = hypo
  source 1..30: mol_type = genomic DNA
tcgcctggcccctcacgtgcggagcacgtc

SEQ ID NO: 41583 - DNA, 30 bp, Homo sapiens
  misc_feature 1..30: note = chr7:157320767-157320797
  misc_feature 1..30: note = hypo
  source 1..30: mol_type = genomic DNA
ttcagggttaggccccggaacctcacacat

SEQ ID NO: 41584 - DNA, 142 bp, Homo sapiens
  misc_feature 1..142: note = chr7:157337964-157338106
  misc_feature 1..142: note = hypo
  source 1..142: mol_type = genomic DNA
tgtgagcagtgtgcacggctgtatgtgggtgtgtaccacatgcgtgggtgtgtaggtgtgtgtggggggtgtgcctgggtgtgtgcatggggatgcgcagtgtgtggctgagtgtgggtgtgcactgcgtgagtgggtgtgt

SEQ ID NO: 41585 - DNA, 83 bp, Homo sapiens
  misc_feature 1..83: note = chr7:157338308-157338391
  misc_feature 1..83: note = hypo
  source 1..83: mol_type = genomic DNA
gatggagtttgtggtcggggactgagttgccaaatgctcaggtgggcgctggtgaaacattttctattcgacccaaattccag

SEQ ID NO: 41586 - DNA, 30 bp, Homo sapiens
  misc_feature 1..30: note = chr7:157346704-157346734
  misc_feature 1..30: note = hypo
  source 1..30: mol_type = genomic DNA
tgggtgcggccaggccgggcgccggatcct

SEQ ID NO: 41587 - DNA, 151 bp, Homo sapiens
  misc_feature 1..151: note = chr7:157346983-157347134
  misc_feature 1..151: note = hypo
  source 1..151: mol_type = genomic DNA
tgcggccaggccgggcgccggatcctgcccgctctcgtgccctcctgggcatgggtgcggccaggccgggcgctggatcctgcccgctcttgtgccctcctgagcatgggtgtggccaggccgggcaggggcacaacgttggcattgataa

SEQ ID NO: 41588 - DNA, 37 bp, Homo sapiens
  misc_feature 1..37: note = chr7:157347797-157347834
  misc_feature 1..37: note = hypo
  source 1..37: mol_type = genomic DNA
agacaccaggctctgcgtgctccgctggcacccgaat

SEQ ID NO: 41589 - DNA, 129 bp, Homo sapiens
  misc_feature 1..129: note = chr7:157352962-157353091
  misc_feature 1..129: note = hypo
  source 1..129: mol_type = genomic DNA
tacactcagtgaggacggctccatgcacagggacgaagacccccgaggagaccatcgaaggatggtgggcagtgctgcccacacggatgcccagagcgtgttccccaagaccagcgggtctcatgctgt

SEQ ID NO: 41590 - DNA, 69 bp, Homo sapiens
  misc_feature 1..69: note = chr7:157370495-157370564
  misc_feature 1..69: note = hypo
  source 1..69: mol_type = genomic DNA
gggtgactcagcctccgtcccctgaacatggggtgcgctgagcctccctgcatgcggccctcgggggtg

SEQ ID NO: 41591 - DNA, 209 bp, Homo sapiens
  misc_feature 1..209: note = chr7:157396449-157396658
  misc_feature 1..209: note = hypo
  source 1..209: mol_type = genomic DNA
atgttctacaagtcacggaacccaccgcccagcgtgagccgggacccacacggctcataaacagccccgctggtgaaggaacaggggagtggcgggagcccaatgggcagagtcggccctgtccaccgcagagacgctgagctgggtggggacgtgatttcccccgagaaccttcccacgtgatttgccgcgtccgtgccacccaaggg

SEQ ID NO: 41592 - DNA, 189 bp, Homo sapiens
  misc_feature 1..189: note = chr7:157403604-157403793
  misc_feature 1..189: note = hypo
  source 1..189: mol_type = genomic DNA
gtcattcagggcctccgcagctcagcatacaatgctgcatctgggcagactgggacaggctggggctcatatccagaaagccctgctacatccagagatggtcatgaaaatgagacctgccccacccaccactcaggaggcacgctgctcaccgctgagctgaataaccgagcgcgaggctggtgtccg

SEQ ID NO: 41593 - DNA, 152 bp, Homo sapiens
  misc_feature 1..152: note = chr7:157408585-157408737
  misc_feature 1..152: note = hypo
  source 1..152: mol_type = genomic DNA
ggcctcagaatcagccggcgctgagatgtgcacctggcaggatgaacgtaacttctggtggataaagtgggaggcctgatccaggaagaagcacaccgtggcctggggcccctctggagggtaggtcttccaagtcacgggaaacagggcgc

SEQ ID NO: 41594 - DNA, 101 bp, Homo sapiens
  misc_feature 1..101: note = chr7:157437497-157437598
  misc_feature 1..101: note = hypo
  source 1..101: mol_type = genomic DNA
aaaaaaaaaacaaaaaacaaaagaaaacaaaacaaaagcagcagcactgtctgctctgagctacaatcctatgcacgatttccacccgtgggaaccacacg

SEQ ID NO: 41595 - DNA, 77 bp, Homo sapiens
  misc_feature 1..77: note = chr7:157443179-157443256
  misc_feature 1..77: note = hypo
  source 1..77: mol_type = genomic DNA
ggagagttcgccctgcggcctggtttactcatcaggcctccgcgccagcacccgagccagagcgagaacggccagcc

SEQ ID NO: 41596 - DNA, 88 bp, Homo sapiens
  misc_feature 1..88: note = chr7:157448438-157448526
  misc_feature 1..88: note = hypo
  source 1..88: mol_type = genomic DNA
tgtcctaataacacccggacattcattatgtatggagtggcaatgcacggccacacacgcgtgatcactccagcgaggaccctggaaa

SEQ ID NO: 41597 - DNA, 160 bp, Homo sapiens
  misc_feature 1..160: note = chr7:157449174-157449334
  misc_feature 1..160: note = hypo
  source 1..160: mol_type = genomic DNA
gatgcgtgacgtgtgcgggccctcaggtcggtctggtggccgcgtggccatacgctggcggcacagctcctgcaggacagggggaggaagagcagggggttagtggcattggggacacccagcaggacgagggccacggcacccacgtggcacaacccct

SEQ ID NO: 41598 - DNA, 93 bp, Homo sapiens
  misc_feature 1..93: note = chr7:157455478-157455571
  misc_feature 1..93: note = hypo
  source 1..93: mol_type = genomic DNA
tgtgcttttccagggcgagccttctttttggacatgggatgtacccgatgtctacaagcttgaagtaacattgccgaccgtgtgcttcttgtg

SEQ ID NO: 41599 - DNA, 30 bp, Homo sapiens
  misc_feature 1..30: note = chr7:157455840-157455870
  misc_feature 1..30: note = hypo
  source 1..30: mol_type = genomic DNA
tgggaagaagttccccgggcatcggcgact

SEQ ID NO: 41600 - DNA, 44 bp, Homo sapiens
  misc_feature 1..44: note = chr7:157511451-157511495
  misc_feature 1..44: note = hypo
  source 1..44: mol_type = genomic DNA
gggtgagtctcagcacgtccaggcgtccgcggtgacactgcagc

SEQ ID NO: 41601 - DNA, 152 bp, Homo sapiens
  misc_feature 1..152: note = chr7:157512238-157512390
  misc_feature 1..152: note = hypo
  source 1..152: mol_type = genomic DNA
ccagttcttggcatccgggagctccagctggcatgaaggcagaaagaataacagccagtggcagtggaaggcatgagcgcccccggagagcagggccagaccatcagcagggcccctccaagaggagctctgtatgccgggggagtgggctc

SEQ ID NO: 41602 - DNA, 52 bp, Homo sapiens
  misc_feature 1..52: note = chr7:157527557-157527609
  misc_feature 1..52: note = hypo
  source 1..52: mol_type = genomic DNA
tcggccatgtgcctgcgttttccaatattgatgtcgacgtgggaggcaagtt

SEQ ID NO: 41603 - DNA, 30 bp, Homo sapiens
  misc_feature 1..30: note = chr7:157530181-157530211
  misc_feature 1..30: note = hypo
  source 1..30: mol_type = genomic DNA
tgcccgggcagggggcgcaggcaggagggc

SEQ ID NO: 41604 - DNA, 30 bp, Homo sapiens
  misc_feature 1..30: note = chr7:157536702-157536732
  misc_feature 1..30: note = hypo
  source 1..30: mol_type = genomic DNA
acgtgctccggggcacgactctgacgcagc

SEQ ID NO: 41605 - DNA, 103 bp, Homo sapiens
  misc_feature 1..103: note = chr7:157551220-157551323
  misc_feature 1..103: note = hypo
  source 1..103: mol_type = genomic DNA
gaggctaaagggagccgaggcaggtggcagctgctgtgctgggaaggctgcgtgcgcggggcatcctctcttggcccgggtgggcggacgcaggggtccctgg

SEQ ID NO: 41606 - DNA, 48 bp, Homo sapiens; identical to SEQ ID NO: 15075
  misc_feature 1..48: note = chr7:157565500-157565548
  misc_feature 1..48: note = hypo
  source 1..48: mol_type = genomic DNA

SEQ ID NO: 41607 - DNA, 30 bp, Homo sapiens; identical to SEQ ID NO: 15076
  misc_feature 1..30: note = chr7:157568187-157568217
  misc_feature 1..30: note = hypo
  source 1..30: mol_type = genomic DNA

SEQ ID NO: 41608 - DNA, 30 bp, Homo sapiens
  misc_feature 1..30: note = chr7:157578615-157578645
  misc_feature 1..30: note = hypo
  source 1..30: mol_type = genomic DNA
gcagggtgggagggccgggtggggatggct

SEQ ID NO: 41609 - DNA, 341 bp, Homo sapiens
  misc_feature 1..341: note = chr7:157583900-157584241
  misc_feature 1..341: note = hypo
  source 1..341: mol_type = genomic DNA
aagaagaatgagatacgtccatttgctgtgataagaaaagatattccacagtttcgtatttgttaagtattttcagcaaatcatggaacacgatgcaacacccgattccatgtttgaaaacagaacagaacaaaattcaacaagaaataagcgcccgcgtccacatattctcgtgcctggcgtgttttacgtgcttgggaagcggagcggccgctgggcttggctctgaggtcgggactggtgcaggcggatgcatgtatgtgcccgggtcccgcctccacacgcctgcctggcgccagcctgcctgtcctccctgcacccgcccccgctccctgcaccca

SEQ ID NO: 41610 - DNA, 30 bp, Homo sapiens
  misc_feature 1..30: note = chr7:157584643-157584673
  misc_feature 1..30: note = hypo
  source 1..30: mol_type = genomic DNA
ccgaccaggcctccacgaagtgcttcgata

SEQ ID NO: 41611 - DNA, 30 bp, Homo sapiens
  misc_feature 1..30: note = chr7:157585079-157585109
  misc_feature 1..30: note = hypo
  source 1..30: mol_type = genomic DNA
ttgctgtggctctggcggacattagccagc

SEQ ID NO: 41612 - DNA, 407 bp, Homo sapiens
  misc_feature 1..407: note = chr7:157588586-157588993
  misc_feature 1..407: note = hypo
  source 1..407: mol_type = genomic DNA
cacatgtgatgctgacgccctcagaaacctggggctaaggccacacctgatcaccgtgatggaggggggcaggcgccgaggcgaacttgggagaggccctatggtgcacacccctacccttcctggctggagaaaaatggcccgccccgtgaaacagcaaataaacacacgcgttccaggacgtgagatacggcctccacatcaatcagagggacctgcccagtcctgtcaattttccatctaaattacataactgtcctccttagagacgcggggatgcccaggcacaggcatgaaagatcggccttgaggttattttgtctctgcaagtattgatgcgaggacttgtggcgcttttctttcccggtgaactttcccaactgctgatgttacgtgcactaagcaca

SEQ ID NO: 41613 - DNA, 30 bp, Homo sapiens
  misc_feature 1..30: note = chr7:157601854-157601884
  misc_feature 1..30: note = hypo
  source 1..30: mol_type = genomic DNA
cagtccaaagaggaacgtgttgcgacaagc

SEQ ID NO: 41614 - DNA, 270 bp, Homo sapiens
  misc_feature 1..270: note = chr7:157606494-157606764
  misc_feature 1..270: note = hypo
  source 1..270: mol_type = genomic DNA
cagaatggcctggagcgcgggtaaaacagctcggggccagccagagcttctgagccagggctgggcccaagaacgtgcatttgcgttgttccccaggtgatgctgctggtgaccccggggaccccgccgtgagagccccgacacaagtcgcggtttgtggtgctttggaggagtttgctccttagagtgagggggattgttctgccccaatggcctcttcagagctgcgagactgtgcccacgcgaggcagtggtcgccacacccacact

SEQ ID NO: 41615 - DNA, 123 bp, Homo sapiens
  misc_feature 1..123: note = chr7:157633412-157633535
  misc_feature 1..123: note = hypo
  source 1..123: mol_type = genomic DNA
atccagagcctccagcgttttcacccagtgggttgctgctgctcagcagtcagggggacaggttgtttcttcctggtctcaggccacaggacccctgaagaggagccccgtcctcagacccct

SEQ ID NO: 41616 - DNA, 30 bp, Homo sapiens
  misc_feature 1..30: note = chr7:157642058-157642088
  misc_feature 1..30: note = hypo
  source 1..30: mol_type = genomic DNA
gctcatgtgggtgtgcgtcctctcagggtc

SEQ ID NO: 41617 - DNA, 30 bp, Homo sapiens
  misc_feature 1..30: note = chr7:157654407-157654437
  misc_feature 1..30: note = hypo
  source 1..30: mol_type = genomic DNA
gactcccagcctctgcgttgccagcagccc

SEQ ID NO: 41618 - DNA, 30 bp, Homo sapiens
  misc_feature 1..30: note = chr7:157656677-157656707
  misc_feature 1..30: note = hypo
  source 1..30: mol_type = genomic DNA
tacaggctccaaaaacgctctctgcatgtg

SEQ ID NO: 41619 - DNA, 213 bp, Homo sapiens
  misc_feature 1..213: note = chr7:157659256-157659469
  misc_feature 1..213: note = hypo
  source 1..213: mol_type = genomic DNA
ggtctgcaggaaacacgtccatagaggtggagctgaggctggtgtgcattctcccaggcacccagcatgagtgcccagctcagggtctgcaccgaggctgtctggcccgagtcccaggctcgccccagtgcttgccacacacaccctggggtctcctcagaagcagtgcctgtgccccgagatgcacggccaccaccccgcccctgaggccct

SEQ ID NO: 41620 - DNA, 30 bp, Homo sapiens
  misc_feature 1..30: note = chr7:157660091-157660121
  misc_feature 1..30: note = hypo
  source 1..30: mol_type = genomic DNA
gacgccctggatacacggccacctggatac

SEQ ID NO: 41621 - DNA, 30 bp, Homo sapiens
  misc_feature 1..30: note = chr7:157690247-157690277
  misc_feature 1..30: note = hypo
  source 1..30: mol_type = genomic DNA
ccagtttccatcagtcgccggctgctctcc

SEQ ID NO: 41622 - DNA, 30 bp, Homo sapiens
  misc_feature 1..30: note = chr7:157718446-157718476
  misc_feature 1..30: note = hypo
  source 1..30: mol_type = genomic DNA
tcagtcctagagacgcgtcacagagaaacg

SEQ ID NO: 41623 - DNA, 30 bp, Homo sapiens
  misc_feature 1..30: note = chr7:157722621-157722651
  misc_feature 1..30: note = hypo
  source 1..30: mol_type = genomic DNA
ttcagtccacatcagcgggtccaagcctgg

SEQ ID NO: 41624 - DNA, 161 bp, Homo sapiens; identical to SEQ ID NO: 15083
  misc_feature 1..161: note = chr7:157776781-157776942
  misc_feature 1..161: note = hypo
  source 1..161: mol_type = genomic DNA

SEQ ID NO: 41625 - DNA, 17 bp, Homo sapiens
  misc_feature 1..17: note = chr7:157793339-157793356
  misc_feature 1..17: note = hypo
  source 1..17: mol_type = genomic DNA
gtgggggctggtgtccg

SEQ ID NO: 41626 - DNA, 23 bp, Homo sapiens
  misc_feature 1..23: note = chr7:157793865-157793888
  misc_feature 1..23: note = hypo
  source 1..23: mol_type = genomic DNA
tggtgcaacgtggggctggggtc

SEQ ID NO: 41627 - DNA, 81 bp, Homo sapiens
  misc_feature 1..81: note = chr7:157794503-157794584
  misc_feature 1..81: note = hypo
  source 1..81: mol_type = genomic DNA
tgttgtgccctcacccggaaccgtgccaggcaccgaggaggtgctcagtaaactatggggttgcatcgtatttgaggtcat

SEQ ID NO: 41628 - DNA, 30 bp, Homo sapiens; identical to SEQ ID NO: 15085
  misc_feature 1..30: note = chr7:157877477-157877507
  misc_feature 1..30: note = hypo
  source 1..30: mol_type = genomic DNA

SEQ ID NO: 41629 - DNA, 90 bp, Homo sapiens
  misc_feature 1..90: note = chr7:157958578-157958668
  misc_feature 1..90: note = hypo
  source 1..90: mol_type = genomic DNA
gcagagcagtcacctcgaggccgacactgttcagctagtgcatggtgagcagcatgaaatccagacagggggcttcggaggatgtggcaa

SEQ ID NO: 41630 - DNA, 78 bp, Homo sapiens
  misc_feature 1..78: note = chr7:157987024-157987102
  misc_feature 1..78: note = hypo
  source 1..78: mol_type = genomic DNA
atgtccataaaagaacgggcatcaccattaaaaagatgggccagtctgggggcccttgctgtccggctctgctgccca

SEQ ID NO: 41631 - DNA, 30 bp, Homo sapiens
  misc_feature 1..30: note = chr7:158040286-158040316
  misc_feature 1..30: note = hypo
  source 1..30: mol_type = genomic DNA
ggacttgggtgtctgcggtttttttgtttg

SEQ ID NO: 41632 - DNA, 50 bp, Homo sapiens
  misc_feature 1..50: note = chr7:158059313-158059363
  misc_feature 1..50: note = hypo
  source 1..50: mol_type = genomic DNA
gggacccagcagcagcggcctcaggacaggcacaacggccacttcccggc

SEQ ID NO: 41633 - DNA, 30 bp, Homo sapiens
  misc_feature 1..30: note = chr7:158059960-158059990
  misc_feature 1..30: note = hypo
  source 1..30: mol_type = genomic DNA
ggtgctggagttgaccggctggcccggcag

SEQ ID NO: 41634 - DNA, 39 bp, Homo sapiens
  misc_feature 1..39: note = chr7:158065365-158065404
  misc_feature 1..39: note = hypo
  source 1..39: mol_type = genomic DNA
gaggggaggtctcagcgccactgccgggataagccctca

SEQ ID NO: 41635 - DNA, 30 bp, Homo sapiens
  misc_feature 1..30: note = chr7:158113225-158113255
  misc_feature 1..30: note = hypo
  source 1..30: mol_type = genomic DNA
gtgttcccgcgtcctcggcagcgccgggtg

SEQ ID NO: 41636 - DNA, 30 bp, Homo sapiens
  misc_feature 1..30: note = chr7:158144262-158144292
  misc_feature 1..30: note = hypo
  source 1..30: mol_type = genomic DNA
aaacatggttacctacgagtgaaatggcag

SEQ ID NO: 41637 - DNA, 132 bp, Homo sapiens
  misc_feature 1..132: note = chr7:158187607-158187739
  misc_feature 1..132: note = hypo
  source 1..132: mol_type = genomic DNA
gccgcatctctgcaacgcgtcagccagagaaagccgggggcaccccagccagcactcaggaggccctgcccgtccacacgacacctgggccaaccagccctttctgctgtaaaacttcggctcctctacctg

SEQ ID NO: 41638 - DNA, 30 bp, Homo sapiens
  misc_feature 1..30: note = chr7:158249183-158249213
  misc_feature 1..30: note = hypo
  source 1..30: mol_type = genomic DNA
gagaacataacggcacggatgccatcggcc

SEQ ID NO: 41639 - DNA, 44 bp, Homo sapiens
  misc_feature 1..44: note = chr7:158283192-158283236
  misc_feature 1..44: note = hypo
  source 1..44: mol_type = genomic DNA
gcaaaggttggcgttcggctccacgtccacgcctgtcttaaaca

SEQ ID NO: 41640 - DNA, 436 bp, Homo sapiens
  misc_feature 1..436: note = chr7:158301251-158301687
  misc_feature 1..436: note = hypo
  source 1..436: mol_type = genomic DNA
ggagaggagcaggtgcggaagtggctccgctcctgtgggtgtcggggcaacgtgggacgctcggagcaggtgcggaagtggctccgctcctgtgggtgtcggggcaacgtgggacgctcggagcaggtgcggaagtggctctgctcctgtgggtgtcggggcaacgtgggacgctcggagcaggtgcggaagtggctctgctcctgtgggtgtcggggcaacgtgggacgctcggagcaggtgcggaagtggctctgctcctgtgggtgtcggggcaacgtgggacgctcggagcaggtgcggaagtggctccgctcctgtgggtgtcggggcaacgtgggacgctcggagcaggtgcggaagtggctctgctcctgtgggtgtcagggcaacgtgggatgctcaggagggggcctcagcacgcaggaagctgagc

SEQ ID NO: 41641 - DNA, 30 bp, Homo sapiens
  misc_feature 1..30: note = chr7:158332352-158332382
  misc_feature 1..30: note = hypo
  source 1..30: mol_type = genomic DNA
tctagcgccgagtcccgggtcctgagggac

SEQ ID NO: 41642 - DNA, 65 bp, Homo sapiens
  misc_feature 1..65: note = chr7:158349464-158349529
  misc_feature 1..65: note = hypo
  source 1..65: mol_type = genomic DNA
cgcaggtcgctcccacgcaggtcaggcggctcccgcgcaggtcgctcccacgcaggtcaggcagc

SEQ ID NO: 41643 - DNA, 240 bp, Homo sapiens
  misc_feature 1..240: note = chr7:158550099-158550339
  misc_feature 1..240: note = hypo
  source 1..240: mol_type = genomic DNA
acccaaagtttccctcgtagatgcccttagggcagtggagccaggggagaaagcagagaacggtggattgtggtcaatgagagcaccaggagcaccacagacagtgagaggcagagccaaaggatcccagagctcgcgggacgccccttaatccagcgccaaaggatcccagagctcgcgggacgccccttaatccagagccaaaggatcctagagcccgcgggacgccccttaatcccg

SEQ ID NO: 41644 - DNA, 30 bp, Homo sapiens
  misc_feature 1..30: note = chr7:158564374-158564404
  misc_feature 1..30: note = hypo
  source 1..30: mol_type = genomic DNA
gtccctcagaagacacgccagctttccagc

SEQ ID NO: 41645 - DNA, 35 bp, Homo sapiens
  misc_feature 1..35: note = chr7:158857187-158857222
  misc_feature 1..35: note = hypo
  source 1..35: mol_type = genomic DNA
actgtggtctcaagtcggggcggccagctgggtgc

SEQ ID NO: 41646 - DNA, 30 bp, Homo sapiens
  misc_feature 1..30: note = chr7:158868457-158868487
  misc_feature 1..30: note = hypo
  source 1..30: mol_type = genomic DNA
cggcacccacggacccgctgcatcagtgag

SEQ ID NO: 41647 - DNA, 30 bp, Homo sapiens
  misc_feature 1..30: note = chr7:158963513-158963543
  misc_feature 1..30: note = hypo
  source 1..30: mol_type = genomic DNA
ggccactgtgaggatcgcgtgagcagaaac

SEQ ID NO: 41648 - DNA, 128 bp, Homo sapiens
  misc_feature 1..128: note = chr8:245097-245225
  misc_feature 1..128: note = hypo
  source 1..128: mol_type = genomic DNA
gaagcaagaaagcatcgtatgcctttgccttcacaaggtccggcctccagccattgtgacaatgataacgccgacccagaggagatgtggagaggactctggctccacttctgcggctctgtgcccat

SEQ ID NO: 41649 - DNA, 52 bp, Homo sapiens
  misc_feature 1..52: note = chr8:644647-644699
  misc_feature 1..52: note = hypo
  source 1..52: mol_type = genomic DNA
ccacgaggggcctcacggcttgctcgtctgtgaatcacggtgaccatgtaac

SEQ ID NO: 41650 - DNA, 30 bp, Homo sapiens
  misc_feature 1..30: note = chr8:700159-700189
  misc_feature 1..30: note = hypo
  source 1..30: mol_type = genomic DNA
ggctgcatgggcgaacgttcctgagtctgg

SEQ ID NO: 41651 - DNA, 30 bp, Homo sapiens
  misc_feature 1..30: note = chr8:854787-854817
  misc_feature 1..30: note = hypo
  source 1..30: mol_type = genomic DNA
ttctcagctgctaaacgctgctgtagaaca

SEQ ID NO: 41652 - DNA, 30 bp, Homo sapiens
  misc_feature 1..30: note = chr8:889984-890014
  misc_feature 1..30: note = hypo
  source 1..30: mol_type = genomic DNA
gcccatgagagaatccgggaatagaaggag

SEQ ID NO: 41653 - DNA, 164 bp, Homo sapiens
  misc_feature 1..164: note = chr8:914966-915130
  misc_feature 1..164: note = hypo
  source 1..164: mol_type = genomic DNA
acccccgcgtgcacacggcactgttcacctcacatggctcctgagtctgacccctgcgctgcacatggcactgttcaccacacagagctcctgagtctgaccccgcactgcacacggcagtgttcatcacacacgcggctccagagcccgacccccgcatgcac

SEQ ID NO: 41654 - DNA, 70 bp, Homo sapiens
  misc_feature 1..70: note = chr8:962490-962560
  misc_feature 1..70: note = hypo
  source 1..70: mol_type = genomic DNA
agccccccacttcagcggcagtgtggacaacgtccgaccagcccccccacttcagcggcagtgtagacac

SEQ ID NO: 41655 - DNA, 145 bp, Homo sapiens
  misc_feature 1..145: note = chr8:972705-972850
  misc_feature 1..145: note = hypo
  source 1..145: mol_type = genomic DNA
gggggtggacagtaccgtgccgaggtagatgctccaaccacaatccaccctccctgggagtggacagtcccatgccgaggtagacactccagccgccacccatcccccccgggagtggatggttccgtgccgaggtagacactcc

SEQ ID NO: 41656 - DNA, 126 bp, Homo sapiens
  misc_feature 1..126: note = chr8:976259-976385
  misc_feature 1..126: note = hypo
  source 1..126: mol_type = genomic DNA
gaccctctgagatggcgcgcttgccccatgaccccaacgctttgctcttcacgtctcctttgacaaaccactgtgacttcagattgccgttcacatggaagctccacttcacggttggtgttgtac

SEQ ID NO: 41657 - DNA, 30 bp, Homo sapiens
  misc_feature 1..30: note = chr8:1043872-1043902
  misc_feature 1..30: note = hypo
  source 1..30: mol_type = genomic DNA
acgatgggtgccagccgaggggtctgtctg

SEQ ID NO: 41658 - DNA, 47 bp, Homo sapiens
  misc_feature 1..47: note = chr8:1048584-1048631
  misc_feature 1..47: note = hypo
  source 1..47: mol_type = genomic DNA
cccacaccaggctcccggccgcccacgggcgccgccacccacgccag

SEQ ID NO: 41659 - DNA, 115 bp, Homo sapiens
  misc_feature 1..115: note = chr8:1051541-1051656
  misc_feature 1..115: note = hypo
  source 1..115: mol_type = genomic DNA
tttcatggcggcagacgctcagtctgggaagatggaagagttccggagatggtgacacgacaatgggaaggtcctcatcacccctgagccaaacatgacacgacgatgggaaggt

SEQ ID NO: 41660 - DNA, 53 bp, Homo sapiens
  misc_feature 1..53: note = chr8:1066123-1066176
  misc_feature 1..53: note = hypo
  source 1..53: mol_type = genomic DNA
ggccttgatgcggtacgcaatcccatccccatggggtgcgcaggcgtcagctg

SEQ ID NO: 41661 - DNA, 34 bp, Homo sapiens
  misc_feature 1..34: note = chr8:1133089-1133123
  misc_feature 1..34: note = hypo
  source 1..34: mol_type = genomic DNA
acacaaatgcattcacgttcgattccctcgagat

SEQ ID NO: 41662 - DNA, 39 bp, Homo sapiens
  misc_feature 1..39: note = chr8:1136184-1136223
  misc_feature 1..39: note = hypo
  source 1..39: mol_type = genomic DNA
atgggtcggtggcaccgagggcagcgctgcagtctgtgg

SEQ ID NO: 41663 - DNA, 19 bp, Homo sapiens
  misc_feature 1..19: note = chr8:1137245-1137264
  misc_feature 1..19: note = hypo
  source 1..19: mol_type = genomic DNA
ggaatctcacacacacggg

SEQ ID NO: 41664 - DNA, 79 bp, Homo sapiens
  misc_feature 1..79: note = chr8:1139165-1139244
  misc_feature 1..79: note = hypo
  source 1..79: mol_type = genomic DNA
gccccaggccgattccgcggttggggttgaccttacacaggatttgggccccaggccggttccgcggttggggttgagc

SEQ ID NO: 41665 - DNA, 58 bp, Homo sapiens
  misc_feature 1..58: note = chr8:1151131-1151189
  misc_feature 1..58: note = hypo
  source 1..58: mol_type = genomic DNA
aagaggaggatgccacggagccctgtggaggctgaagccgctgcgtagggagcccctt

SEQ ID NO: 41666 - DNA, 53 bp, Homo sapiens
  misc_feature 1..53: note = chr8:1153026-1153079
  misc_feature 1..53: note = hypo
  source 1..53: mol_type = genomic DNA
gggcacccacatccacgccggttccgtaagctgctctccggctctcccaaatg

SEQ ID NO: 41667 - DNA, 118 bp, Homo sapiens
  misc_feature 1..118: note = chr8:1153298-1153416
  misc_feature 1..118: note = hypo
  source 1..118: mol_type = genomic DNA
aatccatgagactggcgtgtccttcggtgacgaggccacccacccctcggtgttagaatccatgagactggcgtgtccttcggtgacgaggccgcccacccttcggtgttagaaccca

SEQ ID NO: 41668 - DNA, 30 bp, Homo sapiens
  misc_feature 1..30: note = chr8:1201984-1202014
  misc_feature 1..30: note = hypo
  source 1..30: mol_type = genomic DNA
actgtggtgttgtcacgtgggtgtgttgtg

SEQ ID NO: 41669 - DNA, 162 bp, Homo sapiens
  misc_feature 1..162: note = chr8:1246678-1246840
  misc_feature 1..162: note = hypo
  source 1..162: mol_type = genomic DNA
gatcacagtgtgacacgttctgtactggggtataaatacggtttcatggggacacacaggagggagctgagtgtgctcctctggccccggagagtgctgagaggcagcgtaccctgcagaagagtggcagtcgctgagcgtgggggacggctcagtaggtac

SEQ ID NO: 41670 - DNA, 30 bp, Homo sapiens
  misc_feature 1..30: note = chr8:1269400-1269430
  misc_feature 1..30: note = hypo
  source 1..30: mol_type = genomic DNA
gtctctgcatgtgcacgtgcatctgtgcca

SEQ ID NO: 41671 - DNA, 42 bp, Homo sapiens
  misc_feature 1..42: note = chr8:1281668-1281710
  misc_feature 1..42: note = hypo
  source 1..42: mol_type = genomic DNA
caggggttcacaccccgtttctcctcccgtgagtcctgtgtg

SEQ ID NO: 41672 - DNA, 142 bp, Homo sapiens
  misc_feature 1..142: note = chr8:1302672-1302814
  misc_feature 1..142: note = hypo
  source 1..142: mol_type = genomic DNA
tgtctcagaaaaaaagaaagaacgaaaagaaaataccttggaatgaaagactgtggggccattaagatgatgctgtgggtgaaggtggaaagtcacggatgatgctgcggatgaaggtggaaagtcacggatgatgctgcgg

SEQ ID NO: 41673 - DNA, 30 bp, Homo sapiens
  misc_feature 1..30: note = chr8:1303386-1303416
  misc_feature 1..30: note = hypo
  source 1..30: mol_type = genomic DNA
cagcggtgacacctgcgtgccagtgtgcac

SEQ ID NO: 41674 - DNA, 30 bp, Homo sapiens
  misc_feature 1..30: note = chr8:1306844-1306874
  misc_feature 1..30: note = hypo
  source 1..30: mol_type = genomic DNA
tgtctttaggagaaacgtgttatccccact

SEQ ID NO: 41675 - DNA, 30 bp, Homo sapiens
  misc_feature 1..30: note = chr8:1340176-1340206
  misc_feature 1..30: note = hypo
  source 1..30: mol_type = genomic DNA
aagaactgtttgaatcgccttatctatccc

SEQ ID NO: 41676 - DNA, 30 bp, Homo sapiens
  misc_feature 1..30: note = chr8:1362767-1362797
  misc_feature 1..30: note = hypo
  source 1..30: mol_type = genomic DNA
ctgagcggagctgcccggcagctgtctctg

SEQ ID NO: 41677 - DNA, 49 bp, Homo sapiens
  misc_feature 1..49: note = chr8:1380107-1380156
  misc_feature 1..49: note = hypo
  source 1..49: mol_type = genomic DNA
catgccagccagcaccgctacggctgccatccatcggggctgaatcctg

SEQ ID NO: 41678 - DNA, 150 bp, Homo sapiens
  misc_feature 1..150: note = chr8:1423699-1423849
  misc_feature 1..150: note = hypo
  source 1..150: mol_type = genomic DNA
gtgaggatcaatgagcggctgggagtaaacgtcttccatactgggtcaggtcaccaccctaaagccctacaaagtcgttgacccccataattcaggaacattgcttgtcatcccgggacccaccgcaaggccgagcggagaggaagacag

SEQ ID NO: 41679 - DNA, 30 bp, Homo sapiens
  misc_feature 1..30: note = chr8:1443699-1443729
  misc_feature 1..30: note = hypo
  source 1..30: mol_type = genomic DNA
ctggcccggcgaggtcggtgtgctgagacc

SEQ ID NO: 41680 - DNA, 101 bp, Homo sapiens
  misc_feature 1..101: note = chr8:1471545-1471646
  misc_feature 1..101: note = hypo
  source 1..101: mol_type = genomic DNA
gatttgccggcctcacgccggccgagccactgctgacttcacgcagccccagccatgcccccacgcagacacacggagccccaaggcgggccagatctcag

SEQ ID NO: 41681 - DNA, 74 bp, Homo sapiens
  misc_feature 1..74: note = chr8:1501600-1501674
  misc_feature 1..74: note = hypo
  source 1..74: mol_type = genomic DNA
cagccctgttttattcggcgtgttcacggtcagcagccccgttgtgcttggcgtgttcacgggcagccccgtta

SEQ ID NO: 41682 - DNA, 156 bp, Homo sapiens
  misc_feature 1..156: note = chr8:1574846-1575002
  misc_feature 1..156: note = hypo
  source 1..156: mol_type = genomic DNA
acctctgccctgcagcgggtgctcacagaatgccttttctcctttcttctttcctgtagccagacctacctgcaagctgcaagcgatgtgcctgtgggacacagcctggaccccgctgcgaactacaactccccgaaattccgctcccggaaccag

SEQ ID NO: 41683 - DNA, 30 bp, Homo sapiens
  misc_feature 1..30: note = chr8:1588688-1588718
  misc_feature 1..30: note = hypo
  source 1..30: mol_type = genomic DNA
tgatccccattagaacgtctcagaaactgc

SEQ ID NO: 41684 - DNA, 69 bp, Homo sapiens
  misc_feature 1..69: note = chr8:1588920-1588989
  misc_feature 1..69: note = hypo
  source 1..69: mol_type = genomic DNA
aagtctcacgtggcccgcccccccgcatctagacttgtgttttacagtaaatgacgaaatgcagtccag

SEQ ID NO: 41685 - DNA, 30 bp, Homo sapiens
  misc_feature 1..30: note = chr8:1616193-1616223
  misc_feature 1..30: note = hypo
  source 1..30: mol_type = genomic DNA
tgctgctggatttgtcggtatttttaaatg

SEQ ID NO: 41686 - DNA, 38 bp, Homo sapiens
  misc_feature 1..38: note = chr8:1645305-1645343
  misc_feature 1..38: note = hypo
  source 1..38: mol_type = genomic DNA
tccccaggaccccagcgccatgccgaggccgacgtcgc

SEQ ID NO: 41687 - DNA, 76 bp, Homo sapiens
  misc_feature 1..76: note = chr8:1778994-1779070
  misc_feature 1..76: note = hypo
  source 1..76: mol_type = genomic DNA
aggagccatggcaggcgaggcgccaagagaatggggtcattgcctgaaatgccactggagccgagagatgagctga

SEQ ID NO: 41688 - DNA, 30 bp, Homo sapiens
  misc_feature 1..30: note = chr8:2536020-2536050
  misc_feature 1..30: note = hypo
  source 1..30: mol_type = genomic DNA
tcggttagaaattgtcgatggaagagcatt

SEQ ID NO: 41689 - DNA, 56 bp, Homo sapiens
  misc_feature 1..56: note = chr8:2652772-2652828
  misc_feature 1..56: note = hypo
  source 1..56: mol_type = genomic DNA
atactatgggaacagcggactgaaggcatccactgccagaccgtgagttatcaact

SEQ ID NO: 41690 - DNA, 37 bp, Homo sapiens
  misc_feature 1..37: note = chr8:3769062-3769099
  misc_feature 1..37: note = hypo
  source 1..37: mol_type = genomic DNA
aaaaaaaagaagaagaagaaaacgaaggctatataac

SEQ ID NO: 41691 - DNA, 24 bp, Homo sapiens
  misc_feature 1..24: note = chr8:5949419-5949443
  misc_feature 1..24: note = hypo
  source 1..24: mol_type = genomic DNA
ggcaaactccgtcttttctatccg

SEQ ID NO: 41692 - DNA, 21 bp, Homo sapiens
  misc_feature 1..21: note = chr8:6063185-6063206
  misc_feature 1..21: note = hypo
  source 1..21: mol_type = genomic DNA
ataagacgatgaacaaggatc

SEQ ID NO: 41693 - DNA, 196 bp, Homo sapiens
  misc_feature 1..196: note = chr8:6434295-6434491
  misc_feature 1..196: note = hypo
  source 1..196: mol_type = genomic DNA
tgacctcaggtgatccgtccgcaggtgagccacccgcctcggcctcctaaagtgctgggagaggcacaggcgtcagccacagtgcctggcctactgtcttctctaaaatggcatctgtgcattcatctcagccgcccctgctcagataaaagcaatggcgcctcctttgaaatctgagagacgcagggccctgccc

SEQ ID NO: 41694 - DNA, 30 bp, Homo sapiens
  misc_feature 1..30: note = chr8:6542607-6542637
  misc_feature 1..30: note = hypo
  source 1..30: mol_type = genomic DNA
tcagttgaacaaatccgtgtccaaaagaaa

SEQ ID NO: 41695 - DNA, 30 bp, Homo sapiens
  misc_feature 1..30: note = chr8:6932550-6932580
  misc_feature 1..30: note = hypo
  source 1..30: mol_type = genomic DNA
gttgtacaccacctgcgatatttggagtca

SEQ ID NO: 41696 - DNA, 360 bp, Homo sapiens
  misc_feature 1..360: note = chr8:8639451-8639811
  misc_feature 1..360: note = hypo
  source 1..360: mol_type = genomic DNA
ctgtcacctctcagcgggatgcagccgtagggccagccacacctctcccacgtgggacgcacctcttgtgacacttcttttggaaattctagttgcctcctgctttcctctgttctgttggcaaaagtggctttgaattctgcacaccccacggttctacctgccttgtcaggagtcttgcagtgaggccctcctggtctgaagcgatcccttcttccctgtattgcgctgtcttcagggcagggctcctcttgttacagtaggtagtcaggcacacataagcagggcagaagaacgccccccagcaaccatcaggtgagatggtcaggtggttgttacactgtctctctaaaataattg

SEQ ID NO: 41697 - DNA, 75 bp, Homo sapiens
  misc_feature 1..75: note = chr8:8748377-8748452
  misc_feature 1..75: note = hypo
  source 1..75: mol_type = genomic DNA
tgaggttgtggaagacgtgctccttgagagccggactgtcctcaaagtagagtagcttgccgctctcatgcaggt

SEQ ID NO: 41698 - DNA, 335 bp, Homo sapiens
  misc_feature 1..335: note = chr8:8748683-8749018
  misc_feature 1..335: note = hypo
  source 1..335: mol_type = genomic DNA
agctaacaggcaacacgggggagaggatctgcagccggtggttgagcaggtattgaaaatgggccttgcgccgtcgaaggttcttgtccgaaacgccatagtaggctgcgtgggggctggcagagcgcagctcgaagtcccgggccagtgcctcgtccaccaccttggccaagcggctcagtccctccgcgtcgtgcttctcctgcagggcgatctggcggtgaatgtccagacatttctcctccagctcacgctctccgcacaggtctgcgtgggtgcccacgatgcacaccaccgcgtggggcactctcgccccgacccgatgcaagaaggag

SEQ ID NO: 41699 - DNA, 30 bp, Homo sapiens
  misc_feature 1..30: note = chr8:8898369-8898399
  misc_feature 1..30: note = hypo
  source 1..30: mol_type = genomic DNA
gcctctccatcagcccgccagcaccaagcc

SEQ ID NO: 41700 - DNA, 30 bp, Homo sapiens
  misc_feature 1..30: note = chr8:8898687-8898717
  misc_feature 1..30: note = hypo
  source 1..30: mol_type = genomic DNA
aattccaagcaacaacgtattagggatgat

SEQ ID NO: 41701 - DNA, 115 bp, Homo sapiens
  misc_feature 1..115: note = chr8:10005445-10005560
  misc_feature 1..115: note = hypo
  source 1..115: mol_type = genomic DNA
cgactttagagggaccggaaaggggaagcgagtctcccatggtttgaggtgttgctgcccgtacctgtgcacttggccacagtccaaagtgactccattgcgggcacagccgtgg

SEQ ID NO: 41702 - DNA, 32 bp, Homo sapiens
  misc_feature 1..32: note = chr8:10192893-10192925
  misc_feature 1..32: note = hypo
  source 1..32: mol_type = genomic DNA
ccgtggctccaaagccgcgaggacagcactcc

SEQ ID NO: 41703 - DNA, 30 bp, Homo sapiens
  misc_feature 1..30: note = chr8:10261847-10261877
  misc_feature 1..30: note = hypo
  source 1..30: mol_type = genomic DNA
cagccccgtgacaaacgacagtcaagcttg

SEQ ID NO: 41704 - DNA, 142 bp, Homo sapiens
  misc_feature 1..142: note = chr8:10528983-10529125
  misc_feature 1..142: note = hypo
  source 1..142: mol_type = genomic DNA
acactcagaagcccccgaggacccctggacaccccacaggcggcgcaggtccgcaggtatccgttctttggggagaggtgtggtgagtcgcacactccaagacagagaggggtgaacaccgccactgcgtaaatgtgtgagt

SEQ ID NO: 41705 - DNA, 56 bp, Homo sapiens
  misc_feature 1..56: note = chr8:10548206-10548262
  misc_feature 1..56: note = hypo
  source 1..56: mol_type = genomic DNA
gcccagcccagactccgggtatgagggcccaaggaagccaccggagccccctggtc

SEQ ID NO: 41706 - DNA, 30 bp, Homo sapiens
  misc_feature 1..30: note = chr8:11704567-11704597
  misc_feature 1..30: note = hypo
  source 1..30: mol_type = genomic DNA
gtagagcaggaagtccgaatacacagagaa

SEQ ID NO: 41707 - DNA, 238 bp, Homo sapiens
  misc_feature 1..238: note = chr8:11705917-11706155
  misc_feature 1..238: note = hypo
  source 1..238: mol_type = genomic DNA
taccagaccaggctacgagtgcccttccgggtagaacactgattctcaactgagcagacgctaaacttccctaaggtacttaaaaacaccaccagttctctgaaatgagaatcgccagtgattcccatttaactagttaggggagaagcccatgcatttttttaagccctcaggcatttcggatctgcagccgccagtgaacaccgctactgcggaaccaaggcgaggctgcaggcag

SEQ ID NO: 41708 - DNA, 37 bp, Homo sapiens
  misc_feature 1..37: note = chr8:11708426-11708463
  misc_feature 1..37: note = hypo
  source 1..37: mol_type = genomic DNA
tgtggccattgttcccgtgcatcgaagcttgcaggca

SEQ ID NO: 41709 - DNA, 29 bp, Homo sapiens
  misc_feature 1..29: note = chr8:11726469-11726498
  misc_feature 1..29: note = hypo
  source 1..29: mol_type = genomic DNA
cagaggggctgggttcggtggctcacgcc

SEQ ID NO: 41710 - DNA, 120 bp, Homo sapiens
  misc_feature 1..120: note = chr8:11726738-11726858
  misc_feature 1..120: note = hypo
  source 1..120: mol_type = genomic DNA
aagagtgaaactctgtattaaaaaaaaaaaaaaggctcagaagaatcgtattttatccaggctgtggcgacagtaagaaggcagtagccgggtgcagtggctcacgcctgtaatcccagc

SEQ ID NO: 41711 - DNA, 149 bp, Homo sapiens
  misc_feature 1..149: note = chr8:12671777-12671926
  misc_feature 1..149: note = hypo
  source 1..149: mol_type = genomic DNA
ccaaggggtgggtggcgagggccagcagttggcggcacccactccctgtctcctctcacttggtatctccctggcctcacgctcaatcaggtcttccgtgaccacacagggaaatgaagaatactgttcgcttacgaagaatctgggaa

SEQ ID NO: 41712 - DNA, 86 bp, Homo sapiens
  misc_feature 1..86: note = chr8:12831656-12831742
  misc_feature 1..86: note = hypo
  source 1..86: mol_type = genomic DNA
gtgacaagcaagaccctgtcccttaaaaaagaaaagaaaaggacttttctggctccctaacctctccttgccggctcccttcacca

SEQ ID NO: 41713 - DNA, 89 bp, Homo sapiens
  misc_feature 1..89: note = chr8:12949930-12950019
  misc_feature 1..89: note = hypo
  source 1..89: mol_type = genomic DNA
ctattttctcatgcacgccaacagaccagtctcaggtatgtctttattagcggtgtgagaatggactaatatagcggtctaaccttctt

SEQ ID NO: 41714 - DNA, 108 bp, Homo sapiens
  misc_feature 1..108: note = chr8:12952416-12952524
  misc_feature 1..108: note = hypo
  source 1..108: mol_type = genomic DNA
cgcagagcctgaatccgggacttgacccccgattttctgaagagcccaacctgtcggaagagcaacactaagtgtggggtacattcacgtggacgcagtgtttacacc

SEQ ID NO: 41715 - DNA, 90 bp, Homo sapiens
  misc_feature 1..90: note = chr8:12956998-12957088
  misc_feature 1..90: note = hypo
  source 1..90: mol_type = genomic DNA
ctgttttggagaggacgggcagggagagaccgagtccagggctgagtccgaatctccctcatcagaaaacttctccgaccactgattgac

SEQ ID NO: 41716 - DNA, 20 bp, Homo sapiens
  misc_feature 1..20: note = chr8:13003493-13003513
  misc_feature 1..20: note = hypo
  source 1..20: mol_type = genomic DNA
aatatactgtagggccgggc

SEQ ID NO: 41717 - DNA, 30 bp, Homo sapiens
  misc_feature 1..30: note = chr8:13319931-13319961
  misc_feature 1..30: note = hypo
  source 1..30: mol_type = genomic DNA
agtctggctggctggcgacagcccaggctg

SEQ ID NO: 41718 - DNA, 30 bp, Homo sapiens
  misc_feature 1..30: note = chr8:13654931-13654961
  misc_feature 1..30: note = hypo
  source 1..30: mol_type = genomic DNA
agaatagttatgggccgggtgcggtggctc

SEQ ID NO: 41719 - DNA, 80 bp, Homo sapiens
  misc_feature 1..80: note = chr8:14898122-14898202
  misc_feature 1..80: note = hypo
  source 1..80: mol_type = genomic DNA
tctatctcaaaacaaaaaagtgatttcacttccaagtaaaatgaatatgattatatttagttgatcgtactgcttttatt

SEQ ID NO: 41720 - DNA, 95 bp, Homo sapiens
  misc_feature 1..95: note = chr8:20317378-20317473
  misc_feature 1..95: note = hypo
  source 1..95: mol_type = genomic DNA
gcacacacacacacacgcgcgcacacacacacacacacacgggcatgcacacatgcatgctagaaactcacagaaatttccgagcaaaaccctta

SEQ ID NO: 41721 - DNA, 125 bp, Homo sapiens
  misc_feature 1..125: note = chr8:20431789-20431914
  misc_feature 1..125: note = hypo
  source 1..125: mol_type = genomic DNA
aaagggcgtttctttcgcaggtaggagagagactgtcttccctctccctgcctttctgggtatgaggaagggagcacattggctgcaggggctgcaggcagccatcttgacgccacgtgggaaac

SEQ ID NO: 41722 - DNA, 33 bp, Homo sapiens
  misc_feature 1..33: note = chr8:21302252-21302285
  misc_feature 1..33: note = hypo
  source 1..33: mol_type = genomic DNA
tgtcacactcctgctcgccgtgcacctggagag

SEQ ID NO: 41723 - DNA, 173 bp, Homo sapiens
  misc_feature 1..173: note = chr8:21393876-21394049
  misc_feature 1..173: note = hypo
  source 1..173: mol_type = genomic DNA
caaaacaaaaagtaacgtaaaggcattttcagatcactgaaagtagaaagaattcattaccaacagacccacaccacaagaaatgctaaccgaagttatttgggctcaatagaaattatgcgagatggaaatttggaaatacaggaaggaatgaagaacgctgaaaattatca

SEQ ID NO: 41724 - DNA, 30 bp, Homo sapiens
  misc_feature 1..30: note = chr8:21563318-21563348
  misc_feature 1..30: note = hypo
  source 1..30: mol_type = genomic DNA
tgatgcagagaaggccgggctcaggctgtc

SEQ ID NO: 41725 - DNA, 101 bp, Homo sapiens
  misc_feature 1..101: note = chr8:21608043-21608144
  misc_feature 1..101: note = hypo
  source 1..101: mol_type = genomic DNA
gcctggcaatgcaagcgccctcctgccagcaccaccggggctgccgcggcactcaccgacacaggtggtcagtccggcacacgccacgcaggtccaggcag

SEQ ID NO: 41726 - DNA, 15 bp, Homo sapiens
  misc_feature 1..15: note = chr8:22101753-22101768
  misc_feature 1..15: note = hypo
  source 1..15: mol_type = genomic DNA
cgaaattgtgatacg

SEQ ID NO: 41727 - DNA, 233 bp, Homo sapiens
  misc_feature 1..233: note = chr8:23290404-23290637
  misc_feature 1..233: note = hypo
  source 1..233: mol_type = genomic DNA
ttccttttgagtcttcgtggagctgtgagctggatcacaaggtccccggggcattctgggcgggaaggccctcctccatccagagggcggcggccgagctgctccggggagtgcgcctgtggatgcgccgcagccgcagcaggtacagcaggatggccagcagcaccaccaggaagcagccagagaacaggtagtggttgtagacaaaggaaacgccccgccagtgggtgtga

SEQ ID NO: 41728 - DNA, 30 bp, Homo sapiens
  misc_feature 1..30: note = chr8:23331189-23331219
  misc_feature 1..30: note = hypo
  source 1..30: mol_type = genomic DNA
cctcaaacagagctccgtttcttgaattct

SEQ ID NO: 41729 - DNA, 30 bp, Homo sapiens
  misc_feature 1..30: note = chr8:23340639-23340669
  misc_feature 1..30: note = hypo
  source 1..30: mol_type = genomic DNA
cccgcagcacagcagcggttgaagcagcac

SEQ ID NO: 41730 - DNA, 30 bp, Homo sapiens
  misc_feature 1..30: note = chr8:23380796-23380826
  misc_feature 1..30: note = hypo
  source 1..30: mol_type = genomic DNA
ttcaggtagagctgccgggaggcacatgaa

SEQ ID NO: 41731 - DNA, 30 bp, Homo sapiens
  misc_feature 1..30: note = chr8:23395420-23395450
  misc_feature 1..30: note = hypo
  source 1..30: mol_type = genomic DNA
cttgcatgtaaagcccgacctttgcatggc

SEQ ID NO: 41732 - DNA, 38 bp, Homo sapiens; identical to SEQ ID NO: 15103
  misc_feature 1..38: note = chr8:23399594-23399632
  misc_feature 1..38: note = hypo
  source 1..38: mol_type = genomic DNA

SEQ ID NO: 41733 - DNA, 152 bp, Homo sapiens; identical to SEQ ID NO: 15104
  misc_feature 1..152: note = chr8:23423918-23424070
  misc_feature 1..152: note = hypo
  source 1..152: mol_type = genomic DNA

SEQ ID NO: 41734 - DNA, 30 bp, Homo sapiens
  misc_feature 1..30: note = chr8:23430870-23430900
  misc_feature 1..30: note = hypo
  source 1..30: mol_type = genomic DNA
gctctgccaggctgccgtgcaagggaatac

SEQ ID NO: 41735 - DNA, 41 bp, Homo sapiens
  misc_feature 1..41: note = chr8:25318815-25318856
  misc_feature 1..41: note = hypo
  source 1..41: mol_type = genomic DNA
gaagattgattctggctaatgtccttcgagcagtagaaatg

SEQ ID NO: 41736 - DNA, 216 bp, Homo sapiens
  misc_feature 1..216: note = chr8:25397045-25397261
  misc_feature 1..216: note = hypo
  source 1..216: mol_type = genomic DNA
gggagaggagatggccggcccagttcaacagactgtgagcccggctggctgctgggcgtgtagcgatcactgaggacaggtcagcctggggatttggagcgcagctacctgcagtacctgttctaactccgtctgtgtcggagcgcccttctgttatcctcagtgcattagcatggctatttttttttttttttgagacggagtctcgctcttccg

SEQ ID NO: 41737 - DNA, 30 bp, Homo sapiens
  misc_feature 1..30: note = chr8:26267175-26267205
  misc_feature 1..30: note = hypo
  source 1..30: mol_type = genomic DNA
gtgtctataccttgccgtctctctttcagt

SEQ ID NO: 41738 - DNA, 18 bp, Homo sapiens
  misc_feature 1..18: note = chr8:27914784-27914802
  misc_feature 1..18: note = hypo
  source 1..18: mol_type = genomic DNA
tgctattgataaatacgg

SEQ ID NO: 41739 - DNA, 30 bp, Homo sapiens
  misc_feature 1..30: note = chr8:27931084-27931114
  misc_feature 1..30: note = hypo
  source 1..30: mol_type = genomic DNA
ttatatccctgtcatcgtcctatagggaag

SEQ ID NO: 41740 - DNA, 30 bp, Homo sapiens
  misc_feature 1..30: note = chr8:28938557-28938587
  misc_feature 1..30: note = hypo
  source 1..30: mol_type = genomic DNA
cagcagacagggaaacgctggcaggtcctg

SEQ ID NO: 41741 - DNA, 30 bp, Homo sapiens
  misc_feature 1..30: note = chr8:29157762-29157792
  misc_feature 1..30: note = hypo
  source 1..30: mol_type = genomic DNA
cccttagctattgctcgtagtatccagggg

SEQ ID NO: 41742 - DNA, 28 bp, Homo sapiens
  misc_feature 1..28: note = chr8:29596408-29596436
  misc_feature 1..28: note = hypo
  source 1..28: mol_type = genomic DNA
tttttaggctgggcacggtagttcatgc

SEQ ID NO: 41743 - DNA, 28 bp, Homo sapiens
  misc_feature 1..28: note = chr8:29596676-29596704
  misc_feature 1..28: note = hypo
  source 1..28: mol_type = genomic DNA
cagaacaagactccgtctcaaaaaaaaa

SEQ ID NO: 41744 - DNA, 148 bp, Homo sapiens
  misc_feature 1..148: note = chr8:32987430-32987578
  misc_feature 1..148: note = hypo
  source 1..148: mol_type = genomic DNA
gcgccttgttgctgccgcagcctcacatgtggaaagacaagagggcaagagctaactgaatgtggtgtgaagcctcttttataatggccttaatcccactttggaggaagaagctcgcaggacctaatcacctctcaaaggccccacc

SEQ ID NO: 41745 - DNA, 30 bp, Homo sapiens
  misc_feature 1..30: note = chr8:37706125-37706155
  misc_feature 1..30: note = hypo
  source 1..30: mol_type = genomic DNA
tgcgactaacttgttcgttttcccctgtgc

SEQ ID NO: 41746 - DNA, 22 bp, Homo sapiens
  misc_feature 1..22: note = chr8:37961880-37961902
  misc_feature 1..22: note = hypo
  source 1..22: mol_type = genomic DNA
aattctgcgaccatatgttaaa

SEQ ID NO: 41747 - DNA, 30 bp, Homo sapiens
  misc_feature 1..30: note = chr8:38005823-38005853
  misc_feature 1..30: note = hypo
  source 1..30: mol_type = genomic DNA
agagtctcttctagccgagaacctggatac

SEQ ID NO: 41748 - DNA, 31 bp, Homo sapiens
  misc_feature 1..31: note = chr8:38786050-38786081
  misc_feature 1..31: note = hypo
  source 1..31: mol_type = genomic DNA
atcaccgcgcccggcccgacctggtctttaa

SEQ ID NO: 41749 - DNA, 148 bp, Homo sapiens
  misc_feature 1..148: note = chr8:41146864-41147012
  misc_feature 1..148: note = hypo
  source 1..148: mol_type = genomic DNA
acagttcagtagcagcgcagaaattagatgccaggactccagaatctgtgttatttttttcttactccatattttatcttctaacgcagaagtctttgtttttgtttcttaacaggtgggtaaactgagccaccgagtgcttcagtga

SEQ ID NO: 41750 - DNA, 30 bp, Homo sapiens
  misc_feature 1..30: note = chr8:41510183-41510213
  misc_feature 1..30: note = hypo
  source 1..30: mol_type = genomic DNA
ggcgttggtgtctggcgcccctaggatgag

SEQ ID NO: 41751 - DNA, 82 bp, Homo sapiens
  misc_feature 1..82: note = chr8:41523651-41523733
  misc_feature 1..82: note = hypo
  source 1..82: mol_type = genomic DNA
ctcatctgtgaagcacggattaaagtgctctccccaccctttctcaaggctgctgggacaatcatgccgcttatgaatgcta

SEQ ID NO: 41752 - DNA, 137 bp, Homo sapiens
  misc_feature 1..137: note = chr8:41554224-41554361
  misc_feature 1..137: note = hypo
  source 1..137: mol_type = genomic DNA
tgttgtctgaggtctcggtggccgggctgctggggatgagggagtcctcatcatactctttagatgcctgaggagagagaaagggtcctcctgtcccacctcctcccgggccagctggatgccgtgccagggcgtgg

SEQ ID NO: 41753 - DNA, 61 bp, Homo sapiens
  misc_feature 1..61: note = chr8:41566351-41566412
  misc_feature 1..61: note = hypo
  source 1..61: mol_type = genomic DNA
cgtggccctcctgggcggccaggtgaaggggcgtcacaccttgcaccgactcggcgtttgc

SEQ ID NO: 41754 - DNA, 52 bp, Homo sapiens
  misc_feature 1..52: note = chr8:41594902-41594954
  misc_feature 1..52: note = hypo
  source 1..52: mol_type = genomic DNA
gaagcttagagctaacgaatggatctgattgtgacctcggcaattgatctct

SEQ ID NO: 41755 - DNA, 64 bp, Homo sapiens
  misc_feature 1..64: note = chr8:41611241-41611305
  misc_feature 1..64: note = hypo
  source 1..64: mol_type = genomic DNA
ctgttcccatctttacgtccctgtctctgtcgctgagtgttgtgactctcgcccctacctgtaa

SEQ ID NO: 41756 - DNA, 53 bp, Homo sapiens
  misc_feature 1..53: note = chr8:41668167-41668220
  misc_feature 1..53: note = hypo
  source 1..53: mol_type = genomic DNA
ggccttccagagcaacgtgccgccgaagcgtaatagcccgatgggttcatctt

SEQ ID NO: 41757 - DNA, 30 bp, Homo sapiens
  misc_feature 1..30: note = chr8:41689306-41689336
  misc_feature 1..30: note = hypo
  source 1..30: mol_type = genomic DNA
cccacacgtcctcagcgtgtgaatgaatag

SEQ ID NO: 41758 - DNA, 32 bp, Homo sapiens
  misc_feature 1..32: note = chr8:41910307-41910339
  misc_feature 1..32: note = hypo
  source 1..32: mol_type = genomic DNA
acagctagtatgtggcgcgcacctgagcctgg

SEQ ID NO: 41759 - DNA, 33 bp, Homo sapiens
  misc_feature 1..33: note = chr8:42036407-42036440
  misc_feature 1..33: note = hypo
  source 1..33: mol_type = genomic DNA
tggttacctggcaggcgtcgtgcaagtttgcct

SEQ ID NO: 41760 - DNA, 127 bp, Homo sapiens
  misc_feature 1..127: note = chr8:42144632-42144759
  misc_feature 1..127: note = hypo
  source 1..127: mol_type = genomic DNA
ggcagctggagtgcccgaggccagagccgctttccctgctgcccgtgccacagcctcagggcctgcccgtctccagtgtccccactcatgcaccagggagaagaggggaggccgccaggagccagtg

SEQ ID NO: 41761 - DNA, 23 bp, Homo sapiens
  misc_feature 1..23: note = chr8:42333901-42333924
  misc_feature 1..23: note = hypo
  source 1..23: mol_type = genomic DNA
tgagccaccgtgcccggccggtt

SEQ ID NO: 41762 - DNA, 30 bp, Homo sapiens; identical to SEQ ID NO: 15108
  misc_feature 1..30: note = chr8:42699267-42699297
  misc_feature 1..30: note = hypo
  source 1..30: mol_type = genomic DNA

SEQ ID NO: 41763 - DNA, 35 bp, Homo sapiens
  misc_feature 1..35: note = chr8:42749967-42750002
  misc_feature 1..35: note = hypo
  source 1..35: mol_type = genomic DNA
attacaggcgcgagacaccgcgcctggccacgtat

SEQ ID NO: 41764 - DNA, 42 bp, Homo sapiens
  misc_feature 1..42: note = chr8:43401723-43401765
  misc_feature 1..42: note = hypo
  source 1..42: mol_type = genomic DNA
tctgccaagatctggcgcagggcctgacgggaaggcactggc

SEQ ID NO: 41765 - DNA, 153 bp, Homo sapiens
  misc_feature 1..153: note = chr8:43416676-43416829
  misc_feature 1..153: note = hypo
  source 1..153: mol_type = genomic DNA
cccccccgtcacctccgggagagagacatgcaccctggggtgaaagccagggactccacagcctgcccatgtttagcgcagggcctgccgggaaggcactggcctcgggggggatgaacccagcctcctcttctgcctcgctgctttttttcc

SEQ ID NO: 41766 - DNA, 30 bp, Homo sapiens
  misc_feature 1..30: note = chr8:47016307-47016337
  misc_feature 1..30: note = hypo
  source 1..30: mol_type = genomic DNA
gaccacgctaccctgcggctctgctttcac

SEQ ID NO: 41767 - DNA, 124 bp, Homo sapiens
  misc_feature 1..124: note = chr8:47093290-47093414
  misc_feature 1..124: note = hypo
  source 1..124: mol_type = genomic DNA
tcccaccattccctgcggcctcgctgctacccccatctgccagcctcaacatccccatgagtccctatgtcctgtccacaccgcaccgaggccaagttttcgctagtggcggccttctgctaga

SEQ ID NO: 41768 - DNA, 183 bp, Homo sapiens
  misc_feature 1..183: note = chr8:47155037-47155220
  misc_feature 1..183: note = hypo
  source 1..183: mol_type = genomic DNA
gtggcaaaggctcagcgctttgtttaggcaggcagaggagaaaagcagcaagaccgcagggaatgctgagagctcccaaatatgcctctcacatttcagcagcacccagggctgtcccgggcgggcagtaaagccccagactttggagcatgctgcctgtgtctgtcgcgaaaggcccccaca

SEQ ID NO: 41769 - DNA, 108 bp, Homo sapiens
  misc_feature 1..108: note = chr8:47334490-47334598
  misc_feature 1..108: note = hypo
  source 1..108: mol_type = genomic DNA
aggcctgcagaagggcgaagcagcgagaccgcggagaatgctgggatactgccaaggaggcctctaccatccaagaagcccgcagggatgtcccgaactggttgtaaa

SEQ ID NO: 41770 - DNA, 30 bp, Homo sapiens
  misc_feature 1..30: note = chr8:47355877-47355907
  misc_feature 1..30: note = hypo
  source 1..30: mol_type = genomic DNA
cttgtgggggctttccgtgacagatacagg

SEQ ID NO: 41771 - DNA, 37 bp, Homo sapiens
  misc_feature 1..37: note = chr8:48045032-48045069
  misc_feature 1..37: note = hypo
  source 1..37: mol_type = genomic DNA
ggaggggcagcctggcggaactcgctgcaaatggcct

SEQ ID NO: 41772 - DNA, 168 bp, Homo sapiens; identical to SEQ ID NO: 15113
  misc_feature 1..168: note = chr8:48294168-48294336
  misc_feature 1..168: note = hypo
  source 1..168: mol_type = genomic DNA

SEQ ID NO: 41773 - DNA, 30 bp, Homo sapiens
  misc_feature 1..30: note = chr8:48676823-48676853
  misc_feature 1..30: note = hypo
  source 1..30: mol_type = genomic DNA
gggcctagcccctgacgctctgcagcgttg

SEQ ID NO: 41774 - DNA, 45 bp, Homo sapiens
  misc_feature 1..45: note = chr8:48796372-48796417
  misc_feature 1..45: note = hypo
  source 1..45: mol_type = genomic DNA
cagttgcctgtgtcccgctacgccctctggcgtccctttcctcag

SEQ ID NO: 41775 - DNA, 251 bp, Homo sapiens
  misc_feature 1..251: note = chr8:49334991-49335242
  misc_feature 1..251: note = hypo
  source 1..251: mol_type = genomic DNA
gggctgcgctgccttcgggggcacgtgacgccacgtgggaagtgctgtgaggctggtgcggagagcaaacctcctgcaactcttagcgagtaaatgggcacatccacactggagttgaacacaggggcgccggccacgggttcaggctagcccgggcgtctggcttccctgccaggatggctgcctcgttactgagatggaacacacaacacagccgcgtgggcagtgggaggctgcgaggttagcctggc

SEQ ID NO: 41776 - DNA, 45 bp, Homo sapiens
  misc_feature 1..45: note = chr8:49496375-49496420
  misc_feature 1..45: note = hypo
  source 1..45: mol_type = genomic DNA
agcggtgccatcaaccgacactcgtcctcccgcccttccctgccc

SEQ ID NO: 41777 - DNA, 59 bp, Homo sapiens
  misc_feature 1..59: note = chr8:49572124-49572183
  misc_feature 1..59: note = hypo
  source 1..59: mol_type = genomic DNA
gacctgcgaggctgtcgggggtgcgcctgggactgagctgggctcgtcttcatttccct

SEQ ID NO: 41778 - DNA, 267 bp, Homo sapiens
  misc_feature 1..267: note = chr8:49608941-49609208
  misc_feature 1..267: note = hypo
  source 1..267: mol_type = genomic DNA
gacatggggtcctgacggaggtcgggaggcacagggtgtgggtgctgcttgtctccccagcttctccaccgcaccatgtgtctgggtctgtgattaccggaggcgactcgcaacaggcccagactcgcctgtgtgcatagcactaagggtaatgacaactcctctgtgtgtgcaggtgcctgttggagacgcagagctctgcagcagcaggtgagctgatgctgcaacctgctaaacgccgctcctgcggagcgccagggcccagag

SEQ ID NO: 41779 - DNA, 30 bp, Homo sapiens
  misc_feature 1..30: note = chr8:49773216-49773246
  misc_feature 1..30: note = hypo
  source 1..30: mol_type = genomic DNA
ctctgctttacgaggcgcaccttaaacccc

SEQ ID NO: 41780 - DNA, 137 bp, Homo sapiens
  misc_feature 1..137: note = chr8:49808681-49808818
  misc_feature 1..137: note = hypo
  source 1..137: mol_type = genomic DNA
tgggagtgacccctgcggagctgacaagccaatgctggagaagtgcacgggcaggctcaggcgcagccactcaatgggcctgtctgtgtcgggggcaggggcacagagaggggcaggtgagtcgaagctgattgggt

SEQ ID NO: 41781 - DNA, 222 bp, Homo sapiens
  misc_feature 1..222: note = chr8:49959230-49959452
  misc_feature 1..222: note = hypo
  source 1..222: mol_type = genomic DNA
attatggaggaggaacgggaagttctaccaggagtcgctgtactgtattcacggctcttgttatatgatttatgctggcattatctaaactgagaagcggacaatcctttattcaaaggcgagctccctctattttgtgttgccgctcatggagtcctaaggtcggagccccataggagctgccagcagagtcccaatggaggtgagcggctcatttcagct

SEQ ID NO: 41782 - DNA, 120 bp, Homo sapiens
  misc_feature 1..120: note = chr8:50015598-50015718
  misc_feature 1..120: note = hypo
  source 1..120: mol_type = genomic DNA
cttggagcagggggctttgctcctcggggaggctcaggctgtgcaagagcccatggcctgggtggggcgcgggaaggctcaggcatggggcactgcaggtcccgagccctgccccacggg

SEQ ID NO: 41783 - DNA, 156 bp, Homo sapiens
  misc_feature 1..156: note = chr8:50314445-50314601
  misc_feature 1..156: note = hypo
  source 1..156: mol_type = genomic DNA
aggtaactaataaaacgacagcattcatttttaaaagttactaaaatgaaagcaaacaaaataaattgcgttatataaatactgacggagatagaaaaacctgatgtttgttagtttacatttaaattctgagtttagaggtaattacccctataa

SEQ ID NO: 41784 - DNA, 58 bp, Homo sapiens
  misc_feature 1..58: note = chr8:50377787-50377845
  misc_feature 1..58: note = hypo
  source 1..58: mol_type = genomic DNA
aggcagacacacaggcggctgaacatcgaggggagcacaccaacggagaagacacaag

SEQ ID NO: 41785 - DNA, 34 bp, Homo sapiens; identical to SEQ ID NO: 15119
  misc_feature 1..34: note = chr8:52432891-52432925
  misc_feature 1..34: note = hypo
  source 1..34: mol_type = genomic DNA

SEQ ID NO: 41786 - DNA, 97 bp, Homo sapiens
  misc_feature 1..97: note = chr8:53352314-53352411
  misc_feature 1..97: note = hypo
  source 1..97: mol_type = genomic DNA
ggatgctgaggtttgcgtgcagaggacagagaccagtaacacccagatcctaggcctgagaaactggagaatgaaattaccacgtactgacacagta

SEQ ID NO: 41787 - DNA, 30 bp, Homo sapiens
  misc_feature 1..30: note = chr8:53805607-53805637
  misc_feature 1..30: note = hypo
  source 1..30: mol_type = genomic DNA
tgcccagcaggaagacggagtgacccagcg

SEQ ID NO: 41788 - DNA, 40 bp, Homo sapiens
  misc_feature 1..40: note = chr8:55191496-55191536
  misc_feature 1..40: note = hypo
  source 1..40: mol_type = genomic DNA
cactcatactgggaccgtttagacacgccaatgaaccttt

SEQ ID NO: 41789 - DNA, 30 bp, Homo sapiens
  misc_feature 1..30: note = chr8:55285908-55285938
  misc_feature 1..30: note = hypo
  source 1..30: mol_type = genomic DNA
gcagggcctggcctccggaaaggaccctgg

SEQ ID NO: 41790 - DNA, 30 bp, Homo sapiens; identical to SEQ ID NO: 15120
  misc_feature 1..30: note = chr8:55689465-55689495
  misc_feature 1..30: note = hypo
  source 1..30: mol_type = genomic DNA

SEQ ID NO: 41791 - DNA, 32 bp, Homo sapiens
  misc_feature 1..32: note = chr8:55787831-55787863
  misc_feature 1..32: note = hypo
  source 1..32: mol_type = genomic DNA
gcggttccgggtgggcgcgggctgggcaggcc

SEQ ID NO: 41792 - DNA, 30 bp, Homo sapiens
  misc_feature 1..30: note = chr8:56362016-56362046
  misc_feature 1..30: note = hypo
  source 1..30: mol_type = genomic DNA
cctagtggtcggtaacgactggaagcagag

SEQ ID NO: 41793 - DNA, 78 bp, Homo sapiens
  misc_feature 1..78: note = chr8:56364255-56364333
  misc_feature 1..78: note = hypo
  source 1..78: mol_type = genomic DNA
tagatggcatgcatgcggttgaccagagaaatgcggaaggattcagacttggcccggctcaggcggctgctcaggggg

SEQ ID NO: 41794 - DNA, 95 bp, Homo sapiens
  misc_feature 1..95: note = chr8:56539998-56540093
  misc_feature 1..95: note = hypo
  source 1..95: mol_type = genomic DNA
cagcaaacgggaccacgggtgtgtgatcctaacgcatctaaaaacagttcaaatcattaatgtacattttttatgaggcgcgacaggggagcaaa

SEQ ID NO: 41795 - DNA, 27 bp, Homo sapiens
  misc_feature 1..27: note = chr8:56688545-56688572
  misc_feature 1..27: note = hypo
  source 1..27: mol_type = genomic DNA
ctaaatcccttggatcgattgactgta

SEQ ID NO: 41796 - DNA, 30 bp, Homo sapiens
  misc_feature 1..30: note = chr8:56883198-56883228
  misc_feature 1..30: note = hypo
  source 1..30: mol_type = genomic DNA
gttaggaaattgctacggccttcttgggaa

SEQ ID NO: 41797 - DNA, 78 bp, Homo sapiens
  misc_feature 1..78: note = chr8:56929748-56929826
  misc_feature 1..78: note = hypo
  source 1..78: mol_type = genomic DNA
ggcagcgtgaggccacgccttggagagaaggtactgtcccaggtgagcgtgagcttctcataccgtgctggtggcagc

SEQ ID NO: 41798 - DNA, 39 bp, Homo sapiens
  misc_feature 1..39: note = chr8:57566358-57566397
  misc_feature 1..39: note = hypo
  source 1..39: mol_type = genomic DNA
gagctaccgcgccgggcctcaagtcgcccttcttaaaac

SEQ ID NO: 41799 - DNA, 30 bp, Homo sapiens
  misc_feature 1..30: note = chr8:57995953-57995983
  misc_feature 1..30: note = hypo
  source 1..30: mol_type = genomic DNA
gcaggtttccaagcccgtgtagctctccgc

SEQ ID NO: 41800 - DNA, 234 bp, Homo sapiens
  misc_feature 1..234: note = chr8:58105946-58106180
  misc_feature 1..234: note = hypo
  source 1..234: mol_type = genomic DNA
ggtggtgcagtcaagcgggccctggggcaggcctggcccagcgctccgttcttgggagccctgccagcccacaggcccatctgcggcaggcacgtggtgccgcgagaacttggctcagggacggtttttccgccatgcgcagattctcgcctctcgcgggggcgccagggggcagctggttgaggtgcgcatgcgcactggcacctaacggctcttcttcgagtcttctcagag

SEQ ID NO: 41801 - DNA, 35 bp, Homo sapiens
  misc_feature 1..35: note = chr8:58106674-58106709
  misc_feature 1..35: note = hypo
  source 1..35: mol_type = genomic DNA
gaaagaatgggtgtgcggagcgggccgttctggtg

SEQ ID NO: 41802 - DNA, 129 bp, Homo sapiens
  misc_feature 1..129: note = chr8:58116950-58117079
  misc_feature 1..129: note = hypo
  source 1..129: mol_type = genomic DNA
cagaaacgttgcagccgatggcacggcagtggggaggaaaacgtaggaagcatggaagtgcatggcttgcgaaagaagcatctgaagccatggcatgtctgagagaggacacatcgggcaagattccac

SEQ ID NO: 41803 - DNA, 514 bp, Homo sapiens
  misc_feature 1..514: note = chr8:58130301-58130815
  misc_feature 1..514: note = hypo
  source 1..514: mol_type = genomic DNA
ggaagacacatctgacgagatcgaatgttttgcagaagagccatgtgaccagatccctggtttggcagaggagacatgcgagaagacggaacgttttggccgaggagacatctggcagggtggaacggagggaacaggtgtggcagagagaatatctgagaagctcgcaggattcccagaaggagcactgggagtagattgcctgttttcccgaaggaacggcaagttccaaaggtcagaggctcatgtgaactctgtcgggttcaggagcagctcagtgttgctggtggcaagagtgtggtacgagagtggttgggcgtggtttgaatatctagaaaaggcgagctgagggtagatttttgaacagtccggagtaggaggggtagagacatattctatgggccacagccacattctcaggatgctcgtggctgtaaatagtagatgacccaagtaagagcggctgaagccataggcaccagaattgtgttggcatcgtcgtgtcacgctcacg

SEQ ID NO: 41804 - DNA, 38 bp, Homo sapiens
  misc_feature 1..38: note = chr8:58716351-58716389
  misc_feature 1..38: note = hypo
  source 1..38: mol_type = genomic DNA
tggattacagacgtgagccatagcgcccagccttgtat

SEQ ID NO: 41805 - DNA, 62 bp, Homo sapiens
  misc_feature 1..62: note = chr8:59059044-59059106
  misc_feature 1..62: note = hypo
  source 1..62: mol_type = genomic DNA
tgcccggctgccaagcgcgcactgggcagccccacgctcaaagtgttcggcaaccacgccaa

SEQ ID NO: 41806 - DNA, 30 bp, Homo sapiens
  misc_feature 1..30: note = chr8:61272270-61272300
  misc_feature 1..30: note = hypo
  source 1..30: mol_type = genomic DNA
cgatgagtgcatttgcggagggctgagaag

SEQ ID NO: 41807 - DNA, 30 bp, Homo sapiens
  misc_feature 1..30: note = chr8:61777517-61777547
  misc_feature 1..30: note = hypo
  source 1..30: mol_type = genomic DNA
agatcaagttgtcttcgacagcctttatag

SEQ ID NO: 41808 - DNA, 108 bp, Homo sapiens
  misc_feature 1..108: note = chr8:61789877-61789985
  misc_feature 1..108: note = hypo
  source 1..108: mol_type = genomic DNA
tggtcgcaataatgacgacgaggcggatggcggcggggaggctagagcccatttcagaagcctgcagtgaggattccaccagttcacatgcatcgggcactgagccct

SEQ ID NO: 41809 - DNA, 30 bp, Homo sapiens
  misc_feature 1..30: note = chr8:63056935-63056965
  misc_feature 1..30: note = hypo
  source 1..30: mol_type = genomic DNA
aggagagacctccggcggcagggctccaac

SEQ ID NO: 41810 - DNA, 37 bp, Homo sapiens
  misc_feature 1..37: note = chr8:64023507-64023544
  misc_feature 1..37: note = hypo
  source 1..37: mol_type = genomic DNA
tacaggcgtgagccaccgcgcccggccttaagtgttt

SEQ ID NO: 41811 - DNA, 22 bp, Homo sapiens
  misc_feature 1..22: note = chr8:64511304-64511326
  misc_feature 1..22: note = hypo
  source 1..22: mol_type = genomic DNA
aatagaacgaagaaaggaggac

SEQ ID NO: 41812 - DNA, 23 bp, Homo sapiens
  misc_feature 1..23: note = chr8:65385213-65385236
  misc_feature 1..23: note = hypo
  source 1..23: mol_type = genomic DNA
cgagactccgtctcaaaaaaaaa

SEQ ID NO: 41813 - DNA, 30 bp, Homo sapiens
  misc_feature 1..30: note = chr8:65519445-65519475
  misc_feature 1..30: note = hypo
  source 1..30: mol_type = genomic DNA
ccaccagccccagtacgaatgcaggcagag

SEQ ID NO: 41814 - DNA, 90 bp, Homo sapiens; identical to SEQ ID NO: 15127
  misc_feature 1..90: note = chr8:65749819-65749909
  misc_feature 1..90: note = hypo
  source 1..90: mol_type = genomic DNA

SEQ ID NO: 41815 - DNA, 33 bp, Homo sapiens
  misc_feature 1..33: note = chr8:66055590-66055623
  misc_feature 1..33: note = hypo
  source 1..33: mol_type = genomic DNA
tgaccatctggaccccgccgattctccccatac

SEQ ID NO: 41816 - DNA, 42 bp, Homo sapiens
  misc_feature 1..42: note = chr8:66548717-66548759
  misc_feature 1..42: note = hypo
  source 1..42: mol_type = genomic DNA
atgtctaaacttggccgggcgtggtggctcaagcctgtaatc

SEQ ID NO: 41817 - DNA, 22 bp, Homo sapiens
  misc_feature 1..22: note = chr8:66560523-66560545
  misc_feature 1..22: note = hypo
  source 1..22: mol_type = genomic DNA
ttacaggcgtgagtcaccatgc

SEQ ID NO: 41818 - DNA, 162 bp, Homo sapiens
  misc_feature 1..162: note = chr8:67117765-67117927
  misc_feature 1..162: note = hypo
  source 1..162: mol_type = genomic DNA
gttcactactctagccgtgacaaattctctcttcacattgggcacgctgtatcaattatcttgtcaactgttatattgtctatcgtgtcatcaatgggtatttccttcttttggctgtagatttgtgggggataagatgaagacttccgtgcattaagaacc

SEQ ID NO: 41819 - DNA, 68 bp, Homo sapiens
  misc_feature 1..68: note = chr8:68347722-68347790
  misc_feature 1..68: note = hypo
  source 1..68: mol_type = genomic DNA
gtgatggggaggagacggcaggtgcggggaggctccggccttccttggtgccccgccctttgtttgca

SEQ ID NO: 41820 - DNA, 260 bp, Homo sapiens
  misc_feature 1..260: note = chr8:71017232-71017492
  misc_feature 1..260: note = hypo
  source 1..260: mol_type = genomic DNA
ttggcttcttaatcacgcatccagaggtgctggctggctcctgagccgggagacatctgtgggaaacttcgcttgcttcttgacgttactcactgcttgccattcagctttccaggggctacaaaatgagtcaccacccttttatcagctttcaacttacattttgttgctgttgtttcatctcctattatccttgtccttgtgggtttatgcctttataaaaaggcatttgggccaggcgcggtggctcatgcttataa

SEQ ID NO: 41821 - DNA, 213 bp, Homo sapiens
  misc_feature 1..213: note = chr8:71368455-71368668
  misc_feature 1..213: note = hypo
  source 1..213: mol_type = genomic DNA
cactaacattctacacgtctaaacttcgaggaacttttctaaagcaagaaaaagaataagggctaaatttaattcgtcagagtggaaagagaacaaagagagaggactgggagtgggagattaaaaggctgtggaaagtggtcttgagatagatgttattggggaccaaccttctcaatgcactggtcaagcgccggacgttgttgagaacag

SEQ ID NO: 41822 - DNA, 43 bp, Homo sapiens
  misc_feature 1..43: note = chr8:74086196-74086239
  misc_feature 1..43: note = hypo
  source 1..43: mol_type = genomic DNA
agtggcattgctggccgggcgcggtggctcccgcctgtaatcc

SEQ ID NO: 41823 - DNA, 32 bp, Homo sapiens; identical to SEQ ID NO: 15130
  misc_feature 1..32: note = chr8:74332813-74332845
  misc_feature 1..32: note = hypo
  source 1..32: mol_type = genomic DNA

SEQ ID NO: 41824 - DNA, 30 bp, Homo sapiens
  misc_feature 1..30: note = chr8:74674435-74674465
  misc_feature 1..30: note = hypo
  source 1..30: mol_type = genomic DNA
ctactcgttgtccaccgaaattcattctcc

SEQ ID NO: 41825 - DNA, 101 bp, Homo sapiens
  misc_feature 1..101: note = chr8:74759410-74759511
  misc_feature 1..101: note = hypo
  source 1..101: mol_type = genomic DNA
aactaaccaaacagaaaaataagcaaaagtctagaattcgtaattcacaaaaacaccataatggctaataaaaacaggaaaagaaacgcaacctcactggt

SEQ ID NO: 41826 - DNA, 44 bp, Homo sapiens
  misc_feature 1..44: note = chr8:74759819-74759863
  misc_feature 1..44: note = hypo
  source 1..44: mol_type = genomic DNA
aatgtccatcatcaacggtaaaacgggtatattgcggccgggtg

SEQ ID NO: 41827 - DNA, 145 bp, Homo sapiens
  misc_feature 1..145: note = chr8:78532944-78533089
  misc_feature 1..145: note = hypo
  source 1..145: mol_type = genomic DNA
ctcgttccacccactcggcggcaggctgcgctcagctcacactactggcctggatcctatgcccattgcagctctgccctcagcctgcagctggtccagccatgccgcaactggcttcctccttgggtgccgacatctagacgag

SEQ ID NO: 41828 - DNA, 162 bp, Homo sapiens
  misc_feature 1..162: note = chr8:80483857-80484019
  misc_feature 1..162: note = hypo
  source 1..162: mol_type = genomic DNA
cctcagcggatcttgcgggacagcttcttggtgtgccaatgactggtgacccctttgtagcctttgctctttgtcaccccaatgacatcaatcatctcgtcctgcccaaacacctggttcacaggtacctgctgctcaagcctctcgcgggcccagtccagc

SEQ ID NO: 41829 - DNA, 22 bp, Homo sapiens
  misc_feature 1..22: note = chr8:82903036-82903058
  misc_feature 1..22: note = hypo
  source 1..22: mol_type = genomic DNA
tggcagacgctcctccctcagc

SEQ ID NO: 41830 - DNA, 30 bp, Homo sapiens
  misc_feature 1..30: note = chr8:83282016-83282046
  misc_feature 1..30: note = hypo
  source 1..30: mol_type = genomic DNA
atcatccactttccccgtgcatattgcgaa

SEQ ID NO: 41831 - DNA, 114 bp, Homo sapiens
  misc_feature 1..114: note = chr8:86370822-86370936
  misc_feature 1..114: note = hypo
  source 1..114: mol_type = genomic DNA
cccttcgccccgttccgcccagtccccatttacaaataaagcatgtgaagttcagagggattgcttagtttgctgaaggtgatgcagcaagtaagtgttcgagtcagagtatga

SEQ ID NO: 41832 - DNA, 30 bp, Homo sapiens
  misc_feature 1..30: note = chr8:86389645-86389675
  misc_feature 1..30: note = hypo
  source 1..30: mol_type = genomic DNA
ctagcaaataaacagcgttcagtaaatctt

SEQ ID NO: 41833 - DNA, 40 bp, Homo sapiens
  misc_feature 1..40: note = chr8:86405563-86405603
  misc_feature 1..40: note = hypo
  source 1..40: mol_type = genomic DNA
tgcacgggggatgggcgcggtgcctcaagcctataatccc

SEQ ID NO: 41834 - DNA, 36 bp, Homo sapiens
  misc_feature 1..36: note = chr8:86406813-86406849
  misc_feature 1..36: note = hypo
  source 1..36: mol_type = genomic DNA
acattattcccgttttacaaacggagacttgggggc

SEQ ID NO: 41835 - DNA, 26 bp, Homo sapiens
  misc_feature 1..26: note = chr8:86417676-86417702
  misc_feature 1..26: note = hypo
  source 1..26: mol_type = genomic DNA
agaatcacaagcgtgagccactgtgc

SEQ ID NO: 41836 - DNA, 37 bp, Homo sapiens
  misc_feature 1..37: note = chr8:86436621-86436658
  misc_feature 1..37: note = hypo
  source 1..37: mol_type = genomic DNA
gcatccaacctgactcggcccgcgtggcagcctgtgg

SEQ ID NO: 41837 - DNA, 30 bp, Homo sapiens
  misc_feature 1..30: note = chr8:86849611-86849641
  misc_feature 1..30: note = hypo
  source 1..30: mol_type = genomic DNA
tgtttgtcacaccagcgtatagaaaaatca

SEQ ID NO: 41838 - DNA, 19 bp, Homo sapiens
  misc_feature 1..19: note = chr8:86926063-86926082
  misc_feature 1..19: note = hypo
  source 1..19: mol_type = genomic DNA
accacgcctggctaatttt

SEQ ID NO: 41839 - DNA, 498 bp, Homo sapiens
  misc_feature 1..498: note = chr8:88885698-88886196
  misc_feature 1..498: note = hypo
  source 1..498: mol_type = genomic DNA
gctacctatgaacagcgacgctgggagcagcacggcacagcttggagtatctgcaagtcccacgaagcacagcagaaggtgggaatccaagtgattcagtgaggcccagcacatagaattcaccttccgattagggacgtagagggttttgtgcgggtatacccggagctcaggggtcgtcaggcctcgcatggtgatgatgccgtacttggagcctccagcttcgacttggttcactgtgaagagctggtcagtgttggtattcgccagtatgcggttaaatcggtcgcttgccaaagaggagggatcccagctatgaatctggacctttttcctctgcatgcagcttacacgcagctcgcgagctatacggcaatagttggcgaatctgaggaaacctagctggttctttcgtagcatggaaggtgcattgagtcccactctgactgtctttttctgcttgtctgcttcctcgagcagtcgcggtcttttgctctc

SEQ ID NO: 41840 - DNA, 17 bp, Homo sapiens
  misc_feature 1..17: note = chr8:89830498-89830515
  misc_feature 1..17: note = hypo
  source 1..17: mol_type = genomic DNA
gccggaaaacatatgtc

SEQ ID NO: 41841 - DNA, 36 bp, Homo sapiens
  misc_feature 1..36: note = chr8:90768546-90768582
  misc_feature 1..36: note = hypo
  source 1..36: mol_type = genomic DNA
aaaaagcttattggccgggcgcggtggctcacgcct

SEQ ID NO: 41842 - DNA, 35 bp, Homo sapiens
  misc_feature 1..35: note = chr8:90768822-90768857
  misc_feature 1..35: note = hypo
  source 1..35: mol_type = genomic DNA
gacagagcacgactccctctcgaaaagaaaaaaaa

SEQ ID NO: 41843 - DNA, 137 bp, Homo sapiens; identical to SEQ ID NO: 1578
  misc_feature 1..137: note = chr8:90913516-90913653
  misc_feature 1..137: note = hypo
  source 1..137: mol_type = genomic DNA

SEQ ID NO: 41844 - DNA, 30 bp, Homo sapiens; identical to SEQ ID NO: 15135
  misc_feature 1..30: note = chr8:91130098-91130128
  misc_feature 1..30: note = hypo
  source 1..30: mol_type = genomic DNA

SEQ ID NO: 41845 - DNA, 22 bp, Homo sapiens
  misc_feature 1..22: note = chr8:91163928-91163950
  misc_feature 1..22: note = hypo
  source 1..22: mol_type = genomic DNA
gtaatccctgcacttcggcagg

SEQ ID NO: 41846 - DNA, 195 bp, Homo sapiens
  misc_feature 1..195: note = chr8:91865364-91865559
  misc_feature 1..195: note = hypo
  source 1..195: mol_type = genomic DNA
cctggctcctgtaaccgctcacctgcatgctgcctcctgtgaggggtggagtgcagcgggtctgagtgagtggaggtaactcctgccagtgcagaagcagccagctggttccagcactcgtggactccagttcctgcctctttctctcacatgctctctcccacaaggagttgaaagctgcgggctgggtaaatg

SEQ ID NO: 41847 - DNA, 99 bp, Homo sapiens; identical to SEQ ID NO: 5080
  misc_feature 1..99: note = chr8:92083523-92083622
  misc_feature 1..99: note = hypo
  source 1..99: mol_type = genomic DNA

SEQ ID NO: 41848 - DNA, 30 bp, Homo sapiens
  misc_feature 1..30: note = chr8:93449207-93449237
  misc_feature 1..30: note = hypo
  source 1..30: mol_type = genomic DNA
catcgcaaactatgtcgttattgaatatag

SEQ ID NO: 41849 - DNA, 226 bp, Homo sapiens
  misc_feature 1..226: note = chr8:93848232-93848458
  misc_feature 1..226: note = hypo
  source 1..226: mol_type = genomic DNA
tgtgctgtcagccatcgctgacaggtgagagccactggcccaagatcagaaagattgcttgcatagcgaaaggacacacctcacctgtcagctgtcacagacactctttttacattactccactccaggaaaggtgatatctcgttcaggggtttaacagtccagagttatgaagtacaaatgaagtgacggctgtgcatttattagatcacgtgtagtgtttctt

SEQ ID NO: 41850 - DNA, 174 bp, Homo sapiens
  misc_feature 1..174: note = chr8:95211968-95212142
  misc_feature 1..174: note = hypo
  source 1..174: mol_type = genomic DNA
atctaccacaccatgcggttgttaggagcatagacccaggagttagactggctggcttgggtcttaactcctccaccggctgactcgtggccctatctactcatctataaagcagggataataataataatacctaccttcgagagttaagagattcagcgagttaatatttgg

SEQ ID NO: 41851 - DNA, 77 bp, Homo sapiens; identical to SEQ ID NO: 15137
  misc_feature 1..77: note = chr8:95416054-95416131
  misc_feature 1..77: note = hypo
  source 1..77: mol_type = genomic DNA

SEQ ID NO: 41852 - DNA, 30 bp, Homo sapiens
  misc_feature 1..30: note = chr8:95622883-95622913
  misc_feature 1..30: note = hypo
  source 1..30: mol_type = genomic DNA
acaagagcgaaactccgcctcaaaaaaccc

SEQ ID NO: 41853 - DNA, 25 bp, Homo sapiens
  misc_feature 1..25: note = chr8:95816428-95816453
  misc_feature 1..25: note = hypo
  source 1..25: mol_type = genomic DNA
tcaaaaaattaaatgcgggccgggc

SEQ ID NO: 41854 - DNA, 28 bp, Homo sapiens
  misc_feature 1..28: note = chr8:95837639-95837667
  misc_feature 1..28: note = hypo
  source 1..28: mol_type = genomic DNA
atagagtaagactcggaaaaaaaaaaaa

SEQ ID NO: 41855 - DNA, 30 bp, Homo sapiens
  misc_feature 1..30: note = chr8:95904181-95904211
  misc_feature 1..30: note = hypo
  source 1..30: mol_type = genomic DNA
tcggattaactcacacgtgatctctccctg

SEQ ID NO: 41856 - DNA, 172 bp, Homo sapiens
  misc_feature 1..172: note = chr8:96208663-96208835
  misc_feature 1..172: note = hypo
  source 1..172: mol_type = genomic DNA
atgtaatatggtggccgagttaagcgcttggattctgccactgaacttgttttcttggagatctgactcgttgccatcagcaacatgggcggggtggagctggctttctctgcatctgttctcctctacacctgatgttaacagaatgcctggattccggggacttccaggt

SEQ ID NO: 41857 - DNA, 30 bp, Homo sapiens
  misc_feature 1..30: note = chr8:97039387-97039417
  misc_feature 1..30: note = hypo
  source 1..30: mol_type = genomic DNA
aaatatttcaatcatcgaagagtcaattga

SEQ ID NO: 41858 - DNA, 23 bp, Homo sapiens
  misc_feature 1..23: note = chr8:97272415-97272438
  misc_feature 1..23: note = hypo
  source 1..23: mol_type = genomic DNA
actgcgctcggcccattctgcga

SEQ ID NO: 41859 - DNA, 362 bp, Homo sapiens
  misc_feature 1..362: note = chr8:97339840-97340202
  misc_feature 1..362: note = hypo
  source 1..362: mol_type = genomic DNA
ggcctggtaagagagcgcacacggagcttgagattaatgcagaagcaaagatcccgggtgctggttaataagcttttccaggagcgtggttgtctgctcggccgtcattaatttgaatgctcattaccataatgtagaagccaagctggggtcctgcgccctccttgccgccagccccgtggtcctggacagcctggctctcatcccacgtagtttcttctcgcccccccgccctttctttaaacgaagtgtgcaattgctattttaaatctgagccttgacattttcagtgggtacgtgcctagatttccacaggtgtgattgcaaacctgtaaattaccggcttccgtttgctgggacaa

SEQ ID NO: 41860 - DNA, 37 bp, Homo sapiens
  misc_feature 1..37: note = chr8:97977869-97977906
  misc_feature 1..37: note = hypo
  source 1..37: mol_type = genomic DNA
tagaggcgtgagccaccgcacccggccaagccaattt

SEQ ID NO: 41861 - DNA, 30 bp, Homo sapiens
  misc_feature 1..30: note = chr8:97982654-97982684
  misc_feature 1..30: note = hypo
  source 1..30: mol_type = genomic DNA
aagcagtaggtaactcgtgttatattcatt

SEQ ID NO: 41862 - DNA, 39 bp, Homo sapiens
  misc_feature 1..39: note = chr8:98404793-98404832
  misc_feature 1..39: note = hypo
  source 1..39: mol_type = genomic DNA
attataggtgtgatccaccacgcccggccacctctaacc

SEQ ID NO: 41863 - DNA, 30 bp, Homo sapiens; identical to SEQ ID NO: 15140
  misc_feature 1..30: note = chr8:98738336-98738366
  misc_feature 1..30: note = hypo
  source 1..30: mol_type = genomic DNA

SEQ ID NO: 41864 - DNA, 22 bp, Homo sapiens
  misc_feature 1..22: note = chr8:98748478-98748500
  misc_feature 1..22: note = hypo
  source 1..22: mol_type = genomic DNA
gactgggcgacggagggagact

SEQ ID NO: 41865 - DNA, 79 bp, Homo sapiens
  misc_feature 1..79: note = chr8:99130932-99131011
  misc_feature 1..79: note = hypo
  source 1..79: mol_type = genomic DNA
tgtaaccattatgcccggcctcattttttttctttcccttgtcctgtttcctattgtgctgtaccgcataatttagtat

SEQ ID NO: 41866 - DNA, 95 bp, Homo sapiens
  misc_feature 1..95: note = chr8:100026644-100026739
  misc_feature 1..95: note = hypo
  source 1..95: mol_type = genomic DNA
ctgcataatttttaaaaatagtttgttcccagttttggtatattagaatgggattacttaaagttgctttgacagaaagacgatttcattgttca

SEQ ID NO: 41867 - DNA, 36 bp, Homo sapiens
  misc_feature 1..36: note = chr8:100245127-100245163
  misc_feature 1..36: note = hypo
  source 1..36: mol_type = genomic DNA
tgcagagtccctggccgcctccgcagacttctcatt

SEQ ID NO: 41868 - DNA, 32 bp, Homo sapiens
  misc_feature 1..32: note = chr8:100359795-100359827
  misc_feature 1..32: note = hypo
  source 1..32: mol_type = genomic DNA
tggtactccacagtacgcgtgtgccaccttca

SEQ ID NO: 41869 - DNA, 103 bp, Homo sapiens
  misc_feature 1..103: note = chr8:100904181-100904284
  misc_feature 1..103: note = hypo
  source 1..103: mol_type = genomic DNA
atatgatttcgcagacgcctggccagaaggccacgcatccgaggttttggcaaaacttcgggagccatggtagttactgtccttgatacgtatgctaacctta

SEQ ID NO: 41870 - DNA, 216 bp, Homo sapiens
  misc_feature 1..216: note = chr8:100906569-100906785
  misc_feature 1..216: note = hypo
  source 1..216: mol_type = genomic DNA
tgcatgatattgagtcgatatatacactgagtacctactatgtgccagattctgctaaacaagaggacagatcttcggggagtctcattctgatcagggagtctttgtcctcaacctattaaccaacactctggagggtgaaacctggccacaaagaaaggtgctcaattgaggttcaaaagtaggtttggactttaccaacgtttttcaggcctc

SEQ ID NO: 41871 - DNA, 150 bp, Homo sapiens
  misc_feature 1..150: note = chr8:101156747-101156897
  misc_feature 1..150: note = hypo
  source 1..150: mol_type = genomic DNA
ggactcaacagttcacggataaatcaatcaagcctcttcgatattcatttttaaaaactaggcttctgataaaaggctgagaaaacttattcctaaagtgttctttaagaaaaaaaaaaaaaaaagcagcggccgggcgcggtggctcac

SEQ ID NO: 41872 - DNA, 23 bp, Homo sapiens
  misc_feature 1..23: note = chr8:101241341-101241364
  misc_feature 1..23: note = hypo
  source 1..23: mol_type = genomic DNA
aatgaggaagtaggccgggcgtg

SEQ ID NO: 41873 - DNA, 30 bp, Homo sapiens
  misc_feature 1..30: note = chr8:101299821-101299851
  misc_feature 1..30: note = hypo
  source 1..30: mol_type = genomic DNA
tcacttaatatcaagcgaatatcatgggga

SEQ ID NO: 41874 - DNA, 30 bp, Homo sapiens
  misc_feature 1..30: note = chr8:101438141-101438171
  misc_feature 1..30: note = hypo
  source 1..30: mol_type = genomic DNA
ccttgtttcacaggccgctgttacacatga

SEQ ID NO: 41875 - DNA, 78 bp, Homo sapiens
  misc_feature 1..78: note = chr8:101693784-101693862
  misc_feature 1..78: note = hypo
  source 1..78: mol_type = genomic DNA
acggatgcagacttgcgagggtttgctaagttcttgtaaaggggcaggggtggctgcaagtttcgtcatgcagaggat

SEQ ID NO: 41876 - DNA, 30 bp, Homo sapiens
  misc_feature 1..30: note = chr8:101717092-101717122
  misc_feature 1..30: note = hypo
  source 1..30: mol_type = genomic DNA
ccccataaaaagccacgtaataactgtgta

SEQ ID NO: 41877 - DNA, 42 bp, Homo sapiens
  misc_feature 1..42: note = chr8:101729504-101729546
  misc_feature 1..42: note = hypo
  source 1..42: mol_type = genomic DNA
ggatttacaggcatgagccaccgcgcccggacttgtgagtaa

SEQ ID NO: 41878 - DNA, 40 bp, Homo sapiens
  misc_feature 1..40: note = chr8:101872226-101872266
  misc_feature 1..40: note = hypo
  source 1..40: mol_type = genomic DNA
gcctccctggctttccgtcctacctcgcacccgtttcacg

SEQ ID NO: 41879 - DNA, 51 bp, Homo sapiens
  misc_feature 1..51: note = chr8:102039492-102039543
  misc_feature 1..51: note = hypo
  source 1..51: mol_type = genomic DNA
cttcaggtcactaaccgccccattggagagggttcacgcagctcacgtgta

SEQ ID NO: 41880 - DNA, 213 bp, Homo sapiens
  misc_feature 1..213: note = chr8:102155655-102155868
  misc_feature 1..213: note = hypo
  source 1..213: mol_type = genomic DNA
gcaagccccagggcccgggaccccaaatgcagaagaaatgcctagtagccacagggcccagaggggtgtgcagtactgggagacagagatggcactaattcccaggacagtggcggccaccagggcatgcccaggagctcaggggtcttggtggtacccgggaagctccttccctcacccagcaagcagctgaggctgcggagaccaggtacc

SEQ ID NO: 41881 - DNA, 30 bp, Homo sapiens
  misc_feature 1..30: note = chr8:103403324-103403354
  misc_feature 1..30: note = hypo
  source 1..30: mol_type = genomic DNA
aggttgatgctgcagcgtacagtgatggtg

SEQ ID NO: 41882 - DNA, 41 bp, Homo sapiens
  misc_feature 1..41: note = chr8:103629841-103629882
  misc_feature 1..41: note = hypo
  source 1..41: mol_type = genomic DNA
actctcttaaaggctttgctggatcacgtagacctaacaaa

SEQ ID NO: 41883 - DNA, 20 bp, Homo sapiens
  misc_feature 1..20: note = chr8:104235237-104235257
  misc_feature 1..20: note = hypo
  source 1..20: mol_type = genomic DNA
tttaaaactttttggcgggc

SEQ ID NO: 41884 - DNA, 165 bp, Homo sapiens
  misc_feature 1..165: note = chr8:104382635-104382800
  misc_feature 1..165: note = hypo
  source 1..165: mol_type = genomic DNA
cacttatgaaaacagcgtttatatatcatttgggtcatgggactcttggaaaacctgatgatacctatggtttcttcctgcctccgccccacccccaccttccagcctccaaaaatgtcacctccaaaaaacaaataaggcagggcgcggtggctcacgcctgta

SEQ ID NO: 41885 - DNA, 23 bp, Homo sapiens
  misc_feature 1..23: note = chr8:104488605-104488628
  misc_feature 1..23: note = hypo
  source 1..23: mol_type = genomic DNA
actgcgcccggcccataatatat

SEQ ID NO: 41886 - DNA, 30 bp, Homo sapiens
  misc_feature 1..30: note = chr8:105386063-105386093
  misc_feature 1..30: note = hypo
  source 1..30: mol_type = genomic DNA
ttctcagcagcagagcgacccccacctgga

SEQ ID NO: 41887 - DNA, 30 bp, Homo sapiens
  misc_feature 1..30: note = chr8:105456591-105456621
  misc_feature 1..30: note = hypo
  source 1..30: mol_type = genomic DNA
tccactgcctctgggcggcacagctcgtgg

SEQ ID NO: 41888 - DNA, 20 bp, Homo sapiens
  misc_feature 1..20: note = chr8:105645632-105645652
  misc_feature 1..20: note = hypo
  source 1..20: mol_type = genomic DNA
gcgagcgagggctgttggca

SEQ ID NO: 41889 - DNA, 30 bp, Homo sapiens
  misc_feature 1..30: note = chr8:106433918-106433948
  misc_feature 1..30: note = hypo
  source 1..30: mol_type = genomic DNA
aatttttctcagtgacgcataattatgttt

SEQ ID NO: 41890 - DNA, 30 bp, Homo sapiens; identical to SEQ ID NO: 15145
  misc_feature 1..30: note = chr8:106500552-106500582
  misc_feature 1..30: note = hypo
  source 1..30: mol_type = genomic DNA

SEQ ID NO: 41891 - DNA, 16 bp, Homo sapiens
  misc_feature 1..16: note = chr8:106706503-106706519
  misc_feature 1..16: note = hypo
  source 1..16: mol_type = genomic DNA
gcgcccagcctctcca

SEQ ID NO: 41892 - DNA, 30 bp, Homo sapiens
  misc_feature 1..30: note = chr8:107359293-107359323
  misc_feature 1..30: note = hypo
  source 1..30: mol_type = genomic DNA
aagctctttggtgttcgattttaattaagc

SEQ ID NO: 41893 - DNA, 185 bp, Homo sapiens
  misc_feature 1..185: note = chr8:107531614-107531799
  misc_feature 1..185: note = hypo
  source 1..185: mol_type = genomic DNA
atatacgtacatatacgtacacatatactatctctctctctcttaggtttttcaatttttaactttgtgtgctattttcattttagccattgttcagccagcacctttcttgttttttgtttttgttattttcattttcccttcaggctcccaggtctctgaacctgttccgtcaggttgttaag

SEQ ID NO: 41894 - DNA, 150 bp, Homo sapiens
  misc_feature 1..150: note = chr8:108134676-108134826
  misc_feature 1..150: note = hypo
  source 1..150: mol_type = genomic DNA
ccgtgtgggaggtgccgctggggctgcctgctccatggagcctgcaggatccaggacaggtaggagccccgcccctttctgagtgggaggggcaggagccccaccctcccaggggtagctgcagccacccagccacggttgtggacctgg

SEQ ID NO: 41895 - DNA, 77 bp, Homo sapiens
  misc_feature 1..77: note = chr8:108582504-108582581
  misc_feature 1..77: note = hypo
  source 1..77: mol_type = genomic DNA
tattactcccaatgtcgcagagagtgtacaccccccgtgatgtttttatttaatatccaggaagggagaagttggca

SEQ ID NO: 41896 - DNA, 17 bp, Homo sapiens
  misc_feature 1..17: note = chr8:108582641-108582658
  misc_feature 1..17: note = hypo
  source 1..17: mol_type = genomic DNA
ggcggagaaaatattac

SEQ ID NO: 41897 - DNA, 30 bp, Homo sapiens
  misc_feature 1..30: note = chr8:108588091-108588121
  misc_feature 1..30: note = hypo
  source 1..30: mol_type = genomic DNA
gttcctaatatgtggcggggagaggatgat

SEQ ID NO: 41898 - DNA, 41 bp, Homo sapiens
  misc_feature 1..41: note = chr8:108593714-108593755
  misc_feature 1..41: note = hypo
  source 1..41: mol_type = genomic DNA
tgtacacttcccctgcgatattgttcctaatatccaggatg

SEQ ID NO: 41899 - DNA, 30 bp, Homo sapiens
  misc_feature 1..30: note = chr8:108601942-108601972
  misc_feature 1..30: note = hypo
  source 1..30: mol_type = genomic DNA
tgtatacacgttccccgtgataatgttcct

SEQ ID NO: 41900 - DNA, 30 bp, Homo sapiens
  misc_feature 1..30: note = chr8:108957755-108957785
  misc_feature 1..30: note = hypo
  source 1..30: mol_type = genomic DNA
atgagccaccgtgctcggcttctttttcct

SEQ ID NO: 41901 - DNA, 31 bp, Homo sapiens
  misc_feature 1..31: note = chr8:110274990-110275021
  misc_feature 1..31: note = hypo
  source 1..31: mol_type = genomic DNA
aaacctgaatgtggccgggtgtggtagctca

SEQ ID NO: 41902 - DNA, 36 bp, Homo sapiens
  misc_feature 1..36: note = chr8:110406111-110406147
  misc_feature 1..36: note = hypo
  source 1..36: mol_type = genomic DNA
aatcaactgtagggccgggcgcggtggctcacgcct

SEQ ID NO: 41903 - DNA, 171 bp, Homo sapiens; identical to SEQ ID NO: 15148
  misc_feature 1..171: note = chr8:110548417-110548588
  misc_feature 1..171: note = hypo
  source 1..171: mol_type = genomic DNA

SEQ ID NO: 41904 - DNA, 30 bp, Homo sapiens; identical to SEQ ID NO: 15149
  misc_feature 1..30: note = chr8:110961977-110962007
  misc_feature 1..30: note = hypo
  source 1..30: mol_type = genomic DNA

SEQ ID NO: 41905 - DNA, 30 bp, Homo sapiens
  misc_feature 1..30: note = chr8:111586661-111586691
  misc_feature 1..30: note = hypo
  source 1..30: mol_type = genomic DNA
gtgagccaccgtgcccggcctttcccatta

SEQ ID NO: 41906 - DNA, 34 bp, Homo sapiens
  misc_feature 1..34: note = chr8:112636593-112636627
  misc_feature 1..34: note = hypo
  source 1..34: mol_type = genomic DNA
gggcgtgctcttccacgggcgtgctcttccacgg

SEQ ID NO: 41907 - DNA, 30 bp, Homo sapiens
  misc_feature 1..30: note = chr8:113146243-113146273
  misc_feature 1..30: note = hypo
  source 1..30: mol_type = genomic DNA
tggattaggactacacgattaagaccttat

SEQ ID NO: 41908 - DNA, 191 bp, Homo sapiens
  misc_feature 1..191: note = chr8:113175066-113175257
  misc_feature 1..191: note = hypo
  source 1..191: mol_type = genomic DNA
ttcactgtaaagtgccgagcatatctgtagactccagaaagtgtcccacctgtgcttacaaacaaggtgggtgttgagggttctgccgctgctgcacttttgtggggccagtctcctgctgcatccgataaggatctgcaggtgagctgagaagccctcctccattcacccagtgtcgctgtctcccccga

SEQ ID NO: 41909 - DNA, 38 bp, Homo sapiens
  misc_feature 1..38: note = chr8:113221643-113221681
  misc_feature 1..38: note = hypo
  source 1..38: mol_type = genomic DNA
aagattaaacctggccgggcgcggtggcttcacgcttg

SEQ ID NO: 41910 - DNA, 30 bp, Homo sapiens
  misc_feature 1..30: note = chr8:115649508-115649538
  misc_feature 1..30: note = hypo
  source 1..30: mol_type = genomic DNA
tgggctgttcctattcggccatcttggctc

SEQ ID NO: 41911 - DNA, 170 bp, Homo sapiens
  misc_feature 1..170: note = chr8:116710279-116710449
  misc_feature 1..170: note = hypo
  source 1..170: mol_type = genomic DNA
gtcttatttgaaatgcgtaatacattcagctaaaacatgctgatgtcagctacaatcacagatgaggtaaaaaacaaagtttgggcttccttctgactgtgttggatgacttattaaaatgtgcaggtacggaaatggccctattggtagatcggcggctgcacattttg

SEQ ID NO: 41912 - DNA, 30 bp, Homo sapiens; identical to SEQ ID NO: 15150
  misc_feature 1..30: note = chr8:117824014-117824044
  misc_feature 1..30: note = hypo
  source 1..30: mol_type = genomic DNA

SEQ ID NO: 41913 - DNA, 16 bp, Homo sapiens
  misc_feature 1..16: note = chr8:120695441-120695457
  misc_feature 1..16: note = hypo
  source 1..16: mol_type = genomic DNA
gcgcccagcctttata

SEQ ID NO: 41914 - DNA, 18 bp, Homo sapiens
  misc_feature 1..18: note = chr8:120844122-120844140
  misc_feature 1..18: note = hypo
  source 1..18: mol_type = genomic DNA
tggtgcggtggctcacgc

SEQ ID NO: 41915 - DNA, 38 bp, Homo sapiens; identical to SEQ ID NO: 15151
  misc_feature 1..38: note = chr8:121206396-121206434
  misc_feature 1..38: note = hypo
  source 1..38: mol_type = genomic DNA

SEQ ID NO: 41916 - DNA, 30 bp, Homo sapiens
  misc_feature 1..30: note = chr8:121354745-121354775
  misc_feature 1..30: note = hypo
  source 1..30: mol_type = genomic DNA
ttcttttcccatgagcgtaccactaaggaa

SEQ ID NO: 41917 - DNA, 30 bp, Homo sapiens
  misc_feature 1..30: note = chr8:121566445-121566475
  misc_feature 1..30: note = hypo
  source 1..30: mol_type = genomic DNA
cgttcggtgacaaggcgtttctacatggtc

SEQ ID NO: 41918 - DNA, 30 bp, Homo sapiens
  misc_feature 1..30: note = chr8:121573169-121573199
  misc_feature 1..30: note = hypo
  source 1..30: mol_type = genomic DNA
gagaatttgaacccacggctatatgactac

SEQ ID NO: 41919 - DNA, 75 bp, Homo sapiens
  misc_feature 1..75: note = chr8:121712263-121712338
  misc_feature 1..75: note = hypo
  source 1..75: mol_type = genomic DNA
ccccctttggtcattcgcccaaagtcagtgttggaaaatggcagaagcatgaggtgaatccgggtagactggctc

SEQ ID NO: 41920 - DNA, 183 bp, Homo sapiens
  misc_feature 1..183: note = chr8:121732132-121732315
  misc_feature 1..183: note = hypo
  source 1..183: mol_type = genomic DNA
cacttacatgaatggcgggcaaggctcaaaaagcctcgccttcctatttgtaaaatgacttcaaactgtctacatagttcaattaaaattttatacttccttccaggattagaacacagcttccaaattctcttaaatgcctgggcagccatcaaaccttccagtgatcggtgatgcagtaaa

SEQ ID NO: 41921 - DNA, 89 bp, Homo sapiens
  misc_feature 1..89: note = chr8:121825686-121825775
  misc_feature 1..89: note = hypo
  source 1..89: mol_type = genomic DNA
tgactccctaaagagcggagtcccagccaggtcaaggaatgaaatgaaaacatttggacattttcttgagaaggcggagtcactgcagg

SEQ ID NO: 41922 - DNA, 144 bp, Homo sapiens
  misc_feature 1..144: note = chr8:121982491-121982635
  misc_feature 1..144: note = hypo
  source 1..144: mol_type = genomic DNA
ctcaagtgacttttccggatcctcagtaccggtgccaggtcacctacactaccttacgttccagcccctggggccttttggcctgttctctattaaacaaacatgtcacaccaccgtatttttcttctccggtttcccaaagat

SEQ ID NO: 41923 - DNA, 210 bp, Homo sapiens
  misc_feature 1..210: note = chr8:123695489-123695699
  misc_feature 1..210: note = hypo
  source 1..210: mol_type = genomic DNA
gagaaatttaaagggcgagagatggcggcaggccagttgcgccgaaggtggagtgagacgaggtgatcgcgttgagggagacttgcttttcccgagtctgtcagggcaaagcatgtgtgagtttcccatggagcagaactggcctgggaggtgcggcgccagatgctagggggtgagggagaagcagtggaggaacggtcagaagagatg

SEQ ID NO: 41924 - DNA, 347 bp, Homo sapiens
  misc_feature 1..347: note = chr8:123966045-123966392
  misc_feature 1..347: note = hypo
  source 1..347: mol_type = genomic DNA
gaggccacctcagaccggtcagagggcagcagccgggacggccagggtagcgacgagaacgaggagtcgagcgttgtggattacgtggaggtgacggtcggggaggaggatgcgatctcagatagatcagatagctggagtcaggctgcggcagaaggtgtgtcggaactggctgaatcagactccgactgcgtccctgcagaggctggccaggcctagacaggtaattccacctgctcacccaggcagcaggggagaacgcagcttgctttcttttcgttgccagggttaatatagattgtagggtacagagatgttgacacagatggtggcgtctttttcttgta

SEQ ID NO: 41925 - DNA, 105 bp, Homo sapiens
  misc_feature 1..105: note = chr8:124055130-124055235
  misc_feature 1..105: note = hypo
  source 1..105: mol_type = genomic DNA
tgcacagagaaaagccgctctaactaggttggaatgttggaggaactaaaagccaaaatgatccatcttgtctaattcaacttgtataagaaggaatctttaaga

SEQ ID NO: 41926 - DNA, 45 bp, Homo sapiens
  misc_feature 1..45: note = chr8:124055535-124055580
  misc_feature 1..45: note = hypo
  source 1..45: mol_type = genomic DNA
aaaaaagaaaagatactgagtagagtttcccgttgttttgggatt

SEQ ID NO: 41927 - DNA, 17 bp, Homo sapiens
  misc_feature 1..17: note = chr8:124288888-124288905
  misc_feature 1..17: note = hypo
  source 1..17: mol_type = genomic DNA
gccgatgactaggtttt

SEQ ID NO: 41928 - DNA, 20 bp, Homo sapiens
  misc_feature 1..20: note = chr8:124428122-124428142
  misc_feature 1..20: note = hypo
  source 1..20: mol_type = genomic DNA
gcacccggccctaaacacta

SEQ ID NO: 41929 - DNA, 97 bp, Homo sapiens
  misc_feature 1..97: note = chr8:125452302-125452399
  misc_feature 1..97: note = hypo
  source 1..97: mol_type = genomic DNA
tgccaaacacactcacgcacctgactatcctgtcagtaagggattgttttttggtgtttgtttgttttttgtttttgttcgtttgttttgagacgga

SEQ ID NO: 41930 - DNA, 36 bp, Homo sapiens
  misc_feature 1..36: note = chr8:125452639-125452675
  misc_feature 1..36: note = hypo
  source 1..36: mol_type = genomic DNA
gattacaggcataagccaccgcgctaggccataagg

SEQ ID NO: 41931 - DNA, 30 bp, Homo sapiens
  misc_feature 1..30: note = chr8:125568984-125569014
  misc_feature 1..30: note = hypo
  source 1..30: mol_type = genomic DNA
gtctgaagggaccagcgctccttaacaacc

SEQ ID NO: 41932 - DNA, 121 bp, Homo sapiens
  misc_feature 1..121: note = chr8:126267003-126267124
  misc_feature 1..121: note = hypo
  source 1..121: mol_type = genomic DNA
tgactgagactgtgacgttctatggaagcagtttggtccgggaatgaatcctttcattcagcaaacaaatgccatgccagctgagtcctgaaagagctcatgggcacgtaaaggaatatag

SEQ ID NO: 41933 - DNA, 30 bp, Homo sapiens
  misc_feature 1..30: note = chr8:126284175-126284205
  misc_feature 1..30: note = hypo
  source 1..30: mol_type = genomic DNA
aaacccagagatattcggtgacttggccaa

SEQ ID NO: 41934 - DNA, 97 bp, Homo sapiens; identical to SEQ ID NO: 15154
  misc_feature 1..97: note = chr8:127305217-127305314
  misc_feature 1..97: note = hypo
  source 1..97: mol_type = genomic DNA

SEQ ID NO: 41935 - DNA, 80 bp, Homo sapiens
  misc_feature 1..80: note = chr8:128745542-128745622
  misc_feature 1..80: note = hypo
  source 1..80: mol_type = genomic DNA
agccaaggccaggagcgatgactcgcacttgtattcccagcagtttcagaggcaaaggccgaaggatcgctttaaccgag

SEQ ID NO: 41936 - DNA, 39 bp, Homo sapiens
  misc_feature 1..39: note = chr8:128864120-128864159
  misc_feature 1..39: note = hypo
  source 1..39: mol_type = genomic DNA
tcacattctctagaccggttgccacgccatgctcacagt

SEQ ID NO: 41937 - DNA, 117 bp, Homo sapiens
  misc_feature 1..117: note = chr8:128872322-128872439
  misc_feature 1..117: note = hypo
  source 1..117: mol_type = genomic DNA
cagggctaccaggaacggtgtgtgtgcctctgggcagggccacttcctagaaccatggggctgctctgtgaagagaaccggctcccagtgagctccaggagacgaggagcaggtcct

SEQ ID NO: 41938 - DNA, 265 bp, Homo sapiens
  misc_feature 1..265: note = chr8:128888983-128889248
  misc_feature 1..265: note = hypo
  source 1..265: mol_type = genomic DNA
acaactcctgtcctccgtggcgcttgggtgacagcagagcagagccgatgtgcctgctcctggtcatgggctgttcgtgctgtcatcgctttcatttgccccatccccccaatttggacttacccagaatccttgggcaagctagatggctgccaaagtttacttagcgagatgtgcctgcgtgacttgagtagagacctgcttctgagaaagtcagaagtgcattccaaagtcaggagcgtgacctccccggaagcccagctaa

SEQ ID NO: 41939 - DNA, 30 bp, Homo sapiens
  misc_feature 1..30: note = chr8:128931231-128931261
  misc_feature 1..30: note = hypo
  source 1..30: mol_type = genomic DNA
tctctgggttctgatcgttggggctgtcct

SEQ ID NO: 41940 - DNA, 35 bp, Homo sapiens
  misc_feature 1..35: note = chr8:128962506-128962541
  misc_feature 1..35: note = hypo
  source 1..35: mol_type = genomic DNA
agcacccaatagccccgtggcggcatgctgttatt

SEQ ID NO: 41941 - DNA, 202 bp, Homo sapiens
  misc_feature 1..202: note = chr8:129069803-129070005
  misc_feature 1..202: note = hypo
  source 1..202: mol_type = genomic DNA
cctggcactggctgacgtgggaggtacagaatgaggtgtccgtccctccaaggcacggtgacctagaatcccactgctcactgcctgtctctgttcagcctttcagttcataaacatgctttcctccctgcattttgacatccatcatcgtttaaattccaggtcgtcatccttgtagaacgaggttcggatctcggcatta

SEQ ID NO: 41942 - DNA, 30 bp, Homo sapiens
  misc_feature 1..30: note = chr8:130080387-130080417
  misc_feature 1..30: note = hypo
  source 1..30: mol_type = genomic DNA
gtgacccactgcgcccggccagcatttgaa

SEQ ID NO: 41943 - DNA, 30 bp, Homo sapiens; identical to SEQ ID NO: 15159
  misc_feature 1..30: note = chr8:130116433-130116463
  misc_feature 1..30: note = hypo
  source 1..30: mol_type = genomic DNA

SEQ ID NO: 41944 - DNA, 203 bp, Homo sapiens
  misc_feature 1..203: note = chr8:130288699-130288902
  misc_feature 1..203: note = hypo
  source 1..203: mol_type = genomic DNA
catctatgaatatgtcgatgttcctgactgtctggaagtttcgttttctttctcttaaagtcatgttttccattgtcttgcagatcttttagccaaagctagggcatttgttgtggggatcaccttatggcctcccctcccatagtaagctgtcccagtggctctccaaggacatgctgcatttactgcgtatccatttcaaa

SEQ ID NO: 41945 - DNA, 209 bp, Homo sapiens
  misc_feature 1..209: note = chr8:130368840-130369049
  misc_feature 1..209: note = hypo
  source 1..209: mol_type = genomic DNA
tgagcatacctgaatcgagatttaagcattagtaatgaattgaattcccccatttgacaaaggtggtatcagctttcagtataacagagacagtattactttcaaaggaaaatttgggaactggagcaacagaggtgcttggccatgagaatggggccatttgtgagaatgacggctttttgttttgttttgtttttattgagacggag

SEQ ID NO: 41946 - DNA, 89 bp, Homo sapiens
  misc_feature 1..89: note = chr8:130369289-130369378
  misc_feature 1..89: note = hypo
  source 1..89: mol_type = genomic DNA
taaggaagcagtacactgcagtggagagtgctggagtcacgatacagatgctagttcagccgctggccaagtgtcgaccctgagaagtt

SEQ ID NO: 41947 - DNA, 31 bp, Homo sapiens
  misc_feature 1..31: note = chr8:130461175-130461206
  misc_feature 1..31: note = hypo
  source 1..31: mol_type = genomic DNA
cgtgagccaccgcgcccggccaggaatctgt

SEQ ID NO: 41948 - DNA, 201 bp, Homo sapiens
  misc_feature 1..201: note = chr8:130583277-130583478
  misc_feature 1..201: note = hypo
  source 1..201: mol_type = genomic DNA
aacgtatttccaaatcgtttatctgataagggatttgtatctagaatatatttttaaaagtgttacaactcagtagtaaatatcttagaacccagttttaaaatgagtaaagaatttggataggcatttttccaaatgatcaataagcacacgaaaagatgctcaacattaagtcattaggaaatgcgaatcaaagcagca

SEQ ID NO: 41949 - DNA, 23 bp, Homo sapiens
  misc_feature 1..23: note = chr8:131922190-131922213
  misc_feature 1..23: note = hypo
  source 1..23: mol_type = genomic DNA
tttttttttttgagacggagttt

SEQ ID NO: 41950 - DNA, 30 bp, Homo sapiens
  misc_feature 1..30: note = chr8:132284091-132284121
  misc_feature 1..30: note = hypo
  source 1..30: mol_type = genomic DNA
agatgttagtggacacgacacaagcaaagg

SEQ ID NO: 41951 - DNA, 30 bp, Homo sapiens
  misc_feature 1..30: note = chr8:132783128-132783158
  misc_feature 1..30: note = hypo
  source 1..30: mol_type = genomic DNA
ttgtcacccagaacccgatacaatggggca

SEQ ID NO: 41952 - DNA, 36 bp, Homo sapiens
  misc_feature 1..36: note = chr8:133062829-133062865
  misc_feature 1..36: note = hypo
  source 1..36: mol_type = genomic DNA
ccggctgtgagacttcgggcacgtgttctttcctcg

SEQ ID NO: 41953 - DNA, 101 bp, Homo sapiens
  misc_feature 1..101: note = chr8:133686745-133686846
  misc_feature 1..101: note = hypo
  source 1..101: mol_type = genomic DNA
tggggagctcaaaaacgttgtcgatatcaaaatggttcatacaatataaataacttacccgcatcaccttgcagtttgttagtatattcttaaagaaacac

SEQ ID NO: 41954 - DNA, 132 bp, Homo sapiens; identical to SEQ ID NO: 15163
  misc_feature 1..132: note = chr8:133811037-133811169
  misc_feature 1..132: note = hypo
  source 1..132: mol_type = genomic DNA

SEQ ID NO: 41955 - DNA, 179 bp, Homo sapiens
  misc_feature 1..179: note = chr8:134470121-134470300
  misc_feature 1..179: note = hypo
  source 1..179: mol_type = genomic DNA
accaggaaaaagtcacgcctcctcaaagcagcagcgaccttttcagggatattttcaacaagaaagtggtttttctgcttaaacattagtaactggagccaacaatcaccgtcccccacattcctgtcactctccactccacacccagcagcaataaggtttcacggagttttggagac

SEQ ID NO: 41956 - DNA, 45 bp, Homo sapiens
  misc_feature 1..45: note = chr8:134541589-134541634
  misc_feature 1..45: note = hypo
  source 1..45: mol_type = genomic DNA
tgggagcttataggtcgaaggtgctgctaccgagcaaatgtacaa

SEQ ID NO: 41957 - DNA, 34 bp, Homo sapiens
  misc_feature 1..34: note = chr8:135301251-135301285
  misc_feature 1..34: note = hypo
  source 1..34: mol_type = genomic DNA
aatatctctggccagatcccgcaatagagtatta

SEQ ID NO: 41958 - DNA, 154 bp, Homo sapiens
  misc_feature 1..154: note = chr8:138910227-138910381
  misc_feature 1..154: note = hypo
  source 1..154: mol_type = genomic DNA
aacatgcacctttaaatgaatatttcgttttattaatttatttcaataagttgagttccatctcccaactttatttgaacagaattaaccaaactggttaaaacttaagagagttaacaaagcacgaatgattttcttccgcactgcacacccc

SEQ ID NO: 41959 - DNA, 30 bp, Homo sapiens
  misc_feature 1..30: note = chr8:140630956-140630986
  misc_feature 1..30: note = hypo
  source 1..30: mol_type = genomic DNA
aaaggccacgtagagcggcttcttctgcag

SEQ ID NO: 41960 - DNA, 37 bp, Homo sapiens
  misc_feature 1..37: note = chr8:140691457-140691494
  misc_feature 1..37: note = hypo
  source 1..37: mol_type = genomic DNA
tgccaggtgggttcccggagagcgcctgtgtccctga

SEQ ID NO: 41961 - DNA, 119 bp, Homo sapiens; identical to SEQ ID NO: 5084
  misc_feature 1..119: note = chr8:140834148-140834267
  misc_feature 1..119: note = hypo
  source 1..119: mol_type = genomic DNA

SEQ ID NO: 41962 - DNA, 130 bp, Homo sapiens
  misc_feature 1..130: note = chr8:140834841-140834971
  misc_feature 1..130: note = hypo
  source 1..130: mol_type = genomic DNA
ctgagagccaagagccgtaggatggcgggggggggctgccttgcctccatgggaaggacagcagaggggctgccatctgccagaggcctgctgagtgcatgcgtcctctcagacacgctgcctgccgctg

SEQ ID NO: 41963 - DNA, 70 bp, Homo sapiens
  misc_feature 1..70: note = chr8:140963292-140963362
  misc_feature 1..70: note = hypo
  source 1..70: mol_type = genomic DNA
tgcctcacctgctcacggcttggagtcagccagacccaggcgcgcacatccccaccgccacctccccacc

SEQ ID NO: 41964 - DNA, 30 bp, Homo sapiens
  misc_feature 1..30: note = chr8:141018127-141018157
  misc_feature 1..30: note = hypo
  source 1..30: mol_type = genomic DNA
tcaacctgctcctgccgtgtgaaggctggg

SEQ ID NO: 41965 - DNA, 30 bp, Homo sapiens
  misc_feature 1..30: note = chr8:141054547-141054577
  misc_feature 1..30: note = hypo
  source 1..30: mol_type = genomic DNA
gaatttggttccatacgtgcccaactttga

SEQ ID NO: 41966 - DNA, 41 bp, Homo sapiens
  misc_feature 1..41: note = chr8:141106960-141107001
  misc_feature 1..41: note = hypo
  source 1..41: mol_type = genomic DNA
ggactaggacagggacgtggactggacgtgagacattccta

SEQ ID NO: 41967 - DNA, 133 bp, Homo sapiens
  misc_feature 1..133: note = chr8:141107540-141107673
  misc_feature 1..133: note = hypo
  source 1..133: mol_type = genomic DNA
cctgagtcctggctgcgcagcctgtgttgccagtcgcagggtaatacactcgcctgcatcgtgggtgccccgccaccgccctgccacagtctacaaggcaagaacgcccgtctgggtccgtagtgtgcagccg

SEQ ID NO: 41968 - DNA, 30 bp, Homo sapiens
  misc_feature 1..30: note = chr8:141159919-141159949
  misc_feature 1..30: note = hypo
  source 1..30: mol_type = genomic DNA
catgaagtacgagtgcgagcagtggagcct

SEQ ID NO: 41969 - DNA, 218 bp, Homo sapiens
  misc_feature 1..218: note = chr8:141202517-141202735
  misc_feature 1..218: note = hypo
  source 1..218: mol_type = genomic DNA
gtcaacaggcccaatcgtccacagagcaaggtgatctgcagaaacctcctggcacagtgcctggggcgtgttttctagcagtaaaaacaggcagcatggtgcaggggaggagcaagctgcccgcccacagccctcgcaccagctgtgcagtcagggcagccccattatgcagagcctcgcttcaatacctgcaaaacctgctccgacgaggtttaaga

SEQ ID NO: 41970 - DNA, 30 bp, Homo sapiens
  misc_feature 1..30: note = chr8:141249579-141249609
  misc_feature 1..30: note = hypo
  source 1..30: mol_type = genomic DNA
aaacaagtaagactccggccctgcccgcga

SEQ ID NO: 41971 - DNA, 196 bp, Homo sapiens
  misc_feature 1..196: note = chr8:141466557-141466753
  misc_feature 1..196: note = hypo
  source 1..196: mol_type = genomic DNA
gtggattttatggcaggtaatcgaggctcaatgaagctgttatttttgacacactagatttctgaaacatttattgtttacatgtttccggacaactgtttttccctctacactactagtcctccacacaattaaaaaaacgaacaaacacacacaacaaaacctagccagatctttaggacggcaatgttcctgg

SEQ ID NO: 41972 - DNA, 30 bp, Homo sapiens
  misc_feature 1..30: note = chr8:141566854-141566884
  misc_feature 1..30: note = hypo
  source 1..30: mol_type = genomic DNA
gatttttcaaagagtcgtgatgttagagga

SEQ ID NO: 41973 - DNA, 77 bp, Homo sapiens
  misc_feature 1..77: note = chr8:141588102-141588179
  misc_feature 1..77: note = hypo
  source 1..77: mol_type = genomic DNA
gctacaatgcacacccgtggagtcggctggcagacaatcctggccaccactcaggcctccgccgcccagagagagca

SEQ ID NO: 41974 - DNA, 30 bp, Homo sapiens
  misc_feature 1..30: note = chr8:141594857-141594887
  misc_feature 1..30: note = hypo
  source 1..30: mol_type = genomic DNA
cacacatcagaatgccgtgactttaggggc

SEQ ID NO: 41975 - DNA, 278 bp, Homo sapiens
  misc_feature 1..278: note = chr8:141596819-141597097
  misc_feature 1..278: note = hypo
  source 1..278: mol_type = genomic DNA
ctctctacgccacaccggagtagaacaaagcacttgccaacacgtggccctgttctcaggtggctccaaccacccagtgagacggctcccaggaaacgtctaggacagagcccgggaatctggccctgtggccaatctcgatttcagggtcgggcacgctcctctcggggaggagagtcactgtccttcggtgactcccagcttacaaggtgctcatgcagttacttaaccgagcctcacaaccataccacaaaggggcacaccgctggctgcaagaa

SEQ ID NO: 41976 - DNA, 30 bp, Homo sapiens
  misc_feature 1..30: note = chr8:141600227-141600257
  misc_feature 1..30: note = hypo
  source 1..30: mol_type = genomic DNA
gcctcacccagcccacgttcacagagacgc

SEQ ID NO: 41977 - DNA, 30 bp, Homo sapiens
  misc_feature 1..30: note = chr8:141602372-141602402
  misc_feature 1..30: note = hypo
  source 1..30: mol_type = genomic DNA
tggtccagggctgctcgaagcctgacacct

SEQ ID NO: 41978 - DNA, 35 bp, Homo sapiens
  misc_feature 1..35: note = chr8:141624396-141624431
  misc_feature 1..35: note = hypo
  source 1..35: mol_type = genomic DNA
taggagacagagtgagactccgtctcaaaacaaaa

SEQ ID NO: 41979 - DNA, 30 bp, Homo sapiens
  misc_feature 1..30: note = chr8:142231672-142231702
  misc_feature 1..30: note = hypo
  source 1..30: mol_type = genomic DNA
taccgatggcagagccgttaaggaaaagtg

SEQ ID NO: 41980 - DNA, 30 bp, Homo sapiens
  misc_feature 1..30: note = chr8:142243948-142243978
  misc_feature 1..30: note = hypo
  source 1..30: mol_type = genomic DNA
ggtccagcaggtctgcggctggacctgact

SEQ ID NO: 41981 - DNA, 30 bp, Homo sapiens
  misc_feature 1..30: note = chr8:142244184-142244214
  misc_feature 1..30: note = hypo
  source 1..30: mol_type = genomic DNA
aatcgtcgccaacatcggggcctgcatcgc

SEQ ID NO: 41982 - DNA, 56 bp, Homo sapiens
  misc_feature 1..56: note = chr8:142292571-142292627
  misc_feature 1..56: note = hypo
  source 1..56: mol_type = genomic DNA
gccctccctccaggccgccgctcagggcacgccgcctccatcgctgccctctctcc

SEQ ID NO: 41983 - DNA, 22 bp, Homo sapiens
  misc_feature 1..22: note = chr8:142313512-142313534
  misc_feature 1..22: note = hypo
  source 1..22: mol_type = genomic DNA
gcaggaacgagcctctgtgccc

SEQ ID NO: 41984 - DNA, 30 bp, Homo sapiens
  misc_feature 1..30: note = chr8:142323052-142323082
  misc_feature 1..30: note = hypo
  source 1..30: mol_type = genomic DNA
caccaggtgactgtccgtgccacccttttg

SEQ ID NO: 41985 - DNA, 58 bp, Homo sapiens
  misc_feature 1..58: note = chr8:142367766-142367824
  misc_feature 1..58: note = hypo
  source 1..58: mol_type = genomic DNA
gtcttggcccgggtgcggcagcagaagacgtacagcgccagcccgttgagcaccagcc

SEQ ID NO: 41986 - DNA, 72 bp, Homo sapiens
  misc_feature 1..72: note = chr8:142432225-142432297
  misc_feature 1..72: note = hypo
  source 1..72: mol_type = genomic DNA
caagcacagggatctcgttctcctcattttttgggggtgtgtggggacttctcaggtcgtgtccccagcctt

SEQ ID NO: 41987 - DNA, 30 bp, Homo sapiens
  misc_feature 1..30: note = chr8:142439319-142439349
  misc_feature 1..30: note = hypo
  source 1..30: mol_type = genomic DNA
cacggtggagccacacggggcacctgcagc

SEQ ID NO: 41988 - DNA, 42 bp, Homo sapiens
  misc_feature 1..42: note = chr8:142452256-142452298
  misc_feature 1..42: note = hypo
  source 1..42: mol_type = genomic DNA
gtgggagactcagggcgtgtggcgtagcggagcccagagaag

SEQ ID NO: 41989 - DNA, 30 bp, Homo sapiens
  misc_feature 1..30: note = chr8:142501450-142501480
  misc_feature 1..30: note = hypo
  source 1..30: mol_type = genomic DNA
tgaaactaaaggtgacgtggttttagaagt

SEQ ID NO: 41990 - DNA, 179 bp, Homo sapiens
  misc_feature 1..179: note = chr8:142535328-142535507
  misc_feature 1..179: note = hypo
  source 1..179: mol_type = genomic DNA
gagagagggtcaggacggcaaggctggggccggggcggcgggaagggtgaggtttctgtgcactgagatggggctgctggggctgtctggggagtccgaggtgcccaggggcaggcggtgggctcagtacacgaacgctgcgggcaaacaggccgggggaggagcgaggacctgcctgc

SEQ ID NO: 41991 - DNA, 144 bp, Homo sapiens
  misc_feature 1..144: note = chr8:142553829-142553973
  misc_feature 1..144: note = hypo
  source 1..144: mol_type = genomic DNA
gatggggctgagccccggcgcaggctgccactgatcctggttccaccttgtgtgtccgcttccatcagcctcttcccccatcccattctgaaccttcccctgccatgcctgggcctttgccattccttccgctgcagggtcctt

SEQ ID NO: 41992 - DNA, 37 bp, Homo sapiens
  misc_feature 1..37: note = chr8:142560165-142560202
  misc_feature 1..37: note = hypo
  source 1..37: mol_type = genomic DNA
taccctgtgagtccccggcaggcgtcactgcccccag

SEQ ID NO: 41993 - DNA, 30 bp, Homo sapiens
  misc_feature 1..30: note = chr8:142568598-142568628
  misc_feature 1..30: note = hypo
  source 1..30: mol_type = genomic DNA
ccacctgcctgaggtcgcacagctggcctg

SEQ ID NO: 41994 - DNA, 124 bp, Homo sapiens
  misc_feature 1..124: note = chr8:142583056-142583180
  misc_feature 1..124: note = hypo
  source 1..124: mol_type = genomic DNA
cagctgtgtgcagggcggggtggcggggggggacggggagggcggaggagccattggagtgattatgatggagctggcactggtcataaactttaatcaacttaaaacccgcttttggtattaa

SEQ ID NO: 41995 - DNA, 144 bp, Homo sapiens
  misc_feature 1..144: note = chr8:142593584-142593728
  misc_feature 1..144: note = hypo
  source 1..144: mol_type = genomic DNA
cgctttctggaaagccgtggtgaagcatcacccggtaccagccgcctcgctagctcttgccatagcagcagcgtgaacaagcgtcccgccatttagtggctcaaaacaacaaggtgccgtggtttctcccgagcctcgggtggg

SEQ ID NO: 41996 - DNA, 30 bp, Homo sapiens
  misc_feature 1..30: note = chr8:142680135-142680165
  misc_feature 1..30: note = hypo
  source 1..30: mol_type = genomic DNA
actcctccagacggccgggagggcttcaca

SEQ ID NO: 41997 - DNA, 30 bp, Homo sapiens; identical to SEQ ID NO: 15174
  misc_feature 1..30: note = chr8:142694812-142694842
  misc_feature 1..30: note = hypo
  source 1..30: mol_type = genomic DNA

SEQ ID NO: 41998 - DNA, 193 bp, Homo sapiens
  misc_feature 1..193: note = chr8:142706678-142706871
  misc_feature 1..193: note = hypo
  source 1..193: mol_type = genomic DNA
taggaagagagatgccgggaagaaaactgcgtctgctcacgtcctttccttctgcccccatgctccctccaccttccttccagcctggacatggagcctcatttccgcagaggtgagccttgagtcacaagggtgtcccccacaaactctaggaagcaagcgccttgagcgccatgggcggtactggggaagt

SEQ ID NO: 41999 - DNA, 114 bp, Homo sapiens
  misc_feature 1..114: note = chr8:142939132-142939246
  misc_feature 1..114: note = hypo
  source 1..114: mol_type = genomic DNA
tattagcaccaccatcgtcatccccatccttgtcatcatcaccagtactatcatcatcatcatcgtcatcatcatagctattaccatcaacatcaatgccgttactgtcatcat

SEQ ID NO: 42000 - DNA, 97 bp, Homo sapiens
  misc_feature 1..97: note = chr8:143054769-143054866
  misc_feature 1..97: note = hypo
  source 1..97: mol_type = genomic DNA
actgtacttgcctcacgtgtgcctgggctcacggtgcctgcgctcacgggtgcctgccctcacggtgcctgcgttcacgggtgcctgccctcacggg

SEQ ID NO: 42001 - DNA, 97 bp, Homo sapiens
  misc_feature 1..97: note = chr8:143054986-143055083
  misc_feature 1..97: note = hypo
  source 1..97: mol_type = genomic DNA
cggtgcctgggctcacggtgcctgcgctcacgggtgcctgccctcacgagcctgcgctcacgggtgcctgtgcttacaggtgcgcaccaccccccac

SEQ ID NO: 42002 - DNA, 33 bp, Homo sapiens
  misc_feature 1..33: note = chr8:143088493-143088526
  misc_feature 1..33: note = hypo
  source 1..33: mol_type = genomic DNA
ccaccgcagcgtgtacgccgttttctacattta

SEQ ID NO: 42003 - DNA, 68 bp, Homo sapiens
  misc_feature 1..68: note = chr8:143088999-143089067
  misc_feature 1..68: note = hypo
  source 1..68: mol_type = genomic DNA
ggactaaagtcccctcgagcgcctcagggtcggcttcccaggccttcgcagcccgtgtgaagctagag

SEQ ID NO: 42004 - DNA, 30 bp, Homo sapiens
  misc_feature 1..30: note = chr8:143090706-143090736
  misc_feature 1..30: note = hypo
  source 1..30: mol_type = genomic DNA
ggacgccaaatctgccggcaccttgatctt

SEQ ID NO: 42005 - DNA, 33 bp, Homo sapiens; identical to SEQ ID NO: 15178
  misc_feature 1..33: note = chr8:143097424-143097457
  misc_feature 1..33: note = hypo
  source 1..33: mol_type = genomic DNA

SEQ ID NO: 42006 - DNA, 166 bp, Homo sapiens
  misc_feature 1..166: note = chr8:143105211-143105377
  misc_feature 1..166: note = hypo
  source 1..166: mol_type = genomic DNA
ctgcgccagctcagccgtctgtctcaggcaggcaccgtctgctgtggccggcgggtggtgtgtctgggccggctctgctctagatgccgctaaggtgcaggaggcatggctgctgccctctgggagctcgtcctggggtgtccgtgtgacacggacctgcccatgc

SEQ ID NO: 42007 - DNA, 30 bp, Homo sapiens
  misc_feature 1..30: note = chr8:143128771-143128801
  misc_feature 1..30: note = hypo
  source 1..30: mol_type = genomic DNA
gcgtgatggcaaactcgagtccggccagaa

SEQ ID NO: 42008 - DNA, 30 bp, Homo sapiens
  misc_feature 1..30: note = chr8:143156215-143156245
  misc_feature 1..30: note = hypo
  source 1..30: mol_type = genomic DNA
gcttgtgctggccaacggaatgttactgga

SEQ ID NO: 42009 - DNA, 102 bp, Homo sapiens
  misc_feature 1..102: note = chr8:143171156-143171258
  misc_feature 1..102: note = hypo
  source 1..102: mol_type = genomic DNA
gagtcaacagagagccgcagctgctcgtaccgggcaagtctctgcggggtgggaccctgtcccaggacgcaggattggcgctgagctcgggatctctgtgtg

SEQ ID NO: 42010 - DNA, 39 bp, Homo sapiens
  misc_feature 1..39: note = chr8:143198927-143198966
  misc_feature 1..39: note = hypo
  source 1..39: mol_type = genomic DNA
aggccacagctactccgcagctcacggcagttgggaccc

SEQ ID NO: 42011 - DNA, 144 bp, Homo sapiens
  misc_feature 1..144: note = chr8:143210699-143210843
  misc_feature 1..144: note = hypo
  source 1..144: mol_type = genomic DNA
aagtcggagggaacccggaacaggaaacaacgcacaggctcaggacaggggacaccggtgtgtgtgacccattgctgccacccaccagccgtgtggccctggggacccccatcgccctctgtgcctcggcgtcctcgtctgcag

SEQ ID NO: 42012 - DNA, 66 bp, Homo sapiens
  misc_feature 1..66: note = chr8:143217605-143217671
  misc_feature 1..66: note = hypo
  source 1..66: mol_type = genomic DNA
ccggaacctaagctccgaagccaggccgtgctctcttcccagcgccgcttccgcatctcccacttg

SEQ ID NO: 42013 - DNA, 30 bp, Homo sapiens
  misc_feature 1..30: note = chr8:143265172-143265202
  misc_feature 1..30: note = hypo
  source 1..30: mol_type = genomic DNA
tggtgggtccttcatcggactcaccactca

SEQ ID NO: 42014 - DNA, 43 bp, Homo sapiens
  misc_feature 1..43: note = chr8:143314664-143314707
  misc_feature 1..43: note = hypo
  source 1..43: mol_type = genomic DNA
ggcctaggacccaagcggggtttttggacgggtgatggtcaag

SEQ ID NO: 42015 - DNA, 365 bp, Homo sapiens
  misc_feature 1..365: note = chr8:143317093-143317458
  misc_feature 1..365: note = hypo
  source 1..365: mol_type = genomic DNA
actttaggccaaaggcggcagcgggtgagagcacatggcgttgggtccactgtcctgaaagggaagcggccctgagcgtttcctctgtgccagggcctgccaggggcacgggagtcctgtcttttagggagggcttcatgcagggtgggggatggacaagttgaggagcatggcggggcaggaggaggtgggcacgcaggaggggcttcacctggcgaggtgggggcacagaaggctgcaagtcccccaggggagacgggctcacctctcccaattagccccaggctgtgcaggatgctggagcttcagggcaaggactccgcagccaggctccagccacagcctcaccgcgtggccatgaggct

SEQ ID NO: 42016 - DNA, 30 bp, Homo sapiens
  misc_feature 1..30: note = chr8:143326109-143326139
  misc_feature 1..30: note = hypo
  source 1..30: mol_type = genomic DNA
acgcagggagagagacgcttaccgcagccc

SEQ ID NO: 42017 - DNA, 32 bp, Homo sapiens
  misc_feature 1..32: note = chr8:143333080-143333112
  misc_feature 1..32: note = hypo
  source 1..32: mol_type = genomic DNA
catgtacccgccacccgcgatctctgtctgca

SEQ ID NO: 42018 - DNA, 278 bp, Homo sapiens
  misc_feature 1..278: note = chr8:143333390-143333668
  misc_feature 1..278: note = hypo
  source 1..278: mol_type = genomic DNA
tgtacccgccgcccacgttctctatctgcagggcccgggcaccatgtacccaccgctcgcgttctctatctgcagggcccgggcaccatgtacccgccgcccgcgttctctgtctgcagggcacgcacgttgagagagagcttgtttgatatctgggcggtttgtttggtttaattttgttgttttccctttctgctgtcaagaggtaaacagacggctgcttcatcttcttaagcaggcctacattcgtaatgcatgggttgcgggtgggaggagga

SEQ ID NO: 42019 - DNA, 76 bp, Homo sapiens
  misc_feature 1..76: note = chr8:143334563-143334639
  misc_feature 1..76: note = hypo
  source 1..76: mol_type = genomic DNA
aggagggccggtagccgtggagtcacagcagtggtgacggcggtgcctgcagaagcagggccgctgggccacctcc

SEQ ID NO: 42020 - DNA, 30 bp, Homo sapiens
  misc_feature 1..30: note = chr8:143386910-143386940
  misc_feature 1..30: note = hypo
  source 1..30: mol_type = genomic DNA
tcgggggcctggtgccgctctccccagcag

SEQ ID NO: 42021 - DNA, 179 bp, Homo sapiens
  misc_feature 1..179: note = chr8:143405792-143405971
  misc_feature 1..179: note = hypo
  source 1..179: mol_type = genomic DNA
tgactgaggagtctgcgaggcctgcctggggggtgtgtcacctgaggcccatttgccctagcgccctgccctagtctgccggggccagaaccgacctgagtacggaggctctcgcatttgcttgtcattacttaagatgccgtttagaagcacctcatgtcccgcgtatctcatacctg

SEQ ID NO: 42022 - DNA, 241 bp, Homo sapiens
  misc_feature 1..241: note = chr8:143436977-143437218
  misc_feature 1..241: note = hypo
  source 1..241: mol_type = genomic DNA
gcaggggtccctgtgcgggcagcttctgactggcctacaccctaatgctatcactacggaacctgctggccaggccacaccttaagttctaaacacctcagggcaagggctccacccgcccacacaaacacctgaagtgcgaaggcaggtttcagagcaaagtgagcctcacgccagctgagtacagacccaagtccctagggccggggaaggcggtgtgaccccacgttccctctgagca

SEQ ID NO: 42023 - DNA, 52 bp, Homo sapiens
  misc_feature 1..52: note = chr8:143463629-143463681
  misc_feature 1..52: note = hypo
  source 1..52: mol_type = genomic DNA
cacccccaggcacctcgtagaccacgcccagaatcagcggtggagaagcacc

SEQ ID NO: 42024 - DNA, 355 bp, Homo sapiens
  misc_feature 1..355: note = chr8:143509189-143509544
  misc_feature 1..355: note = hypo
  source 1..355: mol_type = genomic DNA
cgctccctttctccacggcacctctgtgattctcgtcacctgccaacaccagcaccagggctgcccctcctgacggccccctcgccgtctttctgggcacactccatcggcacagcgtcttcactgtcctcctgacaaacctcgtgccacccccatcagcttcagcaccacctccacagcagccgtggccagcaccgacgtccttttccgtcaccgtcaagcctcaaaactgggaccgtgggtaatggcgtcaccccatccgccgtctctctctagctgccaacggcgccttcaccagacacgcccggcaccaccttccaggtcagcagtcccagccctgcgtatcggaggcctg

SEQ ID NO: 42025 - DNA, 64 bp, Homo sapiens
  misc_feature 1..64: note = chr8:143511468-143511532
  misc_feature 1..64: note = hypo
  source 1..64: mol_type = genomic DNA
aatgcccatccacaccgctgggcaggactggctaaaataacacgtgcgacgcatgcacctgctg

SEQ ID NO: 42026 - DNA, 40 bp, Homo sapiens
  misc_feature 1..40: note = chr8:143535787-143535827
  misc_feature 1..40: note = hypo
  source 1..40: mol_type = genomic DNA
accgtgaggtgcacacgggtgcacacggcacccccgcccc

SEQ ID NO: 42027 - DNA, 49 bp, Homo sapiens
  misc_feature 1..49: note = chr8:143538439-143538488
  misc_feature 1..49: note = hypo
  source 1..49: mol_type = genomic DNA
atgagccctagactacgggagatgcagtgaggcccggaacctgagggcc

SEQ ID NO: 42028 - DNA, 205 bp, Homo sapiens
  misc_feature 1..205: note = chr8:143556064-143556269
  misc_feature 1..205: note = hypo
  source 1..205: mol_type = genomic DNA
ggtccatgaaggccgcggggactgtcggggcagggatggagaaagactcactagagaagctgaacagagcggccggggtcagggcaggggcgtggcggggaggcgcctgcaggcatttatcccaggctccctcctcgggtggccagctggccaggtccagggcaggctccgtcaggctgtgccctgggttcgaggccctggttgg

SEQ ID NO: 42029 - DNA, 357 bp, Homo sapiens
  misc_feature 1..357: note = chr8:143557723-143558080
  misc_feature 1..357: note = hypo
  source 1..357: mol_type = genomic DNA
cagtgagggaggtggcgcggggtatgggagacaggacccacaggaagggtcccctggtgaccagatgagggctggtgccaggctgggcactctggtccctggctcccagctgcccagtggagccaggtggcccagtgctgccgaactcagagcactgtggccacagagagagaggacgggggcaaagaaccgctcctgtgctgacctaagcccgtcctgcagccgctgggcgcaccagctcccggagccagtccctgcggtccacagatgcccggcggcgcgaggagctgggggacgagctgcagcagtttgggttcccagccccccagaccggtgagctggcgggaggggggtggg

SEQ ID NO: 42030 - DNA, 80 bp, Homo sapiens
  misc_feature 1..80: note = chr8:143558389-143558469
  misc_feature 1..80: note = hypo
  source 1..80: mol_type = genomic DNA
gcagccctcctgctgcggggtctggccccggtctgactgcagccccatgggcggcaggcctgtgacgctgtagtggggcc

SEQ ID NO: 42031 - DNA, 294 bp, Homo sapiens
  misc_feature 1..294: note = chr8:143561118-143561412
  misc_feature 1..294: note = hypo
  source 1..294: mol_type = genomic DNA
gaggtggctgctgtccggtgtccccgcaacgccacaggtgagggctggagagcacgtggtgtatgggggctcccgtcctgtcctcacggtgatgcccacgctgaggtgctgtcagcactgggaggcggcccagacacggagcccagacagcctgcgtgtgctggcgcggggtggtggggccgcgagcccagggcaccgtgtgagaactctgtggcagctgctgttctgagcactcgctaggggctggcacccatgctcagccctaacgcaagatgtccacggagtctaagcaac

SEQ ID NO: 42032 - DNA, 150 bp, Homo sapiens
  misc_feature 1..150: note = chr8:143567944-143568094
  misc_feature 1..150: note = hypo
  source 1..150: mol_type = genomic DNA
caggcggcattcagacgtgtctggtggaaaccatagcttcgtgcctattgtacttgaacaagtcccactaaaacatgtccaagacggatcgacattcttattataatgtctttgggaggctaactagcattaaccttttaaattaaagac

SEQ ID NO: 42033 - DNA, 30 bp, Homo sapiens
  misc_feature 1..30: note = chr8:143573208-143573238
  misc_feature 1..30: note = hypo
  source 1..30: mol_type = genomic DNA
tctgtgagtggcaggcgttggaggacaagg

SEQ ID NO: 42034 - DNA, 123 bp, Homo sapiens
  misc_feature 1..123: note = chr8:143587368-143587491
  misc_feature 1..123: note = hypo
  source 1..123: mol_type = genomic DNA
gccctaccttagtggcgcctgtgggcgcctgtgggactgtcatgcaccagaatgtgtccctggggccacatgtgtgagcagcgtgctgactgagcacctgggcgaccccgaggtggagtaaac

SEQ ID NO: 42035 - DNA, 242 bp, Homo sapiens
  misc_feature 1..242: note = chr8:143595579-143595821
  misc_feature 1..242: note = hypo
  source 1..242: mol_type = genomic DNA
agatggtggtagaggcgggtacgtgggcaccccgggagccagggtgggatgagatccgggcagggtggtagagcgaggggaggtgagacccacgagtcctcctctagagctggcctggagccagggtgtcggcgcagatgcgggctgcgcagatgccggctctgcggctgcagcaggcctacgacggccggaaggttgagtaaccgctctgagtcacacctgtgaggcggatgatgccacct

SEQ ID NO: 42036 - DNA, 30 bp, Homo sapiens
  misc_feature 1..30: note = chr8:143599108-143599138
  misc_feature 1..30: note = hypo
  source 1..30: mol_type = genomic DNA
cccaagaggactgtgcgtgtgggtgggcct

SEQ ID NO: 42037 - DNA, 30 bp, Homo sapiens
  misc_feature 1..30: note = chr8:143599572-143599602
  misc_feature 1..30: note = hypo
  source 1..30: mol_type = genomic DNA
gctggtcatcatctacgtgtccgtgtggag

SEQ ID NO: 42038 - DNA, 47 bp, Homo sapiens
  misc_feature 1..47: note = chr8:143618365-143618412
  misc_feature 1..47: note = hypo
  source 1..47: mol_type = genomic DNA
tgccgtgtggttgaccggcaggaggagggcaacggggactcaggggg

SEQ ID NO: 42039 - DNA, 34 bp, Homo sapiens
  misc_feature 1..34: note = chr8:143620764-143620798
  misc_feature 1..34: note = hypo
  source 1..34: mol_type = genomic DNA
tgtagatcaggtgagcgcccgacaggtgagagga

SEQ ID NO: 42040 - DNA, 161 bp, Homo sapiens; identical to SEQ ID NO: 15189
  misc_feature 1..161: note = chr8:143621956-143622117
  misc_feature 1..161: note = hypo
  source 1..161: mol_type = genomic DNA

SEQ ID NO: 42041 - DNA, 61 bp, Homo sapiens
  misc_feature 1..61: note = chr8:143623394-143623455
  misc_feature 1..61: note = hypo
  source 1..61: mol_type = genomic DNA
cccatgccaaggggccgcccaccaatttcaacagcctgccggccaacgtgtccaagctgca

SEQ ID NO: 42042 - DNA, 30 bp, Homo sapiens
  misc_feature 1..30: note = chr8:143623905-143623935
  misc_feature 1..30: note = hypo
  source 1..30: mol_type = genomic DNA
cagcctgggggatcccggggagcctgccgc

SEQ ID NO: 42043 - DNA, 30 bp, Homo sapiens
  misc_feature 1..30: note = chr8:143624997-143625027
  misc_feature 1..30: note = hypo
  source 1..30: mol_type = genomic DNA
ttccaggacctgaaccggaagctgcagcac

SEQ ID NO: 42044 - DNA, 34 bp, Homo sapiens
  misc_feature 1..34: note = chr8:143631480-143631514
  misc_feature 1..34: note = hypo
  source 1..34: mol_type = genomic DNA
cgaatagctggtgaacgtgcgagccgcccacccc

SEQ ID NO: 42045 - DNA, 30 bp, Homo sapiens
  misc_feature 1..30: note = chr8:143656193-143656223
  misc_feature 1..30: note = hypo
  source 1..30: mol_type = genomic DNA
catgttcccgggactcgtgccagtcccctc

SEQ ID NO: 42046 - DNA, 30 bp, Homo sapiens
  misc_feature 1..30: note = chr8:143702052-143702082
  misc_feature 1..30: note = hypo
  source 1..30: mol_type = genomic DNA
ggcaggaacagcaggcggggctgagctcag

SEQ ID NO: 42047 - DNA, 30 bp, Homo sapiens
  misc_feature 1..30: note = chr8:143819384-143819414
  misc_feature 1..30: note = hypo
  source 1..30: mol_type = genomic DNA
tgagtgtatccagtgcgcatatggatgtgc

SEQ ID NO: 42048 - DNA, 30 bp, Homo sapiens
  misc_feature 1..30: note = chr8:143827179-143827209
  misc_feature 1..30: note = hypo
  source 1..30: mol_type = genomic DNA
aggactctcaccccacgttctttcatctat

SEQ ID NO: 42049 - DNA, 61 bp, Homo sapiens
  misc_feature 1..61: note = chr8:143833212-143833273
  misc_feature 1..61: note = hypo
  source 1..61: mol_type = genomic DNA
ctgcacagctaggcccgactcctctgtccccactgtggggatgcagcggggcctctgcccc

SEQ ID NO: 42050 - DNA, 99 bp, Homo sapiens
  misc_feature 1..99: note = chr8:143855667-143855766
  misc_feature 1..99: note = hypo
  source 1..99: mol_type = genomic DNA
aacccccagcctgtgcgcgcatcccccagtcctgcgtcttttgccttgctcggctgggtcctgctgtggttggggaccaggactcgggggaccacctgc

SEQ ID NO: 42051 - DNA, 36 bp, Homo sapiens; identical to SEQ ID NO: 15190
  misc_feature 1..36: note = chr8:143876928-143876964
  misc_feature 1..36: note = hypo
  source 1..36: mol_type = genomic DNA

SEQ ID NO: 42052 - DNA, 33 bp, Homo sapiens
  misc_feature 1..33: note = chr8:143879185-143879218
  misc_feature 1..33: note = hypo
  source 1..33: mol_type = genomic DNA
agtgctgttggggcacgtcggggagcaggactt

SEQ ID NO: 42053 - DNA, 30 bp, Homo sapiens
  misc_feature 1..30: note = chr8:143882149-143882179
  misc_feature 1..30: note = hypo
  source 1..30: mol_type = genomic DNA
ctcccaggagggctgcgttttccaggcttc

SEQ ID NO: 42054 - DNA, 138 bp, Homo sapiens
  misc_feature 1..138: note = chr8:143960027-143960165
  misc_feature 1..138: note = hypo
  source 1..138: mol_type = genomic DNA
ccctgagggaggctgcggccccggcgaacaccaggctcagtactcagcctgtgacctgggccagtgggagtacccttctcagggcctcagttttctgacctatgggaaggacagtccccagaccgcaagagaaagcat

SEQ ID NO: 42055 - DNA, 198 bp, Homo sapiens; identical to SEQ ID NO: 5086
  misc_feature 1..198: note = chr8:143993967-143994165
  misc_feature 1..198: note = hypo
  source 1..198: mol_type = genomic DNA

SEQ ID NO: 42056 - DNA, 34 bp, Homo sapiens
  misc_feature 1..34: note = chr8:143996499-143996533
  misc_feature 1..34: note = hypo
  source 1..34: mol_type = genomic DNA
agggtcaggctcccccgggcgttctgcagcacct

SEQ ID NO: 42057 - DNA, 33 bp, Homo sapiens
  misc_feature 1..33: note = chr8:144015246-144015279
  misc_feature 1..33: note = hypo
  source 1..33: mol_type = genomic DNA
atgcgaaggtaagctcggcggtgggtgccacct

SEQ ID NO: 42058 - DNA, 141 bp, Homo sapiens
  misc_feature 1..141: note = chr8:144027680-144027821
  misc_feature 1..141: note = hypo
  source 1..141: mol_type = genomic DNA
cacgcctccccaccacggcaccaggggccggcagtgctgctgtctgcttctccctagggtgcatcaccctcagctcagccaccatcgcaaaggccacaggccaggtgccagaatggcagctgtgtgcgtctcacagctctg

SEQ ID NO: 42059 - DNA, 30 bp, Homo sapiens
  misc_feature 1..30: note = chr8:144069635-144069665
  misc_feature 1..30: note = hypo
  source 1..30: mol_type = genomic DNA
gcgagttacaggctgcggtgcaggtggcat

SEQ ID NO: 42060 - DNA, 151 bp, Homo sapiens
  misc_feature 1..151: note = chr8:144070508-144070659
  misc_feature 1..151: note = hypo
  source 1..151: mol_type = genomic DNA
ctccccgggctgctgcggcccccagggtgccacctccctctgcaacagcctttaacagctctgcaagttctgtggggctgtcccacggagaggtgaggtctgagaagggagtggaggcacagggctcctgcggccacgtcagaaacgccct

SEQ ID NO: 42061 - DNA, 30 bp, Homo sapiens
  misc_feature 1..30: note = chr8:144090641-144090671
  misc_feature 1..30: note = hypo
  source 1..30: mol_type = genomic DNA
gttgtctctgcccctcggtggcagctgttt

SEQ ID NO: 42062 - DNA, 128 bp, Homo sapiens
  misc_feature 1..128: note = chr8:144164496-144164624
  misc_feature 1..128: note = hypo
  source 1..128: mol_type = genomic DNA
gggtgatgggaaggacggtacctccggtgtgggtgacgggaagaatggtgcctccagtgtgggtgatgggaaggatggtgcctctgatgggcaatggggaaggatggtgcctccggtgttgggtgatg

SEQ ID NO: 42063 - DNA, 54 bp, Homo sapiens
  misc_feature 1..54: note = chr8:144190378-144190432
  misc_feature 1..54: note = hypo
  source 1..54: mol_type = genomic DNA
taatccagctctgaccgtctcacctgccctcctcttccgcgatggtccctgagc

SEQ ID NO: 42064 - DNA, 241 bp, Homo sapiens
  misc_feature 1..241: note = chr8:144203701-144203942
  misc_feature 1..241: note = hypo
  source 1..241: mol_type = genomic DNA
gagtggggaaggagccgactcaaggctgagtcccgcagccccgtgagggcggagtggaggttacggggcgggagcgggacgggaatctgagctcccagcagccgagccgagaggaaacccctgctcctgcccatgagcccagcagagcacatgccctggatgtcgagacgcggtccacagagagatgggctcctgtgactgtcctcggataggcctctggacgccacgccctagtgcagct

SEQ ID NO: 42065 - DNA, 30 bp, Homo sapiens; identical to SEQ ID NO: 15194
  misc_feature 1..30: note = chr8:144208784-144208814
  misc_feature 1..30: note = hypo
  source 1..30: mol_type = genomic DNA

SEQ ID NO: 42066 - DNA, 50 bp, Homo sapiens
  misc_feature 1..50: note = chr8:144226154-144226204
  misc_feature 1..50: note = hypo
  source 1..50: mol_type = genomic DNA
tggctcagcgctgcccgcacatgcccacgctgctccgtactgtggcttgc

SEQ ID NO: 42067 - DNA, 227 bp, Homo sapiens
  misc_feature 1..227: note = chr8:144238806-144239033
  misc_feature 1..227: note = hypo
  source 1..227: mol_type = genomic DNA
agacatgggcatgcacgtgtgggtgtgggcacgtgcactgggacacgccagtttgtgccagttatgtgcatgccccagcacgtgtgcgcggggcacctggggtgtgtgtgtgtgaaggagcagggcgggcacgggtgtgtgtgcacatgctggctgcgtgggcaccgtttgtatgcttgtctgggcatgagtgtgtgtgcacatgctggctgcgtgggcaccactgt

SEQ ID NO: 42068 - DNA, 67 bp, Homo sapiens
  misc_feature 1..67: note = chr8:144292403-144292470
  misc_feature 1..67: note = hypo
  source 1..67: mol_type = genomic DNA
atttaattcaatctgcgaatcaaatgtgctctgattgtccctaggtgattctcgcaataagcacttg

SEQ ID NO: 42069 - DNA, 184 bp, Homo sapiens
  misc_feature 1..184: note = chr8:144293655-144293839
  misc_feature 1..184: note = hypo
  source 1..184: mol_type = genomic DNA
cggggcggggcggggcgggacggggctgggggggacaggcatcaggtatgaagagtttggggctggcggggcgtgtccggctgtggcgtgggcaccactatgggagaccctggcttggcaagtgaccttgcagccttggctggggaagggctagatgctgggtgggtgccggtagagtggaaag

SEQ ID NO: 42070 - DNA, 147 bp, Homo sapiens
  misc_feature 1..147: note = chr8:144312859-144313006
  misc_feature 1..147: note = hypo
  source 1..147: mol_type = genomic DNA
tacaacatggacaaacgacgtaaagagctatttccctgacgaggacacgcagaaggcaaacgtgcacaggaacagatgttcgacaccacgcaccctcagcgttccgacactagaaccacggtgaggctgcagcgatggctcactcat

SEQ ID NO: 42071 - DNA, 214 bp, Homo sapiens
  misc_feature 1..214: note = chr8:144326825-144327039
  misc_feature 1..214: note = hypo
  source 1..214: mol_type = genomic DNA
taaggctggcaggggcgaggccggggctggcacagaggagctcgaacaggtggagtcttaaaaagcaggaaagggtctgtcaggcggaggcggagcgggggtgttcaaggcccagggttgaggcatgcagccgatgctgtgtggcagggcaagcacttgctgctgagtctcctggaaggggaaagggtggtgagaggggcggcctgcaagtctg

SEQ ID NO: 42072 - DNA, 149 bp, Homo sapiens
  misc_feature 1..149: note = chr8:144330269-144330418
  misc_feature 1..149: note = hypo
  source 1..149: mol_type = genomic DNA
gagccaccgcgcccggccagtccactctgcttttaagaaatattttatttctcagggtgggcagcgtgtagagaagtgagtcattccagtctctgccggttagcacctgccagcctaagttgagtcgacagagccgttatggagaatgt

SEQ ID NO: 42073 - DNA, 511 bp, Homo sapiens
  misc_feature 1..511: note = chr8:144343481-144343992
  misc_feature 1..511: note = hypo
  source 1..511: mol_type = genomic DNA
gggccctgggggcagcgagctgcgcctctgcaccgggagaaaggccgtgtccccagagctgaggcggtggtgggcagggctcctgagaagccggggcagggcagggtgtctctgaggtcaatgaggaacagctgaggtccagggacgcaggaaggatggggtgaactccgggatggggccggcagggagcctcacgcttacagagcctggtgttggcactctcctggcttcctccgcaaacctagccacgtggtcagggagcccgggcctagcagacggcccccaccttgacagaatccccagggtcgtgcgtggcggtgggggcgacttcacagccgagaccgggcctaacgctgctgtctcgcagtcacccctgcaggccgctcagggcagggctctggcctgacgggggttcctggacacgcctctgagccggcagcccctacccgcacccgtgcaccttccacgcccgtctccagcagcccctgcccccacccgcacccctgcacct

SEQ ID NO: 42074 - DNA, 299 bp, Homo sapiens
  misc_feature 1..299: note = chr8:144344244-144344543
  misc_feature 1..299: note = hypo
  source 1..299: mol_type = genomic DNA
cctctgcacctcccacgcccctctccggcagcccctgcccacacccgcacccctgcacctcccacgcccgtcttgccctggggcccaggtgcaggtctgtgaggagggcagccccgtgctcccgtggccaccgctcagccaaatggattcagcgagggtttttagtgtttgtgcctgtgtccccgtgtgcctgtttcctggtgaggctggatgcctggcatgtctgaacactcacattccccaggcatgcatgtgcagccgccgccgccacccatgtactgtggcgctgacccctcctg

SEQ ID NO: 42075 - DNA, 30 bp, Homo sapiens
  misc_feature 1..30: note = chr8:144347029-144347059
  misc_feature 1..30: note = hypo
  source 1..30: mol_type = genomic DNA
cagcttcccgtgatgcgctggatgcacagg

SEQ ID NO: 42076 - DNA, 243 bp, Homo sapiens
  misc_feature 1..243: note = chr8:144360302-144360545
  misc_feature 1..243: note = hypo
  source 1..243: mol_type = genomic DNA
ccctatggccaccagcgctctggacgccccactctgccaggtgagaacgagtttaggggtgcgggctggaggtcagtgtgtctgtccgaagtcagctgggaggcaggcgcctacttgaggcgtccttgctggtgtgcggtgggcctggggttcagactgtctgcctgaaaggtaagggtgaggacgcctgcattctccttgttcagtaacacgcgtgggcagccaggccgaggtgctggctct

SEQ ID NO: 42077 - DNA, 77 bp, Homo sapiens
  misc_feature 1..77: note = chr8:144361758-144361835
  misc_feature 1..77: note = hypo
  source 1..77: mol_type = genomic DNA
acttatccttcctcacggagcctgtttctgcctctgacaatggtggttagcgcagcccgctccgcaccgcacatggc

SEQ ID NO: 42078 - DNA, 30 bp, Homo sapiens; identical to SEQ ID NO: 15203
  misc_feature 1..30: note = chr8:144372473-144372503
  misc_feature 1..30: note = hypo
  source 1..30: mol_type = genomic DNA

SEQ ID NO: 42079 - DNA, 57 bp, Homo sapiens; identical to SEQ ID NO: 15204
  misc_feature 1..57: note = chr8:144383350-144383407
  misc_feature 1..57: note = hypo
  source 1..57: mol_type = genomic DNA

SEQ ID NO: 42080 - DNA, 35 bp, Homo sapiens
  misc_feature 1..35: note = chr8:144386583-144386618
  misc_feature 1..35: note = hypo
  source 1..35: mol_type = genomic DNA
tcttgctcatgtgaccgtcccgtgtgtgctcctgg

SEQ ID NO: 42081 - DNA, 30 bp, Homo sapiens
  misc_feature 1..30: note = chr8:144452062-144452092
  misc_feature 1..30: note = hypo
  source 1..30: mol_type = genomic DNA
tcctagaggaggaggcggtgctatcagcca

SEQ ID NO: 42082 - DNA, 34 bp, Homo sapiens
  misc_feature 1..34: note = chr8:144457801-144457835
  misc_feature 1..34: note = hypo
  source 1..34: mol_type = genomic DNA
agctgcagatgcggacgggcgctgagaacctcta

SEQ ID NO: 42083 - DNA, 179 bp, Homo sapiens; identical to SEQ ID NO: 15205
  misc_feature 1..179: note = chr8:144471637-144471816
  misc_feature 1..179: note = hypo
  source 1..179: mol_type = genomic DNA

SEQ ID NO: 42084 - DNA, 32 bp, Homo sapiens
  misc_feature 1..32: note = chr8:144552577-144552609
  misc_feature 1..32: note = hypo
  source 1..32: mol_type = genomic DNA
gtgcggagggaccaacgcgggggtgctcaggg

SEQ ID NO: 42085 - DNA, 30 bp, Homo sapiens
  misc_feature 1..30: note = chr8:144573375-144573405
  misc_feature 1..30: note = hypo
  source 1..30: mol_type = genomic DNA
tcccacaggaacccccggggggcccttgag

SEQ ID NO: 42086 - DNA, 83 bp, Homo sapiens; identical to SEQ ID NO: 15206
  misc_feature 1..83: note = chr8:144589999-144590082
  misc_feature 1..83: note = hypo
  source 1..83: mol_type = genomic DNA

SEQ ID NO: 42087 - DNA, 175 bp, Homo sapiens
  misc_feature 1..175: note = chr8:144656770-144656945
  misc_feature 1..175: note = hypo
  source 1..175: mol_type = genomic DNA
ctcctcactgcccttcgggcttcagcacagggctgtctcccacgccggcagggcctgtgctttcactgggatgcaaatcttcctgctacctcgagctcagattcccgactccagcccagccgcagcccgggaggcgcagcccgtgggctgggtgaacaaacgacacaaacaacac

SEQ ID NO: 42088 - DNA, 158 bp, Homo sapiens
  misc_feature 1..158: note = chr8:144668814-144668972
  misc_feature 1..158: note = hypo
  source 1..158: mol_type = genomic DNA
tggcctggctgaatccgctttgtgtgccccggccactcctgtcgggcagcagagccgcccagccgccccacgtgcagctctcacctggcgggaggcacctgccacaggcccgttcatctgctcgtagaatctcctttctgcgtcgtcatatttgaact

SEQ ID NO: 42089 - DNA, 37 bp, Homo sapiens
  misc_feature 1..37: note = chr8:144675999-144676036
  misc_feature 1..37: note = hypo
  source 1..37: mol_type = genomic DNA
acctcctcatttccccgcttcccgcattcccaagcat

SEQ ID NO: 42090 - DNA, 177 bp, Homo sapiens
  misc_feature 1..177: note = chr8:144677837-144678014
  misc_feature 1..177: note = hypo
  source 1..177: mol_type = genomic DNA
gccccgccccaaccacgtcttttcttaaatgccactgcaggccagctccatggccagccctgcttgaggggctctggccgacctgcctgcccggcgcagcccctgtgcctcctgggtgactccagcacggcacaggctttctggaaccccagacaatacccacgccacacctcacac

SEQ ID NO: 42091 - DNA, 79 bp, Homo sapiens
  misc_feature 1..79: note = chr8:144681634-144681713
  misc_feature 1..79: note = hypo
  source 1..79: mol_type = genomic DNA
acaagtgcctggctccggaggaggttgcggagtggctgcacctggacgatgatgggggtccgcccgagggctgcaggga

SEQ ID NO: 42092 - DNA, 122 bp, Homo sapiens
  misc_feature 1..122: note = chr8:144685577-144685699
  misc_feature 1..122: note = hypo
  source 1..122: mol_type = genomic DNA
cctggctcaccacaacgctccctgccgtgccgagaactgagcccgtgtctttgtcacaggccctcaccagctgggccaggagtggctggcttgggatctccacctcccgagctgagctcacc

SEQ ID NO: 42093 - DNA, 185 bp, Homo sapiens
  misc_feature 1..185: note = chr8:145739768-145739953
  misc_feature 1..185: note = hypo
  source 1..185: mol_type = genomic DNA
cacagcccaggtgcccgcccgctgcctccctcacccctaggcccatgaggcccccaccttctgcaggacagattcccgttgcttcctggtcatgcccgagtgtatgcaggccgccttgagacacggtggcaggccagacacctgcaaatgcaggagcgacagccgtcatacgccagcccagccct

SEQ ID NO: 42094 - DNA, 30 bp, Homo sapiens
  misc_feature 1..30: note = chr8:145745121-145745151
  misc_feature 1..30: note = hypo
  source 1..30: mol_type = genomic DNA
gtgttcttgagcacacggcaggtgctgcag

SEQ ID NO: 42095 - DNA, 77 bp, Homo sapiens
  misc_feature 1..77: note = chr8:145753490-145753567
  misc_feature 1..77: note = hypo
  source 1..77: mol_type = genomic DNA
gcgtgcaggtgggggcggggaagctcaggaggtcctgaagctcgggaggtcctgaaccggcccgagcccacttttcc

SEQ ID NO: 42096 - DNA, 106 bp, Homo sapiens; identical to SEQ ID NO: 15212
  misc_feature 1..106: note = chr8:145758572-145758678
  misc_feature 1..106: note = hypo
  source 1..106: mol_type = genomic DNA

SEQ ID NO: 42097 - DNA, 18 bp, Homo sapiens
  misc_feature 1..18: note = chr8:145919061-145919079
  misc_feature 1..18: note = hypo
  source 1..18: mol_type = genomic DNA
ggccgtaaaattctttga

SEQ ID NO: 42098 - DNA, 192 bp, Homo sapiens
  misc_feature 1..192: note = chr8:145979452-145979644
  misc_feature 1..192: note = hypo
  source 1..192: mol_type = genomic DNA
gatcagactgatacccggggacaaggggcaggaccctcttctttgggatccaaagagccaaagcagcctcccaagctcctcagaggcccccactgcgaaccaggccaagtgcagagagcctcacccagagaggccacgttcccatagttctccagcatcacatcccggtagagcgcccgctgctgggggccc

SEQ ID NO: 42099 - DNA, 30 bp, Homo sapiens; identical to SEQ ID NO: 15213
  misc_feature 1..30: note = chr8:146013567-146013597
  misc_feature 1..30: note = hypo
  source 1..30: mol_type = genomic DNA

SEQ ID NO: 42100 - DNA, 30 bp, Homo sapiens
  misc_feature 1..30: note = chr8:146050247-146050277
  misc_feature 1..30: note = hypo
  source 1..30: mol_type = genomic DNA
gtttccagggacccacgactataacttctt

SEQ ID NO: 42101 - DNA, 98 bp, Homo sapiens; identical to SEQ ID NO: 5087
  misc_feature 1..98: note = chr8:146079215-146079313
  misc_feature 1..98: note = hypo
  source 1..98: mol_type = genomic DNA

SEQ ID NO: 42102 - DNA, 35 bp, Homo sapiens
  misc_feature 1..35: note = chr9:2727012-2727047
  misc_feature 1..35: note = hypo
  source 1..35: mol_type = genomic DNA
gtgccaaagaggttggggaccgctgttctaaacta

SEQ ID NO: 42103 - DNA, 17 bp, Homo sapiens
  misc_feature 1..17: note = chr9:5230606-5230623
  misc_feature 1..17: note = hypo
  source 1..17: mol_type = genomic DNA
caaacctttttgaaacg

SEQ ID NO: 42104 - DNA, 105 bp, Homo sapiens; identical to SEQ ID NO: 1581
  misc_feature 1..105: note = chr9:6756353-6756458
  misc_feature 1..105: note = hypo
  source 1..105: mol_type = genomic DNA

SEQ ID NO: 42105 - DNA, 30 bp, Homo sapiens; identical to SEQ ID NO: 15216
  misc_feature 1..30: note = chr9:7164747-7164777
  misc_feature 1..30: note = hypo
  source 1..30: mol_type = genomic DNA

SEQ ID NO: 42106 - DNA, 17 bp, Homo sapiens
  misc_feature 1..17: note = chr9:15277136-15277153
  misc_feature 1..17: note = hypo
  source 1..17: mol_type = genomic DNA
aatttatgggctgggcg

SEQ ID NO: 42107 - DNA, 29 bp, Homo sapiens
  misc_feature 1..29: note = chr9:15533122-15533151
  misc_feature 1..29: note = hypo
  source 1..29: mol_type = genomic DNA
cccggccagaaagacgtgtttactacaaa

SEQ ID NO: 42108 - DNA, 126 bp, Homo sapiens; identical to SEQ ID NO: 32413
  misc_feature 1..126: note = chr9:21970940-21971066
  misc_feature 1..126: note = hypo
  source 1..126: mol_type = genomic DNA

SEQ ID NO: 42109 - DNA, 30 bp, Homo sapiens
  misc_feature 1..30: note = chr9:26958024-26958054
  misc_feature 1..30: note = hypo
  source 1..30: mol_type = genomic DNA
acaggcgtgagccaccgctcccggtcgctt

SEQ ID NO: 42110 - DNA, 21 bp, Homo sapiens
  misc_feature 1..21: note = chr9:26976277-26976298
  misc_feature 1..21: note = hypo
  source 1..21: mol_type = genomic DNA
aagaaagcttgaagtcgtaaa

SEQ ID NO: 42111 - DNA, 31 bp, Homo sapiens
  misc_feature 1..31: note = chr9:28641312-28641343
  misc_feature 1..31: note = hypo
  source 1..31: mol_type = genomic DNA
cgtgagccaccgcgcccggcctcagaggttt

SEQ ID NO: 42112 - DNA, 145 bp, Homo sapiens
  misc_feature 1..145: note = chr9:32999975-33000120
  misc_feature 1..145: note = hypo
  source 1..145: mol_type = genomic DNA
aaaaggtaacaaagagtaggtgtctgggagcttaatggacagtcgaagaaaaacaatatagaacagtggcgaagatcaaggtctctgaagttggactgcctgaattcaaacattggttctaccacctactcgctgtgtgacttga

SEQ ID NO: 42113 - DNA, 24 bp, Homo sapiens
  misc_feature 1..24: note = chr9:33647199-33647223
  misc_feature 1..24: note = hypo
  source 1..24: mol_type = genomic DNA
gcgagactgcgtctcaaaaaaaaa

SEQ ID NO: 42114 - DNA, 30 bp, Homo sapiens
  misc_feature 1..30: note = chr9:33862299-33862329
  misc_feature 1..30: note = hypo
  source 1..30: mol_type = genomic DNA
tagtttaaccccattcggttgtcatacaca

SEQ ID NO: 42115 - DNA, 20 bp, Homo sapiens
  misc_feature 1..20: note = chr9:34046353-34046373
  misc_feature 1..20: note = hypo
  source 1..20: mol_type = genomic DNA
gtaaaggcttcatgccgggc

SEQ ID NO: 42116 - DNA, 39 bp, Homo sapiens
  misc_feature 1..39: note = chr9:34062515-34062554
  misc_feature 1..39: note = hypo
  source 1..39: mol_type = genomic DNA
agtaataacatgggccgggcgcggtggctcatgcctgta

SEQ ID NO: 42117 - DNA, 99 bp, Homo sapiens
  misc_feature 1..99: note = chr9:34063196-34063295
  misc_feature 1..99: note = hypo
  source 1..99: mol_type = genomic DNA
aaaaaaaacaaaaccaaacctcaggtgttacttttatgatctaaataatgtttaagcaaatatttagggctattgaaggttgtacgctttcagagagaa

SEQ ID NO: 42118 - DNA, 57 bp, Homo sapiens
  misc_feature 1..57: note = chr9:34224348-34224405
  misc_feature 1..57: note = hypo
  source 1..57: mol_type = genomic DNA
tgttatggaccagctcgttattaaacgcattgtagacaacatcgatgatccttgttt

SEQ ID NO: 42119 - DNA, 56 bp, Homo sapiens
  misc_feature 1..56: note = chr9:34574808-34574864
  misc_feature 1..56: note = hypo
  source 1..56: mol_type = genomic DNA
tgagatcagcatgtgcgtgccctgctgcacgtgtgtgcgggcgtgttgttggggga

SEQ ID NO: 42120 - DNA, 30 bp, Homo sapiens
  misc_feature 1..30: note = chr9:35696547-35696577
  misc_feature 1..30: note = hypo
  source 1..30: mol_type = genomic DNA
ctgactaaagaatcacgcatgaaaatagtt

SEQ ID NO: 42121 - DNA, 95 bp, Homo sapiens
  misc_feature 1..95: note = chr9:35816242-35816337
  misc_feature 1..95: note = hypo
  source 1..95: mol_type = genomic DNA
caataagtcaggtttgcactgctggaatatatatttttgacataagaaacgtggggtcacaaaatactaatattctcagacgctaggtaagtttt

SEQ ID NO: 42122 - DNA, 22 bp, Homo sapiens
  misc_feature 1..22: note = chr9:36036080-36036102
  misc_feature 1..22: note = hypo
  source 1..22: mol_type = genomic DNA
aggcacagtggctcacgcctgc

SEQ ID NO: 42123 - DNA, 53 bp, Homo sapiens
  misc_feature 1..53: note = chr9:36257376-36257429
  misc_feature 1..53: note = hypo
  source 1..53: mol_type = genomic DNA
gtttggcttcaactgcggcgctcctacagttgggttaacgagttacctatact

SEQ ID NO: 42124 - DNA, 23 bp, Homo sapiens
  misc_feature 1..23: note = chr9:36274726-36274749
  misc_feature 1..23: note = hypo
  source 1..23: mol_type = genomic DNA
ttttttctcttgagacggagtct

SEQ ID NO: 42125 - DNA, 30 bp, Homo sapiens
  misc_feature 1..30: note = chr9:37134066-37134096
  misc_feature 1..30: note = hypo
  source 1..30: mol_type = genomic DNA
aggtaaacaaattcccggtaattctttcat

SEQ ID NO: 42126 - DNA, 30 bp, Homo sapiens; identical to SEQ ID NO: 5089
  misc_feature 1..30: note = chr9:37467610-37467640
  misc_feature 1..30: note = hypo
  source 1..30: mol_type = genomic DNA

SEQ ID NO: 42127 - DNA, 30 bp, Homo sapiens; identical to SEQ ID NO: 5090
  misc_feature 1..30: note = chr9:37467940-37467970
  misc_feature 1..30: note = hypo
  source 1..30: mol_type = genomic DNA

SEQ ID NO: 42128 - DNA, 31 bp, Homo sapiens
  misc_feature 1..31: note = chr9:38646913-38646944
  misc_feature 1..31: note = hypo
  source 1..31: mol_type = genomic DNA
caggagccaccgcgcccggctctcctttcta

SEQ ID NO: 42129 - DNA, 117 bp, Homo sapiens
  misc_feature 1..117: note = chr9:71223828-71223945
  misc_feature 1..117: note = hypo
  source 1..117: mol_type = genomic DNA
cagcgcatccccgggcgcggcgcccaccaacactcacagtgcaagggcttggctccgagggggctgggagcccgggcgccctggagtgaggggggccaggagcgggctctggaggct

SEQ ID NO: 42130 - DNA, 106 bp, Homo sapiens
  misc_feature 1..106: note = chr9:71425241-71425347
  misc_feature 1..106: note = hypo
  source 1..106: mol_type = genomic DNA
atctaatggagttagcgcaattcataatcgaagagaagtggacagcagcagagatggacatgaaacccaggccttcggaggcctatcccagcgttcttccaattca

SEQ ID NO: 42131 - DNA, 19 bp, Homo sapiens
  misc_feature 1..19: note = chr9:71501084-71501103
  misc_feature 1..19: note = hypo
  source 1..19: mol_type = genomic DNA
actccgtctgaaaaaaaaa

SEQ ID NO: 42132 - DNA, 26 bp, Homo sapiens
  misc_feature 1..26: note = chr9:71655284-71655310
  misc_feature 1..26: note = hypo
  source 1..26: mol_type = genomic DNA
atgtaaatatttatacgctgccgggc

SEQ ID NO: 42133 - DNA, 120 bp, Homo sapiens
  misc_feature 1..120: note = chr9:71734802-71734922
  misc_feature 1..120: note = hypo
  source 1..120: mol_type = genomic DNA
cagtaacctggcccaaccagttctgccatcgcagataggaacagaagacatatgaaaacctaacttcgacccccgcctgattccatctccaacctgaccaatcagcactccccacttctc

SEQ ID NO: 42134 - DNA, 27 bp, Homo sapiens
  misc_feature 1..27: note = chr9:71921187-71921214
  misc_feature 1..27: note = hypo
  source 1..27: mol_type = genomic DNA
tctgggcaagatgatcgccctgaataa

SEQ ID NO: 42135 - DNA, 44 bp, Homo sapiens
  misc_feature 1..44: note = chr9:72819967-72820011
  misc_feature 1..44: note = hypo
  source 1..44: mol_type = genomic DNA
gttcctattcggccatcttggctcctccccgcttattttttaat

SEQ ID NO: 42136 - DNA, 16 bp, Homo sapiens
  misc_feature 1..16: note = chr9:73032801-73032817
  misc_feature 1..16: note = hypo
  source 1..16: mol_type = genomic DNA
aacctattctttttcc

SEQ ID NO: 42137 - DNA, 173 bp, Homo sapiens
  misc_feature 1..173: note = chr9:74469850-74470023
  misc_feature 1..173: note = hypo
  source 1..173: mol_type = genomic DNA
ttctggcaatatttccggcagactggacagcaaaactggctcaggtagtgagagaaagccctcagggaagaaatacaagtgctggcagctggcaagtgggcccgtgtgcactgaagtggtacagattaaggaatatgagtgaggcaccaaagcatcttcgtggaaatttcaat

SEQ ID NO: 42138 - DNA, 30 bp, Homo sapiens
  misc_feature 1..30: note = chr9:78557098-78557128
  misc_feature 1..30: note = hypo
  source 1..30: mol_type = genomic DNA
gctgcggagctggctcggtgttgccaattt

SEQ ID NO: 42139 - DNA, 44 bp, Homo sapiens
  misc_feature 1..44: note = chr9:79073406-79073450
  misc_feature 1..44: note = hypo
  source 1..44: mol_type = genomic DNA
tttaaacaacatggaaacaaataagacctcgttctgttttctag

SEQ ID NO: 42140 - DNA, 30 bp, Homo sapiens; identical to SEQ ID NO: 15224
  misc_feature 1..30: note = chr9:79231349-79231379
  misc_feature 1..30: note = hypo
  source 1..30: mol_type = genomic DNA

SEQ ID NO: 42141 - DNA, 17 bp, Homo sapiens
  misc_feature 1..17: note = chr9:79448387-79448404
  misc_feature 1..17: note = hypo
  source 1..17: mol_type = genomic DNA
aaaccaaatacaggccg

SEQ ID NO: 42142 - DNA, 140 bp, Homo sapiens
  misc_feature 1..140: note = chr9:80852180-80852320
  misc_feature 1..140: note = hypo
  source 1..140: mol_type = genomic DNA
gccaccgcgcccggcctgtcttcattttttaaggtgtatataagaagtttgtaaagtgctttacaaatacaagccatttgtaaatgtatagtggtataattagggatccagactctctgattattcggaaaatatgttag

SEQ ID NO: 42143 - DNA, 30 bp, Homo sapiens
  misc_feature 1..30: note = chr9:81359075-81359105
  misc_feature 1..30: note = hypo
  source 1..30: mol_type = genomic DNA
tgtctacagtggattcggcagggacttggc

SEQ ID NO: 42144 - DNA, 30 bp, Homo sapiens
  misc_feature 1..30: note = chr9:84294960-84294990
  misc_feature 1..30: note = hypo
  source 1..30: mol_type = genomic DNA
tcctctggcgaaggacgctcctcaatttgc

SEQ ID NO: 42145 - DNA, 30 bp, Homo sapiens
  misc_feature 1..30: note = chr9:87326719-87326749
  misc_feature 1..30: note = hypo
  source 1..30: mol_type = genomic DNA
aatgaccttagaagacggccctgacccttc

SEQ ID NO: 42146 - DNA, 30 bp, Homo sapiens
  misc_feature 1..30: note = chr9:88832474-88832504
  misc_feature 1..30: note = hypo
  source 1..30: mol_type = genomic DNA
gtcaataccagaaggcggcgatcacaggga

SEQ ID NO: 42147 - DNA, 165 bp, Homo sapiens
  misc_feature 1..165: note = chr9:90322123-90322288
  misc_feature 1..165: note = hypo
  source 1..165: mol_type = genomic DNA
ctgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcct

SEQ ID NO: 42148 - DNA, 132 bp, Homo sapiens
  misc_feature 1..132: note = chr9:90421580-90421712
  misc_feature 1..132: note = hypo
  source 1..132: mol_type = genomic DNA
ctgctcaaggtgacccgagtcagaactgcaggtcagccccttcctggcttcctccgcaggcactgtctgctcctgaactcccaccacaatcctcagcgatgcattctccaaagaagccgctgtgacagctgt

SEQ ID NO: 42149 - DNA, 39 bp, Homo sapiens; identical to SEQ ID NO: 15227
  misc_feature 1..39: note = chr9:91914149-91914188
  misc_feature 1..39: note = hypo
  source 1..39: mol_type = genomic DNA

SEQ ID NO: 42150 - DNA, 138 bp, Homo sapiens
  misc_feature 1..138: note = chr9:91995955-91996093
  misc_feature 1..138: note = hypo
  source 1..138: mol_type = genomic DNA
gaggagtcactcacccgggcacacagaagcatcgccgctcatctcctgaatcaaacccctgcaaaacaaccggcacgtgttattcacccacacacatgggggacatccccaggcagcgcatcccgccccatacctgct

SEQ ID NO: 42151 - DNA, 159 bp, Homo sapiens
  misc_feature 1..159: note = chr9:92897057-92897216
  misc_feature 1..159: note = hypo
  source 1..159: mol_type = genomic DNA
aaagtgatgggattacaggcgtgagccaccgcgcccggccaccggggctccagtacttcagggagactggagcacacctgacgtgacccacccccgggacaaggaagcaggaagatcatcctccaactcccatcccgctggctgcgggctgctggcaag

SEQ ID NO: 42152 - DNA, 77 bp, Homo sapiens; identical to SEQ ID NO: 15229
  misc_feature 1..77: note = chr9:92980516-92980593
  misc_feature 1..77: note = hypo
  source 1..77: mol_type = genomic DNA

SEQ ID NO: 42153 - DNA, 16 bp, Homo sapiens
  misc_feature 1..16: note = chr9:93462711-93462727
  misc_feature 1..16: note = hypo
  source 1..16: mol_type = genomic DNA
ccgttctcctgcctca

SEQ ID NO: 42154 - DNA, 28 bp, Homo sapiens
  misc_feature 1..28: note = chr9:93698029-93698057
  misc_feature 1..28: note = hypo
  source 1..28: mol_type = genomic DNA
gagcaggtggttggccgggcgcggtggc

SEQ ID NO: 42155 - DNA, 30 bp, Homo sapiens
  misc_feature 1..30: note = chr9:94572598-94572628
  misc_feature 1..30: note = hypo
  source 1..30: mol_type = genomic DNA
aggtgagagagttcacgtggcaaacatgag

SEQ ID NO: 42156 - DNA, 53 bp, Homo sapiens
  misc_feature 1..53: note = chr9:94573085-94573138
  misc_feature 1..53: note = hypo
  source 1..53: mol_type = genomic DNA
cacacacagggaatgcggccctaattaggaccccacttcgctgtgaggaagac

SEQ ID NO: 42157 - DNA, 141 bp, Homo sapiens
  misc_feature 1..141: note = chr9:94658109-94658250
  misc_feature 1..141: note = hypo
  source 1..141: mol_type = genomic DNA
agcgagactctgtctcaaaaaagaaaaaagaaatacataaatctatttaaaaaaatgactctactcttaattggtaattcaggcatttggtgatacagggaagccaaggtccctccatgtcacccgcgtgccagtacctcc

SEQ ID NO: 42158 - DNA, 81 bp, Homo sapiens
  misc_feature 1..81: note = chr9:94863469-94863550
  misc_feature 1..81: note = hypo
  source 1..81: mol_type = genomic DNA
gagagaaaacttaatcgaataataaaaaaaaacaagccatagcctgaatgagaaattcaacaaagacatagataccattaa

SEQ ID NO: 42159 - DNA, 138 bp, Homo sapiens
  misc_feature 1..138: note = chr9:95417482-95417620
  misc_feature 1..138: note = hypo
  source 1..138: mol_type = genomic DNA
ctttgcctaactcaccgacacatctgttcttccctcacgtggccctgtgtggccctgcagatgcagcgaccctgaggggtgcatcgtcagcctggaatgggctctgcacctactttcccactgcgccagagcccagcg

SEQ ID NO: 42160 - DNA, 30 bp, Homo sapiens
  misc_feature 1..30: note = chr9:95485122-95485152
  misc_feature 1..30: note = hypo
  source 1..30: mol_type = genomic DNA
agcctccacagggcacgagaggggctcagt

SEQ ID NO: 42161 - DNA, 17 bp, Homo sapiens
  misc_feature 1..17: note = chr9:96230169-96230186
  misc_feature 1..17: note = hypo
  source 1..17: mol_type = genomic DNA
cttttttttttgagacg

SEQ ID NO: 42162 - DNA, 54 bp, Homo sapiens
  misc_feature 1..54: note = chr9:96362025-96362079
  misc_feature 1..54: note = hypo
  source 1..54: mol_type = genomic DNA
gcagcaagggggattcggagcacgaaagggatttagaggcgccggtggggccag

SEQ ID NO: 42163 - DNA, 327 bp, Homo sapiens
  misc_feature 1..327: note = chr9:97317331-97317658
  misc_feature 1..327: note = hypo
  source 1..327: mol_type = genomic DNA
atgcagtctaggaaccggcatgcgcataacctcaggatataaataatgctgaagcagagttacgttttttttgttgttgttttttttgtttttgtttttttaggtttccgtgtgtttctattgagctgctcagtgcccggcttagaagaccaggaaaaggagtcacaggtcgtatgctggaggcttgagccgcggcaccgtggcgcggctcgcctcgctgcggttggtggtggcggtggacattgcagcgcggctggaggggtaggaagaagaagatagttttgggatagatagaggtgggtaaagagtgtggttagtgccaaaggg

SEQ ID NO: 42164 - DNA, 30 bp, Homo sapiens
  misc_feature 1..30: note = chr9:97682189-97682219
  misc_feature 1..30: note = hypo
  source 1..30: mol_type = genomic DNA
tgaaattgtgaaaagcgttgaatccataag

SEQ ID NO: 42165 - DNA, 30 bp, Homo sapiens
  misc_feature 1..30: note = chr9:97807798-97807828
  misc_feature 1..30: note = hypo
  source 1..30: mol_type = genomic DNA
ccgcaccttccagtgcggtcaaggatgctg

SEQ ID NO: 42166 - DNA, 30 bp, Homo sapiens
  misc_feature 1..30: note = chr9:97863868-97863898
  misc_feature 1..30: note = hypo
  source 1..30: mol_type = genomic DNA
attctcacagcccagcgagggcacttactc

SEQ ID NO: 42167 - DNA, 96 bp, Homo sapiens
  misc_feature 1..96: note = chr9:97864916-97865012
  misc_feature 1..96: note = hypo
  source 1..96: mol_type = genomic DNA
ctggaagggttgggccgttctgggagggtgaacaactgccttggttttcccaggactattctggttttactgcctcaggtccgacagcccaggaca

SEQ ID NO: 42168 - DNA, 30 bp, Homo sapiens
  misc_feature 1..30: note = chr9:97887619-97887649
  misc_feature 1..30: note = hypo
  source 1..30: mol_type = genomic DNA
acaggataaatttgtcgctccctgttatat

SEQ ID NO: 42169 - DNA, 317 bp, Homo sapiens
  misc_feature 1..317: note = chr9:100397395-100397712
  misc_feature 1..317: note = hypo
  source 1..317: mol_type = genomic DNA
aggtggaggcagaatcgcatgcatttagttttaatagtgaaacaccagatttctacgaaggaatggcttgagaggatattctagtccagctttctatctgacacctaagggtctagagactgagcataactaagatggagggacagctgtcagttcccaaacaccagcaagagcgaatccagtccggggctctcttcactacacaggtataaattaaataactatgctgcgtgctttgatttctaacacgaggtttcttgtgtaacctctgtacaaggcacagaaaatacaattccctcccttttttttttttttct

SEQ ID NO: 42170 - DNA, 41 bp, Homo sapiens
  misc_feature 1..41: note = chr9:100843360-100843401
  misc_feature 1..41: note = hypo
  source 1..41: mol_type = genomic DNA
gaaggtgtgtcctgccggactctactcggttctgctgccgt

SEQ ID NO: 42171 - DNA, 120 bp, Homo sapiens
  misc_feature 1..120: note = chr9:100935554-100935674
  misc_feature 1..120: note = hypo
  source 1..120: mol_type = genomic DNA
ccactctttgagaatcgctgctctacagcccagctctatgattcacaactatcgctcagtttacccctcacaaccatctgggggcgcggaggattatctccacttcgtgagtgtggccgg

SEQ ID NO: 42172 - DNA, 30 bp, Homo sapiens
  misc_feature 1..30: note = chr9:100981193-100981223
  misc_feature 1..30: note = hypo
  source 1..30: mol_type = genomic DNA
gagagaagaggaagccgcctggctgggggc

SEQ ID NO: 42173 - DNA, 94 bp, Homo sapiens
  misc_feature 1..94: note = chr9:100981840-100981934
  misc_feature 1..94: note = hypo
  source 1..94: mol_type = genomic DNA
tgatttagcctactacgcacccagctagatggtgtagcctattgctccgaggctgcagacctgtgcacctgttacggtactgaataccataggt

SEQ ID NO: 42174 - DNA, 30 bp, Homo sapiens
  misc_feature 1..30: note = chr9:101557939-101557969
  misc_feature 1..30: note = hypo
  source 1..30: mol_type = genomic DNA
agaaaccttcccccacgtctccaaaatggg

SEQ ID NO: 42175 - DNA, 19 bp, Homo sapiens
  misc_feature 1..19: note = chr9:101982656-101982675
  misc_feature 1..19: note = hypo
  source 1..19: mol_type = genomic DNA
tacataagaatgtcccggc

SEQ ID NO: 42176 - DNA, 30 bp, Homo sapiens
  misc_feature 1..30: note = chr9:102107331-102107361
  misc_feature 1..30: note = hypo
  source 1..30: mol_type = genomic DNA
acacactcacacacccgagggggcacgctt

SEQ ID NO: 42177 - DNA, 37 bp, Homo sapiens; identical to SEQ ID NO: 15233
  misc_feature 1..37: note = chr9:103174717-103174754
  misc_feature 1..37: note = hypo
  source 1..37: mol_type = genomic DNA

SEQ ID NO: 42178 - DNA, 101 bp, Homo sapiens
  misc_feature 1..101: note = chr9:103176794-103176895
  misc_feature 1..101: note = hypo
  source 1..101: mol_type = genomic DNA
tgatgtatgaaataacgaaggctatagcgggtcacatcctcgagttaatgaaatacagtgttcttttttttttttttgagaccgagtctcgctctgtggcc

SEQ ID NO: 42179 - DNA, 196 bp, Homo sapiens
  misc_feature 1..196: note = chr9:107221358-107221554
  misc_feature 1..196: note = hypo
  source 1..196: mol_type = genomic DNA
accgaggtttcttaccggctctgacaataacaagatatgtgaccttcaataagtaagttcactctcagagactcgcttgattttctttaaacaggactgatacgactaagtcacctgtctgaaggaaggctagtgaatctagctataaaaccctttacataaatttgaaacttcttccgatcgaaggctagcctag

SEQ ID NO: 42180 - DNA, 76 bp, Homo sapiens
  misc_feature 1..76: note = chr9:107396386-107396462
  misc_feature 1..76: note = hypo
  source 1..76: mol_type = genomic DNA
cgccctgagctctgccgggggcctcactcgggtcctccggactcgctccgcccgctcggcccggaaggctgtgttc

SEQ ID NO: 42181 - DNA, 30 bp, Homo sapiens
  misc_feature 1..30: note = chr9:114710299-114710329
  misc_feature 1..30: note = hypo
  source 1..30: mol_type = genomic DNA
ttctgtgcagctctgcggcattcagagcct

SEQ ID NO: 42182 - DNA, 42 bp, Homo sapiens; identical to SEQ ID NO: 15235
  misc_feature 1..42: note = chr9:115067926-115067968
  misc_feature 1..42: note = hypo
  source 1..42: mol_type = genomic DNA

SEQ ID NO: 42183 - DNA, 30 bp, Homo sapiens
  misc_feature 1..30: note = chr9:115087309-115087339
  misc_feature 1..30: note = hypo
  source 1..30: mol_type = genomic DNA
ttacacataaatgttcgtggtagctttatt

SEQ ID NO: 42184 - DNA, 24 bp, Homo sapiens
  misc_feature 1..24: note = chr9:115087591-115087615
  misc_feature 1..24: note = hypo
  source 1..24: mol_type = genomic DNA
ctaagggcccgtctgcacactggg

SEQ ID NO: 42185 - DNA, 146 bp, Homo sapiens
  misc_feature 1..146: note = chr9:115172301-115172447
  misc_feature 1..146: note = hypo
  source 1..146: mol_type = genomic DNA
aaaaaaaaaaaaagacgtaggttttagttatttaaataacagtaaggtcattctcattatgaatcacactttattgtaaccaataaaaacactaatactttcttgggctttgccggggaaatgtagactatcgaatgaaagaacat

SEQ ID NO: 42186 - DNA, 17 bp, Homo sapiens
  misc_feature 1..17: note = chr9:115479233-115479250
  misc_feature 1..17: note = hypo
  source 1..17: mol_type = genomic DNA
ctcggtctcaaaaaaaa

SEQ ID NO: 42187 - DNA, 30 bp, Homo sapiens
  misc_feature 1..30: note = chr9:115599305-115599335
  misc_feature 1..30: note = hypo
  source 1..30: mol_type = genomic DNA
catggggcggacagacgtgagcagtgtaaa

SEQ ID NO: 42188 - DNA, 30 bp, Homo sapiens
  misc_feature 1..30: note = chr9:115773781-115773811
  misc_feature 1..30: note = hypo
  source 1..30: mol_type = genomic DNA
gcatatacaatttttcgaagtgcattcaca

SEQ ID NO: 42189 - DNA, 30 bp, Homo sapiens
  misc_feature 1..30: note = chr9:116065790-116065820
  misc_feature 1..30: note = hypo
  source 1..30: mol_type = genomic DNA
cagcagaaaaatagtcgggagacggttgag

SEQ ID NO: 42190 - DNA, 30 bp, Homo sapiens
  misc_feature 1..30: note = chr9:116128876-116128906
  misc_feature 1..30: note = hypo
  source 1..30: mol_type = genomic DNA
ctagcccgggtggttcgctgtagacttcac

SEQ ID NO: 42191 - DNA, 30 bp, Homo sapiens; identical to SEQ ID NO: 15237
  misc_feature 1..30: note = chr9:116331277-116331307
  misc_feature 1..30: note = hypo
  source 1..30: mol_type = genomic DNA

SEQ ID NO: 42192 - DNA, 32 bp, Homo sapiens
  misc_feature 1..32: note = chr9:116633864-116633896
  misc_feature 1..32: note = hypo
  source 1..32: mol_type = genomic DNA
aattccacctgccgacgtgtgcgctttctcta

SEQ ID NO: 42193 - DNA, 30 bp, Homo sapiens
  misc_feature 1..30: note = chr9:117050981-117051011
  misc_feature 1..30: note = hypo
  source 1..30: mol_type = genomic DNA
ggccctgtgggtgatcgaggagaccgcggg

SEQ ID NO: 42194 - DNA, 30 bp, Homo sapiens
  misc_feature 1..30: note = chr9:123150500-123150530
  misc_feature 1..30: note = hypo
  source 1..30: mol_type = genomic DNA
gtggtgtgggggctgcgggagcagaggtgg

SEQ ID NO: 42195 - DNA, 30 bp, Homo sapiens
  misc_feature 1..30: note = chr9:123272513-123272543
  misc_feature 1..30: note = hypo
  source 1..30: mol_type = genomic DNA
agccagctgggtgaccggtacgactttaat

SEQ ID NO: 42196 - DNA, 30 bp, Homo sapiens; identical to SEQ ID NO: 15239
  misc_feature 1..30: note = chr9:123287840-123287870
  misc_feature 1..30: note = hypo
  source 1..30: mol_type = genomic DNA

SEQ ID NO: 42197 - DNA, 30 bp, Homo sapiens
  misc_feature 1..30: note = chr9:123294978-123295008
  misc_feature 1..30: note = hypo
  source 1..30: mol_type = genomic DNA
tgatctctgggagtgcgcctgggacacagc

SEQ ID NO: 42198 - DNA, 30 bp, Homo sapiens
  misc_feature 1..30: note = chr9:123295496-123295526
  misc_feature 1..30: note = hypo
  source 1..30: mol_type = genomic DNA
atagaagcaggacaacgttcagccctgcat

SEQ ID NO: 42199 - DNA, 30 bp, Homo sapiens
  misc_feature 1..30: note = chr9:125551770-125551800
  misc_feature 1..30: note = hypo
  source 1..30: mol_type = genomic DNA
cactgctggccatctcgtgcagtgacacca

SEQ ID NO: 42200 - DNA, 39 bp, Homo sapiens
  misc_feature 1..39: note = chr9:125623471-125623510
  misc_feature 1..39: note = hypo
  source 1..39: mol_type = genomic DNA
taagaagtcaaatttcggccgggcacggtggctcacacc

SEQ ID NO: 42201 - DNA, 30 bp, Homo sapiens
  misc_feature 1..30: note = chr9:126110108-126110138
  misc_feature 1..30: note = hypo
  source 1..30: mol_type = genomic DNA
catgtagtgtgtgtgcgttgtgatgtatgt

SEQ ID NO: 42202 - DNA, 30 bp, Homo sapiens; identical to SEQ ID NO: 15240
  misc_feature 1..30: note = chr9:126125543-126125573
  misc_feature 1..30: note = hypo
  source 1..30: mol_type = genomic DNA

SEQ ID NO: 42203 - DNA, 103 bp, Homo sapiens
  misc_feature 1..103: note = chr9:126132916-126133019
  misc_feature 1..103: note = hypo
  source 1..103: mol_type = genomic DNA
gcgaccctggagctacggctctggcatgagggctgccctgcccggctctgtgtggcctctggtcctgtggccctggcttccacggcttcggcaactccgctgc

SEQ ID NO: 42204 - DNA, 224 bp, Homo sapiens
  misc_feature 1..224: note = chr9:126133716-126133940
  misc_feature 1..224: note = hypo
  source 1..224: mol_type = genomic DNA
tgcctccaggacctgcgactcgatggctgccacctccccttctttcctctgccactggataactcaagccagcccagcgagctcggcggcaggcagtcctggaacctcactgcgggctgcgtctccgaggacatgtgcagtgtaagtgtctggtggcggtggtggtggtggggtggggagtccttttcccaggatctgtcctgtgtcaccggggcttagtgtgt

SEQ ID NO: 42205 - DNA, 162 bp, Homo sapiens
  misc_feature 1..162: note = chr9:126140319-126140481
  misc_feature 1..162: note = hypo
  source 1..162: mol_type = genomic DNA
ctggttctccagctccggtccttcctagcagcctggtgagctcactccttcccctgatgactggctgcctctacacagactcggcgagaggacttgaaggaagccctctgggttgtctgctgagtacaggggctcagtgaacactggcgctgcctctgagtc

SEQ ID NO: 42206 - DNA, 36 bp, Homo sapiens
  misc_feature 1..36: note = chr9:126141357-126141393
  misc_feature 1..36: note = hypo
  source 1..36: mol_type = genomic DNA
acaggtgtgagccaccgcgcccggcccgcgtgcctg

SEQ ID NO: 42207 - DNA, 30 bp, Homo sapiens
  misc_feature 1..30: note = chr9:126145363-126145393
  misc_feature 1..30: note = hypo
  source 1..30: mol_type = genomic DNA
cctggcccaggtcctcgttcccagcaggga

SEQ ID NO: 42208 - DNA, 37 bp, Homo sapiens
  misc_feature 1..37: note = chr9:126153029-126153066
  misc_feature 1..37: note = hypo
  source 1..37: mol_type = genomic DNA
accctctcctgtgagcggggctcggagtagatgcaca

SEQ ID NO: 42209 - DNA, 297 bp, Homo sapiens
  misc_feature 1..297: note = chr9:126154254-126154551
  misc_feature 1..297: note = hypo
  source 1..297: mol_type = genomic DNA
ccccacggctgctcccgcctctgcccaccttgtctccgcgtggagttcccatgcagatgacttcccgaaccccttctaatgtttggtttaacgtgtcgccggttagcgcgcgcgtgtgacagtggtgacaggcgaggctgttcctttttaaataccatgtcagagacacggcgtcaggaagcagggacgtgctccatgctctctgccgcgccgggatcgcaccggcttattttttaatgaggaagatctgcatctcgggagtttttttcatgtgtcacatcgcgtggacaaatcagc

SEQ ID NO: 42210 - DNA, 34 bp, Homo sapiens; identical to SEQ ID NO: 15243
  misc_feature 1..34: note = chr9:126158010-126158044
  misc_feature 1..34: note = hypo
  source 1..34: mol_type = genomic DNA

SEQ ID NO: 42211 - DNA, 17 bp, Homo sapiens
  misc_feature 1..17: note = chr9:126160660-126160677
  misc_feature 1..17: note = hypo
  source 1..17: mol_type = genomic DNA
cttttttatttgagacg

SEQ ID NO: 42212 - DNA, 44 bp, Homo sapiens; identical to SEQ ID NO: 15244
  misc_feature 1..44: note = chr9:126169447-126169491
  misc_feature 1..44: note = hypo
  source 1..44: mol_type = genomic DNA

SEQ ID NO: 42213 - DNA, 23 bp, Homo sapiens
  misc_feature 1..23: note = chr9:127950771-127950794
  misc_feature 1..23: note = hypo
  source 1..23: mol_type = genomic DNA
gcagtatacctaggccggcgcgg

SEQ ID NO: 42214 - DNA, 30 bp, Homo sapiens
  misc_feature 1..30: note = chr9:128750886-128750916
  misc_feature 1..30: note = hypo
  source 1..30: mol_type = genomic DNA
ctcagggcctttgcacgggcttgccctctg

SEQ ID NO: 42215 - DNA, 122 bp, Homo sapiens
  misc_feature 1..122: note = chr9:128759852-128759974
  misc_feature 1..122: note = hypo
  source 1..122: mol_type = genomic DNA
gctctgccagggaggcgctgccccaaaggtggcctggccaccgtccagaatggaggcccccggtgctggcctgcccagcagcacctgcggctcagtccctccaggatcggaaggaatcacac

SEQ ID NO: 42216 - DNA, 30 bp, Homo sapiens
  misc_feature 1..30: note = chr9:128777807-128777837
  misc_feature 1..30: note = hypo
  source 1..30: mol_type = genomic DNA
tgcccagcggaggtgcgtgcaggagtgggc

SEQ ID NO: 42217 - DNA, 166 bp, Homo sapiens
  misc_feature 1..166: note = chr9:128824568-128824734
  misc_feature 1..166: note = hypo
  source 1..166: mol_type = genomic DNA
ctacgcggcacacaacggacccagtccctgccctcggggctctcgcctgcagacctgggaggcagaattcatgcaggtgttcagtagctagtgagtcatggttgtgctaagagcacaaaagaggggaggctgtgtgctgtaagaggctgaacgggcctcacctggc

SEQ ID NO: 42218 - DNA, 113 bp, Homo sapiens
  misc_feature 1..113: note = chr9:130179969-130180082
  misc_feature 1..113: note = hypo
  source 1..113: mol_type = genomic DNA
gggagctgtgctaggcgggtgggaggccctggggggggttcataaagggacatttgagatcttcaatcatttttctccttatattctatttcctacctcgccctcttggcaac

SEQ ID NO: 42219 - DNA, 38 bp, Homo sapiens
  misc_feature 1..38: note = chr9:130248346-130248384
  misc_feature 1..38: note = hypo
  source 1..38: mol_type = genomic DNA
tgtgtggcaggcactcggctaagcgatgaaccacattc

SEQ ID NO: 42220 - DNA, 21 bp, Homo sapiens
  misc_feature 1..21: note = chr9:130326077-130326098
  misc_feature 1..21: note = hypo
  source 1..21: mol_type = genomic DNA
tcaccgcgcccagcagagagg

SEQ ID NO: 42221 - DNA, 18 bp, Homo sapiens
  misc_feature 1..18: note = chr9:130505479-130505497
  misc_feature 1..18: note = hypo
  source 1..18: mol_type = genomic DNA
ttaaatattcagttacgg

SEQ ID NO: 42222 - DNA, 30 bp, Homo sapiens
  misc_feature 1..30: note = chr9:130534900-130534930
  misc_feature 1..30: note = hypo
  source 1..30: mol_type = genomic DNA
taaggattgaaaagccggggactcctttgg

SEQ ID NO: 42223 - DNA, 30 bp, Homo sapiens
  misc_feature 1..30: note = chr9:130676213-130676243
  misc_feature 1..30: note = hypo
  source 1..30: mol_type = genomic DNA
ccagatcttccaggacgagacaggcaagaa

SEQ ID NO: 42224 - DNA, 30 bp, Homo sapiens
  misc_feature 1..30: note = chr9:130857460-130857490
  misc_feature 1..30: note = hypo
  source 1..30: mol_type = genomic DNA
ttcccacacacctgccgccttccagtatga

SEQ ID NO: 42225 - DNA, 21 bp, Homo sapiens
  misc_feature 1..21: note = chr9:131060946-131060967
  misc_feature 1..21: note = hypo
  source 1..21: mol_type = genomic DNA
ccaccgcgcctggccccttgg

SEQ ID NO: 42226 - DNA, 30 bp, Homo sapiens
  misc_feature 1..30: note = chr9:131095785-131095815
  misc_feature 1..30: note = hypo
  source 1..30: mol_type = genomic DNA
atgggccgttcagaacgggcgcagagcccc

SEQ ID NO: 42227 - DNA, 20 bp, Homo sapiens
  misc_feature 1..20: note = chr9:131417485-131417505
  misc_feature 1..20: note = hypo
  source 1..20: mol_type = genomic DNA
aaagttagcctgggccggcg

SEQ ID NO: 42228 - DNA, 278 bp, Homo sapiens
  misc_feature 1..278: note = chr9:131504870-131505148
  misc_feature 1..278: note = hypo
  source 1..278: mol_type = genomic DNA
cattgcacaggtgcacggcgatccgctggatagactcgtcctgccgcgtggggttgaggatgctgagcaggagctcgttgacccggcggtactggaattccagctcctcggggatgctgaagttgcagagcgtcaggcagcagttccgctgcacctgggccgggacaggacacaagtggggcacattcagggtcagactcaggagcagggctctaggaactatctagaggtatgagctcatccagagttgtggcagtccagcccggttttctggaaga

SEQ ID NO: 42229 - DNA, 105 bp, Homo sapiens
  misc_feature 1..105: note = chr9:131579999-131580104
  misc_feature 1..105: note = hypo
  source 1..105: mol_type = genomic DNA
gttttttggaatattcgccccaggtttctgttccagccagcagccagcatcagccgtctgcatccttgtcctcaaactgctgttaattaaaatctttgccaatct

SEQ ID NO: 42230 - DNA, 34 bp, Homo sapiens
  misc_feature 1..34: note = chr9:131822149-131822183
  misc_feature 1..34: note = hypo
  source 1..34: mol_type = genomic DNA
agaaccggagtgggtcggccgagccacgcaccct

SEQ ID NO: 42231 - DNA, 338 bp, Homo sapiens
  misc_feature 1..338: note = chr9:131854116-131854454
  misc_feature 1..338: note = hypo
  source 1..338: mol_type = genomic DNA
caggaaactataaggcgagccctggcctcgaatcatagctaaaaaacaaggatccgagaggtagatttaacagcagatgagagagagttaaaaaggaaaagcaaactggagggtgtgtcagaagacatcccggctgcagtgtggagtgggaaagctaccgggagcagcttcaggcgcacccgcccccgctaactcatcgccttcacttcatccacactcacctgcttaccctgaccccgctccaacctgcccaaggtgcggtgctgggcagaagcccaactcttcaagccctcagaagcctctttgaaatatccacttttcgcggctgggcgcggtgg

SEQ ID NO: 42232 - DNA, 32 bp, Homo sapiens
  misc_feature 1..32: note = chr9:131868926-131868958
  misc_feature 1..32: note = hypo
  source 1..32: mol_type = genomic DNA
aaagtcctgacctgacgcgtctcagcaaatgt

SEQ ID NO: 42233 - DNA, 144 bp, Homo sapiens
  misc_feature 1..144: note = chr9:132040507-132040651
  misc_feature 1..144: note = hypo
  source 1..144: mol_type = genomic DNA
cccccataagaatgccgcagttccccacagtctcccagctccacccttctccacacagaagctaaaagacccttttaaaatgcaagtcaaatcccatctcttgccggctcagaaccccccaggggcttgcggagaggaagatgc

SEQ ID NO: 42234 - DNA, 451 bp, Homo sapiens
  misc_feature 1..451: note = chr9:132402765-132403216
  misc_feature 1..451: note = hypo
  source 1..451: mol_type = genomic DNA
cccagcgtcgggccgcgtttaagccacctgcccacccccggggctctcgctgaccttcaaagttgagattggccccatgccgcaagagaacgtcggccgcccgcgtcagccccagctcagccatcttgagcagggcgttgctcacgccttcctggtaaaagggagagtgggctttcctctccagcagctcagtgagaacaaggattcggctctcctcgctggcgacataactgggcctgggacaggagagaggctgagggtaggcacagctgtgggaccgggtgaccgcgcagcctgtgggttggtgggctttagtcctgctatcatcatcagcaagcagggccctggctctgtgggtcacaggggcttgggggaagctctgaagtagagagagggccacgctgcatctcttaatacgggagcagactgggatttgcggagaatgggctgg

SEQ ID NO: 42235 - DNA, 93 bp, Homo sapiens
  misc_feature 1..93: note = chr9:132491528-132491621
  misc_feature 1..93: note = hypo
  source 1..93: mol_type = genomic DNA
caggaactgtatgatcgtaagcgtgtatagttttaaactggcaacttgttacacagccataaaaaactaacacaggtgggaatgaagcttgaa

SEQ ID NO: 42236 - DNA, 27 bp, Homo sapiens
  misc_feature 1..27: note = chr9:132815103-132815130
  misc_feature 1..27: note = hypo
  source 1..27: mol_type = genomic DNA
ccaaagcaggttgggcgcagtgactca

SEQ ID NO: 42237 - DNA, 30 bp, Homo sapiens
  misc_feature 1..30: note = chr9:133510031-133510061
  misc_feature 1..30: note = hypo
  source 1..30: mol_type = genomic DNA
tgcttttgtgttcttcgcacaggccagcag

SEQ ID NO: 42238 - DNA, 30 bp, Homo sapiens; identical to SEQ ID NO: 15253
  misc_feature 1..30: note = chr9:133518455-133518485
  misc_feature 1..30: note = hypo
  source 1..30: mol_type = genomic DNA

SEQ ID NO: 42239 - DNA, 30 bp, Homo sapiens
  misc_feature 1..30: note = chr9:133767827-133767857
  misc_feature 1..30: note = hypo
  source 1..30: mol_type = genomic DNA
gcctgcagccactcccggctgagcgtgggc

SEQ ID NO: 42240 - DNA, 193 bp, Homo sapiens
  misc_feature 1..193: note = chr9:133773730-133773923
  misc_feature 1..193: note = hypo
  source 1..193: mol_type = genomic DNA
gggtggcatggtgcccgcttaggcagtgttcactgctgctgctagggagggcgcagggtggtggcccccatctaagcccgggtcccctgggctgttggcaactgccgctccggttctgctggccgaacccctcctgccctgggaagccgcttcccatgctgttgggcaccatttctcgcggaattgcatgagc

SEQ ID NO: 42241 - DNA, 126 bp, Homo sapiens
  misc_feature 1..126: note = chr9:133779518-133779644
  misc_feature 1..126: note = hypo
  source 1..126: mol_type = genomic DNA
aggaggaccactccacgccgtcggcataggaggcgtgcgcaccgcgcaggtactgcccattgaggttggacgtgtggcagttgcggtaccaccaggcaccgcggtagaaggcggcacagttgttct

SEQ ID NO: 42242 - DNA, 30 bp, Homo sapiens
  misc_feature 1..30: note = chr9:133782157-133782187
  misc_feature 1..30: note = hypo
  source 1..30: mol_type = genomic DNA
ccgttctcagcccttcgtgcagatgagtga

SEQ ID NO: 42243 - DNA, 64 bp, Homo sapiens
  misc_feature 1..64: note = chr9:133864850-133864914
  misc_feature 1..64: note = hypo
  source 1..64: mol_type = genomic DNA
gagcagcagacgtgccggtcactccctgttatttaggggcctccgttggcgggctgccctgcct

SEQ ID NO: 42244 - DNA, 189 bp, Homo sapiens
  misc_feature 1..189: note = chr9:133865355-133865544
  misc_feature 1..189: note = hypo
  source 1..189: mol_type = genomic DNA
cccactgcacagagtcggacggggaccgtgctagccgtgccaggtgcgggggatgcgcgaaccggccgacagcggcccagcccttcgcggggccctgccctcggagtcacagagaggctcagtggctgagcctggggtcatcattgatccccaggactgtcccctgctggggaccggacaccagcctgt

SEQ ID NO: 42245 - DNA, 30 bp, Homo sapiens; identical to SEQ ID NO: 15257
  misc_feature 1..30: note = chr9:133928236-133928266
  misc_feature 1..30: note = hypo
  source 1..30: mol_type = genomic DNA

SEQ ID NO: 42246 - DNA, 30 bp, Homo sapiens
  misc_feature 1..30: note = chr9:133936721-133936751
  misc_feature 1..30: note = hypo
  source 1..30: mol_type = genomic DNA
ggagagcccagcttacgggcagcaggcatg

SEQ ID NO: 42247 - DNA, 31 bp, Homo sapiens
  misc_feature 1..31: note = chr9:134119973-134120004
  misc_feature 1..31: note = hypo
  source 1..31: mol_type = genomic DNA
gtcataaaatgtgggcggcaagccacccagg

SEQ ID NO: 42248 - DNA, 126 bp, Homo sapiens
  misc_feature 1..126: note = chr9:134135879-134136005
  misc_feature 1..126: note = hypo
  source 1..126: mol_type = genomic DNA
agtttttttaaaaaacggaaaaagcagtgtttcagggaatctgttacaagtgagcgactgaaactgagaaaaaggagaggcaaggagaccagaggtcaccctgagggcgcacgtggggtctgtctg

SEQ ID NO: 42249 - DNA, 41 bp, Homo sapiens
  misc_feature 1..41: note = chr9:134136231-134136272
  misc_feature 1..41: note = hypo
  source 1..41: mol_type = genomic DNA
ccaccagcggctgcccgtacttgggccgccacatgaggacc

SEQ ID NO: 42250 - DNA, 133 bp, Homo sapiens; identical to SEQ ID NO: 15258
  misc_feature 1..133: note = chr9:134191085-134191218
  misc_feature 1..133: note = hypo
  source 1..133: mol_type = genomic DNA

SEQ ID NO: 42251 - DNA, 271 bp, Homo sapiens
  misc_feature 1..271: note = chr9:134191463-134191734
  misc_feature 1..271: note = hypo
  source 1..271: mol_type = genomic DNA
cactcatcctgtgtgcggctcccacccgccccatccaaaaagtctcagggaggcagcggcacaagggctggctctgggcagtttcctcatctgtaagatgcgtcgatgctctgcgccagcgtatggagaggcagccgctgcagtctgtgccccccacagtctgtacattgaaatcccaaccaaaacacgagggtatgaagaggtgggcgtttggggtcattaggtcatgagggtgggcccacacgacgggattagtgcccttacaaaaaag

SEQ ID NO: 42252 - DNA, 96 bp, Homo sapiens
  misc_feature 1..96: note = chr9:134207916-134208012
  misc_feature 1..96: note = hypo
  source 1..96: mol_type = genomic DNA
gtggctttgacttaccgtgtaagactccatttcctcatctgtaaaatgaggagaaccggccagccgggcgcagtgactcacgcctgtaatcccagc

SEQ ID NO: 42253 - DNA, 76 bp, Homo sapiens
  misc_feature 1..76: note = chr9:134717269-134717345
  misc_feature 1..76: note = hypo
  source 1..76: mol_type = genomic DNA
gggaagagaaaaagccgagaaaaaagcggtttgaacggggggtgatgtcaccggttacacgcgtggtttctgatgg

SEQ ID NO: 42254 - DNA, 30 bp, Homo sapiens
  misc_feature 1..30: note = chr9:134724244-134724274
  misc_feature 1..30: note = hypo
  source 1..30: mol_type = genomic DNA
tgtctgcgtgaaccacgcagctgtggtcaa

SEQ ID NO: 42255 - DNA, 30 bp, Homo sapiens
  misc_feature 1..30: note = chr9:134818649-134818679
  misc_feature 1..30: note = hypo
  source 1..30: mol_type = genomic DNA
aacagacccaaccttcgaaacacaaatcaa

SEQ ID NO: 42256 - DNA, 198 bp, Homo sapiens
  misc_feature 1..198: note = chr9:134913048-134913246
  misc_feature 1..198: note = hypo
  source 1..198: mol_type = genomic DNA
gcaatgacagaaaaccggagctaccctgctggtgatgggaaatgacaatggcattgcaaagaggctctggaaacatcaccaaatgaaagtgggcaaaacagtcaggctttcaccgggcagctgtagactgggaaaagtgctgtgtttctgacacatgagctttggctgacacacaacatgtcccgaccccagacagga

SEQ ID NO: 42257 - DNA, 30 bp, Homo sapiens
  misc_feature 1..30: note = chr9:135027845-135027875
  misc_feature 1..30: note = hypo
  source 1..30: mol_type = genomic DNA
caatcctgttcttgacgcatgtctctcctc

SEQ ID NO: 42258 - DNA, 30 bp, Homo sapiens
  misc_feature 1..30: note = chr9:135054774-135054804
  misc_feature 1..30: note = hypo
  source 1..30: mol_type = genomic DNA
tgaggggatcaagagcgtcccctaagccca

SEQ ID NO: 42259 - DNA, 114 bp, Homo sapiens
  misc_feature 1..114: note = chr9:135102332-135102446
  misc_feature 1..114: note = hypo
  source 1..114: mol_type = genomic DNA
tgcaagaagaatttccgcacccggtcctggcgggccggctcctacctgccgctgccccatggctctcccaacgcctgtacgtgccatgccccggggccacgagcccacatggct

SEQ ID NO: 42260 - DNA, 204 bp, Homo sapiens
  misc_feature 1..204: note = chr9:135512910-135513114
  misc_feature 1..204: note = hypo
  source 1..204: mol_type = genomic DNA
ggagagggggcctgccgtctctctgagaagggacgcagcacactcgcctctgacgccttcccggcctgccaaaagtcattactgccgtgtgtggaaagccatcagcagggtccaggcccccgttgtccgggtgacagattgggctgcgtaatcagaggaggaaggagagagtgcagaagctgtcagaggcgagagatcttggct

SEQ ID NO: 42261 - DNA, 41 bp, Homo sapiens
  misc_feature 1..41: note = chr9:135548238-135548279
  misc_feature 1..41: note = hypo
  source 1..41: mol_type = genomic DNA
gcccagttcttggcacgctgtaaatgctcaaggtgaaaata

SEQ ID NO: 42262 - DNA, 74 bp, Homo sapiens
  misc_feature 1..74: note = chr9:135768018-135768092
  misc_feature 1..74: note = hypo
  source 1..74: mol_type = genomic DNA
tcttagtgctttcagcgagaaaaggtgagtctcattacgcagaacttttgtttgctcttcggttctttccttct

SEQ ID NO: 42263 - DNA, 30 bp, Homo sapiens
  misc_feature 1..30: note = chr9:135833429-135833459
  misc_feature 1..30: note = hypo
  source 1..30: mol_type = genomic DNA
agtaggggcagatcacgaggggtcatgtga

SEQ ID NO: 42264 - DNA, 153 bp, Homo sapiens
  misc_feature 1..153: note = chr9:135865042-135865195
  misc_feature 1..153: note = hypo
  source 1..153: mol_type = genomic DNA
tggagtgtcctgttccgcaggggatcccggccgggtccagtcctgagcctgcacctgaccccccggggcctcatttcctccggcaggagcgcagcttcgagtgccgcatgtgcggcaaggccttcaagcgctcgtccacgctgtccacccacc

SEQ ID NO: 42265 - DNA, 246 bp, Homo sapiens
  misc_feature 1..246: note = chr9:135898878-135899124
  misc_feature 1..246: note = hypo
  source 1..246: mol_type = genomic DNA
gggatctggatgcagcggctggggttggcagggcccactgcagggaaacggttaaaatgcgctgggcttcgtttttcccggaagccctcattacctggtattaccttaggtgtggattcctttattcgcctgctgtctgtctctgccaatcaaatgtgagctccgtgagggcggaggggggcggtcctctcggcttcatcatccgagcccagcacaggatcgggcacatcgcggggagcatttggt

SEQ ID NO: 42266 - DNA, 56 bp, Homo sapiens
  misc_feature 1..56: note = chr9:135908143-135908199
  misc_feature 1..56: note = hypo
  source 1..56: mol_type = genomic DNA
aagggacataaggatcgaggacataagtcctttccacctgccgaacaatcttcccg

SEQ ID NO: 42267 - DNA, 138 bp, Homo sapiens
  misc_feature 1..138: note = chr9:136375595-136375733
  misc_feature 1..138: note = hypo
  source 1..138: mol_type = genomic DNA
gaacctccgcacctggccggacccatgtgactattcgaacttaaattatttaaaatgaggataacatttaaagatccaggtttggggttgtaccagctacgttgcagatgcccaggcaccaggcgtgttgggcagccc

SEQ ID NO: 42268 - DNA, 70 bp, Homo sapiens
  misc_feature 1..70: note = chr9:136383935-136384005
  misc_feature 1..70: note = hypo
  source 1..70: mol_type = genomic DNA
acaggggagaggtgacgggcctcctgggtccccgttcatcgaggctcgcgcagtacgcacccactttgcc

SEQ ID NO: 42269 - DNA, 30 bp, Homo sapiens
  misc_feature 1..30: note = chr9:136521608-136521638
  misc_feature 1..30: note = hypo
  source 1..30: mol_type = genomic DNA
atggcccggggctgacgggtctcctccaac

SEQ ID NO: 42270 - DNA, 30 bp, Homo sapiens
  misc_feature 1..30: note = chr9:136559282-136559312
  misc_feature 1..30: note = hypo
  source 1..30: mol_type = genomic DNA
gtcagcagcccatcccgtccatcctgccct

SEQ ID NO: 42271 - DNA, 45 bp, Homo sapiens
  misc_feature 1..45: note = chr9:136573425-136573470
  misc_feature 1..45: note = hypo
  source 1..45: mol_type = genomic DNA
tcctcatgttgcgcccggccagcggctcatcgtgggggaagacga

SEQ ID NO: 42272 - DNA, 30 bp, Homo sapiens; identical to SEQ ID NO: 15265
  misc_feature 1..30: note = chr9:136999528-136999558
  misc_feature 1..30: note = hypo
  source 1..30: mol_type = genomic DNA

SEQ ID NO: 42273 - DNA, 30 bp, Homo sapiens
  misc_feature 1..30: note = chr9:137248217-137248247
  misc_feature 1..30: note = hypo
  source 1..30: mol_type = genomic DNA
ttgtttagctcccaccgggaacacacctgg

SEQ ID NO: 42274 - DNA, 33 bp, Homo sapiens
  misc_feature 1..33: note = chr9:137427038-137427071
  misc_feature 1..33: note = hypo
  source 1..33: mol_type = genomic DNA
gctgccgtaacaaatcgccgtgaatttaaaacg

SEQ ID NO: 42275 - DNA, 93 bp, Homo sapiens
  misc_feature 1..93: note = chr9:137457467-137457560
  misc_feature 1..93: note = hypo
  source 1..93: mol_type = genomic DNA
tttatcccatgttcacgacagggatctgcagagacagagctgtggtctctcaggaatgaggggctgcggggtagcgggcgatggctaaagggc

SEQ ID NO: 42276 - DNA, 30 bp, Homo sapiens
  misc_feature 1..30: note = chr9:137539456-137539486
  misc_feature 1..30: note = hypo
  source 1..30: mol_type = genomic DNA
ccggccccagctggacgggagaggaggaga

SEQ ID NO: 42277 - DNA, 174 bp, Homo sapiens
  misc_feature 1..174: note = chr9:137580733-137580907
  misc_feature 1..174: note = hypo
  source 1..174: mol_type = genomic DNA
tgagaaatgcggcttcgatttccctccaccctggtctccttcagagccctgcccaggctgctgtcttccctgcactgtcagctggtcatggcgggggtgggggtggcacaggttcctgtctgtacctccttgtggcctgcgcaccaagcacagtgcccgcgctgagtcccctgg

SEQ ID NO: 42278 - DNA, 35 bp, Homo sapiens
  misc_feature 1..35: note = chr9:137602268-137602303
  misc_feature 1..35: note = hypo
  source 1..35: mol_type = genomic DNA
tgctccccatcgagacgccccgtctgttgggtgca

SEQ ID NO: 42279 - DNA, 30 bp, Homo sapiens
  misc_feature 1..30: note = chr9:137624178-137624208
  misc_feature 1..30: note = hypo
  source 1..30: mol_type = genomic DNA
ctgtgatggagggggcgggataggtgctga

SEQ ID NO: 42280 - DNA, 30 bp, Homo sapiens
  misc_feature 1..30: note = chr9:137631987-137632017
  misc_feature 1..30: note = hypo
  source 1..30: mol_type = genomic DNA
ctttcacagcatccccggcctggcagccac

SEQ ID NO: 42281 - DNA, 30 bp, Homo sapiens
  misc_feature 1..30: note = chr9:137638965-137638995
  misc_feature 1..30: note = hypo
  source 1..30: mol_type = genomic DNA
ggttcatgggggtggcgacattctttcctt

SEQ ID NO: 42282 - DNA, 221 bp, Homo sapiens
  misc_feature 1..221: note = chr9:137656925-137657146
  misc_feature 1..221: note = hypo
  source 1..221: mol_type = genomic DNA
acgagcctcgccgaccggagagggcgtgccagctcttgcccagagtagcgtcctggaaaagatctgtaccccacgcctccttctgcacattcagtcttggggttcccaccagggactagtttcacctggtgctctcctgcccgcaccctctgaccctgtgatatcataaaaacaatcgtatgtcgctgcggaggggaattcaggagcgagccggtaatgag

SEQ ID NO: 42283 - DNA, 30 bp, Homo sapiens
  misc_feature 1..30: note = chr9:137667327-137667357
  misc_feature 1..30: note = hypo
  source 1..30: mol_type = genomic DNA
cctcgttacatggggcgcacagctccagag

SEQ ID NO: 42284 - DNA, 35 bp, Homo sapiens
  misc_feature 1..35: note = chr9:137685677-137685712
  misc_feature 1..35: note = hypo
  source 1..35: mol_type = genomic DNA
ttgaagaactggaaccggagcgcattgttaaaaag

SEQ ID NO: 42285 - DNA, 119 bp, Homo sapiens
  misc_feature 1..119: note = chr9:137694532-137694651
  misc_feature 1..119: note = hypo
  source 1..119: mol_type = genomic DNA
ccaggcagtgagcagcgtaccaacacccaccctctagatttttgccgggaagagaaggcttgcaaaggcacttggaggtttggtgtgcccgcagcagacctttgcgtccatgaccaggg

SEQ ID NO: 42286 - DNA, 347 bp, Homo sapiens
  misc_feature 1..347: note = chr9:137710245-137710592
  misc_feature 1..347: note = hypo
  source 1..347: mol_type = genomic DNA
tggcgctgtgacacccggtctgtggtcggcgcagtcagcggagacgggatccctgctggcctgggagatgatcgggatggagacttgaccagggcagcttccacaggcaatgaaatgtggagaattagggcaaccccggatatggggtcacctgggactcctccagaggtgcccagggtttccgagcagtggtcctgggccagggtgcctggagcctagagctccggacctcattctgccctccgccgtcctgcagggagaagccggcttggaaggccctcctgggaagactggccccatcggcccccagggggcccctgggaagcccggaccggatggccttcgag

SEQ ID NO: 42287 - DNA, 30 bp, Homo sapiens
  misc_feature 1..30: note = chr9:137711104-137711134
  misc_feature 1..30: note = hypo
  source 1..30: mol_type = genomic DNA
cagctcgggagatcccggaggcccctgcgg

SEQ ID NO: 42288 - DNA, 30 bp, Homo sapiens
  misc_feature 1..30: note = chr9:137716969-137716999
  misc_feature 1..30: note = hypo
  source 1..30: mol_type = genomic DNA
gacctgcttgaacctcgtgttcctgacctg

SEQ ID NO: 42289 - DNA, 240 bp, Homo sapiens
  misc_feature 1..240: note = chr9:137718850-137719090
  misc_feature 1..240: note = hypo
  source 1..240: mol_type = genomic DNA
caagcctgcagctctcgtgcccctgcatcagcttgaacggcctctccttcatgagctcgcagttgtcgcgtggccccaggcaaaggccgcccatttctggggccgcagcggtttgctgtgcaggtccagacctgtgcgcccctgcagcctctgcttcctaacaacctcagtgccccagaagcagtttcctgccaggggaagagcagctacgttctccccagggaccgccatccccttacc

SEQ ID NO: 42290 - DNA, 78 bp, Homo sapiens
  misc_feature 1..78: note = chr9:137719540-137719618
  misc_feature 1..78: note = hypo
  source 1..78: mol_type = genomic DNA
cacaggctgcagcctcgggcctgggctacagctgcttggccaagggcaagtggagacgctttccgaggtggccccctt

SEQ ID NO: 42291 - DNA, 40 bp, Homo sapiens
  misc_feature 1..40: note = chr9:137724640-137724680
  misc_feature 1..40: note = hypo
  source 1..40: mol_type = genomic DNA
gccctgggactgcagcgtgttccctcgcccctgggaaggc

SEQ ID NO: 42292 - DNA, 30 bp, Homo sapiens
  misc_feature 1..30: note = chr9:137726926-137726956
  misc_feature 1..30: note = hypo
  source 1..30: mol_type = genomic DNA
agtggcctggcaggacgcagccacgggcag

SEQ ID NO: 42293 - DNA, 30 bp, Homo sapiens
  misc_feature 1..30: note = chr9:137730841-137730871
  misc_feature 1..30: note = hypo
  source 1..30: mol_type = genomic DNA
cgtctcatttaattacggaggctgctgcag

SEQ ID NO: 42294 - DNA, 60 bp, Homo sapiens
  misc_feature 1..60: note = chr9:137734084-137734144
  misc_feature 1..60: note = hypo
  source 1..60: mol_type = genomic DNA
atgacttcggtgaagcgtcacagaaatttggatttgaagtggggccggcttgcttcatgg

SEQ ID NO: 42295 - DNA, 30 bp, Homo sapiens
  misc_feature 1..30: note = chr9:137851369-137851399
  misc_feature 1..30: note = hypo
  source 1..30: mol_type = genomic DNA
ggctccaggtggaggcgccccacgccacct

SEQ ID NO: 42296 - DNA, 17 bp, Homo sapiens
  misc_feature 1..17: note = chr9:137854747-137854764
  misc_feature 1..17: note = hypo
  source 1..17: mol_type = genomic DNA
cccggccgctccttaac

SEQ ID NO: 42297 - DNA, 30 bp, Homo sapiens
  misc_feature 1..30: note = chr9:138265242-138265272
  misc_feature 1..30: note = hypo
  source 1..30: mol_type = genomic DNA
ccactgcttcatggtcgcccactccctctg

SEQ ID NO: 42298 - DNA, 34 bp, Homo sapiens; identical to SEQ ID NO: 15269
  misc_feature 1..34: note = chr9:138289547-138289581
  misc_feature 1..34: note = hypo
  source 1..34: mol_type = genomic DNA

SEQ ID NO: 42299 - DNA, 30 bp, Homo sapiens
  misc_feature 1..30: note = chr9:138290031-138290061
  misc_feature 1..30: note = hypo
  source 1..30: mol_type = genomic DNA
tactgaggcacagcacggcagaccacacca

SEQ ID NO: 42300 - DNA, 235 bp, Homo sapiens
  misc_feature 1..235: note = chr9:138393554-138393789
  misc_feature 1..235: note = hypo
  source 1..235: mol_type = genomic DNA
gggctgctgggctcccggctccccacctcggtgtcacagaaggcacttgggagcaggggtgggcgggaactgcgctctgcctgtctctgctgccaccggtgggagacgcagcgtcgctcctcctccctgccgtagatttcaacgacaagattttgaatgagcccctcaagcactctgacttcttcaatgtcaaggaactgttttccgtgagaagcctcttcgatgcccgagtcca

SEQ ID NO: 42301 - DNA, 30 bp, Homo sapiens
  misc_feature 1..30: note = chr9:138416397-138416427
  misc_feature 1..30: note = hypo
  source 1..30: mol_type = genomic DNA
ccagggtgggcctgtcgtgccgtccatcct

SEQ ID NO: 42302 - DNA, 30 bp, Homo sapiens
  misc_feature 1..30: note = chr9:138506224-138506254
  misc_feature 1..30: note = hypo
  source 1..30: mol_type = genomic DNA
tcaggcctggaacaacggcttgagtgtcac

SEQ ID NO: 42303 - DNA, 123 bp, Homo sapiens
  misc_feature 1..123: note = chr9:138557664-138557787
  misc_feature 1..123: note = hypo
  source 1..123: mol_type = genomic DNA
gggtccctgtccctgcgctgagagccccctctgtccttccagatccctgctactccaagcattacaggagcccgcccaggcctcccatgcgtgagctgcgactcgggacgggcagggggctgg

SEQ ID NO: 42304 - DNA, 78 bp, Homo sapiens
  misc_feature 1..78: note = chr9:138562725-138562803
  misc_feature 1..78: note = hypo
  source 1..78: mol_type = genomic DNA
tctgccagccatgcccggcttgtgtggcccctcaccatagcccgcccagggtctctcgggcatcgaaaggacaagctt

SEQ ID NO: 42305 - DNA, 221 bp, Homo sapiens
  misc_feature 1..221: note = chr9:138563059-138563280
  misc_feature 1..221: note = hypo
  source 1..221: mol_type = genomic DNA
tgtggggtgagcccccgcctctgtttccccaaatgactggtatgttcctgggcacacatccgatggctgccagcctgcacgtcacgcccagctgccggagctactgcgggattccagaacaaggaacgtgacatgctcggcctggagcggaacaaggcacctggctcccgcaccctcgacggggccctgcccagtggacacgaccacgtggaagcctcttc

SEQ ID NO: 42306 - DNA, 30 bp, Homo sapiens
  misc_feature 1..30: note = chr9:138577404-138577434
  misc_feature 1..30: note = hypo
  source 1..30: mol_type = genomic DNA
agggatgcgatgagccgggggtggggtgac

SEQ ID NO: 42307 - DNA, 168 bp, Homo sapiens
  misc_feature 1..168: note = chr9:138577710-138577878
  misc_feature 1..168: note = hypo
  source 1..168: mol_type = genomic DNA
ccggagggtcctcgacggatttgtgcatgagaaaccagatcgcttctacctggggtgggcagctctgctcccgggtggccttggcgctccttggctggctccctggaactggaaagggcagccctggggctcctggtcactgcagggggagtgcgtgggcccctgcac

SEQ ID NO: 42308 - DNA, 30 bp, Homo sapiens
  misc_feature 1..30: note = chr9:138587151-138587181
  misc_feature 1..30: note = hypo
  source 1..30: mol_type = genomic DNA
cccacaggctgcccccgaggacctcgtgac

SEQ ID NO: 42309 - DNA, 30 bp, Homo sapiens
  misc_feature 1..30: note = chr9:138591441-138591471
  misc_feature 1..30: note = hypo
  source 1..30: mol_type = genomic DNA
cccccatagcgcatgcgctctagccctccc

SEQ ID NO: 42310 - DNA, 30 bp, Homo sapiens
  misc_feature 1..30: note = chr9:138598276-138598306
  misc_feature 1..30: note = hypo
  source 1..30: mol_type = genomic DNA
tcctcacaacagtgccggggtgtggtgtgt

SEQ ID NO: 42311 - DNA, 186 bp, Homo sapiens
  misc_feature 1..186: note = chr9:138627615-138627801
  misc_feature 1..186: note = hypo
  source 1..186: mol_type = genomic DNA
gagggctctgccacccggcactgctgaggacaggggcgcatctgacagcctcctgcctctaccgagctggcttcggggcagctgggcctcccggtgccaataccccccggctgttacctgcctgtcacctgggcgagtcacctggagccgcgtctgtgacatggaagggaacggttacaaaagcca

SEQ ID NO: 42312 - DNA, 50 bp, Homo sapiens
  misc_feature 1..50: note = chr9:138634173-138634223
  misc_feature 1..50: note = hypo
  source 1..50: mol_type = genomic DNA
ggcctgggctggcttcgtgctgagcagggccagggcgagtgcccaaagca

SEQ ID NO: 42313 - DNA, 30 bp, Homo sapiens
  misc_feature 1..30: note = chr9:138637950-138637980
  misc_feature 1..30: note = hypo
  source 1..30: mol_type = genomic DNA
ttttgtggtggtgctcggagaagtgggcgg

SEQ ID NO: 42314 - DNA, 30 bp, Homo sapiens
  misc_feature 1..30: note = chr9:138642836-138642866
  misc_feature 1..30: note = hypo
  source 1..30: mol_type = genomic DNA
gctctacattgtgcgcgtcctgctcgatga

SEQ ID NO: 42315 - DNA, 48 bp, Homo sapiens
  misc_feature 1..48: note = chr9:138650116-138650164
  misc_feature 1..48: note = hypo
  source 1..48: mol_type = genomic DNA
aggtacaggctgccccgtgggcctcagccgagacgcaggtgtggccgg

SEQ ID NO: 42316 - DNA, 30 bp, Homo sapiens
  misc_feature 1..30: note = chr9:138651295-138651325
  misc_feature 1..30: note = hypo
  source 1..30: mol_type = genomic DNA
tgcattgtcagccagcgtcaggcaggaggt

SEQ ID NO: 42317 - DNA, 39 bp, Homo sapiens
  misc_feature 1..39: note = chr9:138651662-138651701
  misc_feature 1..39: note = hypo
  source 1..39: mol_type = genomic DNA
ggtcatcatgatctgcgtggccctcgtggtgctcccact

SEQ ID NO: 42318 - DNA, 30 bp, Homo sapiens
  misc_feature 1..30: note = chr9:138655771-138655801
  misc_feature 1..30: note = hypo
  source 1..30: mol_type = genomic DNA
tgacagcagagcccccgccagcaccatccg

SEQ ID NO: 42319 - DNA, 240 bp, Homo sapiens
  misc_feature 1..240: note = chr9:138659727-138659967
  misc_feature 1..240: note = hypo
  source 1..240: mol_type = genomic DNA
gctcccactcagggccgtggccaggagaagctgtcagctggtgtctccaggacacaccatccatagcatctgaccccctgcccccacccgctgtcagcctgcacacactcgggggacaggtgtggctcctgacccctgcccccacccgctgtcagcctgcacacgctcaggggacaggtgtggctcctgaaccctgcccccaccctctgtcagcctgcacacgctcgggggacaggtgtg

SEQ ID NO: 42320 - DNA, 439 bp, Homo sapiens
  misc_feature 1..439: note = chr9:138660771-138661210
  misc_feature 1..439: note = hypo
  source 1..439: mol_type = genomic DNA
tcaagtttgctggtgcgtctggggcacacgtgggtgatggtgtatctggggcagggcacgtgtgcacacgtgggtgatggtgcatctggggcagggcgcatgtgcacatgtgtgacggtgcgtctggggcaggacgcgtgtgcacacgtgggtgacggtgcgtctggggcaggatgcgtgtgcacacgtgggtgtcggtgcgtctggggcagggcgcatgtgcacacgtgggtgacggtgcgtctggggcagggcgcgtgtgcacacgtgggtgacagtgcatctggggcagggcacgtgtgcacgtgtgtgtcggtgtgtctggggcagggcgcgtgtgcatgctgttgggtgatggtgcgtctggggcagggcgcgtgtgcacacgtgggtgacggtgtgtctggggcagggcgcatgtgcacgcagttaggcgagc

SEQ ID NO: 42321 - DNA, 513 bp, Homo sapiens
  misc_feature 1..513: note = chr9:138661428-138661941
  misc_feature 1..513: note = hypo
  source 1..513: mol_type = genomic DNA
gggcagggaccatgccgggtgcccggggaacggggggcaggccccatgccaggtgcccaggggacaggggtcagggcccacatggagtgcccaaggcacaggggccagggcctgccccgccctggaactcctcgctgagctgggagagaagcacaggagcgatggaaggtccaccgaggctcagaccaagtagggggttgaggtccacagactctcggggcagagatgctgaagccggacagcagacacgggggtgccaggcaagggtgcatctgcatagcaccttcaggaagtgagcaggtactgtgggggaggagagagccggcagagcggcaggtggaccggcctcccccactgcccgcagaccacgtggtgtgtgaggaggagtgcaagtacgccatgctggcgctgaactgcatctgcccggcgacctccaccctcatcaccctgctggtgcacacgtcccgcggccagtgagtgccccgtgccccgggggaccgacctccatggcgg

SEQ ID NO: 42322 - DNA, 148 bp, Homo sapiens
  misc_feature 1..148: note = chr9:138666455-138666603
  misc_feature 1..148: note = hypo
  source 1..148: mol_type = genomic DNA
gtgtatgttgtgtgtcgatgtgtgtgttgtgtgtctgggtgtgtggtgtgtatgttatgtgtccgtgcacgtggtgcacgtgtgcatacgcctgcatgtgttcatttctgtgcgcatgtgttgtgtgtgtgtccgggtgtgtccattt

SEQ ID NO: 42323 - DNA, 73 bp, Homo sapiens
  misc_feature 1..73: note = chr9:138671215-138671288
  misc_feature 1..73: note = hypo
  source 1..73: mol_type = genomic DNA
gcctcagcatcaccacggagctcacccacccttccaacatgcgcttcatgcagttccgcgccaaggacagcta

SEQ ID NO: 42324 - DNA, 50 bp, Homo sapiens
  misc_feature 1..50: note = chr9:138675763-138675813
  misc_feature 1..50: note = hypo
  source 1..50: mol_type = genomic DNA
tcatgcacacatgtacggtgcacacacagtgccctcgaccccgtggctgc

SEQ ID NO: 42325 - DNA, 38 bp, Homo sapiens
  misc_feature 1..38: note = chr9:138678379-138678417
  misc_feature 1..38: note = hypo
  source 1..38: mol_type = genomic DNA
ggcgcgggtgggggccggacggacggactgggccaggg

SEQ ID NO: 42326 - DNA, 74 bp, Homo sapiens
  misc_feature 1..74: note = chr9:138743697-138743771
  misc_feature 1..74: note = hypo
  source 1..74: mol_type = genomic DNA
ctatgcgtgtacagacgggtgttgcccaggcatactctgagaggggactcgctgggccacgagctaggcacgcc

SEQ ID NO: 42327 - DNA, 284 bp, Homo sapiens
  misc_feature 1..284: note = chr9:138780586-138780870
  misc_feature 1..284: note = hypo
  source 1..284: mol_type = genomic DNA
aactcaaggtaaaagcgaccagtagtccacgccccagctccatcctggagaggccagacacaagggtaagaaaagctgatgtaatggtccccacagggccaagaccacctgacccccacccagggacaaccagtaacaaactgcaccttgacagcggagcgccaggtgcacagacaagcacacaccccacagggcgctggcccgggcatgccacaccaggctcaggtgcagacttggcttccagccagaaggccagcaagggagaccctcgggaaccctcagag

SEQ ID NO: 42328 - DNA, 30 bp, Homo sapiens
  misc_feature 1..30: note = chr9:138781904-138781934
  misc_feature 1..30: note = hypo
  source 1..30: mol_type = genomic DNA
gcctccttccaggcacggtggaccctgtgc

SEQ ID NO: 42329 - DNA, 66 bp, Homo sapiens
  misc_feature 1..66: note = chr9:138831936-138832002
  misc_feature 1..66: note = hypo
  source 1..66: mol_type = genomic DNA
ctttcaggtttgtcccgatgactgtgtggataagactgtctcggcagccaccgcaggtttacccca

SEQ ID NO: 42330 - DNA, 30 bp, Homo sapiens
  misc_feature 1..30: note = chr9:138851606-138851636
  misc_feature 1..30: note = hypo
  source 1..30: mol_type = genomic DNA
agcttagtgatgccccgatggttgttcaga

SEQ ID NO: 42331 - DNA, 30 bp, Homo sapiens
  misc_feature 1..30: note = chr9:138873468-138873498
  misc_feature 1..30: note = hypo
  source 1..30: mol_type = genomic DNA
gagacggacctagggcgtccttctccagca

SEQ ID NO: 42332 - DNA, 87 bp, Homo sapiens
  misc_feature 1..87: note = chr9:138994353-138994440
  misc_feature 1..87: note = hypo
  source 1..87: mol_type = genomic DNA
tgtgaaggtggaacccggaggaatgaggagggctgggagggaaggggaggtggggagcgttcggactgaggccgggcaggtgggccc

SEQ ID NO: 42333 - DNA, 246 bp, Homo sapiens
  misc_feature 1..246: note = chr9:139000396-139000642
  misc_feature 1..246: note = hypo
  source 1..246: mol_type = genomic DNA
aggcctgtcccatcccgagggaggcagatcctggctggagctggcggagacttacggccacaccctgccaaggtgtgcccactgggacccgggcccagcctgtcacggcgcctctccctgtgccatccgccagcccaggcttgattgagctccatatgaatattcatacagcattctgctgggaccgtcgttaatattctgaggaagcggcaagaatgcccgtccccatgtcgtgagccatggtca

SEQ ID NO: 42334 - DNA, 139 bp, Homo sapiens
  misc_feature 1..139: note = chr9:139012272-139012411
  misc_feature 1..139: note = hypo
  source 1..139: mol_type = genomic DNA
ccctcccatgtggctcgtgctgggacgccggcaccgtgagatggcgcccgtggccagatagagggtggcgtgtaaagcaggtggtcacccgtcactcgacttttcgcgtgctggtgagggtggtcgcatgtccatggat

SEQ ID NO: 42335 - DNA, 30 bp, Homo sapiens
  misc_feature 1..30: note = chr9:139047603-139047633
  misc_feature 1..30: note = hypo
  source 1..30: mol_type = genomic DNA
cacgggaaaacacggcgagcctgggagcgt

SEQ ID NO: 42336 - DNA, 99 bp, Homo sapiens
  misc_feature 1..99: note = chr9:139077555-139077654
  misc_feature 1..99: note = hypo
  source 1..99: mol_type = genomic DNA
agggcctgccttcttcgcagtggccggccacgtccctgggccacccaggcggcacctgcccctcaggtgactgagccccacctccggagccagctcccc

SEQ ID NO: 42337 - DNA, 141 bp, Homo sapiens
  misc_feature 1..141: note = chr9:139078960-139079101
  misc_feature 1..141: note = hypo
  source 1..141: mol_type = genomic DNA
cgggcctgtggccttcggtaatgataaaatcaaaacagctttggctaaaattcagaacactgcattccaactaaccgttcatttcagtgacaagaaggctccttcctccgtcaaccgtgtcattgccgcacccaagaagtc

SEQ ID NO: 42338 - DNA, 30 bp, Homo sapiens; identical to SEQ ID NO: 15282
  misc_feature 1..30: note = chr9:139100397-139100427
  misc_feature 1..30: note = hypo
  source 1..30: mol_type = genomic DNA

SEQ ID NO: 42339 - DNA, 40 bp, Homo sapiens
  misc_feature 1..40: note = chr9:139103561-139103601
  misc_feature 1..40: note = hypo
  source 1..40: mol_type = genomic DNA
caggaggatgagccacggactcggccgccagggcccaaag

SEQ ID NO: 42340 - DNA, 30 bp, Homo sapiens
  misc_feature 1..30: note = chr9:139111268-139111298
  misc_feature 1..30: note = hypo
  source 1..30: mol_type = genomic DNA
gtggggaccttaaggcgttttgtaaagctg

SEQ ID NO: 42341 - DNA, 30 bp, Homo sapiens
  misc_feature 1..30: note = chr9:139133153-139133183
  misc_feature 1..30: note = hypo
  source 1..30: mol_type = genomic DNA
gccccgccaaatgcccgctgacacctgcat

SEQ ID NO: 42342 - DNA, 136 bp, Homo sapiens
  misc_feature 1..136: note = chr9:139265293-139265429
  misc_feature 1..136: note = hypo
  source 1..136: mol_type = genomic DNA
tccagctgcaggtcacggttccgcatgagcgcggcgcccttctcctcactctggtgcgccaggcgcatggccaggtcgtagttctcctccttgcagcgcttgagctcgcggctgccggcctcgcactcctccttga

SEQ ID NO: 42343 - DNA, 30 bp, Homo sapiens
  misc_feature 1..30: note = chr9:139268822-139268852
  misc_feature 1..30: note = hypo
  source 1..30: mol_type = genomic DNA
aactgtgcacttcagcgtgtgggctgccag

SEQ ID NO: 42344 - DNA, 65 bp, Homo sapiens
  misc_feature 1..65: note = chr9:139317772-139317837
  misc_feature 1..65: note = hypo
  source 1..65: mol_type = genomic DNA
gtgttagtttggacacgaatttagtctaaaaagctgtctggttgtataaacggtgcaaacaatgt

SEQ ID NO: 42345 - DNA, 28 bp, Homo sapiens
  misc_feature 1..28: note = chr9:139375871-139375899
  misc_feature 1..28: note = hypo
  source 1..28: mol_type = genomic DNA
gagccaccgcgcccggcccagggaattt

SEQ ID NO: 42346 - DNA, 30 bp, Homo sapiens
  misc_feature 1..30: note = chr9:139412504-139412534
  misc_feature 1..30: note = hypo
  source 1..30: mol_type = genomic DNA
ccctgaagccagaatcgacttctcatcggt

SEQ ID NO: 42347 - DNA, 30 bp, Homo sapiens
  misc_feature 1..30: note = chr9:139419942-139419972
  misc_feature 1..30: note = hypo
  source 1..30: mol_type = genomic DNA
aaggcagcagcctcacggctcaggccctgg

SEQ ID NO: 42348 - DNA, 181 bp, Homo sapiens
  misc_feature 1..181: note = chr9:139421932-139422113
  misc_feature 1..181: note = hypo
  source 1..181: mol_type = genomic DNA
cttccatgagtgacccgcaccccaccttccaccgtccccgcatctcctcctatcaggggcggtggggagacccctctggggctaaaaagtgaggcttgagatagggaacgccagtctcccccgactggacgagagagctgccctgtccaccaagccacccagctctcgggctcccacggag

SEQ ID NO: 42349 - DNA, 40 bp, Homo sapiens; identical to SEQ ID NO: 15284
  misc_feature 1..40: note = chr9:139472499-139472539
  misc_feature 1..40: note = hypo
  source 1..40: mol_type = genomic DNA

SEQ ID NO: 42350 - DNA, 30 bp, Homo sapiens
  misc_feature 1..30: note = chr9:139487465-139487495
  misc_feature 1..30: note = hypo
  source 1..30: mol_type = genomic DNA
tggagtgcttggcagcgtagacagtcccag

SEQ ID NO: 42351 - DNA, 30 bp, Homo sapiens
  misc_feature 1..30: note = chr9:139504374-139504404
  misc_feature 1..30: note = hypo
  source 1..30: mol_type = genomic DNA
ccccgcccctccctgcgatgctgcctccct

SEQ ID NO: 42352 - DNA, 157 bp, Homo sapiens
  misc_feature 1..157: note = chr9:139504823-139504980
  misc_feature 1..157: note = hypo
  source 1..157: mol_type = genomic DNA
aggggagggcgacttcggtgttttccagcattattctagtggccacagcccccaggcctgtttcctctgtaaatggagatggcagcccaccccacgggcgctggaggggagctgaccctcaggccagtcaggagccctgtgacgggactcgctggag

SEQ ID NO: 42353 - DNA, 101 bp, Homo sapiens
  misc_feature 1..101: note = chr9:139505621-139505722
  misc_feature 1..101: note = hypo
  source 1..101: mol_type = genomic DNA
gccaggcagggggggcggccgtggggggcaggtgtgggcaggcagggagggatccctacaggtggcagctcacgctgcaggaccagcggccccaggaacac

SEQ ID NO: 42354 - DNA, 76 bp, Homo sapiens
  misc_feature 1..76: note = chr9:139506440-139506516
  misc_feature 1..76: note = hypo
  source 1..76: mol_type = genomic DNA
cccatgggtgggtgacggatgaaccgggtagaccgtctgtacaatggaatatttatccttccgccacaaaaacaga

SEQ ID NO: 42355 - DNA, 30 bp, Homo sapiens
  misc_feature 1..30: note = chr9:139517238-139517268
  misc_feature 1..30: note = hypo
  source 1..30: mol_type = genomic DNA
ccctagccacggtgccgcccctgctgtctc

SEQ ID NO: 42356 - DNA, 46 bp, Homo sapiens
  misc_feature 1..46: note = chr9:139546557-139546603
  misc_feature 1..46: note = hypo
  source 1..46: mol_type = genomic DNA
ctcctgtgagcacaacgctgtgtgtacattgcgcgtctgtttgaat

SEQ ID NO: 42357 - DNA, 51 bp, Homo sapiens; identical to SEQ ID NO: 15286
  misc_feature 1..51: note = chr9:139634047-139634098
  misc_feature 1..51: note = hypo
  source 1..51: mol_type = genomic DNA

SEQ ID NO: 42358 - DNA, 130 bp, Homo sapiens
  misc_feature 1..130: note = chr9:139638401-139638531
  misc_feature 1..130: note = hypo
  source 1..130: mol_type = genomic DNA
cttggtgacgacccccgccatcctccccgcaattccccggctggcccccagtcaaaagcatccttggtttgctgtggaatcgctttattctgagctggtgctgggccccgggagccgctgagcgaggtgg

SEQ ID NO: 42359 - DNA, 138 bp, Homo sapiens
  misc_feature 1..138: note = chr9:139654706-139654844
  misc_feature 1..138: note = hypo
  source 1..138: mol_type = genomic DNA
ccttctggacaagggcgatttggtgttgccccccatgtttcccaacccagcgggggtgtgcagggagacgttggtgcagacttgtgcaaagctgaacagccccagtgtccccaggcaggacggcgagtctccagggag

SEQ ID NO: 42360 - DNA, 30 bp, Homo sapiens
  misc_feature 1..30: note = chr9:139662292-139662322
  misc_feature 1..30: note = hypo
  source 1..30: mol_type = genomic DNA
cccctctgtgcacctcgcagaccatggaag

SEQ ID NO: 42361 - DNA, 595 bp, Homo sapiens
  misc_feature 1..595: note = chr9:139698658-139699253
  misc_feature 1..595: note = hypo
  source 1..595: mol_type = genomic DNA
ggctgaatgcacttccgtgagttctaggtggacctggccaggaggcagctgggggccagcggctggagggcagcagagcgtctgggctggcacatgctctgaggcatgggcaaggagggccgtgagctgaggggccacgggcacaagtggtttaggaaaagggtgtggccattggccggggatgcagttccaaagtctagtaaggtgagcatggccaaccgcccgctggctttactgccattaggggccttgttgagacagctccccaaccctgtgcccacccgcatgtccccagaggaacatgaggcaaagggaggcgtccttcatcgaggagcgccgggcaagggagaaccggctcaaccagcagaagaagctgatcgacaagatccacacgaaggagaccagcgagaagtaccgccgggtaagccccaggccagggcctggctggctgcccatccccatgacagctgggtggacacaggctcagggccaccactcagggcccactccctgccaaggatgtctcatcccttccccgcccccacctcccatcagggccagatggacttggacttcccctcgaacctgatgagca

SEQ ID NO: 42362 - DNA, 41 bp, Homo sapiens
  misc_feature 1..41: note = chr9:139703929-139703970
  misc_feature 1..41: note = hypo
  source 1..41: mol_type = genomic DNA
atgaaagttggtgtccgggccgggcacggtggctcatgcct

SEQ ID NO: 42363 - DNA, 340 bp, Homo sapiens
  misc_feature 1..340: note = chr9:139704090-139704430
  misc_feature 1..340: note = hypo
  source 1..340: mol_type = genomic DNA
aaagttgatgtccgaaccaagggccgtattggcttttcttatactctagaacatacgacgacaaagaagattttgatgaagttcaaattagagtcagcgtgctcatcagaaagaaagcgcagccaacacgtttaggaacagaaacggattatgttgaagacaaacaatccattgcgtttgtgttcagtaacccaagcatcaaaggaacttgtggctggggagaaggcttgactatttgaaatctcaggactcctctgtccaggagctcccagactcccgtggagtggaagcctgggggctcgctgaagaagtcacgtgactggaacgtgcttaatgcttg

SEQ ID NO: 42364 - DNA, 99 bp, Homo sapiens
  misc_feature 1..99: note = chr9:139705312-139705411
  misc_feature 1..99: note = hypo
  source 1..99: mol_type = genomic DNA
aatattttacagagcgtaacagaccagcaatgtgatcaagacagagtcgagggttttgggggtgagagtttctgggaactgctgcgggtttccaggagt

SEQ ID NO: 42365 - DNA, 98 bp, Homo sapiens
  misc_feature 1..98: note = chr9:139714085-139714183
  misc_feature 1..98: note = hypo
  source 1..98: mol_type = genomic DNA
gtcctagtgctacagcgacagtgatgccatatgcagaatatacttcaaaatgaaagagagcgggtagaaatgtgaagggttaccgcaggctcagagaa

SEQ ID NO: 42366 - DNA, 216 bp, Homo sapiens
  misc_feature 1..216: note = chr9:139717731-139717947
  misc_feature 1..216: note = hypo
  source 1..216: mol_type = genomic DNA
gctgccccctgggcccggttcgccgttgatgctctgtgtgctgccaggtgtcctcctgatgggagaggttgccatggtacccacccatcgtcttcctcccctgcctgccggtcacctggtctgattctagcaagaaagatgaaacaggtggcagcagaaccggctctccttgtagttgctcttaaagctgcagcttgggttcggttcgtttaattt

SEQ ID NO: 42367 - DNA, 175 bp, Homo sapiens
  misc_feature 1..175: note = chr9:139734923-139735098
  misc_feature 1..175: note = hypo
  source 1..175: mol_type = genomic DNA
ggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctgga

SEQ ID NO: 42368 - DNA, 30 bp, Homo sapiens
  misc_feature 1..30: note = chr9:139779368-139779398
  misc_feature 1..30: note = hypo
  source 1..30: mol_type = genomic DNA
gcagccaggaggagacgccttcttacgttt

SEQ ID NO: 42369 - DNA, 104 bp, Homo sapiens
  misc_feature 1..104: note = chr9:139794879-139794983
  misc_feature 1..104: note = hypo
  source 1..104: mol_type = genomic DNA
ccagataatgctgcccgcagggaggtggagagcctgccggccgtctgtcccagtgatggatgcacctggaaggggaccctgaaagaatacgaggtaaagatgcc

SEQ ID NO: 42370 - DNA, 312 bp, Homo sapiens
  misc_feature 1..312: note = chr9:139809779-139810091
  misc_feature 1..312: note = hypo
  source 1..312: mol_type = genomic DNA
gcattgtgggagcaccgtctcccgagacttgccagcacagtgtggtgtgaaggttggacgtgccactgtgatgtgtgagaaacacatcagtcctctgtatcgggggtccacgccgtggatccagccaaccgtaggttggaaatgttcaggtaaaaatgcactgaacacgcgcggacattttttattgacacagcgttcacgttgtattggtcatgagtcaccgagagctgatttcaggtatgagggagggtgtgcttaggctctgtgcaaacactctgccatcttccatcagggactcgagcatccttgggt

SEQ ID NO: 42371 - DNA, 282 bp, Homo sapiens
  misc_feature 1..282: note = chr9:139818340-139818622
  misc_feature 1..282: note = hypo
  source 1..282: mol_type = genomic DNA
gcgtatctacctgaacggcgacggcaccgggcgaggaacacacctgtccctcttctttgtggtgatgaagggcccgaatgacgccctgctgcggtggcccttcaaccagaaggtgaggccgtccctgcaggcttcgctagggccgcacctgggagtccctctgggcagtgcagcttctgtggtgcagggttgtgcgggacaaggtggcttgggctcgctggaccaggtgtctgcagcaggcacgtcaccctgtgatgctgtgtcacgcggtggagagctctg

SEQ ID NO: 42372 - DNA, 227 bp, Homo sapiens; identical to SEQ ID NO: 15294
  misc_feature 1..227: note = chr9:139859041-139859268
  misc_feature 1..227: note = hypo
  source 1..227: mol_type = genomic DNA

SEQ ID NO: 42373 - DNA, 299 bp, Homo sapiens
  misc_feature 1..299: note = chr9:139888764-139889063
  misc_feature 1..299: note = hypo
  source 1..299: mol_type = genomic DNA
actggaagtgccctgcggggaggggagcgcctgccccgggacaggattgaggaatgtgccagcccccatccacctggggcaccccgccccaccccggcctgactggtttgggagcccagtccggtcctggagatccctgaggccaccggttgcaggaggcctggagtctgcgccttcttagcgtggaggatgggaccggcccgacccccggcgctcctgcccctgtggttctgggctatcgggctgagcgtcccaccctggggtttggggatgggaagtgatcccgagacctctggccc

SEQ ID NO: 42374 - DNA, 30 bp, Homo sapiens
  misc_feature 1..30: note = chr9:139904297-139904327
  misc_feature 1..30: note = hypo
  source 1..30: mol_type = genomic DNA
cagccggcttgtctgcgtacttggtcagct

SEQ ID NO: 42375 - DNA, 30 bp, Homo sapiens
  misc_feature 1..30: note = chr9:139913362-139913392
  misc_feature 1..30: note = hypo
  source 1..30: mol_type = genomic DNA
tgaactggatccagccgcaggccgcgttgt

SEQ ID NO: 42376 - DNA, 30 bp, Homo sapiens
  misc_feature 1..30: note = chr9:139916163-139916193
  misc_feature 1..30: note = hypo
  source 1..30: mol_type = genomic DNA
gctgcctgggtcccacgacatgcctctacc

SEQ ID NO: 42377 - DNA, 82 bp, Homo sapiens
  misc_feature 1..82: note = chr9:139978914-139978996
  misc_feature 1..82: note = hypo
  source 1..82: mol_type = genomic DNA
cgcgccgggccggttgctggcatcttaatgttctgtaggtggaatatttccaataaacacaaggtgccgtaattgactgcta

SEQ ID NO: 42378 - DNA, 49 bp, Homo sapiens
  misc_feature 1..49: note = chr9:140030248-140030297
  misc_feature 1..49: note = hypo
  source 1..49: mol_type = genomic DNA
ctcacctgggagtcacgcaccattacctctaccacgttccatttgtaag

SEQ ID NO: 42379 - DNA, 41 bp, Homo sapiens
  misc_feature 1..41: note = chr9:140030498-140030539
  misc_feature 1..41: note = hypo
  source 1..41: mol_type = genomic DNA
ccacccttagaacagcgtctggtacacggtaggtgctcagt

SEQ ID NO: 42380 - DNA, 40 bp, Homo sapiens
  misc_feature 1..40: note = chr9:140041778-140041818
  misc_feature 1..40: note = hypo
  source 1..40: mol_type = genomic DNA
acacacctggacacacgctcaggtgcgctcctcatgtgca

SEQ ID NO: 42381 - DNA, 119 bp, Homo sapiens
  misc_feature 1..119: note = chr9:140043219-140043338
  misc_feature 1..119: note = hypo
  source 1..119: mol_type = genomic DNA
agagagagcacagaacgagcacaggtgagcgcgcaggctgaagacaggacaggaccggagaggcgaggccaggccaggcaaggactgaggaaggcaggcggaggcgcaggtggcaggcg

SEQ ID NO: 42382 - DNA, 30 bp, Homo sapiens
  misc_feature 1..30: note = chr9:140052371-140052401
  misc_feature 1..30: note = hypo
  source 1..30: mol_type = genomic DNA
ttcactgatgtggcccgatgggtacaatgc

SEQ ID NO: 42383 - DNA, 196 bp, Homo sapiens
  misc_feature 1..196: note = chr9:140107128-140107324
  misc_feature 1..196: note = hypo
  source 1..196: mol_type = genomic DNA
accagcttccagggtcggcccctgcgcgcctcagggccctcgcagtggtactggcttctccacaacgctccctggtgggcaccccaggcttcacgctgcggggagggcacagaggggagcaggcagggtggcaaagggctgggctccagccacgctgacgtcacacaggcctacctggcgccggtccccactttta

SEQ ID NO: 42384 - DNA, 177 bp, Homo sapiens
  misc_feature 1..177: note = chr9:140108225-140108402
  misc_feature 1..177: note = hypo
  source 1..177: mol_type = genomic DNA
ccacaggttcaacttcgtggccaagaagctgcaccgacggctactgcagcttgggggcagcgccctcctgcccgtgtgcctgggcgatgaccagcatgagctggggtgagtctgcgggcgtggtacccgcctccacagtctggtctggccacacgcagggtccgctcaggccagcgc

SEQ ID NO: 42385 - DNA, 30 bp, Homo sapiens
  misc_feature 1..30: note = chr9:140115123-140115153
  misc_feature 1..30: note = hypo
  source 1..30: mol_type = genomic DNA
acttggggcaggactcgtagagaatctgca

SEQ ID NO: 42386 - DNA, 516 bp, Homo sapiens
  misc_feature 1..516: note = chr9:140127654-140128170
  misc_feature 1..516: note = hypo
  source 1..516: mol_type = genomic DNA
ccacagggctttcagcggctcggcggtgcacgggatcttcaactggctcacagtgctggtcctgctgccactggagagcgccacggccctgctggagaggctaagtgagctagccctgggtgccgccagcctgacacccagggcgcaggcgcccgacatcctcaaggtgctgacgaagccgctcacacacctcatcgtgcaggtgaggacggccaccgcccccgcccagagagcctgagcaggccggatgggaggaggggaggcccgccctgccctgatggagggtcagcggagggtctgggccctgtcctgggacaggggaggagagggcagcagtgggcagggctgggctggaccccgcgggcgccagagccccgggtgagtcctgagagagggtgcagcacaccgtcacgacccctctggcccccagttggactccgacatgatcatgagcagtgccacaggcaacgccactaacagcagtctcattaagcactggtgcggcaccacggggca

SEQ ID NO: 42387 - DNA, 87 bp, Homo sapiens
  misc_feature 1..87: note = chr9:140137230-140137317
  misc_feature 1..87: note = hypo
  source 1..87: mol_type = genomic DNA
ctcagtccaccagctcgtagaaaacacagacgagacctactgcattgataacgaagctctctacgacatttgcttcagaaccctaaa

SEQ ID NO: 42388 - DNA, 180 bp, Homo sapiens
  misc_feature 1..180: note = chr9:140137557-140137737
  misc_feature 1..180: note = hypo
  source 1..180: mol_type = genomic DNA
caagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacat

SEQ ID NO: 42389 - DNA, 30 bp, Homo sapiens
  misc_feature 1..30: note = chr9:140140759-140140789
  misc_feature 1..30: note = hypo
  source 1..30: mol_type = genomic DNA
cagtagcctcctgcacgggaagagaactgg

SEQ ID NO: 42390 - DNA, 54 bp, Homo sapiens
  misc_feature 1..54: note = chr9:140144171-140144225
  misc_feature 1..54: note = hypo
  source 1..54: mol_type = genomic DNA
gaggttcccagagggcggcaactagcgaggacatggaagcgccagcccctcccc

SEQ ID NO: 42391 - DNA, 56 bp, Homo sapiens
  misc_feature 1..56: note = chr9:140147052-140147108
  misc_feature 1..56: note = hypo
  source 1..56: mol_type = genomic DNA
ggctggctgagggtccgtggggagcaccctgccctgcagcccgtctcctaccccct

SEQ ID NO: 42392 - DNA, 30 bp, Homo sapiens
  misc_feature 1..30: note = chr9:140167020-140167050
  misc_feature 1..30: note = hypo
  source 1..30: mol_type = genomic DNA
cgtctaagctggaggcgttgcagaaggccc

SEQ ID NO: 42393 - DNA, 30 bp, Homo sapiens
  misc_feature 1..30: note = chr9:140198590-140198620
  misc_feature 1..30: note = hypo
  source 1..30: mol_type = genomic DNA
caggtgggctcaagccgggcctggagaagg

SEQ ID NO: 42394 - DNA, 237 bp, Homo sapiens
  misc_feature 1..237: note = chr9:140245670-140245907
  misc_feature 1..237: note = hypo
  source 1..237: mol_type = genomic DNA
acccagcaccctccccggggcacacggagggaagggtcaggcaggggtgcgggctgctttctttctggactgggcagggggccccagggcttcactcacccagcttggtgatagaggggtccgagaggagctgggccaccagccgggaaaaggcctgggctccctgccctgttggtggctgcgagagtgccaggacgtccagaaggaacacgtggccctccacggccacctgcagga

SEQ ID NO: 42395 - DNA, 120 bp, Homo sapiens
  misc_feature 1..120: note = chr9:140265734-140265854
  misc_feature 1..120: note = hypo
  source 1..120: mol_type = genomic DNA
tgcattgtcctgtgccgggacatggtggcttctcagcgccatgcacccgccgcgagacgacggccccgggcgtggcaggtgacagcgccaggggtggggcccgcgcggcccacacagggg

SEQ ID NO: 42396 - DNA, 30 bp, Homo sapiens
  misc_feature 1..30: note = chr9:140266433-140266463
  misc_feature 1..30: note = hypo
  source 1..30: mol_type = genomic DNA
ccaggctcaggacgacggggctgtgatgct

SEQ ID NO: 42397 - DNA, 61 bp, Homo sapiens; identical to SEQ ID NO: 15304
  misc_feature 1..61: note = chr9:140267262-140267323
  misc_feature 1..61: note = hypo
  source 1..61: mol_type = genomic DNA

SEQ ID NO: 42398 - DNA, 158 bp, Homo sapiens
  misc_feature 1..158: note = chr9:140274104-140274262
  misc_feature 1..158: note = hypo
  source 1..158: mol_type = genomic DNA
tcactcattgtgaaacggctggttttatatgtcgtgcatcttaccccaataaagcattcgatgaagccgacgctccgtggctctgatttggggtgcgctctcgcccaggctggtttctgtcacccccggagttctgcagcacccgttctaaccacagc

SEQ ID NO: 42399 - DNA, 30 bp, Homo sapiens
  misc_feature 1..30: note = chr9:140274632-140274662
  misc_feature 1..30: note = hypo
  source 1..30: mol_type = genomic DNA
ggtccctcctcccttcgagcccttcactgg

SEQ ID NO: 42400 - DNA, 30 bp, Homo sapiens
  misc_feature 1..30: note = chr9:140325615-140325645
  misc_feature 1..30: note = hypo
  source 1..30: mol_type = genomic DNA
tggggccacgcgggccgggcacaggagggc

SEQ ID NO: 42401 - DNA, 30 bp, Homo sapiens
  misc_feature 1..30: note = chr9:140327964-140327994
  misc_feature 1..30: note = hypo
  source 1..30: mol_type = genomic DNA
gtggccctgagggcacgaagaggagccgac

SEQ ID NO: 42402 - DNA, 41 bp, Homo sapiens
  misc_feature 1..41: note = chr9:140332500-140332541
  misc_feature 1..41: note = hypo
  source 1..41: mol_type = genomic DNA
cgtgtgggaggagcccgcatcaaacacgatcccaaactggg

SEQ ID NO: 42403 - DNA, 217 bp, Homo sapiens
  misc_feature 1..217: note = chr9:140332929-140333146
  misc_feature 1..217: note = hypo
  source 1..217: mol_type = genomic DNA
gctcagacggtctcccgtggccttagaggcatctccggggctcaggcggcctcccgtggccatagaggcatctccggggctcagacggcctcccgtggccatagaggcatccccggggctcagacggcctcccgtggccatagaggcatccccggggctcagacggtctcccgtggccatagaggcatccccggggctcagacgcctcccgtggcca

SEQ ID NO: 42404 - DNA, 48 bp, Homo sapiens
  misc_feature 1..48: note = chr9:140352105-140352153
  misc_feature 1..48: note = hypo
  source 1..48: mol_type = genomic DNA
ccgccccttcaccaccgccagctcaatggcctccgcctcagggctggg

SEQ ID NO: 42405 - DNA, 68 bp, Homo sapiens
  misc_feature 1..68: note = chr9:140382557-140382625
  misc_feature 1..68: note = hypo
  source 1..68: mol_type = genomic DNA
cctcatcctgagcttcggcctgaacgctgctctcgtggtctgatgtctcgtcccgagcttcacttgca

SEQ ID NO: 42406 - DNA, 178 bp, Homo sapiens
  misc_feature 1..178: note = chr9:140389309-140389487
  misc_feature 1..178: note = hypo
  source 1..178: mol_type = genomic DNA
tgccctcacctgctccgtgacctcatccactccgcgccttcacctgctctgcgctctcacctgctccgcgccctcacctgctctgtgccctcacccgctccgccctcacctgttccatgccctcatccactccacaccctcatccgctccgcatcctcacccacgccatgctcacctg

SEQ ID NO: 42407 - DNA, 264 bp, Homo sapiens
  misc_feature 1..264: note = chr9:140392377-140392641
  misc_feature 1..264: note = hypo
  source 1..264: mol_type = genomic DNA
aaatccaggaggccacgaagtgtgtttccgagctaagctggggtggggctggggaaatccagccttccatgtgtggtttccacagtaacttccgtgtgtggtttccacggtaaccgtgctttgcccatccccagctcctgcatgccagggcagcatggatgcggagtgtgtggcacccacggcctcacctgtatattgctcgcccggcctccacctccacccagtccagggcaaagtcgatttgccgcacgaaggacgacatcc

SEQ ID NO: 42408 - DNA, 167 bp, Homo sapiens; identical to SEQ ID NO: 15310
  misc_feature 1..167: note = chr9:140396560-140396727
  misc_feature 1..167: note = hypo
  source 1..167: mol_type = genomic DNA

SEQ ID NO: 42409 - DNA, 68 bp, Homo sapiens
  misc_feature 1..68: note = chr9:140397029-140397097
  misc_feature 1..68: note = hypo
  source 1..68: mol_type = genomic DNA
ggcgcgttgtcagcccgaggaggagccgtgggaggttcttcaggagaagaaagcggcctccctgagga

SEQ ID NO: 42410 - DNA, 71 bp, Homo sapiens; identical to SEQ ID NO: 15312
  misc_feature 1..71: note = chr9:140400208-140400279
  misc_feature 1..71: note = hypo
  source 1..71: mol_type = genomic DNA

SEQ ID NO: 42411 - DNA, 30 bp, Homo sapiens
  misc_feature 1..30: note = chr9:140401540-140401570
  misc_feature 1..30: note = hypo
  source 1..30: mol_type = genomic DNA
aggggcgcatgtctccgaggcttacgctga

SEQ ID NO: 42412 - DNA, 82 bp, Homo sapiens
  misc_feature 1..82: note = chr9:140507337-140507419
  misc_feature 1..82: note = hypo
  source 1..82: mol_type = genomic DNA
ccctttgcagccatccgggtgacctgcataggttcctgcggggtctccaacaaggctaatgacacagcgtgggtagtggagg

SEQ ID NO: 42413 - DNA, 30 bp, Homo sapiens
  misc_feature 1..30: note = chr9:140508520-140508550
  misc_feature 1..30: note = hypo
  source 1..30: mol_type = genomic DNA
acaagctggtgaagacgggcagcgtggtcc

SEQ ID NO: 42414 - DNA, 23 bp, Homo sapiens
  misc_feature 1..23: note = chr9:140511850-140511873
  misc_feature 1..23: note = hypo
  source 1..23: mol_type = genomic DNA
accgcacccggcccagtcaacaa

SEQ ID NO: 42415 - DNA, 152 bp, Homo sapiens
  misc_feature 1..152: note = chr9:140512180-140512332
  misc_feature 1..152: note = hypo
  source 1..152: mol_type = genomic DNA
ggagggccatgaaggcgctcgtgtctcctgcgagggctcagggtgctcggcctgtcataaatggacttaggctttgacagagcagtttagctgccctaaagaaacctgggaaggttcccttggcacttgggattgtccgtttccttttctgt

SEQ ID NO: 42416 - DNA, 33 bp, Homo sapiens
  misc_feature 1..33: note = chr9:140615444-140615477
  misc_feature 1..33: note = hypo
  source 1..33: mol_type = genomic DNA
cctttctcccctcctcgccggcgtcctcgccag

SEQ ID NO: 42417 - DNA, 207 bp, Homo sapiens
  misc_feature 1..207: note = chr9:140657710-140657917
  misc_feature 1..207: note = hypo
  source 1..207: mol_type = genomic DNA
tcagagggttcagcacgtcccgtctctgctgcctctgggacaggaggggggatcaggcagagcacagacggaattaatgttttctgagaatttctccagttctttttaacacgatttctttcagccctcagagcctcgtgaccatggctggccatggtgagggtctgagcaggaggcttgttggcaccaggccgagaggcaccacat

SEQ ID NO: 42418 - DNA, 76 bp, Homo sapiens
  misc_feature 1..76: note = chr9:140664584-140664660
  misc_feature 1..76: note = hypo
  source 1..76: mol_type = genomic DNA
ggcccactttatttcttcagtcttgtgtttttttctttctttctgggattccttgtacacacgttagattgtttga

SEQ ID NO: 42419 - DNA, 45 bp, Homo sapiens; identical to SEQ ID NO: 15313
  misc_feature 1..45: note = chr9:140680320-140680365
  misc_feature 1..45: note = hypo
  source 1..45: mol_type = genomic DNA

SEQ ID NO: 42420 - DNA, 34 bp, Homo sapiens
  misc_feature 1..34: note = chr9:140682888-140682922
  misc_feature 1..34: note = hypo
  source 1..34: mol_type = genomic DNA
aaaggaggttgcaggcgtacggaggttgcaggtg

SEQ ID NO: 42421 - DNA, 30 bp, Homo sapiens
  misc_feature 1..30: note = chr9:140693933-140693963
  misc_feature 1..30: note = hypo
  source 1..30: mol_type = genomic DNA
gggccacctgcctcacgagtgaatgactgg

SEQ ID NO: 42422 - DNA, 156 bp, Homo sapiens
  misc_feature 1..156: note = chr9:140708986-140709142
  misc_feature 1..156: note = hypo
  source 1..156: mol_type = genomic DNA
tcaggtggtaagtgccgctggtccgggtctgcaaaaacagtgcaggcgtctgtgaccccagcgctgtcgtggcagcgtcgggaaggagttggaggtgagctgggtgtgacaggcaggggaggcacagcgggcaccagcacccgagtcagggtcgtg

SEQ ID NO: 42423 - DNA, 60 bp, Homo sapiens
  misc_feature 1..60: note = chr9:140727525-140727585
  misc_feature 1..60: note = hypo
  source 1..60: mol_type = genomic DNA
cgccgtgaaggttgacggagagctgctctcgtccacgcctttacccgcttgttggtttgg

SEQ ID NO: 42424 - DNA, 82 bp, Homo sapiens
  misc_feature 1..82: note = chr9:140770013-140770095
  misc_feature 1..82: note = hypo
  source 1..82: mol_type = genomic DNA
ctaccacaatctgtgcgatctgtgcaaggcgcagggaagtcccaagggccaggattcaccatgcctgcgtgatgccatcccc

SEQ ID NO: 42425 - DNA, 37 bp, Homo sapiens
  misc_feature 1..37: note = chr9:140793786-140793823
  misc_feature 1..37: note = hypo
  source 1..37: mol_type = genomic DNA
cacctgtcttggcctcccaaagcgctgggattgggat

SEQ ID NO: 42426 - DNA, 58 bp, Homo sapiens
  misc_feature 1..58: note = chr9:140969282-140969340
  misc_feature 1..58: note = hypo
  source 1..58: mol_type = genomic DNA
tgttagtctggcagccgcgctgaaggacaggcctgacccgcggcgggggttacatgct

SEQ ID NO: 42427 - DNA, 177 bp, Homo sapiens
  misc_feature 1..177: note = chr9:141022582-141022759
  misc_feature 1..177: note = hypo
  source 1..177: mol_type = genomic DNA
cttatttaactttaacgatggtttcccactggcatcagaacaggggtcgcagaactgacctggcccccagtccctgagcgctcccacctgctgccctctcccgcccagcccagcccagctgcctgcgttgcggcctccacctgcagggacacagcaggctctcgggagtcttgggaa

SEQ ID NO: 42428 - DNA, 30 bp, Homo sapiens
  misc_feature 1..30: note = chr10:482288-482318
  misc_feature 1..30: note = hypo
  source 1..30: mol_type = genomic DNA
gcactgctgggtcatcgtgaccatgggcag

SEQ ID NO: 42429 - DNA, 60 bp, Homo sapiens
  misc_feature 1..60: note = chr10:524611-524671
  misc_feature 1..60: note = hypo
  source 1..60: mol_type = genomic DNA
acacatccaagttcccgtcttattctcactcatctcgtgtccgggcgtgctgggggtgta

SEQ ID NO: 42430 - DNA, 35 bp, Homo sapiens
  misc_feature 1..35: note = chr10:769828-769863
  misc_feature 1..35: note = hypo
  source 1..35: mol_type = genomic DNA
catcaccatgcccagcgtcacgtgacatggataga

SEQ ID NO: 42431 - DNA, 30 bp, Homo sapiens; identical to SEQ ID NO: 15317
  misc_feature 1..30: note = chr10:833307-833337
  misc_feature 1..30: note = hypo
  source 1..30: mol_type = genomic DNA

SEQ ID NO: 42432 - DNA, 44 bp, Homo sapiens
  misc_feature 1..44: note = chr10:851432-851476
  misc_feature 1..44: note = hypo
  source 1..44: mol_type = genomic DNA
gcctggcggcctctgcggagcgccctctgcggagctgcctctgg

SEQ ID NO: 42433 - DNA, 194 bp, Homo sapiens
  misc_feature 1..194: note = chr10:978811-979005
  misc_feature 1..194: note = hypo
  source 1..194: mol_type = genomic DNA
ctgggatcaaggccccggcccttccccaaacccccaacccacacccgggaccaaaaggccccggccccacgtttcctagaggcgctgggttcgggcccacgttgcaacgagtcagatgctcttggtagctcagggaggtgttcacactcctgccgtttccgtgaggatggtgacgactccgaactatagcagca

SEQ ID NO: 42434 - DNA, 149 bp, Homo sapiens
  misc_feature 1..149: note = chr10:1156723-1156872
  misc_feature 1..149: note = hypo
  source 1..149: mol_type = genomic DNA
atcgccaaggacatccgtgagcctccgatgggtgtccagcgtgttagcgcccagacccacagggcctggcaccctgataggtgggaatgttggcccagggccgggcctgaggcctgcaggactgcctgctcatccgggaagtagctctg

SEQ ID NO: 42435 - DNA, 52 bp, Homo sapiens
  misc_feature 1..52: note = chr10:1209169-1209221
  misc_feature 1..52: note = hypo
  source 1..52: mol_type = genomic DNA
catcacgtgggtgtgcggtctggctgctgggtccacgcgggttctcaatcat

SEQ ID NO: 42436 - DNA, 132 bp, Homo sapiens
  misc_feature 1..132: note = chr10:1233108-1233240
  misc_feature 1..132: note = hypo
  source 1..132: mol_type = genomic DNA
tggcagctgccaccccgagagccgggagggacaatctggcccgttggccgctgtggctgtcctactaggcaggggccgcctgggcaggaggagccagccaccaaggccagggatgaccgggcactgggagag

SEQ ID NO: 42437 - DNA, 30 bp, Homo sapiens
  misc_feature 1..30: note = chr10:1248527-1248557
  misc_feature 1..30: note = hypo
  source 1..30: mol_type = genomic DNA
gggacgtaagatgcccgttctcagatttgg

SEQ ID NO: 42438 - DNA, 41 bp, Homo sapiens
  misc_feature 1..41: note = chr10:1252314-1252355
  misc_feature 1..41: note = hypo
  source 1..41: mol_type = genomic DNA
ctccttgaactgggacgtctcctcctcgtgcctgtgtggtc

SEQ ID NO: 42439 - DNA, 221 bp, Homo sapiens
  misc_feature 1..221: note = chr10:1259797-1260018
  misc_feature 1..221: note = hypo
  source 1..221: mol_type = genomic DNA
ctgtgtccagcatctcgtgggtttgcacctgtgcccggacctgccagtgttgcgtgggtttgcacctgtgcccagacctgctggcatcgcgtgggtttgcacgtgtccagcatcatgtaggtttgtacctgtgcccagacctggcattgcgtgggttcgcacctgtgtccagcgttgtgtagctttgcacctgtacccggacctgccggtgacacataggt

SEQ ID NO: 42440 - DNA, 30 bp, Homo sapiens
  misc_feature 1..30: note = chr10:1438451-1438481
  misc_feature 1..30: note = hypo
  source 1..30: mol_type = genomic DNA
ccttgagagtgctgccggactgaacttccc

SEQ ID NO: 42441 - DNA, 127 bp, Homo sapiens
  misc_feature 1..127: note = chr10:1506252-1506379
  misc_feature 1..127: note = hypo
  source 1..127: mol_type = genomic DNA
tggaggggccaggaccgccacacacatgcgctgggggcagtcacagcgggcagtgtgccggagaagagggtggacacacactcccccacacacgcgcggggggcagtcacagcgggcagtgcgccgg

SEQ ID NO: 42442 - DNA, 30 bp, Homo sapiens
  misc_feature 1..30: note = chr10:1555620-1555650
  misc_feature 1..30: note = hypo
  source 1..30: mol_type = genomic DNA
ggagtgtgtggctagcgatgacggccgtcc

SEQ ID NO: 42443 - DNA, 40 bp, Homo sapiens
  misc_feature 1..40: note = chr10:1558592-1558632
  misc_feature 1..40: note = hypo
  source 1..40: mol_type = genomic DNA
cctgcttgtgaccagcgtgcattctcgacatacacgcttc

SEQ ID NO: 42444 - DNA, 46 bp, Homo sapiens
  misc_feature 1..46: note = chr10:1585353-1585399
  misc_feature 1..46: note = hypo
  source 1..46: mol_type = genomic DNA
ggtgcaggatggcggcgttgagagccagaaacgaaaccctgagaag

SEQ ID NO: 42445 - DNA, 140 bp, Homo sapiens
  misc_feature 1..140: note = chr10:1669194-1669334
  misc_feature 1..140: note = hypo
  source 1..140: mol_type = genomic DNA
gtcccaccttttccccgggccccggcgcacccgctagcaccgctttctgcccaccctggcctggacgcctctccctccccacaggctcacacatcagtcacccactcgaactggagccgggccctcgggtgaatcgttag

SEQ ID NO: 42446 - DNA, 180 bp, Homo sapiens
  misc_feature 1..180: note = chr10:1716300-1716480
  misc_feature 1..180: note = hypo
  source 1..180: mol_type = genomic DNA
cactgggaacggccccgtcggccgggggcccaggaatcagccctgtgcagagtgcattccgtaatgtgtgcaccttctctacttcagaaaaaaatattctttgaaagatccattttttaaagcctccaacccccttgtgagaaaattggcaactgtgggggcccccgcagcctcaaattt

SEQ ID NO: 42447 - DNA, 90 bp, Homo sapiens
  misc_feature 1..90: note = chr10:1850230-1850320
  misc_feature 1..90: note = hypo
  source 1..90: mol_type = genomic DNA
gtgcgcaccgcgcctcgtgtccgcctggcgtgtgttgctccgtggtgctccgggggaaggtttgggggacccatgcggcagcgttggcgt

SEQ ID NO: 42448 - DNA, 80 bp, Homo sapiens
  misc_feature 1..80: note = chr10:1995028-1995108
  misc_feature 1..80: note = hypo
  source 1..80: mol_type = genomic DNA
gaaggggctggagcccgggcactcgggttaggcaacgtcaaggggctcgggaggagagtgggctccgccaaggcggtggc

SEQ ID NO: 42449 - DNA, 30 bp, Homo sapiens; identical to SEQ ID NO: 15322
  misc_feature 1..30: note = chr10:2283030-2283060
  misc_feature 1..30: note = hypo
  source 1..30: mol_type = genomic DNA

SEQ ID NO: 42450 - DNA, 102 bp, Homo sapiens
  misc_feature 1..102: note = chr10:2452926-2453028
  misc_feature 1..102: note = hypo
  source 1..102: mol_type = genomic DNA
catcttcaaaggctctttggaagcaacacgacaccagcagcacagacagaccatgtcactcggctctgcgttaggacttcaggaccgcggcagtctcatcat

SEQ ID NO: 42451 - DNA, 30 bp, Homo sapiens
  misc_feature 1..30: note = chr10:2706731-2706761
  misc_feature 1..30: note = hypo
  source 1..30: mol_type = genomic DNA
aaacctcacccccaccgccgctaaaaatat

SEQ ID NO: 42452 - DNA, 193 bp, Homo sapiens
  misc_feature 1..193: note = chr10:2758979-2759172
  misc_feature 1..193: note = hypo
  source 1..193: mol_type = genomic DNA
cttgaaggagaggcccgtgactcatcgcgttctgtcactttggtgcctggaatacggtaaccactcaataaatattaattgccattataatgattaccattgctgttatcagtgttattcttctccactgtagcgtaatacttgctatgatccagatcaggtttttgaagcaacttcacgcttggcatttcag

SEQ ID NO: 42453 - DNA, 30 bp, Homo sapiens
  misc_feature 1..30: note = chr10:2775311-2775341
  misc_feature 1..30: note = hypo
  source 1..30: mol_type = genomic DNA
agagagagagacagacgtccccacagaggg

SEQ ID NO: 42454 - DNA, 78 bp, Homo sapiens; identical to SEQ ID NO: 15323
  misc_feature 1..78: note = chr10:3161042-3161120
  misc_feature 1..78: note = hypo
  source 1..78: mol_type = genomic DNA

SEQ ID NO: 42455 - DNA, 84 bp, Homo sapiens
  misc_feature 1..84: note = chr10:3216467-3216551
  misc_feature 1..84: note = hypo
  source 1..84: mol_type = genomic DNA
gggaaaaagtcccaacgtgtctaccctaaactctccatagggcagccagttctgggctgcaggtaaacacgtacctccttattg

SEQ ID NO: 42456 - DNA, 19 bp, Homo sapiens
  misc_feature 1..19: note = chr10:3285550-3285569
  misc_feature 1..19: note = hypo
  source 1..19: mol_type = genomic DNA
agccaggcgtgctggcgct

SEQ ID NO: 42457 - DNA, 79 bp, Homo sapiens
  misc_feature 1..79: note = chr10:3285689-3285768
  misc_feature 1..79: note = hypo
  source 1..79: mol_type = genomic DNA
aaaaaataataacaataaatagcaaacagcagagagcatcatcttaaggttttgaaaatacatacgtattactattatg

SEQ ID NO: 42458 - DNA, 74 bp, Homo sapiens
  misc_feature 1..74: note = chr10:3329710-3329784
  misc_feature 1..74: note = hypo
  source 1..74: mol_type = genomic DNA
tgttgtaattgagtgcgtgcacactcagtaaatgcgaaatggtttcatcacaaccgcaccgatgcagttcctaa

SEQ ID NO: 42459 - DNA, 191 bp, Homo sapiens
  misc_feature 1..191: note = chr10:3330427-3330618
  misc_feature 1..191: note = hypo
  source 1..191: mol_type = genomic DNA
agcgagcaggtgccacgtccacaccgggtgaggcgtgaggtgagggctcccccgcgccgccctggcgtccaggtggtgagggctgcacggaaacgtggacttcggcagaacatgtgtgcgccacggagcggctgcgtgcagcccgcaggtgagaccgtctgcataactctgccaaccgtggagtatccaag

SEQ ID NO: 42460 - DNA, 30 bp, Homo sapiens
  misc_feature 1..30: note = chr10:3641392-3641422
  misc_feature 1..30: note = hypo
  source 1..30: mol_type = genomic DNA
gcgaggcgggcggatcggatcatgaggtca

SEQ ID NO: 42461 - DNA, 216 bp, Homo sapiens
  misc_feature 1..216: note = chr10:3678616-3678832
  misc_feature 1..216: note = hypo
  source 1..216: mol_type = genomic DNA
agacaccgtgcctggtccaaagagatgtttttatgtggttcaccttcgaccttcatcagggtgactcaggaggcacattctgaagccactctccaacacttaagttttttgccaggtatttttcacaaagcaacgatttgaacaatgaaggagaaaatgtagcctcgcaacttcattcgtaaataatccagactaaccgcacggagtataatggat

SEQ ID NO: 42462 - DNA, 98 bp, Homo sapiens
  misc_feature 1..98: note = chr10:3895354-3895452
  misc_feature 1..98: note = hypo
  source 1..98: mol_type = genomic DNA
gttcccaccacacagcggcggctcaactgcccaggctgtggggtttccagctgtgtcgtgttgacttgaaccgactcagcaggcggtgccctcctgga

SEQ ID NO: 42463 - DNA, 216 bp, Homo sapiens
  misc_feature 1..216: note = chr10:4599789-4600005
  misc_feature 1..216: note = hypo
  source 1..216: mol_type = genomic DNA
aagcgtttcacagtgcggtgacgatgggatccgcccatgtttgcacgtgccaggagcagcggtagcagcagctccagggaggtgcacacttgtcagcggcagtggggtgctggcgggtgccagagggcctgccgccctaaggtcgttcacgatggtgtcagcggcaatgcagctggggtggagggcctgctggcagctgtgcgtgcagtgacactg

SEQ ID NO: 42464 - DNA, 185 bp, Homo sapiens
  misc_feature 1..185: note = chr10:5507960-5508145
  misc_feature 1..185: note = hypo
  source 1..185: mol_type = genomic DNA
tgcaaattctacaaacgctgaatttaaatgctgagcaaagcggcccaggctgttttcatctggaggtctgggctgcaacctctcactctcagacaataactacttaggaaaattcgacatccagaggcctaggagcctcagggcccaaccccaggccgccctagcctgtgcgggtgaacctttca

SEQ ID NO: 42465 - DNA, 30 bp, Homo sapiens
  misc_feature 1..30: note = chr10:5523260-5523290
  misc_feature 1..30: note = hypo
  source 1..30: mol_type = genomic DNA
cgccacaggcaccagcgtgcttctcctcag

SEQ ID NO: 42466 - DNA, 43 bp, Homo sapiens
  misc_feature 1..43: note = chr10:5530764-5530807
  misc_feature 1..43: note = hypo
  source 1..43: mol_type = genomic DNA
gcttccaggtgcagccggggttgggaatcgctggcttatgcaa

SEQ ID NO: 42467 - DNA, 70 bp, Homo sapiens
  misc_feature 1..70: note = chr10:5531049-5531119
  misc_feature 1..70: note = hypo
  source 1..70: mol_type = genomic DNA
cacctgcttctccagcgggaacggagggcgacctgcgcagcctaggcactgcggccgtggttcacatgca

SEQ ID NO: 42468 - DNA, 48 bp, Homo sapiens
  misc_feature 1..48: note = chr10:5538890-5538938
  misc_feature 1..48: note = hypo
  source 1..48: mol_type = genomic DNA
gtctgcccgagagcacggcaggtgggaaagagacgaatcctgactcca

SEQ ID NO: 42469 - DNA, 877 bp, Homo sapiens
  misc_feature 1..877: note = chr10:5540651-5541528
  misc_feature 1..877: note = hypo
  source 1..877: mol_type = genomic DNA
agcacacatggaactcggcagtcctttatttagatcaatgcggggctgaggggccctcattccactgcagggcaaagggggaccaggcccaaggaggcctccttctgcccaaggtctggaggcagagaggggctcgcaggcggcccgagggcgccgcatccaggccccggagcgcaaagccttcctcccagggggaggcagtttcccatccaccgaccaggtttccccggagagtcccagcacaaaagcagcagcgggcggtggccctgaaggctcagagcgcagccagggggacacaggcggggagcctcactcctgggcgagcatcctcgcgaactcctcgtagttcacccgcccgtcctggtccacgtcggcctcgcggatcatggcgtccagctcctcctgcggcagcggctgccccagccccgccatggcccgcctgagctcgtccacggtgatgtggccgtcgccatcctggtcgaaggcgcggaaggcgacctgcaggtcctccaggccggccctggccttcttcgccgccgtcaggaactcctggaagctgatttcgccgtcgccgtcgctgtcaacctcggagatgagtttccttagctgggcctccgagaggttcttgcccgtggccttcagcgccgcgcccagctcctgggcattgatggtgccgtttccatccgtgtcaaccgcggagaaagcctttttgtactgggcctcctcctcaggagtcagctcaccggccatgcctgcgtctcctgcacctcgcggagcctccgagctgctgcccaccggccctcaacctgctgctctcagagctcgtggtccagagtgcaggcagccgcagggatccgggcagcgtctgtcccagaca

SEQ ID NO: 42470 - DNA, 47 bp, Homo sapiens
  misc_feature 1..47: note = chr10:5553281-5553328
  misc_feature 1..47: note = hypo
  source 1..47: mol_type = genomic DNA
ctgcaaagggaaggccgctactgctcacacctcgacttctcagggag

SEQ ID NO: 42471 - DNA, 74 bp, Homo sapiens
  misc_feature 1..74: note = chr10:5567136-5567210
  misc_feature 1..74: note = hypo
  source 1..74: mol_type = genomic DNA
cccgcgagctgggcacggtcatgcggtccctgggccagaaccccacggaggccgagctgcgggacatgatgagt

SEQ ID NO: 42472 - DNA, 30 bp, Homo sapiens
  misc_feature 1..30: note = chr10:5588268-5588298
  misc_feature 1..30: note = hypo
  source 1..30: mol_type = genomic DNA
gggggacagaggggacggtccccagggaag

SEQ ID NO: 42473 - DNA, 160 bp, Homo sapiens
  misc_feature 1..160: note = chr10:5868078-5868238
  misc_feature 1..160: note = hypo
  source 1..160: mol_type = genomic DNA
aaaaaaaaaaaaaagatggttcaatagaaactaatctttccccatctcccaaacagtgctccattcctgcttaatcaacagcagtatctcccagcattctgtgaggaagtagagcctcaggatgctttccaaggaaagagttccacggtcatataaattt

SEQ ID NO: 42474 - DNA, 570 bp, Homo sapiens
  misc_feature 1..570: note = chr10:5874775-5875345
  misc_feature 1..570: note = hypo
  source 1..570: mol_type = genomic DNA
tcagcagttcaaaaccgtgctgacctgccagtacaagcaggccttgaggtcagtaaaaggtaacattacagacatcaaaagcaaattaaaaacccacagcctcagagaataactcctgatgccagctccttctcatggcaccccctgccccatcccaccagtgtcaggtcacaaagccccacactgcgccgggtggggatttaagattcccgctcccccacccctgccaccctgtagaacaaggcgctgccactcaagccagttccctgagaaccagtcggaccaggacaggcccctgaccacacccggcaaactggagtcctggccaaaggtgctgtgagtccatgaggtgctggcagggaggtgctcagaggagggtgcgcagaggcggagggagccaggatggaggctgcagggagcaggggcaggcaggcacggcagggaccacgagctcctgggatgcagacaagacttgcgggggtgcacggagacagagcaatttccccagtactttgttgccacgtttttgtgctgatggcatcagatgaaagagaaaaggggccgggcgca

SEQ ID NO: 42475 - DNA, 48 bp, Homo sapiens
  misc_feature 1..48: note = chr10:5952951-5952999
  misc_feature 1..48: note = hypo
  source 1..48: mol_type = genomic DNA
gtgaatgacatccagcgactgctcttctgcctccggagacccagctcc

SEQ ID NO: 42476 - DNA, 45 bp, Homo sapiens
  misc_feature 1..45: note = chr10:6003482-6003527
  misc_feature 1..45: note = hypo
  source 1..45: mol_type = genomic DNA
tgcgctggccgaggacgctcggagcggctgcgtgtgaaacacggg

SEQ ID NO: 42477 - DNA, 21 bp, Homo sapiens
  misc_feature 1..21: note = chr10:6009743-6009764
  misc_feature 1..21: note = hypo
  source 1..21: mol_type = genomic DNA
gggtgcggtagctcacgcctg

SEQ ID NO: 42478 - DNA, 30 bp, Homo sapiens
  misc_feature 1..30: note = chr10:6024581-6024611
  misc_feature 1..30: note = hypo
  source 1..30: mol_type = genomic DNA
ctgcagtggcaacaacgttgctttctgggc

SEQ ID NO: 42479 - DNA, 205 bp, Homo sapiens; identical to SEQ ID NO: 15336
  misc_feature 1..205: note = chr10:6042309-6042514
  misc_feature 1..205: note = hypo
  source 1..205: mol_type = genomic DNA

SEQ ID NO: 42480 - DNA, 24 bp, Homo sapiens
  misc_feature 1..24: note = chr10:6127024-6127048
  misc_feature 1..24: note = hypo
  source 1..24: mol_type = genomic DNA
gagccaccgcgcccagccttcttt

SEQ ID NO: 42481 - DNA, 159 bp, Homo sapiens
  misc_feature 1..159: note = chr10:6159807-6159966
  misc_feature 1..159: note = hypo
  source 1..159: mol_type = genomic DNA
gaacttccttgtttccctcctccccgcaagagactagaaacttgctttcccagcctgtcttgcaggttgagtagggttgtgcgcttgggatctctgatcagaccggcaccgcagtgtgggagagaagctgtgtgaagagtctgtcgtctgactttggca

SEQ ID NO: 42482 - DNA, 87 bp, Homo sapiens
  misc_feature 1..87: note = chr10:6162138-6162225
  misc_feature 1..87: note = hypo
  source 1..87: mol_type = genomic DNA
ttttatggcacttgacgctggtaaccactcccttcccgaggacggagaccgcggccctgccagtatcgctcacgctttacctcttcc

SEQ ID NO: 42483 - DNA, 24 bp, Homo sapiens
  misc_feature 1..24: note = chr10:6199196-6199220
  misc_feature 1..24: note = hypo
  source 1..24: mol_type = genomic DNA
tttttttttttgagacggagtctc

SEQ ID NO: 42484 - DNA, 133 bp, Homo sapiens
  misc_feature 1..133: note = chr10:6462190-6462323
  misc_feature 1..133: note = hypo
  source 1..133: mol_type = genomic DNA
cacccgcctaggcctcgaaatctccttttaatacacttaaacacaccatgccttcgaatctgtgagttgggcttcttccctaagggagctgctttgtgtggacgctccactcccttgccgtctgactggttgt

SEQ ID NO: 42485 - DNA, 186 bp, Homo sapiens
  misc_feature 1..186: note = chr10:6505370-6505556
  misc_feature 1..186: note = hypo
  source 1..186: mol_type = genomic DNA
taagtgaattctttccggcatgaaaaatgcccgatgatttctctgctgcagaaatccagtaaaattacctctgggtgcattgctgaggtttcccagagcaatgatctcagcagagtgctacccactagatgtgataaacagccattccagccagggattttaagaagctggcggaccaaatccatt

SEQ ID NO: 42486 - DNA, 30 bp, Homo sapiens
  misc_feature 1..30: note = chr10:6528008-6528038
  misc_feature 1..30: note = hypo
  source 1..30: mol_type = genomic DNA
ctcaatcatggccagcgcttcagccattag

SEQ ID NO: 42487 - DNA, 140 bp, Homo sapiens
  misc_feature 1..140: note = chr10:6531036-6531176
  misc_feature 1..140: note = hypo
  source 1..140: mol_type = genomic DNA
ccggcctaaaatctttactatagaaaggatttttttttttcatgattgtgctccaaattccacattgtcggcaaaactcgcataactcacattcgccctatttagaaggtgtcaggtttcaacttcggtagccccagctc

SEQ ID NO: 42488 - DNA, 15 bp, Homo sapiens
  misc_feature 1..15: note = chr10:6564170-6564185
  misc_feature 1..15: note = hypo
  source 1..15: mol_type = genomic DNA
cgggattacaagagt

SEQ ID NO: 42489 - DNA, 118 bp, Homo sapiens
  misc_feature 1..118: note = chr10:6577643-6577761
  misc_feature 1..118: note = hypo
  source 1..118: mol_type = genomic DNA
tgtttcaaaacagcccgtgtccacctcccctcttggtcttttgaagtctcccctcgccgcgcctctttagacgcacctgagatccatcaaagcggacagatcccgattacagtcccct

SEQ ID NO: 42490 - DNA, 21 bp, Homo sapiens
  misc_feature 1..21: note = chr10:6586866-6586887
  misc_feature 1..21: note = hypo
  source 1..21: mol_type = genomic DNA
ccactgcgcccagacccacat

SEQ ID NO: 42491 - DNA, 171 bp, Homo sapiens
  misc_feature 1..171: note = chr10:7139938-7140109
  misc_feature 1..171: note = hypo
  source 1..171: mol_type = genomic DNA
tgctgccagtgcctccgggagcccagctcctccagcggggttctctccagatccttgcagaccccaaacagagagatgatggggcctgcagaccttgcctggctgtcagaaattttccacccgctgaagaggtggctggcagtggtctacgctctgcgtgtggccttccta

SEQ ID NO: 42492 - DNA, 65 bp, Homo sapiens
  misc_feature 1..65: note = chr10:7203062-7203127
  misc_feature 1..65: note = hypo
  source 1..65: mol_type = genomic DNA
acggagagtcttgggcgcttggctccacgggaagcaaacactttcccctgcgacagtggctgtat

SEQ ID NO: 42493 - DNA, 82 bp, Homo sapiens; identical to SEQ ID NO: 15342
  misc_feature 1..82: note = chr10:7205705-7205787
  misc_feature 1..82: note = hypo
  source 1..82: mol_type = genomic DNA

SEQ ID NO: 42494 - DNA, 364 bp, Homo sapiens
  misc_feature 1..364: note = chr10:7212745-7213109
  misc_feature 1..364: note = hypo
  source 1..364: mol_type = genomic DNA
gagggagaagggtctcgcacacctgccgagcagcgccgaagaaccccctcgcaggtgtcacgaggaagccggctaggacacgaggttcatttcagatgcagagtctcagcacatcaaacaatcgacacgcggcaaccaccgtacctgctcctgaaatatcttggccaagggggcacagtctgtcagcttaatgaacctcaccacgtcggtgaccgtccactccaacgggttgctctccagaaccagtctctcctcctcctcctgtttcgtgtcctgcagagaaagggcaggaggagctcagctgcggcacagtcagctggctgggtcctctccagcactctccaggcctcggccgttcctggcc

SEQ ID NO: 42495 - DNA, 30 bp, Homo sapiens; identical to SEQ ID NO: 15344
  misc_feature 1..30: note = chr10:7213658-7213688
  misc_feature 1..30: note = hypo
  source 1..30: mol_type = genomic DNA

SEQ ID NO: 42496 - DNA, 108 bp, Homo sapiens
  misc_feature 1..108: note = chr10:7214167-7214275
  misc_feature 1..108: note = hypo
  source 1..108: mol_type = genomic DNA
gtagcggtggccccgcggtcagaccctgggcccagtgcagaccacctagcaaaccctcggaaatggagccagtggtcccacccgtgggccctacgaggcccttcccag

SEQ ID NO: 42497 - DNA, 30 bp, Homo sapiens
  misc_feature 1..30: note = chr10:7215974-7216004
  misc_feature 1..30: note = hypo
  source 1..30: mol_type = genomic DNA
ccacctcctcccctgcgtttgatcacagca

SEQ ID NO: 42498 - DNA, 155 bp, Homo sapiens
  misc_feature 1..155: note = chr10:7236090-7236245
  misc_feature 1..155: note = hypo
  source 1..155: mol_type = genomic DNA
cgccaaggcctgcttcgttctgagtttgcttatggggtacgtctggacctcagtggaccattgagtgactctggttccagcttctcccaggtcccctacctcccctcgctgcaccccctcgaattgaggccagacacgctcgtggtcctgccaaa

SEQ ID NO: 42499 - DNA, 30 bp, Homo sapiens
  misc_feature 1..30: note = chr10:7258531-7258561
  misc_feature 1..30: note = hypo
  source 1..30: mol_type = genomic DNA
ggctcaagtgactaccgagctatcttgctg

SEQ ID NO: 42500 - DNA, 22 bp, Homo sapiens
  misc_feature 1..22: note = chr10:7288388-7288410
  misc_feature 1..22: note = hypo
  source 1..22: mol_type = genomic DNA
gaatgtgagagaggccgggtgc

SEQ ID NO: 42501 - DNA, 37 bp, Homo sapiens
  misc_feature 1..37: note = chr10:7290469-7290506
  misc_feature 1..37: note = hypo
  source 1..37: mol_type = genomic DNA
ctctaggggctgggtcgaagagcgagggaggaaaacc

SEQ ID NO: 42502 - DNA, 70 bp, Homo sapiens
  misc_feature 1..70: note = chr10:7339992-7340062
  misc_feature 1..70: note = hypo
  source 1..70: mol_type = genomic DNA
aggcctggaggtggtcgtgctgctgttggctgctcgcccagcacccagaggccctcgcagcttgtccttc

SEQ ID NO: 42503 - DNA, 30 bp, Homo sapiens
  misc_feature 1..30: note = chr10:7391910-7391940
  misc_feature 1..30: note = hypo
  source 1..30: mol_type = genomic DNA
gaggcaataaggctacgtcagcacctcata

SEQ ID NO: 42504 - DNA, 23 bp, Homo sapiens
  misc_feature 1..23: note = chr10:7414166-7414189
  misc_feature 1..23: note = hypo
  source 1..23: mol_type = genomic DNA
gccacgcccggccttcttgaaat

SEQ ID NO: 42505 - DNA, 44 bp, Homo sapiens
  misc_feature 1..44: note = chr10:7414544-7414588
  misc_feature 1..44: note = hypo
  source 1..44: mol_type = genomic DNA
ccaagaagtttagagcgtcacagacacagcgaagtgaactagag

SEQ ID NO: 42506 - DNA, 34 bp, Homo sapiens
  misc_feature 1..34: note = chr10:7472551-7472585
  misc_feature 1..34: note = hypo
  source 1..34: mol_type = genomic DNA
gagaaatggacatagcggccgagcacggtggctc

SEQ ID NO: 42507 - DNA, 30 bp, Homo sapiens
  misc_feature 1..30: note = chr10:7608124-7608154
  misc_feature 1..30: note = hypo
  source 1..30: mol_type = genomic DNA
tgacggtgacattggcgttggcagacacgg

SEQ ID NO: 42508 - DNA, 58 bp, Homo sapiens
  misc_feature 1..58: note = chr10:7765067-7765125
  misc_feature 1..58: note = hypo
  source 1..58: mol_type = genomic DNA
tggtgtggtgtggagcggagtgccctggcatggcgtggagtggcgtggcgtggagtgg

SEQ ID NO: 42509 - DNA, 30 bp, Homo sapiens
  misc_feature 1..30: note = chr10:7780425-7780455
  misc_feature 1..30: note = hypo
  source 1..30: mol_type = genomic DNA
atgacagagggagcccgagagaactctgga

SEQ ID NO: 42510 - DNA, 34 bp, Homo sapiens
  misc_feature 1..34: note = chr10:7985160-7985194
  misc_feature 1..34: note = hypo
  source 1..34: mol_type = genomic DNA
cttgaatgaaacaggcgctcgatgttggcctcac

SEQ ID NO: 42511 - DNA, 30 bp, Homo sapiens
  misc_feature 1..30: note = chr10:8025070-8025100
  misc_feature 1..30: note = hypo
  source 1..30: mol_type = genomic DNA
ctcatctggcctctgcggtggcagaggtgg

SEQ ID NO: 42512 - DNA, 30 bp, Homo sapiens
  misc_feature 1..30: note = chr10:8067803-8067833
  misc_feature 1..30: note = hypo
  source 1..30: mol_type = genomic DNA
gcagaagcacacctacgtttgtgtatatgg

SEQ ID NO: 42513 - DNA, 30 bp, Homo sapiens
  misc_feature 1..30: note = chr10:10770967-10770997
  misc_feature 1..30: note = hypo
  source 1..30: mol_type = genomic DNA
agacatgtaaagcgccggctgtatgtggga

SEQ ID NO: 42514 - DNA, 35 bp, Homo sapiens
  misc_feature 1..35: note = chr10:10867443-10867478
  misc_feature 1..35: note = hypo
  source 1..35: mol_type = genomic DNA
attacaggcatgagccaccgcgcccagctggatac

SEQ ID NO: 42515 - DNA, 30 bp, Homo sapiens
  misc_feature 1..30: note = chr10:11344374-11344404
  misc_feature 1..30: note = hypo
  source 1..30: mol_type = genomic DNA
agccccaggtggtgccgatgcgggcgaggc

SEQ ID NO: 42516 - DNA, 136 bp, Homo sapiens
  misc_feature 1..136: note = chr10:11357646-11357782
  misc_feature 1..136: note = hypo
  source 1..136: mol_type = genomic DNA
aagtggtagctgtgccgcggcctcattgttttattccagttagaaccgcctccagctttgacttttccagcagccaagtaggagcctcactgccttgacccccatttccggtacagctcctcgctctgaccttgtc

SEQ ID NO: 42517 - DNA, 151 bp, Homo sapiens
  misc_feature 1..151: note = chr10:11472842-11472993
  misc_feature 1..151: note = hypo
  source 1..151: mol_type = genomic DNA
taaaccctttggcaacgacacacggctccgagaacacacgcatgaataaataaaaccaatactctgctgctgagacatcgctacatccagaaggacccagagcaacagacgcagagaaaagcaacatggaccaccgcggcctgacagcagg

SEQ ID NO: 42518 - DNA, 30 bp, Homo sapiens
  misc_feature 1..30: note = chr10:11486576-11486606
  misc_feature 1..30: note = hypo
  source 1..30: mol_type = genomic DNA
caggggtcctggccccgcccccccgtctcc

SEQ ID NO: 42519 - DNA, 30 bp, Homo sapiens
  misc_feature 1..30: note = chr10:12139715-12139745
  misc_feature 1..30: note = hypo
  source 1..30: mol_type = genomic DNA
gcacctcattgctggcggactcatgacgca

SEQ ID NO: 42520 - DNA, 47 bp, Homo sapiens
  misc_feature 1..47: note = chr10:12531976-12532023
  misc_feature 1..47: note = hypo
  source 1..47: mol_type = genomic DNA
tggggcaggtgtgaacggggcaggcacactcacgggtctgggctctg

SEQ ID NO: 42521 - DNA, 29 bp, Homo sapiens
  misc_feature 1..29: note = chr10:12554507-12554536
  misc_feature 1..29: note = hypo
  source 1..29: mol_type = genomic DNA
cctcagcagctgcccgttgggagactcgg

SEQ ID NO: 42522 - DNA, 30 bp, Homo sapiens
  misc_feature 1..30: note = chr10:12844882-12844912
  misc_feature 1..30: note = hypo
  source 1..30: mol_type = genomic DNA
cagaaaaatcatgaccgtctgactgcagag

SEQ ID NO: 42523 - DNA, 17 bp, Homo sapiens
  misc_feature 1..17: note = chr10:13130744-13130761
  misc_feature 1..17: note = hypo
  source 1..17: mol_type = genomic DNA
gggcgcagtggctcacg

SEQ ID NO: 42524 - DNA, 78 bp, Homo sapiens
  misc_feature 1..78: note = chr10:13137622-13137700
  misc_feature 1..78: note = hypo
  source 1..78: mol_type = genomic DNA
tgctcacctcctgctgttcggtctagttcctgagaggccacaggccagtactggttcaccacccggggtttggggacc

SEQ ID NO: 42525 - DNA, 30 bp, Homo sapiens
  misc_feature 1..30: note = chr10:13140531-13140561
  misc_feature 1..30: note = hypo
  source 1..30: mol_type = genomic DNA
accccttacaggccccggggggaccctttt

SEQ ID NO: 42526 - DNA, 23 bp, Homo sapiens
  misc_feature 1..23: note = chr10:13140997-13141020
  misc_feature 1..23: note = hypo
  source 1..23: mol_type = genomic DNA
agccaccgcgcctggccctcctg

SEQ ID NO: 42527 - DNA, 126 bp, Homo sapiens; identical to SEQ ID NO: 15352
  misc_feature 1..126: note = chr10:13355078-13355204
  misc_feature 1..126: note = hypo
  source 1..126: mol_type = genomic DNA

SEQ ID NO: 42528 - DNA, 43 bp, Homo sapiens
  misc_feature 1..43: note = chr10:13426126-13426169
  misc_feature 1..43: note = hypo
  source 1..43: mol_type = genomic DNA
gattacaggcgtgcgccaccgcgcccagcggagtatggtagac

SEQ ID NO: 42529 - DNA, 149 bp, Homo sapiens
  misc_feature 1..149: note = chr10:13751257-13751406
  misc_feature 1..149: note = hypo
  source 1..149: mol_type = genomic DNA
ccaactcaggctctaagctgctggacctgacacaagttacagcatttcctttagcctcagttttcccctctgtaaaatggcaaaaataacccctctaaggtagatctcagcagccacagatcgtagcacagtaccggcacaaagtgacc

SEQ ID NO: 42530 - DNA, 161 bp, Homo sapiens
  misc_feature 1..161: note = chr10:13898478-13898639
  misc_feature 1..161: note = hypo
  source 1..161: mol_type = genomic DNA
cacaaccaatcacagcgaggtgtggccatgtcataagaaagaaacgcagtacagactaggcggagggggtcagggaaagccttggtggagggtgtcttccaatttgtgatgtaaagacctaagagagaccagccaggtccagggcgcgggggtgtgggaag

SEQ ID NO: 42531 - DNA, 86 bp, Homo sapiens
  misc_feature 1..86: note = chr10:14997207-14997293
  misc_feature 1..86: note = hypo
  source 1..86: mol_type = genomic DNA
attgtacctggctttccaggcctccataacacttgaagtcccactttgtgcacagcactgtgacaaaccttcgggtagcattcaat

SEQ ID NO: 42532 - DNA, 38 bp, Homo sapiens
  misc_feature 1..38: note = chr10:15000601-15000639
  misc_feature 1..38: note = hypo
  source 1..38: mol_type = genomic DNA
aacatgtaaattggccgggcgcggtggctcacgcctgt

SEQ ID NO: 42533 - DNA, 98 bp, Homo sapiens
  misc_feature 1..98: note = chr10:15003062-15003160
  misc_feature 1..98: note = hypo
  source 1..98: mol_type = genomic DNA
ctcctcaatttaactatgggattatgtcccaatacacccatggtaggtcgaaaatgcatttaatgcacctagccaactttaaacgtcctcagaacact

SEQ ID NO: 42534 - DNA, 19 bp, Homo sapiens
  misc_feature 1..19: note = chr10:15131223-15131242
  misc_feature 1..19: note = hypo
  source 1..19: mol_type = genomic DNA
taaatatgtattggccggg

SEQ ID NO: 42535 - DNA, 30 bp, Homo sapiens
  misc_feature 1..30: note = chr10:15255872-15255902
  misc_feature 1..30: note = hypo
  source 1..30: mol_type = genomic DNA
tgtcattgacctggtcgacagaactgcagc

SEQ ID NO: 42536 - DNA, 30 bp, Homo sapiens
  misc_feature 1..30: note = chr10:15484112-15484142
  misc_feature 1..30: note = hypo
  source 1..30: mol_type = genomic DNA
gggaactttccagctcggcctctacttacc

SEQ ID NO: 42537 - DNA, 25 bp, Homo sapiens
  misc_feature 1..25: note = chr10:15568453-15568478
  misc_feature 1..25: note = hypo
  source 1..25: mol_type = genomic DNA
tgtgagccaccgcacccggcccatt

SEQ ID NO: 42538 - DNA, 29 bp, Homo sapiens
  misc_feature 1..29: note = chr10:15783189-15783218
  misc_feature 1..29: note = hypo
  source 1..29: mol_type = genomic DNA
tgagccactatgcccggccgtgattatta

SEQ ID NO: 42539 - DNA, 16 bp, Homo sapiens
  misc_feature 1..16: note = chr10:15932019-15932035
  misc_feature 1..16: note = hypo
  source 1..16: mol_type = genomic DNA
acgatgccaagcatta

SEQ ID NO: 42540 - DNA, 30 bp, Homo sapiens
  misc_feature 1..30: note = chr10:16714330-16714360
  misc_feature 1..30: note = hypo
  source 1..30: mol_type = genomic DNA
ctgccatatgacccacgcattccactccta

SEQ ID NO: 42541 - DNA, 30 bp, Homo sapiens; identical to SEQ ID NO: 15355
  misc_feature 1..30: note = chr10:16715583-16715613
  misc_feature 1..30: note = hypo
  source 1..30: mol_type = genomic DNA

SEQ ID NO: 42542 - DNA, 96 bp, Homo sapiens; identical to SEQ ID NO: 15356
  misc_feature 1..96: note = chr10:17429165-17429261
  misc_feature 1..96: note = hypo
  source 1..96: mol_type = genomic DNA

SEQ ID NO: 42543 - DNA, 96 bp, Homo sapiens; identical to SEQ ID NO: 15357
  misc_feature 1..96: note = chr10:17429561-17429657
  misc_feature 1..96: note = hypo
  source 1..96: mol_type = genomic DNA

SEQ ID NO: 42544 - DNA, 95 bp, Homo sapiens
  misc_feature 1..95: note = chr10:17579985-17580080
  misc_feature 1..95: note = hypo
  source 1..95: mol_type = genomic DNA
agactctgtctcaaagaaaaagaaattaaatgtgaagaaagttctgtaaaagtagcaagaatacagatgcttttctttcccgtatccctcctcca

SEQ ID NO: 42545 - DNA, 139 bp, Homo sapiens
  misc_feature 1..139: note = chr10:20069005-20069144
  misc_feature 1..139: note = hypo
  source 1..139: mol_type = genomic DNA
caataacatgctgtgcgatattgtagcctaggagcaacagactattcattccatataacctggatgtgtaggaggctctaccatctaggtttgtgtaagtacacccaaggatgtttgtcaacaacgaaatcacctatcg

SEQ ID NO: 42546 - DNA, 137 bp, Homo sapiens
  misc_feature 1..137: note = chr10:22033212-22033349
  misc_feature 1..137: note = hypo
  source 1..137: mol_type = genomic DNA
tctcttctcccaaggcgaaggattaccttccctctagaatgacaggtgactcatccatcaactcctgcgagtttaattcctcaacatgtgtcctttgccttagctgcatgtttgtaagtgtccgcttctgtagctct

SEQ ID NO: 42547 - DNA, 41 bp, Homo sapiens
  misc_feature 1..41: note = chr10:22450029-22450070
  misc_feature 1..41: note = hypo
  source 1..41: mol_type = genomic DNA
tatttaagaagaagtcggggccgggttcggtggctcatgcc

SEQ ID NO: 42548 - DNA, 33 bp, Homo sapiens
  misc_feature 1..33: note = chr10:22567375-22567408
  misc_feature 1..33: note = hypo
  source 1..33: mol_type = genomic DNA
cagtgttcgagcgggcagcgggagtgagcatag

SEQ ID NO: 42549 - DNA, 30 bp, Homo sapiens
  misc_feature 1..30: note = chr10:22823530-22823560
  misc_feature 1..30: note = hypo
  source 1..30: mol_type = genomic DNA
caccaagtggaatgccgttaagtctgctat

SEQ ID NO: 42550 - DNA, 30 bp, Homo sapiens
  misc_feature 1..30: note = chr10:22833980-22834010
  misc_feature 1..30: note = hypo
  source 1..30: mol_type = genomic DNA
ctttcactgcattcccgaatcccggcaggc

SEQ ID NO: 42551 - DNA, 30 bp, Homo sapiens
  misc_feature 1..30: note = chr10:22870025-22870055
  misc_feature 1..30: note = hypo
  source 1..30: mol_type = genomic DNA
gcatgaacacaataccgaagagtgttcctt

SEQ ID NO: 42552 - DNA, 41 bp, Homo sapiens
  misc_feature 1..41: note = chr10:24841812-24841853
  misc_feature 1..41: note = hypo
  source 1..41: mol_type = genomic DNA
aggtataattattaccgtgccatgcacgcacccatcagcag

SEQ ID NO: 42553 - DNA, 24 bp, Homo sapiens
  misc_feature 1..24: note = chr10:24842550-24842574
  misc_feature 1..24: note = hypo
  source 1..24: mol_type = genomic DNA
caggaaagggccaggcgaggtggc

SEQ ID NO: 42554 - DNA, 30 bp, Homo sapiens
  misc_feature 1..30: note = chr10:24908432-24908462
  misc_feature 1..30: note = hypo
  source 1..30: mol_type = genomic DNA
aggcggactggtactcgaggcttttctttc

SEQ ID NO: 42555 - DNA, 42 bp, Homo sapiens
  misc_feature 1..42: note = chr10:24988521-24988563
  misc_feature 1..42: note = hypo
  source 1..42: mol_type = genomic DNA
gggattacaggcatgagtcaccgtgcccggcctagaattact

SEQ ID NO: 42556 - DNA, 148 bp, Homo sapiens
  misc_feature 1..148: note = chr10:25592447-25592595
  misc_feature 1..148: note = hypo
  source 1..148: mol_type = genomic DNA
aatgactcatcttcccgaaataccttgagagcatcttaggaataatagtggcgcaaaccgttaataagttaatatgtgttatatgaacattgtctttcttggcagtcaaactccgcctttatcaaaataaattcgatgataacccctt

SEQ ID NO: 42557 - DNA, 32 bp, Homo sapiens
  misc_feature 1..32: note = chr10:26127993-26128025
  misc_feature 1..32: note = hypo
  source 1..32: mol_type = genomic DNA
agaaaagcacttccacggcctggcgcggtggc

SEQ ID NO: 42558 - DNA, 30 bp, Homo sapiens
  misc_feature 1..30: note = chr10:26211012-26211042
  misc_feature 1..30: note = hypo
  source 1..30: mol_type = genomic DNA
tttaagaccaggtctcggccgggtgtggtg

SEQ ID NO: 42559 - DNA, 80 bp, Homo sapiens
  misc_feature 1..80: note = chr10:26638401-26638481
  misc_feature 1..80: note = hypo
  source 1..80: mol_type = genomic DNA
aatattgggggcaggttcccccaatactggcatctataggaaatgtatatgagggatggaagagacgagaggtggggaga

SEQ ID NO: 42560 - DNA, 30 bp, Homo sapiens
  misc_feature 1..30: note = chr10:26720842-26720872
  misc_feature 1..30: note = hypo
  source 1..30: mol_type = genomic DNA
actataattcatgatcgccagtttcaaatg

SEQ ID NO: 42561 - DNA, 132 bp, Homo sapiens
  misc_feature 1..132: note = chr10:26733284-26733416
  misc_feature 1..132: note = hypo
  source 1..132: mol_type = genomic DNA
aggattctgagaaggcgaataacatgatctgacttaaggctcactctgactgcttgagaataaacctgggggagcagaggtgaaagcaaggaacccatgacaaagcgttggattctgcgtatattttgaagg

SEQ ID NO: 42562 - DNA, 30 bp, Homo sapiens; identical to SEQ ID NO: 15362
  misc_feature 1..30: note = chr10:26739045-26739075
  misc_feature 1..30: note = hypo
  source 1..30: mol_type = genomic DNA

SEQ ID NO: 42563 - DNA, 21 bp, Homo sapiens
  misc_feature 1..21: note = chr10:26791280-26791301
  misc_feature 1..21: note = hypo
  source 1..21: mol_type = genomic DNA
gtctcttgggccaggcgtggt

SEQ ID NO: 42564 - DNA, 39 bp, Homo sapiens
  misc_feature 1..39: note = chr10:26801561-26801600
  misc_feature 1..39: note = hypo
  source 1..39: mol_type = genomic DNA
gtcttgctctatcaccgaagctacagtgcaatggcgcaa

SEQ ID NO: 42565 - DNA, 99 bp, Homo sapiens
  misc_feature 1..99: note = chr10:26801660-26801759
  misc_feature 1..99: note = hypo
  source 1..99: mol_type = genomic DNA
gagtagctgggactataggcacacatcatcatatttctcatttttaataatgggacagtcgtctctcaggagagctgggtgggacggagaattgcctgt

SEQ ID NO: 42566 - DNA, 20 bp, Homo sapiens
  misc_feature 1..20: note = chr10:26832097-26832117
  misc_feature 1..20: note = hypo
  source 1..20: mol_type = genomic DNA
atgtttgttgaatgacggcc

SEQ ID NO: 42567 - DNA, 41 bp, Homo sapiens
  misc_feature 1..41: note = chr10:26877719-26877760
  misc_feature 1..41: note = hypo
  source 1..41: mol_type = genomic DNA
atacaggagcagaggcgcccagaacacgctgtcccccaatg

SEQ ID NO: 42568 - DNA, 21 bp, Homo sapiens
  misc_feature 1..21: note = chr10:26907322-26907343
  misc_feature 1..21: note = hypo
  source 1..21: mol_type = genomic DNA
agccaccgcacccggcccaaa

SEQ ID NO: 42569 - DNA, 30 bp, Homo sapiens; identical to SEQ ID NO: 15364
  misc_feature 1..30: note = chr10:26926812-26926842
  misc_feature 1..30: note = hypo
  source 1..30: mol_type = genomic DNA

SEQ ID NO: 42570 - DNA, 45 bp, Homo sapiens
  misc_feature 1..45: note = chr10:26942249-26942294
  misc_feature 1..45: note = hypo
  source 1..45: mol_type = genomic DNA
gacccccctggacttcgtgctccctcccctcgctgtcgccaagag

SEQ ID NO: 42571 - DNA, 22 bp, Homo sapiens
  misc_feature 1..22: note = chr10:28791009-28791031
  misc_feature 1..22: note = hypo
  source 1..22: mol_type = genomic DNA
gccaccacgccctgccagtatg

SEQ ID NO: 42572 - DNA, 30 bp, Homo sapiens
  misc_feature 1..30: note = chr10:29164934-29164964
  misc_feature 1..30: note = hypo
  source 1..30: mol_type = genomic DNA
gaaacagcgattacacggtaggtatttctt

SEQ ID NO: 42573 - DNA, 32 bp, Homo sapiens
  misc_feature 1..32: note = chr10:31006068-31006100
  misc_feature 1..32: note = hypo
  source 1..32: mol_type = genomic DNA
ctcctttcactgagtcgcggggcgcttctccc

SEQ ID NO: 42574 - DNA, 208 bp, Homo sapiens
  misc_feature 1..208: note = chr10:31892881-31893089
  misc_feature 1..208: note = hypo
  source 1..208: mol_type = genomic DNA
catgctgcaaattcccgtggccagcacccgaggcctgctggctccgatctgggccacgtgtacaaccaggtgtgcccccttagcctcacgccctcctcctgttgcctccccatccctctagccttcgggacttggggttgcaatgaatcttaggttttttccaggagtcttttattcctccagcgtctccgtgcgcctgtccgctcca

SEQ ID NO: 42575 - DNA, 16 bp, Homo sapiens
  misc_feature 1..16: note = chr10:32171091-32171107
  misc_feature 1..16: note = hypo
  source 1..16: mol_type = genomic DNA
tcggcctcccaaagtg

SEQ ID NO: 42576 - DNA, 151 bp, Homo sapiens
  misc_feature 1..151: note = chr10:32499025-32499176
  misc_feature 1..151: note = hypo
  source 1..151: mol_type = genomic DNA
caaattctccagtcccgcctcagacctactgaagcggacacactgtgggtgctgcccagcaatctaggttttaacaagccctccagggcattctgaagcgctggtaaattgagaactgttgctttagattttcgaacgtggttgaactgta

SEQ ID NO: 42577 - DNA, 30 bp, Homo sapiens
  misc_feature 1..30: note = chr10:32638913-32638943
  misc_feature 1..30: note = hypo
  source 1..30: mol_type = genomic DNA
attcttttatctgtccgaaagattccttga

SEQ ID NO: 42578 - DNA, 21 bp, Homo sapiens
  misc_feature 1..21: note = chr10:32736537-32736558
  misc_feature 1..21: note = hypo
  source 1..21: mol_type = genomic DNA
taaaagggagcagggcgcaca

SEQ ID NO: 42579 - DNA, 30 bp, Homo sapiens
  misc_feature 1..30: note = chr10:33233494-33233524
  misc_feature 1..30: note = hypo
  source 1..30: mol_type = genomic DNA
caaaggaaactcatccgagatgatgtcatg

SEQ ID NO: 42580 - DNA, 31 bp, Homo sapiens; identical to SEQ ID NO: 15367
  misc_feature 1..31: note = chr10:38078895-38078926
  misc_feature 1..31: note = hypo
  source 1..31: mol_type = genomic DNA

SEQ ID NO: 42581 - DNA, 61 bp, Homo sapiens
  misc_feature 1..61: note = chr10:38445833-38445894
  misc_feature 1..61: note = hypo
  source 1..61: mol_type = genomic DNA
agaggggtcctggctcggcctggaatggggctcggggagggtcagacggtctattgggctc

SEQ ID NO: 42582 - DNA, 30 bp, Homo sapiens
  misc_feature 1..30: note = chr10:42777495-42777525
  misc_feature 1..30: note = hypo
  source 1..30: mol_type = genomic DNA
tctaaaactactccacggccgaggaactgc

SEQ ID NO: 42583 - DNA, 30 bp, Homo sapiens
  misc_feature 1..30: note = chr10:43047017-43047047
  misc_feature 1..30: note = hypo
  source 1..30: mol_type = genomic DNA
tacagacctttcttgcggctgcacctctga

SEQ ID NO: 42584 - DNA, 36 bp, Homo sapiens
  misc_feature 1..36: note = chr10:43265217-43265253
  misc_feature 1..36: note = hypo
  source 1..36: mol_type = genomic DNA
ggcgtggcctcctggcgcgggcgtggcagggcagca

SEQ ID NO: 42585 - DNA, 30 bp, Homo sapiens
  misc_feature 1..30: note = chr10:43615515-43615545
  misc_feature 1..30: note = hypo
  source 1..30: mol_type = genomic DNA
tttttcctcacagctcgttcatcgggactt

SEQ ID NO: 42586 - DNA, 54 bp, Homo sapiens
  misc_feature 1..54: note = chr10:43858319-43858373
  misc_feature 1..54: note = hypo
  source 1..54: mol_type = genomic DNA
gagtccagtagtcctcgtggagacagctgggaaaggcctcggggcaagggacct

SEQ ID NO: 42587 - DNA, 45 bp, Homo sapiens
  misc_feature 1..45: note = chr10:43905839-43905884
  misc_feature 1..45: note = hypo
  source 1..45: mol_type = genomic DNA
gccctgtcattcaggcgggagtgcagtggtacaatcacggctcac

SEQ ID NO: 42588 - DNA, 44 bp, Homo sapiens
  misc_feature 1..44: note = chr10:43906064-43906108
  misc_feature 1..44: note = hypo
  source 1..44: mol_type = genomic DNA
tactggattgagccacgcatctggctgaacgttattttttaaat

SEQ ID NO: 42589 - DNA, 118 bp, Homo sapiens
  misc_feature 1..118: note = chr10:44197833-44197951
  misc_feature 1..118: note = hypo
  source 1..118: mol_type = genomic DNA
cgagctgcccccccacgctgccaccggcgctgccacctgcccatatccccgccttccgcagaggcttcagcctcccctgtacagaggcggggcatggagccggcggctttcagaactc

SEQ ID NO: 42590 - DNA, 30 bp, Homo sapiens
  misc_feature 1..30: note = chr10:44433895-44433925
  misc_feature 1..30: note = hypo
  source 1..30: mol_type = genomic DNA
aggagacagaagccacgcaataatttggac

SEQ ID NO: 42591 - DNA, 37 bp, Homo sapiens
  misc_feature 1..37: note = chr10:44500784-44500821
  misc_feature 1..37: note = hypo
  source 1..37: mol_type = genomic DNA
cgggctctggaagtccgctgttcggggtaaattggca

SEQ ID NO: 42592 - DNA, 86 bp, Homo sapiens
  misc_feature 1..86: note = chr10:44547328-44547414
  misc_feature 1..86: note = hypo
  source 1..86: mol_type = genomic DNA
tatttctggcactcacggtgctgaactcgtttcagctgagtaagcactagtgactcaactccaaggcacaccgtagacttcatctc

SEQ ID NO: 42593 - DNA, 38 bp, Homo sapiens
  misc_feature 1..38: note = chr10:44594208-44594246
  misc_feature 1..38: note = hypo
  source 1..38: mol_type = genomic DNA
aggacattacaaggccggatgcagtggcttatgcctgt

SEQ ID NO: 42594 - DNA, 34 bp, Homo sapiens
  misc_feature 1..34: note = chr10:44869035-44869069
  misc_feature 1..34: note = hypo
  source 1..34: mol_type = genomic DNA
actgggcgtggcagacgcacgaaggcacagagag

SEQ ID NO: 42595 - DNA, 30 bp, Homo sapiens
  misc_feature 1..30: note = chr10:46009848-46009878
  misc_feature 1..30: note = hypo
  source 1..30: mol_type = genomic DNA
ccctgtgcttgatgccggggaacaggcgct

SEQ ID NO: 42596 - DNA, 28 bp, Homo sapiens
  misc_feature 1..28: note = chr10:46221028-46221056
  misc_feature 1..28: note = hypo
  source 1..28: mol_type = genomic DNA
acaaacaaacaaacgacaacaaaaaaaa

SEQ ID NO: 42597 - DNA, 162 bp, Homo sapiens
  misc_feature 1..162: note = chr10:49393632-49393794
  misc_feature 1..162: note = hypo
  source 1..162: mol_type = genomic DNA
tacaatttctcggcccggttcagctataaagctcttcctcctattattctttgagcctagaggtagaatcagagcaccacattgtgcttttcccccaaattatttgggagctaatacaaaaggagtaaacagcatttcacacacatgcgcgcacacacattc

SEQ ID NO: 42598 - DNA, 30 bp, Homo sapiens
  misc_feature 1..30: note = chr10:49541963-49541993
  misc_feature 1..30: note = hypo
  source 1..30: mol_type = genomic DNA
agcagtggagcctggcgcttctgccatctc

SEQ ID NO: 42599 - DNA, 58 bp, Homo sapiens
  misc_feature 1..58: note = chr10:49652949-49653007
  misc_feature 1..58: note = hypo
  source 1..58: mol_type = genomic DNA
cccagacggctggctcgcgtgtcagtggccgagcaaagacagacgccactctccccag

SEQ ID NO: 42600 - DNA, 30 bp, Homo sapiens; identical to SEQ ID NO: 15370
  misc_feature 1..30: note = chr10:49929928-49929958
  misc_feature 1..30: note = hypo
  source 1..30: mol_type = genomic DNA

SEQ ID NO: 42601 - DNA, 30 bp, Homo sapiens
  misc_feature 1..30: note = chr10:50007569-50007599
  misc_feature 1..30: note = hypo
  source 1..30: mol_type = genomic DNA
ccagcacgaagaggccgaggcgggtggatc

SEQ ID NO: 42602 - DNA, 30 bp, Homo sapiens
  misc_feature 1..30: note = chr10:50105263-50105293
  misc_feature 1..30: note = hypo
  source 1..30: mol_type = genomic DNA
gcagggcagctttcacgtgtcagcggccag

SEQ ID NO: 42603 - DNA, 253 bp, Homo sapiens
  misc_feature 1..253: note = chr10:50507469-50507722
  misc_feature 1..253: note = hypo
  source 1..253: mol_type = genomic DNA
ctgagcagctggacacgcagagagcggaaggtacagcccagacacttgtctggctccttagcgtgggcagggaggctcaagttcatggcgggagggatgttcccgctgggccgatgctgtgctggggaagtagttcggtgccagggtgctgtgcagggtggtatgtgtgtgccgggagcccattggtgttggggctaaggttcttggtgtgctggatgggcctcggggaccacgtacccggaaccgtgtacat

SEQ ID NO: 42604 - DNA, 41 bp, Homo sapiens
  misc_feature 1..41: note = chr10:50748353-50748394
  misc_feature 1..41: note = hypo
  source 1..41: mol_type = genomic DNA
ggattacaggtgtgagccaccacgcccggcttgtaacttgc

SEQ ID NO: 42605 - DNA, 17 bp, Homo sapiens
  misc_feature 1..17: note = chr10:57918195-57918212
  misc_feature 1..17: note = hypo
  source 1..17: mol_type = genomic DNA
atttgaatgtaaggccg

SEQ ID NO: 42606 - DNA, 47 bp, Homo sapiens
  misc_feature 1..47: note = chr10:69310972-69311019
  misc_feature 1..47: note = hypo
  source 1..47: mol_type = genomic DNA
tgaacattgagagggcgtcgagaggaggagatcggtggaagaagaca

SEQ ID NO: 42607 - DNA, 30 bp, Homo sapiens
  misc_feature 1..30: note = chr10:69578014-69578044
  misc_feature 1..30: note = hypo
  source 1..30: mol_type = genomic DNA
aaagatccacataaacgttcagaaagttgt

SEQ ID NO: 42608 - DNA, 33 bp, Homo sapiens
  misc_feature 1..33: note = chr10:70232362-70232395
  misc_feature 1..33: note = hypo
  source 1..33: mol_type = genomic DNA
tctgtaatcccagctactcgggaggaggctgag

SEQ ID NO: 42609 - DNA, 80 bp, Homo sapiens; identical to SEQ ID NO: 15373
  misc_feature 1..80: note = chr10:70288112-70288192
  misc_feature 1..80: note = hypo
  source 1..80: mol_type = genomic DNA

SEQ ID NO: 42610 - DNA, 96 bp, Homo sapiens; identical to SEQ ID NO: 15374
  misc_feature 1..96: note = chr10:70476540-70476636
  misc_feature 1..96: note = hypo
  source 1..96: mol_type = genomic DNA

SEQ ID NO: 42611 - DNA, 18 bp, Homo sapiens
  misc_feature 1..18: note = chr10:70483311-70483329
  misc_feature 1..18: note = hypo
  source 1..18: mol_type = genomic DNA
taaaagtaaatgggccgg

SEQ ID NO: 42612 - DNA, 30 bp, Homo sapiens
  misc_feature 1..30: note = chr10:72489875-72489905
  misc_feature 1..30: note = hypo
  source 1..30: mol_type = genomic DNA
cgcgggaacccctcacgcagcctggagcag

SEQ ID NO: 42613 - DNA, 136 bp, Homo sapiens
  misc_feature 1..136: note = chr10:73466313-73466449
  misc_feature 1..136: note = hypo
  source 1..136: mol_type = genomic DNA
gttgtcatgattgtccgtgttgccatggtcgttgttaggtgcgtactggagagaggttctaaggttttctctcctccctttgacagctgagcagcaataagcccccagggcacagggacagcgggagggtctggag

SEQ ID NO: 42614 - DNA, 30 bp, Homo sapiens
  misc_feature 1..30: note = chr10:73553133-73553163
  misc_feature 1..30: note = hypo
  source 1..30: mol_type = genomic DNA
gcaccgttcctctctcgggcacagccattg

SEQ ID NO: 42615 - DNA, 23 bp, Homo sapiens
  misc_feature 1..23: note = chr10:73976938-73976961
  misc_feature 1..23: note = hypo
  source 1..23: mol_type = genomic DNA
aatgaaagtgtaggccgggcgcg

SEQ ID NO: 42616 - DNA, 84 bp, Homo sapiens
  misc_feature 1..84: note = chr10:75501525-75501609
  misc_feature 1..84: note = hypo
  source 1..84: mol_type = genomic DNA
atgagccaccatgcccggccctagtgggtgcaaccttaagcaagacagaggatatttactttcctatatcgatatgagtcaagt

SEQ ID NO: 42617 - DNA, 36 bp, Homo sapiens
  misc_feature 1..36: note = chr10:76784730-76784766
  misc_feature 1..36: note = hypo
  source 1..36: mol_type = genomic DNA
aagaagaaaaggggtcgtaaacgcaggaggatcaac

SEQ ID NO: 42618 - DNA, 23 bp, Homo sapiens
  misc_feature 1..23: note = chr10:76997760-76997783
  misc_feature 1..23: note = hypo
  source 1..23: mol_type = genomic DNA
accgcacccggccaagaatccat

SEQ ID NO: 42619 - DNA, 212 bp, Homo sapiens
  misc_feature 1..212: note = chr10:77022117-77022329
  misc_feature 1..212: note = hypo
  source 1..212: mol_type = genomic DNA
ctcactctatttgggaacagggtaattgaatacagatgggaggaggtaaatgaaagaatttagcaaatatctcagtggaatagctaatgggaatgagacagaataggaaattaaaaattattcgaagcagatggaccattctttgagtttttaaaaatttattagggccgcgagaaaatgtgtctgtttattttctgcggccatgaaattaa

SEQ ID NO: 42620 - DNA, 187 bp, Homo sapiens
  misc_feature 1..187: note = chr10:77893300-77893487
  misc_feature 1..187: note = hypo
  source 1..187: mol_type = genomic DNA
ccaatgtgtggagagcgaggaggggcctgcaaactctgcttaaaacaaacaagtgctaaattaaaaagaatgttaaatacagatcagctgcctggctcctgacagcagatttaattcttccctcctctcacctgatggagcttcgcctgcagggtttgcatcaattactcgacgacatgtggaaaat

SEQ ID NO: 42621 - DNA, 38 bp, Homo sapiens
  misc_feature 1..38: note = chr10:78600985-78601023
  misc_feature 1..38: note = hypo
  source 1..38: mol_type = genomic DNA
aggcttgagccaccgcgcccgaccgccgatgtacatct

SEQ ID NO: 42622 - DNA, 71 bp, Homo sapiens
  misc_feature 1..71: note = chr10:81070800-81070871
  misc_feature 1..71: note = hypo
  source 1..71: mol_type = genomic DNA
ccttcccagcctccccggcagccgccacaggccgctcccagcagccatccacacagcgacctgacctttaa

SEQ ID NO: 42623 - DNA, 32 bp, Homo sapiens
  misc_feature 1..32: note = chr10:81921303-81921335
  misc_feature 1..32: note = hypo
  source 1..32: mol_type = genomic DNA
tgacccatgcgggagcgcgatttacatctgtt

SEQ ID NO: 42624 - DNA, 25 bp, Homo sapiens
  misc_feature 1..25: note = chr10:81966571-81966596
  misc_feature 1..25: note = hypo
  source 1..25: mol_type = genomic DNA
aacaagctgctggttcgattttcct

SEQ ID NO: 42625 - DNA, 30 bp, Homo sapiens
  misc_feature 1..30: note = chr10:82607464-82607494
  misc_feature 1..30: note = hypo
  source 1..30: mol_type = genomic DNA
tcgatctcctgacctcgtggatccacccat

SEQ ID NO: 42626 - DNA, 42 bp, Homo sapiens
  misc_feature 1..42: note = chr10:85949293-85949335
  misc_feature 1..42: note = hypo
  source 1..42: mol_type = genomic DNA
attcctctatttggccgggcgcagtggctcacccgtttaatc

SEQ ID NO: 42627 - DNA, 23 bp, Homo sapiens
  misc_feature 1..23: note = chr10:87967335-87967358
  misc_feature 1..23: note = hypo
  source 1..23: mol_type = genomic DNA
tactaatggtttatgcgatggca

SEQ ID NO: 42628 - DNA, 40 bp, Homo sapiens
  misc_feature 1..40: note = chr10:88414219-88414259
  misc_feature 1..40: note = hypo
  source 1..40: mol_type = genomic DNA
gtctgagtgagctggcggcatggagcgactgagcatgtgc

SEQ ID NO: 42629 - DNA, 30 bp, Homo sapiens; identical to SEQ ID NO: 15378
  misc_feature 1..30: note = chr10:89605951-89605981
  misc_feature 1..30: note = hypo
  source 1..30: mol_type = genomic DNA

SEQ ID NO: 42630 - DNA, 23 bp, Homo sapiens
  misc_feature 1..23: note = chr10:94603312-94603335
  misc_feature 1..23: note = hypo
  source 1..23: mol_type = genomic DNA
aagcatgcatttggccgggcgcg

SEQ ID NO: 42631 - DNA, 120 bp, Homo sapiens
  misc_feature 1..120: note = chr10:96304100-96304220
  misc_feature 1..120: note = hypo
  source 1..120: mol_type = genomic DNA
aaaaccgtctctaccaaaaaacaaaaacacacaaaaaccccaaaccaacaaaaattagcctggaatgggctaatgtccgacactaaaatgtccgggcgtggtggcacgcacctgtagtct

SEQ ID NO: 42632 - DNA, 30 bp, Homo sapiens
  misc_feature 1..30: note = chr10:97202907-97202937
  misc_feature 1..30: note = hypo
  source 1..30: mol_type = genomic DNA
ggagcttactgaaaacgtagaagcggccgg

SEQ ID NO: 42633 - DNA, 300 bp, Homo sapiens
  misc_feature 1..300: note = chr10:98129781-98130081
  misc_feature 1..300: note = hypo
  source 1..300: mol_type = genomic DNA
catcacactctgccccggccccagcgtctccgggacttaccccagagccacagaagcggccgagcctgggcgctgagctgtcgtagccgtcgtaggcttccatgtagtcgtagccgcagtcggcctcctcctcaacctcaaaggtccggaatgtcagctccacgccgtagccgtcctctgccacgatcacccagtcacagcgggcctcgctcgggtagttgttgtccccaaactgggcgtgggaatagagctctttggtctgcacttcagccttcagcctgcccccgcactctggagcag

SEQ ID NO: 42634 - DNA, 59 bp, Homo sapiens
  misc_feature 1..59: note = chr10:98808749-98808808
  misc_feature 1..59: note = hypo
  source 1..59: mol_type = genomic DNA
cgcttgttggcgaggcgccggggactggcacagcgggcaccactcgtctcgatgggatt

SEQ ID NO: 42635 - DNA, 30 bp, Homo sapiens
  misc_feature 1..30: note = chr10:100217214-100217244
  misc_feature 1..30: note = hypo
  source 1..30: mol_type = genomic DNA
tggggttactaaggacgcaaagcaaaccat

SEQ ID NO: 42636 - DNA, 16 bp, Homo sapiens
  misc_feature 1..16: note = chr10:101493058-101493074
  misc_feature 1..16: note = hypo
  source 1..16: mol_type = genomic DNA
ccgtctcaaaaaaata

SEQ ID NO: 42637 - DNA, 30 bp, Homo sapiens
  misc_feature 1..30: note = chr10:103814237-103814267
  misc_feature 1..30: note = hypo
  source 1..30: mol_type = genomic DNA
ttccccctttacagtcgtaacaagagggat

SEQ ID NO: 42638 - DNA, 18 bp, Homo sapiens
  misc_feature 1..18: note = chr10:103818196-103818214
  misc_feature 1..18: note = hypo
  source 1..18: mol_type = genomic DNA
acacgaagagaaaaccca

SEQ ID NO: 42639 - DNA, 37 bp, Homo sapiens
  misc_feature 1..37: note = chr10:103930124-103930161
  misc_feature 1..37: note = hypo
  source 1..37: mol_type = genomic DNA
ggcgtgaggcaccgcgcccggccgagaagggaggttt

SEQ ID NO: 42640 - DNA, 30 bp, Homo sapiens
  misc_feature 1..30: note = chr10:104160106-104160136
  misc_feature 1..30: note = hypo
  source 1..30: mol_type = genomic DNA
ccagctctgctggatcggcatggagactca

SEQ ID NO: 42641 - DNA, 30 bp, Homo sapiens
  misc_feature 1..30: note = chr10:104161739-104161769
  misc_feature 1..30: note = hypo
  source 1..30: mol_type = genomic DNA
tggccccagggctcccgagcacatgcccta

SEQ ID NO: 42642 - DNA, 70 bp, Homo sapiens
  misc_feature 1..70: note = chr10:104823178-104823248
  misc_feature 1..70: note = hypo
  source 1..70: mol_type = genomic DNA
ctgctcagcatgtggcgcatggggaagtcccgccttgagccgcatgcactgatcccgggttggcactgtt

SEQ ID NO: 42643 - DNA, 23 bp, Homo sapiens
  misc_feature 1..23: note = chr10:105119651-105119674
  misc_feature 1..23: note = hypo
  source 1..23: mol_type = genomic DNA
aaaattgaacacagccgggcgtg

SEQ ID NO: 42644 - DNA, 30 bp, Homo sapiens
  misc_feature 1..30: note = chr10:105127046-105127076
  misc_feature 1..30: note = hypo
  source 1..30: mol_type = genomic DNA
gtaatgcatgcagctcgattaacttttaca

SEQ ID NO: 42645 - DNA, 101 bp, Homo sapiens
  misc_feature 1..101: note = chr10:105155380-105155481
  misc_feature 1..101: note = hypo
  source 1..101: mol_type = genomic DNA
ccttccgtgcctctctccacctgtgagatgggcactttattaaaggtccaaagtgaccagtagctcttgttactttctctgttcctcgatattgctatttt

SEQ ID NO: 42646 - DNA, 177 bp, Homo sapiens
  misc_feature 1..177: note = chr10:105413740-105413917
  misc_feature 1..177: note = hypo
  source 1..177: mol_type = genomic DNA
gtcgcagccccaccacgccctgtactcctcgctctgcctgtctaatcccttcattctcccagccctgctcaatgcctccaggaagccttctcgactatgcttgtcttcacccctgacacttcagctctgcaccatgcaacagggctactgagggaccatcagcgtggggttgtcatg

SEQ ID NO: 42647 - DNA, 30 bp, Homo sapiens
  misc_feature 1..30: note = chr10:105796706-105796736
  misc_feature 1..30: note = hypo
  source 1..30: mol_type = genomic DNA
cttccaaggctcagacgaggacaaggtttg

SEQ ID NO: 42648 - DNA, 21 bp, Homo sapiens
  misc_feature 1..21: note = chr10:108522437-108522458
  misc_feature 1..21: note = hypo
  source 1..21: mol_type = genomic DNA
agccaccgtgcccagcctatt

SEQ ID NO: 42649 - DNA, 143 bp, Homo sapiens
  misc_feature 1..143: note = chr10:108578381-108578524
  misc_feature 1..143: note = hypo
  source 1..143: mol_type = genomic DNA
tacaggtgtgagccaccacctccagctggaattttttagggtttaattagcatagtaagatagcagtggaaattaacatgttttacgagtctaaatagacactcttaatcatttaaatctgaaaactacgtcaagatatgcat

SEQ ID NO: 42650 - DNA, 36 bp, Homo sapiens
  misc_feature 1..36: note = chr10:110168394-110168430
  misc_feature 1..36: note = hypo
  source 1..36: mol_type = genomic DNA
tttgtataaaattaacgggcggccgggcgcggtggc

SEQ ID NO: 42651 - DNA, 54 bp, Homo sapiens
  misc_feature 1..54: note = chr10:111902849-111902903
  misc_feature 1..54: note = hypo
  source 1..54: mol_type = genomic DNA
cctccaacctgcttccggagagaatggcttccttaggaccgtacctgtagcagc

SEQ ID NO: 42652 - DNA, 33 bp, Homo sapiens
  misc_feature 1..33: note = chr10:111946090-111946123
  misc_feature 1..33: note = hypo
  source 1..33: mol_type = genomic DNA
aaactgctggctgggcgtggtggctcatgcctg

SEQ ID NO: 42653 - DNA, 32 bp, Homo sapiens
  misc_feature 1..32: note = chr10:111979836-111979868
  misc_feature 1..32: note = hypo
  source 1..32: mol_type = genomic DNA
tttcgtttgacctgacgcgattgaacataaca

SEQ ID NO: 42654 - DNA, 30 bp, Homo sapiens
  misc_feature 1..30: note = chr10:112079213-112079243
  misc_feature 1..30: note = hypo
  source 1..30: mol_type = genomic DNA
aaaaaagccgggggtcggaaagaaaactcc

SEQ ID NO: 42655 - DNA, 79 bp, Homo sapiens
  misc_feature 1..79: note = chr10:112524488-112524567
  misc_feature 1..79: note = hypo
  source 1..79: mol_type = genomic DNA
ctagggaggcacatgcgcaacacccaaaatgactccaggcttcgatagccgcaggtcagcccgtcgtgccaggcaccct

SEQ ID NO: 42656 - DNA, 30 bp, Homo sapiens
  misc_feature 1..30: note = chr10:112553736-112553766
  misc_feature 1..30: note = hypo
  source 1..30: mol_type = genomic DNA
tgcgtagcatggtgacgcttgctcaagagc

SEQ ID NO: 42657 - DNA, 30 bp, Homo sapiens
  misc_feature 1..30: note = chr10:112582575-112582605
  misc_feature 1..30: note = hypo
  source 1..30: mol_type = genomic DNA
tgttttttacctgcacggatctgagtttcc

SEQ ID NO: 42658 - DNA, 83 bp, Homo sapiens; identical to SEQ ID NO: 15387
  misc_feature 1..83: note = chr10:113623006-113623089
  misc_feature 1..83: note = hypo
  source 1..83: mol_type = genomic DNA

SEQ ID NO: 42659 - DNA, 30 bp, Homo sapiens
  misc_feature 1..30: note = chr10:113748400-113748430
  misc_feature 1..30: note = hypo
  source 1..30: mol_type = genomic DNA
aaccgggacatctcacgtggccagagcaga

SEQ ID NO: 42660 - DNA, 26 bp, Homo sapiens
  misc_feature 1..26: note = chr10:114571159-114571185
  misc_feature 1..26: note = hypo
  source 1..26: mol_type = genomic DNA
aaggtgagtgcagaccgggcgcggtg

SEQ ID NO: 42661 - DNA, 34 bp, Homo sapiens
  misc_feature 1..34: note = chr10:114752064-114752098
  misc_feature 1..34: note = hypo
  source 1..34: mol_type = genomic DNA
gcatagattccattccgcacgccaccctcgcctc

SEQ ID NO: 42662 - DNA, 213 bp, Homo sapiens
  misc_feature 1..213: note = chr10:114829478-114829691
  misc_feature 1..213: note = hypo
  source 1..213: mol_type = genomic DNA
tcattgagggcccctcgctggatgtttcagccactccctcacaggttctcgtgtctgcttggtacagttgagatctgcaagagctgattcatcggcctgattgagattcctttgtaaaaccagatattcaagaatactagtggcaagaatgctttggtgagcgtaagatagcggctcccactggatcacatggctggtcggtgtcagggagat

SEQ ID NO: 42663 - DNA, 30 bp, Homo sapiens
  misc_feature 1..30: note = chr10:115479125-115479155
  misc_feature 1..30: note = hypo
  source 1..30: mol_type = genomic DNA
aggcaaaacagattccggatatttctcttt

SEQ ID NO: 42664 - DNA, 34 bp, Homo sapiens; identical to SEQ ID NO: 15388
  misc_feature 1..34: note = chr10:115844821-115844855
  misc_feature 1..34: note = hypo
  source 1..34: mol_type = genomic DNA

SEQ ID NO: 42665 - DNA, 72 bp, Homo sapiens
  misc_feature 1..72: note = chr10:116331126-116331198
  misc_feature 1..72: note = hypo
  source 1..72: mol_type = genomic DNA
ccattgaatgtgactcggtctccgggtggaaacgggcgcctggaggcagaaagacatcgccctcaaggttat

SEQ ID NO: 42666 - DNA, 30 bp, Homo sapiens
  misc_feature 1..30: note = chr10:117011803-117011833
  misc_feature 1..30: note = hypo
  source 1..30: mol_type = genomic DNA
tatagattctttggtcgtatactctctttc

SEQ ID NO: 42667 - DNA, 73 bp, Homo sapiens
  misc_feature 1..73: note = chr10:119807026-119807099
  misc_feature 1..73: note = hypo
  source 1..73: mol_type = genomic DNA
gcctcagtgttttcacgagtaaaaaagccagttctacctcatgtctaagactccatcacgactctatgggctc

SEQ ID NO: 42668 - DNA, 101 bp, Homo sapiens
  misc_feature 1..101: note = chr10:120767098-120767199
  misc_feature 1..101: note = hypo
  source 1..101: mol_type = genomic DNA
tgaagtctctgccttcgtgacactaacactccagggtcacctccggggaggtaatgatagagagtgggagtcaaggagataaaggaaaatattatccttgt

SEQ ID NO: 42669 - DNA, 42 bp, Homo sapiens
  misc_feature 1..42: note = chr10:120791236-120791278
  misc_feature 1..42: note = hypo
  source 1..42: mol_type = genomic DNA
tagctctgagctattcgtgtattaactcgtattcaagaaggt

SEQ ID NO: 42670 - DNA, 30 bp, Homo sapiens
  misc_feature 1..30: note = chr10:120922882-120922912
  misc_feature 1..30: note = hypo
  source 1..30: mol_type = genomic DNA
tgttaaacagatgtacgcttttcttttctt

SEQ ID NO: 42671 - DNA, 30 bp, Homo sapiens
  misc_feature 1..30: note = chr10:121249991-121250021
  misc_feature 1..30: note = hypo
  source 1..30: mol_type = genomic DNA
cttaggcagaccacacgacctatccctggt

SEQ ID NO: 42672 - DNA, 43 bp, Homo sapiens
  misc_feature 1..43: note = chr10:121256846-121256889
  misc_feature 1..43: note = hypo
  source 1..43: mol_type = genomic DNA
tatgcctcatttctgcgactggcatagacgtaggcaatcaggc

SEQ ID NO: 42673 - DNA, 17 bp, Homo sapiens
  misc_feature 1..17: note = chr10:121354427-121354444
  misc_feature 1..17: note = hypo
  source 1..17: mol_type = genomic DNA
cccggcctgaaggacaa

SEQ ID NO: 42674 - DNA, 30 bp, Homo sapiens
  misc_feature 1..30: note = chr10:121398024-121398054
  misc_feature 1..30: note = hypo
  source 1..30: mol_type = genomic DNA
ccctacgacaagaagcggaagtatgagttg

SEQ ID NO: 42675 - DNA, 98 bp, Homo sapiens
  misc_feature 1..98: note = chr10:121651072-121651170
  misc_feature 1..98: note = hypo
  source 1..98: mol_type = genomic DNA
aaggagacagggtctcgctgcacagtgagtggcaagatcagggttaatttggcctcaagcaatattcccgcctcagcctcctgagtagctggcaatat

SEQ ID NO: 42676 - DNA, 30 bp, Homo sapiens
  misc_feature 1..30: note = chr10:122394238-122394268
  misc_feature 1..30: note = hypo
  source 1..30: mol_type = genomic DNA
gaaacaagaatcctccgaaaacagacttgg

SEQ ID NO: 42677 - DNA, 120 bp, Homo sapiens; identical to SEQ ID NO: 15393
  misc_feature 1..120: note = chr10:122492432-122492552
  misc_feature 1..120: note = hypo
  source 1..120: mol_type = genomic DNA

SEQ ID NO: 42678 - DNA, 139 bp, Homo sapiens
  misc_feature 1..139: note = chr10:123820813-123820952
  misc_feature 1..139: note = hypo
  source 1..139: mol_type = genomic DNA
aaaaaaaaggagggagaaaagaatcgaggaagattcctgaagctttggcttgagtgactgggcaggtgggaccatatgctgagatgtgaaaagcactaaggtcaggtgtgtctgccgagttccacggccacagacctgg

SEQ ID NO: 42679 - DNA, 38 bp, Homo sapiens
  misc_feature 1..38: note = chr10:125919683-125919721
  misc_feature 1..38: note = hypo
  source 1..38: mol_type = genomic DNA
acacaatattttacacggtattccgcaccatattccac

SEQ ID NO: 42680 - DNA, 186 bp, Homo sapiens
  misc_feature 1..186: note = chr10:126198949-126199135
  misc_feature 1..186: note = hypo
  source 1..186: mol_type = genomic DNA
agctgtgcacccagccggccctggcgtcccggcccccagcctccgcctccctcgccgacagcttcccggggctctgcctggaggcagcctcgctttatcccgcagaacctccacgctgttcctgcatgagaactcttcctccaagagaccacgttcctctggtcctgtctccgtgggccacatcca

SEQ ID NO: 42681 - DNA, 30 bp, Homo sapiens
  misc_feature 1..30: note = chr10:126314006-126314036
  misc_feature 1..30: note = hypo
  source 1..30: mol_type = genomic DNA
ggattcgatgcagcccggtggtgtgcacac

SEQ ID NO: 42682 - DNA, 73 bp, Homo sapiens
  misc_feature 1..73: note = chr10:126314814-126314887
  misc_feature 1..73: note = hypo
  source 1..73: mol_type = genomic DNA
ctgtgctcaccctctcggtcctgctcggagcttcccactgacctcctctggcataaggcgcaggtagcggggg

SEQ ID NO: 42683 - DNA, 28 bp, Homo sapiens
  misc_feature 1..28: note = chr10:126479341-126479369
  misc_feature 1..28: note = hypo
  source 1..28: mol_type = genomic DNA
cttctttttttgagacggagtcacgctc

SEQ ID NO: 42684 - DNA, 28 bp, Homo sapiens
  misc_feature 1..28: note = chr10:126479609-126479637
  misc_feature 1..28: note = hypo
  source 1..28: mol_type = genomic DNA
gcgtaagccaccacgcacccggccctct

SEQ ID NO: 42685 - DNA, 224 bp, Homo sapiens
  misc_feature 1..224: note = chr10:126697796-126698020
  misc_feature 1..224: note = hypo
  source 1..224: mol_type = genomic DNA
tatggcaccggggaacgagcattccaaacagagccaagcgattcacggcttcatcagcccctgtgacctgcaggtggcctgggaggcaggaggagcctaagcagccggtgtggctcccagcctcatgcacaatgatccaggaagaaagaggagacaaaaccacacaaactccagaggccggggcgggacagggagtgacccaacacagccgaacctgaggcccc

SEQ ID NO: 42686 - DNA, 45 bp, Homo sapiens
  misc_feature 1..45: note = chr10:126712043-126712088
  misc_feature 1..45: note = hypo
  source 1..45: mol_type = genomic DNA
ctggctcgcagccaccgccggagggctccgcgacttgtgccatag

SEQ ID NO: 42687 - DNA, 87 bp, Homo sapiens
  misc_feature 1..87: note = chr10:126809890-126809977
  misc_feature 1..87: note = hypo
  source 1..87: mol_type = genomic DNA
aatgctttactcacacggcttggtgaattcgagaatccacagtcctggaaagaaaagaggcctgaaggaaaccgggttctatttaat

SEQ ID NO: 42688 - DNA, 30 bp, Homo sapiens
  misc_feature 1..30: note = chr10:126814656-126814686
  misc_feature 1..30: note = hypo
  source 1..30: mol_type = genomic DNA
cctgtaccactagaccgcagtgcagcggtg

SEQ ID NO: 42689 - DNA, 194 bp, Homo sapiens
  misc_feature 1..194: note = chr10:127380217-127380411
  misc_feature 1..194: note = hypo
  source 1..194: mol_type = genomic DNA
agtccagcctccaggcgtgcaagtacatgtggggactatttagcgccagcatcccaatgtggaggtgttgatgccaccgtgctgggcccagagatttggggacagagtctgtcattggtatgcacacagctcactactgtatgatttttttaagtaatttgatgtgtctaattgttctgcggtgagataagaac

SEQ ID NO: 42690 - DNA, 36 bp, Homo sapiens
  misc_feature 1..36: note = chr10:127451959-127451995
  misc_feature 1..36: note = hypo
  source 1..36: mol_type = genomic DNA
tctggaaagaatcaacgttatcgtccacctgctggg

SEQ ID NO: 42691 - DNA, 75 bp, Homo sapiens
  misc_feature 1..75: note = chr10:127463306-127463381
  misc_feature 1..75: note = hypo
  source 1..75: mol_type = genomic DNA
cgcgggggaggaagacgctccccccggccttgcggggcaggtcgcgcagggcaggtcgtgcggggcaggtggggg

SEQ ID NO: 42692 - DNA, 30 bp, Homo sapiens
  misc_feature 1..30: note = chr10:127475463-127475493
  misc_feature 1..30: note = hypo
  source 1..30: mol_type = genomic DNA
cctactcagccttcacgttctcaggaatct

SEQ ID NO: 42693 - DNA, 29 bp, Homo sapiens
  misc_feature 1..29: note = chr10:127601468-127601497
  misc_feature 1..29: note = hypo
  source 1..29: mol_type = genomic DNA
gttgggattacaggcgtaagccatcgtgt

SEQ ID NO: 42694 - DNA, 30 bp, Homo sapiens
  misc_feature 1..30: note = chr10:128888749-128888779
  misc_feature 1..30: note = hypo
  source 1..30: mol_type = genomic DNA
tttatttcttaattgcggtaaaatacatat

SEQ ID NO: 42695 - DNA, 135 bp, Homo sapiens
  misc_feature 1..135: note = chr10:129888855-129888990
  misc_feature 1..135: note = hypo
  source 1..135: mol_type = genomic DNA
cccaagaccctcactcgccctgcaccttacatttctttggctctgtatggcagtcacagctctaaagcttctagttgcagaagttactccagtgggaatactccaagtatgcctcgtcctcgcttgccttggctt

SEQ ID NO: 42696 - DNA, 107 bp, Homo sapiens
  misc_feature 1..107: note = chr10:129925726-129925833
  misc_feature 1..107: note = hypo
  source 1..107: mol_type = genomic DNA
tacacaggattctatcggggtctgcttcagttgcgctggtggccatgtgggctcagtaggccacctggggtgaagtgaatggagcctaaacacgcttttggtgacaa

SEQ ID NO: 42697 - DNA, 30 bp, Homo sapiens
  misc_feature 1..30: note = chr10:129947242-129947272
  misc_feature 1..30: note = hypo
  source 1..30: mol_type = genomic DNA
taggtgatgggtacacggggtttgtgtatt

SEQ ID NO: 42698 - DNA, 24 bp, Homo sapiens
  misc_feature 1..24: note = chr10:130065702-130065726
  misc_feature 1..24: note = hypo
  source 1..24: mol_type = genomic DNA
gcctagcagcgaggtctggaggct

SEQ ID NO: 42699 - DNA, 189 bp, Homo sapiens
  misc_feature 1..189: note = chr10:130203362-130203551
  misc_feature 1..189: note = hypo
  source 1..189: mol_type = genomic DNA
ggcccacagtgtgaacggcgccctccaagatgagcagtgtgatgctccgcagagtcgtagacaggaaaagtggaggctgaagtgggaccggacagcactggcacggcttgactttggcaatggacaacagggaaaatggaggcgcaggtgagaaaggaaggcaggtgaagcgcccgactcactccaagc

SEQ ID NO: 42700 - DNA, 55 bp, Homo sapiens
  misc_feature 1..55: note = chr10:130577739-130577794
  misc_feature 1..55: note = hypo
  source 1..55: mol_type = genomic DNA
agcctccgaggattccgcctgaggacacggccccatgagccggctcacgctcaga

SEQ ID NO: 42701 - DNA, 20 bp, Homo sapiens
  misc_feature 1..20: note = chr10:130754356-130754376
  misc_feature 1..20: note = hypo
  source 1..20: mol_type = genomic DNA
gacgccgatgctcctgcaga

SEQ ID NO: 42702 - DNA, 179 bp, Homo sapiens
  misc_feature 1..179: note = chr10:130946123-130946302
  misc_feature 1..179: note = hypo
  source 1..179: mol_type = genomic DNA
ttctcatatttcacccgagaacctgcaccgccaaagagccgatgatgtacctctcccatcctggttctgttcctgcccccctggcccagtgtgattcctccatggtccttgaatcctccactgtcactactctttcatcattatctaaggtgatcggtcagctccgtgccaccccctgt

SEQ ID NO: 42703 - DNA, 30 bp, Homo sapiens
  misc_feature 1..30: note = chr10:130946893-130946923
  misc_feature 1..30: note = hypo
  source 1..30: mol_type = genomic DNA
tgtttgtttttgagacggagtctcgctctg

SEQ ID NO: 42704 - DNA, 208 bp, Homo sapiens
  misc_feature 1..208: note = chr10:131058908-131059116
  misc_feature 1..208: note = hypo
  source 1..208: mol_type = genomic DNA
ggggaaggtgcaggccgttctccgttcagtggcctgtggatggatatgcccggaggcagcgccgcctccacccaccttcagcgaggtggccccagcagggcagggggtgcttccaccctgctcaccgagcctccgttaatgaaattaagcgggaaggtcagctgcattcccataggatcttcttccaggatcccgcagcattaagtag

SEQ ID NO: 42705 - DNA, 185 bp, Homo sapiens
  misc_feature 1..185: note = chr10:131606695-131606880
  misc_feature 1..185: note = hypo
  source 1..185: mol_type = genomic DNA
ggcccatgcagcacccggggctctgcaggggaccccactccaaagcagaatgagacacacaggggttttctgatggttctttcatcccctcagctcctctttcttcaaatcgcctttaacctcagtcagaatgccagtcttcgccaggttggcccagtgcccagcaccctcgcacccacgcagag

SEQ ID NO: 42706 - DNA, 120 bp, Homo sapiens
  misc_feature 1..120: note = chr10:131641071-131641191
  misc_feature 1..120: note = hypo
  source 1..120: mol_type = genomic DNA
ctgcatgctgtggggcgcccatccagccctccctggttcccagcggcaccaacaccgtccacccgccactgcacactgcagatgggtttcaaggctgtgcactcccgctgtgacaagttt

SEQ ID NO: 42707 - DNA, 218 bp, Homo sapiens
  misc_feature 1..218: note = chr10:131647719-131647937
  misc_feature 1..218: note = hypo
  source 1..218: mol_type = genomic DNA
atttgatgattaacacgccccacctcagcaggtgtgcaaggtgcgggggcggacacaaagactgcggcttccggagaggacggctagggggccgcctttgcaagtgctctccaaaataattggtcaccgttctcgagtgcttgggcgtcggcgcatcttgtaagcaacgcaggaagcctcgcacgtacactcaataatgcgcccgaaagttgaggacc

SEQ ID NO: 42708 - DNA, 118 bp, Homo sapiens
  misc_feature 1..118: note = chr10:131739072-131739190
  misc_feature 1..118: note = hypo
  source 1..118: mol_type = genomic DNA
gaaggcagagggcaccgcccaccccggaaacctgtcaccagggctgccataaacatcccacactcgatcctcccatgttgggccacagcaaacaggactgcagcgtaaaaccaggtag

SEQ ID NO: 42709 - DNA, 30 bp, Homo sapiens
  misc_feature 1..30: note = chr10:131739627-131739657
  misc_feature 1..30: note = hypo
  source 1..30: mol_type = genomic DNA
atgtctgttctgccccggtcatcacaaaag

SEQ ID NO: 42710 - DNA, 242 bp, Homo sapiens
  misc_feature 1..242: note = chr10:131825216-131825458
  misc_feature 1..242: note = hypo
  source 1..242: mol_type = genomic DNA
ggttcccacacccaccgcccacctgctgccaggccctgggggagctctagtgagaaacgtccacgtactactgcccaacatgctcgccgctcctgaagagttttgtttgaatagaaatgtccccgtgtccacggccattttgctggaacagactccaggctgcacagaggcgccaacactgtccccagccggaggccaccgctgctgccctcacagctgccatctcacggtctccccctgcc

SEQ ID NO: 42711 - DNA, 284 bp, Homo sapiens
  misc_feature 1..284: note = chr10:131844059-131844343
  misc_feature 1..284: note = hypo
  source 1..284: mol_type = genomic DNA
aggagcagtcaggtccgtgtcacctgtggcttccactcccaggaagtctgatggctccggtcgtggctgttgtggggaatccgtcgtgtggagaacgtgcctgccacgtgcgggggagaaaggagccaccttccgagtacgcgacctcacctgccgggcgtgaggtgctggactgagaccagggtggggctctgggcatgggaggtggggctgggcgtggggcacgtggcacagagggatgcgcgtggtagggctcagggcagacggaacgtggaacagggagt

SEQ ID NO: 42712 - DNA, 92 bp, Homo sapiens
  misc_feature 1..92: note = chr10:131844600-131844692
  misc_feature 1..92: note = hypo
  source 1..92: mol_type = genomic DNA
cgctcccccgcccagcgcctcccccgggacctgctccagaagcgccagttgcgggaccccacacggaaggcagtcttcggtggttctcactg

SEQ ID NO: 42713 - DNA, 192 bp, Homo sapiens
  misc_feature 1..192: note = chr10:131845044-131845236
  misc_feature 1..192: note = hypo
  source 1..192: mol_type = genomic DNA
gaggttcatttaatccgtgcgtctatgcagcgcctaggcctaactctcccaggaggcgccagtcacgttccccagggggagctccctgacctttctgggggtgacagagtggggaagtgggcagtgtgagcccacccctgaggcgtgtgtgtgtaagcgtgcacacttgctttttaacgttctgtattctag

SEQ ID NO: 42714 - DNA, 79 bp, Homo sapiens
  misc_feature 1..79: note = chr10:131936587-131936666
  misc_feature 1..79: note = hypo
  source 1..79: mol_type = genomic DNA
atcgggattacaggcttgagcccccgtgacctgccctgttgatctaaattgagtgaaattttgccgactgaatttgaat

SEQ ID NO: 42715 - DNA, 222 bp, Homo sapiens
  misc_feature 1..222: note = chr10:132001294-132001516
  misc_feature 1..222: note = hypo
  source 1..222: mol_type = genomic DNA
cccgcacagcccacacggtgccctcacagcccgcacggtgcccacacagcacacacagcacacacggtgccctcacagcccgcacggtgcccgcacagcacacacagcacggtgcccacacagcccgcacagtgcccacacagcacacacagcacacatggtgcccacacagcccgcacggtgcctgcacagcacacacagcccgcacggtgccctcacagc

SEQ ID NO: 42716 - DNA, 30 bp, Homo sapiens
  misc_feature 1..30: note = chr10:132050805-132050835
  misc_feature 1..30: note = hypo
  source 1..30: mol_type = genomic DNA
cacagaaagatagagcgatggcgctggccg

SEQ ID NO: 42717 - DNA, 30 bp, Homo sapiens
  misc_feature 1..30: note = chr10:132317215-132317245
  misc_feature 1..30: note = hypo
  source 1..30: mol_type = genomic DNA
gagcaggcaagatggcgctggtcaaagtaa

SEQ ID NO: 42718 - DNA, 207 bp, Homo sapiens
  misc_feature 1..207: note = chr10:132365689-132365896
  misc_feature 1..207: note = hypo
  source 1..207: mol_type = genomic DNA
gaggcgcgaacggagcgggtagaaatgagacggcgcaatggcggaaagcaaagcagaaatggcgtgacagccacatgtgcggggccggggaagtggaggctggctgctcctcacgggcactcgggtgaggctctctccacctcgcgcaggggctacccgctcgccgtgctgagcccttccagctctgccacgcgcaggaagccggtg

SEQ ID NO: 42719 - DNA, 174 bp, Homo sapiens
  misc_feature 1..174: note = chr10:132525800-132525974
  misc_feature 1..174: note = hypo
  source 1..174: mol_type = genomic DNA
caggtgcaatgaaggcgcgcgctgagggctcaggggtcccagaggcatatgagggatggcttgtgccagcagagttcacacggcctggggagcagggcctggcatgaatgccagtgtagccccggcacacgtggcctagagttaggccaaggaatgcgacgcttctgtccttcc

SEQ ID NO: 42720 - DNA, 165 bp, Homo sapiens
  misc_feature 1..165: note = chr10:132586486-132586651
  misc_feature 1..165: note = hypo
  source 1..165: mol_type = genomic DNA
tctcttagggagtcccgggtcgtactccctctgagcccaggtgccttcttggctgagccactgtctgtacctgtgccgttactgagacaaaaggaaaagtgaaaacagcgatgatgttttcagaccttttgagcatcacaagccttgcagcgctcaatctgtgtg

SEQ ID NO: 42721 - DNA, 30 bp, Homo sapiens
  misc_feature 1..30: note = chr10:132609284-132609314
  misc_feature 1..30: note = hypo
  source 1..30: mol_type = genomic DNA
acccccacccgccaacgcccagctctctta

SEQ ID NO: 42722 - DNA, 167 bp, Homo sapiens
  misc_feature 1..167: note = chr10:132811738-132811905
  misc_feature 1..167: note = hypo
  source 1..167: mol_type = genomic DNA
cgtcgaggtttcttgcggctggttggtgtatggggctggctctaaccggccatcttccatgttgacctctggaatccatgcttcctccaccaggatgccattcatctagggtgccagcatcttctcaggtccaagatccggacagcgcagtccgcccacacggacgt

SEQ ID NO: 42723 - DNA, 164 bp, Homo sapiens
  misc_feature 1..164: note = chr10:132818146-132818310
  misc_feature 1..164: note = hypo
  source 1..164: mol_type = genomic DNA
cactgcctgagccaccggcagggacatctgagttagatgacttgcagctggctggctttcagcaggagaaggcagcaaatcttagagtggtggcgtgaggtcgggaacccaggacagatgggaagagggcaagcagcatgtctgtgccccgttccaccttcttc

SEQ ID NO: 42724 - DNA, 30 bp, Homo sapiens
  misc_feature 1..30: note = chr10:132873813-132873843
  misc_feature 1..30: note = hypo
  source 1..30: mol_type = genomic DNA
gaagccttaggtctccgtgcactgggcgca

SEQ ID NO: 42725 - DNA, 119 bp, Homo sapiens; identical to SEQ ID NO: 15408
  misc_feature 1..119: note = chr10:132976493-132976612
  misc_feature 1..119: note = hypo
  source 1..119: mol_type = genomic DNA

SEQ ID NO: 42726 - DNA, 191 bp, Homo sapiens
  misc_feature 1..191: note = chr10:132977044-132977235
  misc_feature 1..191: note = hypo
  source 1..191: mol_type = genomic DNA
gaagatctggctctccgcacttgaggagcctctctttgatcaagttaaacaacagaatcaacagatgggactccactgtacactccgcagagctgcaaatgaattgtttaatgagaaggcaaagcggttccagcagagccccgctcactactcatgtatgctcatcagtgctcgtgcggtccctcagggac

SEQ ID NO: 42727 - DNA, 57 bp, Homo sapiens
  misc_feature 1..57: note = chr10:133058363-133058420
  misc_feature 1..57: note = hypo
  source 1..57: mol_type = genomic DNA
caagcaaagcccaaacggccccagccgaatgtttccctcaaccggagccgggcttca

SEQ ID NO: 42728 - DNA, 30 bp, Homo sapiens
  misc_feature 1..30: note = chr10:133516048-133516078
  misc_feature 1..30: note = hypo
  source 1..30: mol_type = genomic DNA
acagacccgccccgacggcaagggcttctc

SEQ ID NO: 42729 - DNA, 186 bp, Homo sapiens
  misc_feature 1..186: note = chr10:133532610-133532796
  misc_feature 1..186: note = hypo
  source 1..186: mol_type = genomic DNA
tgggagccgctccctcgccgccttggtggggcacacactccctttgactccctggatccaagccccaggccacctctgcctgctcccaggggcttcgacccacacaatgccttgggtatcagctttatttctgggccccagcaatgctaattttctctaacatgacggtagcgtttaattttcatt

SEQ ID NO: 42730 - DNA, 30 bp, Homo sapiens
  misc_feature 1..30: note = chr10:133555035-133555065
  misc_feature 1..30: note = hypo
  source 1..30: mol_type = genomic DNA
accgccgcagagcctcgggtgctgatgggc

SEQ ID NO: 42731 - DNA, 251 bp, Homo sapiens
  misc_feature 1..251: note = chr10:133913806-133914057
  misc_feature 1..251: note = hypo
  source 1..251: mol_type = genomic DNA
gcccttggcatgagccggctggacctcccgcatggctgaagcccatgccacacccaaggtgggggtgtctgggccaccaccagctgagatctcccactcccgcagcctttgggtctctctccagtcgccccgtctgcctcccaggagggtgtcaggaaggccacgagaagacgtattgaccagaacagcctcacacacccttgagactggatgattctctgcaccctggttccttacgagggttggggggt

SEQ ID NO: 42732 - DNA, 30 bp, Homo sapiens
  misc_feature 1..30: note = chr10:133921177-133921207
  misc_feature 1..30: note = hypo
  source 1..30: mol_type = genomic DNA
gccaagtgatcacagcgcctcttggagtca

SEQ ID NO: 42733 - DNA, 119 bp, Homo sapiens
  misc_feature 1..119: note = chr10:133947276-133947395
  misc_feature 1..119: note = hypo
  source 1..119: mol_type = genomic DNA
ccctcccgtgggccccggcctcatcacccttctgctgcagttcatggcacttgctggcccggagtccggccctgggttggtgggaggaggctgtgctgggtatgcgctgccaccatctc

SEQ ID NO: 42734 - DNA, 86 bp, Homo sapiens
  misc_feature 1..86: note = chr10:133949349-133949435
  misc_feature 1..86: note = hypo
  source 1..86: mol_type = genomic DNA
ctgtggtcagtcagccgactctgcgtggagacctgctggttctccgtcacttaaagaacaatcacatagtgcgttgtctttcagtt

SEQ ID NO: 42735 - DNA, 556 bp, Homo sapiens
  misc_feature 1..556: note = chr10:133951469-133952025
  misc_feature 1..556: note = hypo
  source 1..556: mol_type = genomic DNA
ggagccagggcctcccgctgtggtgtggggacaagccagcccagacaccgtcttccctgtcatccaaatgatggcacacgggcagtaaaccgtggactgaaaccggtggagctgctctaccacttacacaacctcttcaactggcttccgcaggagcgggacaagctgttaagattccggaagcaaagaaagaaaatggcaaaacttcccaaggtaaggaacagcacaccggcacgtgcggagagtacgccgggtgtgtgcggagaggaccacgcccgcgtgtgtggagagcgctggtgtgtgcggagaggggtgcgccggtgtacgtggagggcgctgggtgtgtgtgccgaggaccgcgcccacgtgtgtggagagtatgccgggtgcgtgtggagaggaccgcgcccgcgtgtgtggagagtacgccgggtgtgtgcggagaggggtgcgccggtgtatgtggagggcgctgggtgtgtgtgccgaggaccgcgcccgcgtgtgtggagagcgctggtgtgtgtggagagcgtgctggcgtgtgcttagtagg

SEQ ID NO: 42736 - DNA, 77 bp, Homo sapiens
  misc_feature 1..77: note = chr10:133955427-133955504
  misc_feature 1..77: note = hypo
  source 1..77: mol_type = genomic DNA
tggccaaggaggagacggagctgaggttccggcagctgaccatggagtaccaggccctgcagcgtgcctacgctttg

SEQ ID NO: 42737 - DNA, 176 bp, Homo sapiens
  misc_feature 1..176: note = chr10:133962619-133962795
  misc_feature 1..176: note = hypo
  source 1..176: mol_type = genomic DNA
actgagggatgtgcccgtgggctcagggtgggactgcccaggccacgtggccagagtgtgatgaactctgcccggcacatctggggtcagcgaatatacaggggcagtccttgtgggcaggtccaggtccagtgcagattctgccaccactgctgccgctgcggtttggttttcat

SEQ ID NO: 42738 - DNA, 35 bp, Homo sapiens
  misc_feature 1..35: note = chr10:133979192-133979227
  misc_feature 1..35: note = hypo
  source 1..35: mol_type = genomic DNA
agcagtcgccttagacgggccgtgtgtcatcccac

SEQ ID NO: 42739 - DNA, 52 bp, Homo sapiens
  misc_feature 1..52: note = chr10:133982909-133982961
  misc_feature 1..52: note = hypo
  source 1..52: mol_type = genomic DNA
acgccgccccacactcggccccggcacctgaggtgtccgctctggggaggcg

SEQ ID NO: 42740 - DNA, 171 bp, Homo sapiens
  misc_feature 1..171: note = chr10:133984033-133984204
  misc_feature 1..171: note = hypo
  source 1..171: mol_type = genomic DNA
ccccacagctgccctcggtgacatctgggacttggacatccatggacggcatccctggatggagccatttcctgggtactggacctggaggtgactcggagcttctcctgctcccagcgtgtgtccatgggggcggtcagggtagacaggccacaccgtcatcagggaggg

SEQ ID NO: 42741 - DNA, 153 bp, Homo sapiens
  misc_feature 1..153: note = chr10:134012330-134012483
  misc_feature 1..153: note = hypo
  source 1..153: mol_type = genomic DNA
tcatccctctcatctcgtccccaggtggaggctgaggcggtgtaccgagctgtcaccatcgccaagcaggcaaactgcccgctgtacgtcaccaaggtgatgagcaagggggcggccgacgccatcgctcaggccaagcgcagaggtgagcac

SEQ ID NO: 42742 - DNA, 220 bp, Homo sapiens
  misc_feature 1..220: note = chr10:134014330-134014550
  misc_feature 1..220: note = hypo
  source 1..220: mol_type = genomic DNA
ctggcttgtttccagcggggacctccaggtgacaggcagcgcccactgcaccttcaccactgcccagaaggctgtgggcaaggacaacttcgcgctgatccccgagggcaccaacggcattgaggagcgcatgtcgatggtctgggagaaatgtgtggtgagcacaggcctggccggggcacgccgtctggggagcggctgtgggcgggattgtgatggc

SEQ ID NO: 42743 - DNA, 303 bp, Homo sapiens
  misc_feature 1..303: note = chr10:134016136-134016439
  misc_feature 1..303: note = hypo
  source 1..303: mol_type = genomic DNA
cctctctccccagaacgtggagtacaacatcttcgagggagtggagtgccggggagcgcctgccgtggtcataagtcagggccgagtggcgctggaggacgggaagatgtttgtcaccccgggggcgggccgcttcgtccctcggaaaacattcccggactttgtctacaagaggatcaaagctcgcaacagggtagggcggcacccgcaagggtgttgtgcaggtaggcaggtgggcgctgagttctaggcccagaacgcacccctggtcaacctggcccggcctcccgaggggtcaggaag

SEQ ID NO: 42744 - DNA, 30 bp, Homo sapiens
  misc_feature 1..30: note = chr10:134016763-134016793
  misc_feature 1..30: note = hypo
  source 1..30: mol_type = genomic DNA
tcaggagctcagccacgggagccccccccc

SEQ ID NO: 42745 - DNA, 30 bp, Homo sapiens
  misc_feature 1..30: note = chr10:134019334-134019364
  misc_feature 1..30: note = hypo
  source 1..30: mol_type = genomic DNA
ggctgtgggctggtccgacgactcctgcag

SEQ ID NO: 42746 - DNA, 96 bp, Homo sapiens
  misc_feature 1..96: note = chr10:134022845-134022941
  misc_feature 1..96: note = hypo
  source 1..96: mol_type = genomic DNA
ggcttggacttgctccgtggggcctgcaggaccaggcagaagctgttctctgcgggactttgctggaaaccactcccttgccgggcctttcccgtc

SEQ ID NO: 42747 - DNA, 30 bp, Homo sapiens
  misc_feature 1..30: note = chr10:134058791-134058821
  misc_feature 1..30: note = hypo
  source 1..30: mol_type = genomic DNA
gctgcgcgcagaagccggagggctaattcc

SEQ ID NO: 42748 - DNA, 119 bp, Homo sapiens
  misc_feature 1..119: note = chr10:134093662-134093781
  misc_feature 1..119: note = hypo
  source 1..119: mol_type = genomic DNA
cacgcccctgcactccgtgaccacgccacctgcgctccatgaccatgtccctgcactctgtgatcacgctgaggcctccacaccgtgaccacgcccctgcaccccgtgaccacgcccct

SEQ ID NO: 42749 - DNA, 243 bp, Homo sapiens
  misc_feature 1..243: note = chr10:134094008-134094251
  misc_feature 1..243: note = hypo
  source 1..243: mol_type = genomic DNA
catgtccctgcactccgtgatcacgctgaggcctccacaccgtgaccacgcccctgcaccccgtgaccacgcccctgcaccctgtgatcacgccactccactctgtgaccacgcccctgcactccgtgatcacgacactccactccatgatcaccacactccactccgtgatcacgcacctccactccgtgatcatgaacctccactccctgatcacacccctgcactcggtgatcacaccct

SEQ ID NO: 42750 - DNA, 243 bp, Homo sapiens
  misc_feature 1..243: note = chr10:134095563-134095806
  misc_feature 1..243: note = hypo
  source 1..243: mol_type = genomic DNA
aggcagcagcccagccgctccgggggtgggggcgacaggtgctgggcggggaggcgctacattgtgtaacactcagcagccacgctacacttgggaagagcggatgtgctgaaaatgcccagtgcaggaccaaggtgcgccaaccagcccgcaccacgcccgagaggcttcgcagccgcccaccccggctctcacagcgcccatccctgccacacgccctgccagctgcgccagcttccccag

SEQ ID NO: 42751 - DNA, 30 bp, Homo sapiens
  misc_feature 1..30: note = chr10:134118399-134118429
  misc_feature 1..30: note = hypo
  source 1..30: mol_type = genomic DNA
ggcgggctaatgccacgtcaggctggagac

SEQ ID NO: 42752 - DNA, 230 bp, Homo sapiens
  misc_feature 1..230: note = chr10:134123040-134123270
  misc_feature 1..230: note = hypo
  source 1..230: mol_type = genomic DNA
tccagtgcacagagccgagttttcagcccttgcagctgcgaagctctgttccctgctctccctcaaagttgccattctccagcaggcacgcagaaggcagtgggttcagcacctgcctcagaggaagccctcggtgcccatcccagcaggagtggtgaaggagcgtttggaaggggaggtaccaaggcagggcagtgcctggaaccctgcgtacccggtgcacacatcag

SEQ ID NO: 42753 - DNA, 140 bp, Homo sapiens
  misc_feature 1..140: note = chr10:134272738-134272878
  misc_feature 1..140: note = hypo
  source 1..140: mol_type = genomic DNA
gactggagggtgtgccgcagtgggagaggacacagggcagggtgtgactggagggtgtgccgcagtgagcgaggacacaggggtctcccattgatctcggcccccggcatggctccccgcaccaccgcagaccggccgtg

SEQ ID NO: 42754 - DNA, 30 bp, Homo sapiens
  misc_feature 1..30: note = chr10:134292599-134292629
  misc_feature 1..30: note = hypo
  source 1..30: mol_type = genomic DNA
agccatgccttctcacggactcctctctgt

SEQ ID NO: 42755 - DNA, 299 bp, Homo sapiens
  misc_feature 1..299: note = chr10:134301017-134301316
  misc_feature 1..299: note = hypo
  source 1..299: mol_type = genomic DNA
gtcctgttttgtcttcgatgcttctctccggtgagctgcaggtggccacagagtcaggcttgggaagctgtgccgcaagcgggaatgagtggacggggctgctcacgcggctgcttttccgtcacggatgccccacccggtcctgtgcgggaggccctgttgaggtgagctccgccctgccgagtgtagggactttgcctccacctccagggttccacatccttccagtaggacacaggcagacatcgccttgggaggctgaatttgctcaaacggcaaacacacgatgagagcctggg

SEQ ID NO: 42756 - DNA, 29 bp, Homo sapiens
  misc_feature 1..29: note = chr10:134315613-134315642
  misc_feature 1..29: note = hypo
  source 1..29: mol_type = genomic DNA
cgatctcctgacctcgtgatctgctggcc

SEQ ID NO: 42757 - DNA, 30 bp, Homo sapiens
  misc_feature 1..30: note = chr10:134341480-134341510
  misc_feature 1..30: note = hypo
  source 1..30: mol_type = genomic DNA
acaacagtgaccccccgccccccggggcca

SEQ ID NO: 42758 - DNA, 371 bp, Homo sapiens
  misc_feature 1..371: note = chr10:134481125-134481496
  misc_feature 1..371: note = hypo
  source 1..371: mol_type = genomic DNA
taatgacatttgaatcgagcattaacaggcttaattactttaaaattgtcattttaatttacactgatatagtattgatcatacaagcagagattaagctgttcagtggagcagatgatggggaattaaacattaaagggtcctcagggggccgtgtgcgctgcccggcgcgagccggaagagggatgatatttctcggtaatgaactggcggcatgcggggacatgaatcttgggctcttggaaaaggggaaataatggggtttgggaggcatttgcaggttattcattcgccgccatgcaccaattctccagtgattcatccgcctcaccaacatttatttatccagcaaattccggagctttgacctt

SEQ ID NO: 42759 - DNA, 30 bp, Homo sapiens
  misc_feature 1..30: note = chr10:134499348-134499378
  misc_feature 1..30: note = hypo
  source 1..30: mol_type = genomic DNA
tcagaattcagctcccgaaatcaagctaag

SEQ ID NO: 42760 - DNA, 167 bp, Homo sapiens
  misc_feature 1..167: note = chr10:134518611-134518778
  misc_feature 1..167: note = hypo
  source 1..167: mol_type = genomic DNA
tgggagcatggagcccgctgtggggcatcagcagcacccacttctccccacagctcagcttcccactgatgtgtttccattgcagacacagttaccgacaggaaatgaacacagaggctccccggggcaaatggcctccccgagagaggaggcggacatgtttggaa

SEQ ID NO: 42761 - DNA, 60 bp, Homo sapiens
  misc_feature 1..60: note = chr10:134542152-134542212
  misc_feature 1..60: note = hypo
  source 1..60: mol_type = genomic DNA
aagtcaagaagaacccgcgaaagaccaaagccgatcaatcccgggcgcccagcaattggg

SEQ ID NO: 42762 - DNA, 152 bp, Homo sapiens
  misc_feature 1..152: note = chr10:134566190-134566342
  misc_feature 1..152: note = hypo
  source 1..152: mol_type = genomic DNA
ggcatggagggggtgcggcgtggaggcggtgcggcatggaggggtgtgtctagagcatctgggagcaattgtctttcatgtggatccaaagtcctccttttctctcagcattttgacacagagcacgcccctgctgtcggtagccaccatac

SEQ ID NO: 42763 - DNA, 298 bp, Homo sapiens
  misc_feature 1..298: note = chr10:134607898-134608196
  misc_feature 1..298: note = hypo
  source 1..298: mol_type = genomic DNA
ctgagccccaccctgcgagggtgctctgagctctcagggcgttgcttctttgcccatttatcccgggtcttgggtgagttccagtggcggacagagctcagacaagagcagtgctcgcagcagcgccagcagggacagtggcaatacgagggtcacaggtgtgatcggaggccgccagcctgtgctgggtcaccgtgcggtgccagtgaaggtgccctctgcccaggagctgtgggggagccgggggtgccgccaggacgcagtgtgggtcgctgggaagacccgaaagaggggagga

SEQ ID NO: 42764 - DNA, 221 bp, Homo sapiens
  misc_feature 1..221: note = chr10:134610702-134610923
  misc_feature 1..221: note = hypo
  source 1..221: mol_type = genomic DNA
tcctgcgggtggcagcggatgggggtgcagaactgcctttttgctgtttgcctgtttaccctctttgtgcccgcgccaaggtgggagccgctacacccagggaggcgctggagcgtgtgcggaggtcagagcctgatgccgcctcggtctctgggtgccggggcagccattccttcaaacaatggggtgcttccaaaccggtgcctcgtgaggaattggga

SEQ ID NO: 42765 - DNA, 30 bp, Homo sapiens
  misc_feature 1..30: note = chr10:134640686-134640716
  misc_feature 1..30: note = hypo
  source 1..30: mol_type = genomic DNA
agacacaaccccacacggtgctcgtcaggg

SEQ ID NO: 42766 - DNA, 30 bp, Homo sapiens
  misc_feature 1..30: note = chr10:134647659-134647689
  misc_feature 1..30: note = hypo
  source 1..30: mol_type = genomic DNA
aacagagataacaaacgcttggaatatagg

SEQ ID NO: 42767 - DNA, 57 bp, Homo sapiens
  misc_feature 1..57: note = chr10:134648015-134648072
  misc_feature 1..57: note = hypo
  source 1..57: mol_type = genomic DNA
ctgggagcaggcaggcggcgccgagtcctgaacaaaggcggccgagaaggcacagca

SEQ ID NO: 42768 - DNA, 87 bp, Homo sapiens
  misc_feature 1..87: note = chr10:134662545-134662632
  misc_feature 1..87: note = hypo
  source 1..87: mol_type = genomic DNA
agcaaaaggcaggtacgtcccggcctggcctgcatggggcgggggccgcggaagaaccctgcgccctccacacgggacttgacgtct

SEQ ID NO: 42769 - DNA, 30 bp, Homo sapiens
  misc_feature 1..30: note = chr10:134664613-134664643
  misc_feature 1..30: note = hypo
  source 1..30: mol_type = genomic DNA
caattaccaggccgacggaagtgtagtcac

SEQ ID NO: 42770 - DNA, 203 bp, Homo sapiens
  misc_feature 1..203: note = chr10:134665029-134665232
  misc_feature 1..203: note = hypo
  source 1..203: mol_type = genomic DNA
cctcatgttccctcccggtcacctagctgcctgccggcaccctgcattccttggcattttccagaaccgtacctaagtggaggcgcacagagtgctgtctttccgtctggttcattttcctcggtaaagtcaccgtgagactcccccacgcggctgcacgcatgctccttccctctcacagccggcgtcggtgcaccgtgtgc

SEQ ID NO: 42771 - DNA, 51 bp, Homo sapiens
  misc_feature 1..51: note = chr10:134671588-134671639
  misc_feature 1..51: note = hypo
  source 1..51: mol_type = genomic DNA
tgcaaggacaatgtacgacatccacagtaacagacacggctcaggtcagac

SEQ ID NO: 42772 - DNA, 30 bp, Homo sapiens
  misc_feature 1..30: note = chr10:134672451-134672481
  misc_feature 1..30: note = hypo
  source 1..30: mol_type = genomic DNA
gtcctgtggaccccgcgggggtgcagccgg

SEQ ID NO: 42773 - DNA, 162 bp, Homo sapiens
  misc_feature 1..162: note = chr10:134682685-134682847
  misc_feature 1..162: note = hypo
  source 1..162: mol_type = genomic DNA
agggaagagggtggccgcgcagctggctttcacctggccgcaccaagggcgagactcaaaccccaggcggcgcagggtgggacggcacacacctggcctgctccagctcgctgacgcacacctgcccgaccgcctcttcatggcgcgcggctgcttctctca

SEQ ID NO: 42774 - DNA, 21 bp, Homo sapiens
  misc_feature 1..21: note = chr10:134683679-134683700
  misc_feature 1..21: note = hypo
  source 1..21: mol_type = genomic DNA
atgagacggtgaactgagtcg

SEQ ID NO: 42775 - DNA, 38 bp, Homo sapiens; identical to SEQ ID NO: 15428
  misc_feature 1..38: note = chr10:134690510-134690548
  misc_feature 1..38: note = hypo
  source 1..38: mol_type = genomic DNA

SEQ ID NO: 42776 - DNA, 156 bp, Homo sapiens
  misc_feature 1..156: note = chr10:134692252-134692408
  misc_feature 1..156: note = hypo
  source 1..156: mol_type = genomic DNA
ctgcccacggctgggcggtggccctcttgatcctgagatgccctatgggggctccgggcaaactcatcctcagaagaaaggcctgccatgcctggcgctgccctgctggggtgtagcctgcgggaggcctagacagacgcacggggaggcccccga

SEQ ID NO: 42777 - DNA, 42 bp, Homo sapiens
  misc_feature 1..42: note = chr10:134693701-134693743
  misc_feature 1..42: note = hypo
  source 1..42: mol_type = genomic DNA
ccccatgggactctccgtgcgcacctgcgctccccacagagt

SEQ ID NO: 42778 - DNA, 42 bp, Homo sapiens
  misc_feature 1..42: note = chr10:134699364-134699406
  misc_feature 1..42: note = hypo
  source 1..42: mol_type = genomic DNA
ccagcaccttgaggccgccctcccagtcgtcctggtcggcat

SEQ ID NO: 42779 - DNA, 345 bp, Homo sapiens
  misc_feature 1..345: note = chr10:134699728-134700073
  misc_feature 1..345: note = hypo
  source 1..345: mol_type = genomic DNA
ccttggagaattctgcgttcacaaacacagacctgtgtttccacgtattaaagattggcgagcaggacttggggtcctttcaggagttgcatggaaagctcccccgcggccgaggacacagcgccacgtgcacgctcgggagtcctcatgcttggtgcccgcagcacgggaacaatccccgagtctccacgcaggcagcggagccatgtgacacgcagaggcaaaggtgcctgccttcagggcacacacaaaaatcgcctgcctgccgggaggtgagccccacccagcctccatagggcgccctgtgggccatcagtgcccccaaatgcacgaagccagcagggt

SEQ ID NO: 42780 - DNA, 32 bp, Homo sapiens
  misc_feature 1..32: note = chr10:134726267-134726299
  misc_feature 1..32: note = hypo
  source 1..32: mol_type = genomic DNA
ctgatgatcaggcctcgcgccaaggtgttgca

SEQ ID NO: 42781 - DNA, 30 bp, Homo sapiens
  misc_feature 1..30: note = chr10:134729962-134729992
  misc_feature 1..30: note = hypo
  source 1..30: mol_type = genomic DNA
gggtgtccctccccacgccagcctgagtgc

SEQ ID NO: 42782 - DNA, 30 bp, Homo sapiens
  misc_feature 1..30: note = chr10:134730720-134730750
  misc_feature 1..30: note = hypo
  source 1..30: mol_type = genomic DNA
acatactgcctaaatcggcaggtgccctgt

SEQ ID NO: 42783 - DNA, 177 bp, Homo sapiens
  misc_feature 1..177: note = chr10:134731838-134732015
  misc_feature 1..177: note = hypo
  source 1..177: mol_type = genomic DNA
gaacccccctctccacgacgcacctcagcaccgatgaacccccctctccatgacgcacctcagcatggatgaaccccacctccgcgaacttccgcagcaggtcggggcacacctgcctctgcaggacgacctcaggctggctccaggtgtcctgcaccgagccgtccctacctcgct

SEQ ID NO: 42784 - DNA, 865 bp, Homo sapiens
  misc_feature 1..865: note = chr10:134732884-134733749
  misc_feature 1..865: note = hypo
  source 1..865: mol_type = genomic DNA
gacagacgtcccacacgccttgtttccgggccactttggccagctctgcccaaatctgtatcctgctcaccgagaacccaaacgagtgaaaggtgagtagacaagtgtggttgctgaagttagaaaacacctgggctggctgcctgagaaaaggccactgtggctctgcagtttcaaggtggcaaggagcccggcactcgcgctgggtacggcctggcgggtgcatgtcccagggtcgggcgcagctctccgctctccctgccagccagctgtgcgcggcacctcccttccctgtggtgagaagaaaggccacacaatccactccccgggggagtgcacgggacaggcctcccggggatggtaccgaccgcagggtcggtaccaaaaatcagcctgctctggtcacaggcgctgcgtgtcctccgagtgacagcagtgacaggcgggacagggcagccgcacacctcataggccgtggctgtcatcacaggctggggggtcccgtctgtggcgggactcccaggcagggacctcgtcccaccatcctggagcaggtggcctggcgagtccccagacggccacatgcagggtcagctcagccgccacagacactggccctcgggctgagcgacccccgggctgagctgtgcgtggcgctctggccttttcctcactcacctctccttgtcgttttcgttgcccaggcgccgcaggtgcccggcagctttgtccacgctgacggtgtggtgccacgccttcgcacagaggtaggtgaaccggcccctgttcttcccggtggagactgagggcggaaatgcaaaggcaggtgttgcagctgctggccaagggccggggacgtgcccat

SEQ ID NO: 42785 - DNA, 193 bp, Homo sapiens
  misc_feature 1..193: note = chr10:134734077-134734270
  misc_feature 1..193: note = hypo
  source 1..193: mol_type = genomic DNA
tgacgccagatgttccgaatcaccgctccttttcctggcaaataatcacgagcacccggaactcagctccacaccctggggggcctcctgtgcatgggcgaccccgggggctgggcctcccctggctggtgtccaccctctcggccagcacaggggttcaccttcaggagccactcaacggcatcctcccctg

SEQ ID NO: 42786 - DNA, 543 bp, Homo sapiens
  misc_feature 1..543: note = chr10:134738145-134738688
  misc_feature 1..543: note = hypo
  source 1..543: mol_type = genomic DNA
tcctcctatgcgccacgccctctgtggaggacacagcacaggtgagcgccccacctgtccagcttctccagcacgtccgcaacgccagccaggggcttccgcaggtggtgccgcaggttgtgctgcagcaggggcaggcaggtgttccactgcgtggcgcacaccacgtggatgacccgggggtcgcccaggcgcacggctcgctgcagcgcgacgtctagcctctgtatgatatccagctgggcctgcggagaagacgtgggggattctagggaggttgctggctcgagctgcggggctggggcggcacctgcgtgcagggcacactgagaacgcaggccctaaattcatcaccctgcgtggcgtcatgctcaaatctgtccgtgaaaatggccagagtgactctttctaggaggaagtggacgtctcacaagatattacatgcaggaggcttggcggtgcccacacatcgtggctgcgcccgcctcccccgtgtggactcagcgggcgctgctcccttcctgatcccgtctctttcctggg

SEQ ID NO: 42787 - DNA, 87 bp, Homo sapiens
  misc_feature 1..87: note = chr10:134739185-134739272
  misc_feature 1..87: note = hypo
  source 1..87: mol_type = genomic DNA
agaagctcagccccacggaggcagacccaggagcaagtccacagcggcatcggcacccgccgggctgtgacacgtgtgccaggcagt

SEQ ID NO: 42788 - DNA, 30 bp, Homo sapiens
  misc_feature 1..30: note = chr10:134757661-134757691
  misc_feature 1..30: note = hypo
  source 1..30: mol_type = genomic DNA
ggcagccaggtgggccggggcacagggcag

SEQ ID NO: 42789 - DNA, 67 bp, Homo sapiens
  misc_feature 1..67: note = chr10:134773913-134773980
  misc_feature 1..67: note = hypo
  source 1..67: mol_type = genomic DNA
cagccatacagaggacgccccgcatgcaggtggggacccacaatcaggcccccggggcaggtgggca

SEQ ID NO: 42790 - DNA, 34 bp, Homo sapiens
  misc_feature 1..34: note = chr10:134788083-134788117
  misc_feature 1..34: note = hypo
  source 1..34: mol_type = genomic DNA
gggagaggtggatgccgcccgcacctgcctctcc

SEQ ID NO: 42791 - DNA, 32 bp, Homo sapiens
  misc_feature 1..32: note = chr10:134793940-134793972
  misc_feature 1..32: note = hypo
  source 1..32: mol_type = genomic DNA
tgcccagcgagtgcccggcgaatgcccagtga

SEQ ID NO: 42792 - DNA, 30 bp, Homo sapiens
  misc_feature 1..30: note = chr10:134794902-134794932
  misc_feature 1..30: note = hypo
  source 1..30: mol_type = genomic DNA
ctggggctgtgcccccgcccgacaagccca

SEQ ID NO: 42793 - DNA, 44 bp, Homo sapiens
  misc_feature 1..44: note = chr10:134797644-134797688
  misc_feature 1..44: note = hypo
  source 1..44: mol_type = genomic DNA
gctcaggcgtctgtgcgagttgctgcgcgcgtgtgggtgtgcgg

SEQ ID NO: 42794 - DNA, 54 bp, Homo sapiens
  misc_feature 1..54: note = chr10:134832061-134832115
  misc_feature 1..54: note = hypo
  source 1..54: mol_type = genomic DNA
gggacccgcagggagcgtggtgacagagaccgtggtgaccgggaccgtgtgcag

SEQ ID NO: 42795 - DNA, 30 bp, Homo sapiens
  misc_feature 1..30: note = chr10:134834266-134834296
  misc_feature 1..30: note = hypo
  source 1..30: mol_type = genomic DNA
tgccacccttctgcccgaagggacagccac

SEQ ID NO: 42796 - DNA, 304 bp, Homo sapiens
  misc_feature 1..304: note = chr10:134834639-134834943
  misc_feature 1..304: note = hypo
  source 1..304: mol_type = genomic DNA
gtgattgagactggtcgctccagtctgcacctgtctgcggtgacggccgcccttcccgtcagcccctccgcggtcccggccccagccctgggttgagggagggctggggaggagcagggacagacgggcaggcaccaggacgctggctgctgcgtgaatgtcacctgtggtcacggccgacgcccggcgggcctgggcatggagtcaggaccggaaagcgaggccggcagcagcaccagctcctcagcaaggcccccgctgccgactgggcacgggcactccaaggggacgcctggcacgtgcc

SEQ ID NO: 42797 - DNA, 95 bp, Homo sapiens
  misc_feature 1..95: note = chr10:134855674-134855769
  misc_feature 1..95: note = hypo
  source 1..95: mol_type = genomic DNA
gggtctgggaaggcagagtccggtaaggctgggtccgggaaggctggggtccgtggggatgggcagggtctgtggggacacgcagggtgtcccac

SEQ ID NO: 42798 - DNA, 60 bp, Homo sapiens
  misc_feature 1..60: note = chr10:134875820-134875880
  misc_feature 1..60: note = hypo
  source 1..60: mol_type = genomic DNA
caacacgttaagtaacgtgtcacgtgcctgctggccaccaccgtccgctcctgggaagaa

SEQ ID NO: 42799 - DNA, 41 bp, Homo sapiens
  misc_feature 1..41: note = chr10:134886279-134886320
  misc_feature 1..41: note = hypo
  source 1..41: mol_type = genomic DNA
tgttcccaccccttccggcacggcaccggcaccgtcctggg

SEQ ID NO: 42800 - DNA, 49 bp, Homo sapiens; identical to SEQ ID NO: 15439
  misc_feature 1..49: note = chr10:134895296-134895345
  misc_feature 1..49: note = hypo
  source 1..49: mol_type = genomic DNA

SEQ ID NO: 42801 - DNA, 177 bp, Homo sapiens
  misc_feature 1..177: note = chr10:134898411-134898588
  misc_feature 1..177: note = hypo
  source 1..177: mol_type = genomic DNA
tgggtccctcatggccgcgtgagccgcttcctcactgtaaagctcttcacctatgtaactatgtatcaatgtaaacaggaacgtatcctccgcctctgcatctctggtgaatccgggcgatacgtggtgagacaccttaataaacacctagatagaccctgccgtggtgagcacctg

SEQ ID NO: 42802 - DNA, 96 bp, Homo sapiens
  misc_feature 1..96: note = chr10:134912118-134912214
  misc_feature 1..96: note = hypo
  source 1..96: mol_type = genomic DNA
gaaaccctcctttcccgtcccacagcgccatccgcatcagccgcaagggccggcacacgctcctgaatttctgcttccacgcggccctgaccttca

SEQ ID NO: 42803 - DNA, 216 bp, Homo sapiens
  misc_feature 1..216: note = chr10:134913796-134914012
  misc_feature 1..216: note = hypo
  source 1..216: mol_type = genomic DNA
accacagcaagtgcccgggaaacgccattgacgtcccgcctgtaagtgcctgcgagaggccgtcaccatcacgtctgcactttgccaccaagtacgccccacactgggatgaagcctgctggatccgcgggtgaggccccccgagggccttcagcaaaccccgcccgcgccttcgggaacacctgccactgcttgcctggacggagctcctggggc

SEQ ID NO: 42804 - DNA, 60 bp, Homo sapiens
  misc_feature 1..60: note = chr10:134916714-134916774
  misc_feature 1..60: note = hypo
  source 1..60: mol_type = genomic DNA
agcctcctgtgctaccgagttgctggcgtgagaccctctatgccccgcagggcagccaca

SEQ ID NO: 42805 - DNA, 102 bp, Homo sapiens
  misc_feature 1..102: note = chr10:134930914-134931016
  misc_feature 1..102: note = hypo
  source 1..102: mol_type = genomic DNA
cccacagaggccaagcgctcagcgtggccacaccagacctgccccctgggaggtccggtgcactgtggacgtgggcagggcagagcccgggagactgcctgg

SEQ ID NO: 42806 - DNA, 255 bp, Homo sapiens
  misc_feature 1..255: note = chr10:134937581-134937836
  misc_feature 1..255: note = hypo
  source 1..255: mol_type = genomic DNA
cttggcactgggtcacgtggtgatgcactcagggctggtcccaggctctgcaccctccccggccagcccaccctcttgggctctgcaccctccccggccaggccaccctcttgggctctgcaccctccccggctctgcaacctccccggccaagccaccctcttgggctctgcaccctccccggctctgcaccctccctggccaggccaccttccccgggctctgagcaatgtgctctgccgtgagtcagctccc

SEQ ID NO: 42807 - DNA, 371 bp, Homo sapiens
  misc_feature 1..371: note = chr10:134940913-134941284
  misc_feature 1..371: note = hypo
  source 1..371: mol_type = genomic DNA
tggggaagcccaggacgaagcagcaaggcctgggcctggacctggggcttgccgagagctgcgcccctcccagctcgcacccccgaggagtgcgcagcgccccctcctctcccagggagtccaacctaatctttgcctttggacaaggcaggcctggtttgccttctatgggaggggcctggggacaaatagcgatttggcaacagcacagagctcagctgagaagggaaaccccatcgagtaggaacggcggtccagccatcagtgcccagagccagcctggaacctctcattcagggccctcagttccttctgcggccccaggatggcccgcccgtctgccctccgccttgccccgcccacccagctcc

SEQ ID NO: 42808 - DNA, 187 bp, Homo sapiens
  misc_feature 1..187: note = chr10:134941647-134941834
  misc_feature 1..187: note = hypo
  source 1..187: mol_type = genomic DNA
agggccaatagggcccggttcccatccacactctcagcgactctagaaacgcccaaggcccccaagccgcagctgtgcaaagccactcgctaggccgggtgggtgcagggccctttgctctgcagggggcgtcctgagtcctggccgtgctggccccgctgacactgacgtgcgtctccccacagct

SEQ ID NO: 42809 - DNA, 656 bp, Homo sapiens
  misc_feature 1..656: note = chr10:134942483-134943139
  misc_feature 1..656: note = hypo
  source 1..656: mol_type = genomic DNA
cgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagccgttcacacccctgc

SEQ ID NO: 42810 - DNA, 30 bp, Homo sapiens
  misc_feature 1..30: note = chr10:134943582-134943612
  misc_feature 1..30: note = hypo
  source 1..30: mol_type = genomic DNA
gggaccctccgctgtcgtgtgtctgagcca

SEQ ID NO: 42811 - DNA, 30 bp, Homo sapiens
  misc_feature 1..30: note = chr10:134945693-134945723
  misc_feature 1..30: note = hypo
  source 1..30: mol_type = genomic DNA
cgtgtgcctgtgtgtcggatgcaatggagt

SEQ ID NO: 42812 - DNA, 104 bp, Homo sapiens
  misc_feature 1..104: note = chr10:134955053-134955157
  misc_feature 1..104: note = hypo
  source 1..104: mol_type = genomic DNA
cgagcaacaaggacacgcacagtcctgtaccgtccccttcccaggcccaggagccacccgcaggggctgagccctgggagcatcccagccgggctctaagggaa

SEQ ID NO: 42813 - DNA, 30 bp, Homo sapiens
  misc_feature 1..30: note = chr10:134970630-134970660
  misc_feature 1..30: note = hypo
  source 1..30: mol_type = genomic DNA
aggagaccgtgtttccgccagagccacagg

SEQ ID NO: 42814 - DNA, 30 bp, Homo sapiens
  misc_feature 1..30: note = chr10:134992431-134992461
  misc_feature 1..30: note = hypo
  source 1..30: mol_type = genomic DNA
tcgacgctgggcagccgcagcagacagtcc

SEQ ID NO: 42815 - DNA, 651 bp, Homo sapiens
  misc_feature 1..651: note = chr10:134996258-134996909
  misc_feature 1..651: note = hypo
  source 1..651: mol_type = genomic DNA
tgtccctccagaaagcgcagaggggcggggccatggccagcacagatctaggcccaactgcgcgggcggcgagggcgcgggcagtgtgggcgcaggtggtgtgggcgtgggtggcatgggcgcaggcggcaagggcatgggtggcgtgggtgcgagcaatgtgggcacggacggtgtgggcacaggcggtgtgggcacaggcggtgtgggcacaggcggtgtgggcacaggcggcgtgggcacaggcggcaagggcatgggtggcatgggtgcgagcagcatgggcggcgtgggtacaagtgaggagggtgtgggcggcgtgggcacgggcagtgtggacgtgggtggcggcaggggcggcaaaagtgtgggcggtatgggtgtgagcagcgtgggcgcgggcggcgagggtgccagcggcgtgggcgcgggcggcaagggtgtgggcagcgtgggcacgggtgctgcttcccctcaggggaatctcacgattcctgaaacttgagctcctggcccggagaagtgctggccgcggtcggggtggcgcacacgcagagactctggagctgacagcctgtcgtgcccacaggcgcacatctactctctgggggccacgctgaaggccgccctcgagtacgtggcagagcccac

SEQ ID NO: 42816 - DNA, 35 bp, Homo sapiens
  misc_feature 1..35: note = chr10:135001392-135001427
  misc_feature 1..35: note = hypo
  source 1..35: mol_type = genomic DNA
ccgccccctgcaccccgtcccgccctccacctcca

SEQ ID NO: 42817 - DNA, 195 bp, Homo sapiens
  misc_feature 1..195: note = chr10:135002007-135002202
  misc_feature 1..195: note = hypo
  source 1..195: mol_type = genomic DNA
tgtccacactgacctcgccgctctcctgcccacagtgggtgtccctgcaggacctcctgtcccagctgggccggcccttccgggagtacgagctgtgggccctgtgcctggcctgcctccgcgcactgcagacacgccctgagcacccaggtgacgcacgcaccatcccatcccccccgccgtccccacccccca

SEQ ID NO: 42818 - DNA, 30 bp, Homo sapiens
  misc_feature 1..30: note = chr10:135010585-135010615
  misc_feature 1..30: note = hypo
  source 1..30: mol_type = genomic DNA
cgaggcatggacagccggaaaatccttgcc

SEQ ID NO: 42819 - DNA, 225 bp, Homo sapiens
  misc_feature 1..225: note = chr10:135011834-135012059
  misc_feature 1..225: note = hypo
  source 1..225: mol_type = genomic DNA
ccccaggcttcctgccggtgaacagcgacaccgggcttgtggctgtgccagggcccgtgcccggccagcacccctgcggtgaagaagccacccagctgcctgcagcgttcacctccgaggccacgcacttcaagcccattgtcctcgcgcagaacgcaagtgtggccaggtgagcatcgtccccacaccccggagctgctgggtcccgggcgcaggcagcccctc

SEQ ID NO: 42820 - DNA, 42 bp, Homo sapiens
  misc_feature 1..42: note = chr10:135012659-135012701
  misc_feature 1..42: note = hypo
  source 1..42: mol_type = genomic DNA
cactcccagggaggacggcctgcccgtcgctgcaggaggcca

SEQ ID NO: 42821 - DNA, 601 bp, Homo sapiens
  misc_feature 1..601: note = chr10:135014788-135015389
  misc_feature 1..601: note = hypo
  source 1..601: mol_type = genomic DNA
cctctctctgtcacccggccccgtgcggcagttcagggtcccagcatctcccctgcactgggaggcggcagccgtgcccggggggcgcccgtggtgggcgggtgcaagagagaagggcgtcgggtgtgcaagcaccaccggcctcccattaacagcctgcccgggctccgcccacaggagccactgtccacgtaacctgcgtctctttctttcaaggaaaagagaagccagccatggccaggaccagcagcagggccccctgctcacccacctcggtgtcggatgtggactcggacgcactgtcacggggaaacttcgaggtggggtttcggcctcagaggtccgtaaaagccgagagagcgcagcagcctgaggctggcgaggacagacggccagctggcggggcctcagacgtggaggcagtgacccgactggccaggtccaaaggggtcggcccagccttgtcccccggcccagccggattccagagctgcagccccggctggtgcagcgccttctacgaggccgactgcttcggggccgacgtccacaactacgtgaaggacctggggcggcagcaggcggacggggccctgcccga

SEQ ID NO: 42822 - DNA, 377 bp, Homo sapiens
  misc_feature 1..377: note = chr10:135017049-135017426
  misc_feature 1..377: note = hypo
  source 1..377: mol_type = genomic DNA
atttcctcccttcagcgctgacccccacctactggtgccggccgtgtgtgctgggctcagcactgcgggtgccctggggctgtggagctggcatccgcgtctcctgctgttaaaacaagcgtggctcccagagtcagcgtggacagcactggtgtgggttcctcccccgtctgtctgcaccggtgaagcctggcctcgtgtttccctcctcactgccccacatgtggtgtggattttagttaccgtggatttattaaaatcagtcaagaccgtcctcctcatggagtccgcctgtggttcccgcgtgaggagcgcccccgacggacatcgagtctgactgtgaacggaggccgtggaggtgccggccagagaggagt

SEQ ID NO: 42823 - DNA, 42 bp, Homo sapiens
  misc_feature 1..42: note = chr10:135018357-135018399
  misc_feature 1..42: note = hypo
  source 1..42: mol_type = genomic DNA
caggaggctgcgggccgagggctgccgcgcctctcacctctg

SEQ ID NO: 42824 - DNA, 30 bp, Homo sapiens
  misc_feature 1..30: note = chr10:135018962-135018992
  misc_feature 1..30: note = hypo
  source 1..30: mol_type = genomic DNA
actctgggcaggttccggagaatcacaccc

SEQ ID NO: 42825 - DNA, 189 bp, Homo sapiens
  misc_feature 1..189: note = chr10:135020704-135020893
  misc_feature 1..189: note = hypo
  source 1..189: mol_type = genomic DNA
ccgcaccctgcgacacgctggacttcagccccctggacgagtcctcctcgctcatcttctacaacgtcaacaagcacccgggcggccggcagaaggcccgcatcctgcaggccggcacgccgctggggctcatggcctacctgtactccaggtgcgttgggagaaaagctcacccggaaaaggagacgt

SEQ ID NO: 42826 - DNA, 30 bp, Homo sapiens; identical to SEQ ID NO: 15452
  misc_feature 1..30: note = chr10:135023111-135023141
  misc_feature 1..30: note = hypo
  source 1..30: mol_type = genomic DNA

SEQ ID NO: 42827 - DNA, 164 bp, Homo sapiens
  misc_feature 1..164: note = chr10:135023434-135023598
  misc_feature 1..164: note = hypo
  source 1..164: mol_type = genomic DNA
gtctcctgagggtggcgcggtttcacccagtgaagacccagaacctttgagcgtgcagcattgcgcccggtcccgaggcaccagctccctcagcttcccgagctaacgggtcctgcgagtggagacgtcacaaagccctgcatagggctgcgttcagaaaggcc

SEQ ID NO: 42828 - DNA, 26 bp, Homo sapiens
  misc_feature 1..26: note = chr10:135025729-135025755
  misc_feature 1..26: note = hypo
  source 1..26: mol_type = genomic DNA
acgtgtgcaccctcacgcaatccaca

SEQ ID NO: 42829 - DNA, 30 bp, Homo sapiens; identical to SEQ ID NO: 15454
  misc_feature 1..30: note = chr10:135035009-135035039
  misc_feature 1..30: note = hypo
  source 1..30: mol_type = genomic DNA

SEQ ID NO: 42830 - DNA, 30 bp, Homo sapiens
  misc_feature 1..30: note = chr10:135035302-135035332
  misc_feature 1..30: note = hypo
  source 1..30: mol_type = genomic DNA
agacgcggcggctcacgcctgtaaccctag

SEQ ID NO: 42831 - DNA, 42 bp, Homo sapiens
  misc_feature 1..42: note = chr10:135037546-135037588
  misc_feature 1..42: note = hypo
  source 1..42: mol_type = genomic DNA
gcccatccaggcttggcctttctttgccgtaatggacgcccc

SEQ ID NO: 42832 - DNA, 100 bp, Homo sapiens
  misc_feature 1..100: note = chr10:135069848-135069948
  misc_feature 1..100: note = hypo
  source 1..100: mol_type = genomic DNA
ttttgccaccaaaggcgatcactgtggatcatgccggttcctgcacacctgtggggtgctctgagcgtggactccccacgcgagccgtccagacgtgctc

SEQ ID NO: 42833 - DNA, 144 bp, Homo sapiens
  misc_feature 1..144: note = chr10:135087501-135087645
  misc_feature 1..144: note = hypo
  source 1..144: mol_type = genomic DNA
aggtctctgtgtagccggagcccagcaggtccctggaaaagaagtgctgtgactgcctcggccccctcggtgcagagaggctggcccagaggctggacgccggggacaccagtgtgctggagccaggcccgggcaggggggccg

SEQ ID NO: 42834 - DNA, 34 bp, Homo sapiens
  misc_feature 1..34: note = chr10:135124157-135124191
  misc_feature 1..34: note = hypo
  source 1..34: mol_type = genomic DNA
acctcctgcagccgtcggccgtgctcacacatca

SEQ ID NO: 42835 - DNA, 27 bp, Homo sapiens
  misc_feature 1..27: note = chr10:135159617-135159644
  misc_feature 1..27: note = hypo
  source 1..27: mol_type = genomic DNA
agggtgtgccagggacggctaaagaag

SEQ ID NO: 42836 - DNA, 30 bp, Homo sapiens
  misc_feature 1..30: note = chr10:135162912-135162942
  misc_feature 1..30: note = hypo
  source 1..30: mol_type = genomic DNA
acacacacccgaacacgacaccacccacag

SEQ ID NO: 42837 - DNA, 18 bp, Homo sapiens
  misc_feature 1..18: note = chr10:135208606-135208624
  misc_feature 1..18: note = hypo
  source 1..18: mol_type = genomic DNA
acccgtggaagggcccgg

SEQ ID NO: 42838 - DNA, 30 bp, Homo sapiens
  misc_feature 1..30: note = chr11:197439-197469
  misc_feature 1..30: note = hypo
  source 1..30: mol_type = genomic DNA
gggtcaggagccaggcgggcaggtgggggt

SEQ ID NO: 42839 - DNA, 30 bp, Homo sapiens
  misc_feature 1..30: note = chr11:299379-299409
  misc_feature 1..30: note = hypo
  source 1..30: mol_type = genomic DNA
caagtggtctcgaggcggggggtgcggggc

SEQ ID NO: 42840 - DNA, 167 bp, Homo sapiens; identical to SEQ ID NO: 15456
  misc_feature 1..167: note = chr11:394801-394968
  misc_feature 1..167: note = hypo
  source 1..167: mol_type = genomic DNA

SEQ ID NO: 42841 - DNA, 173 bp, Homo sapiens
  misc_feature 1..173: note = chr11:429466-429639
  misc_feature 1..173: note = hypo
  source 1..173: mol_type = genomic DNA
cacacacctcagacacggcaggcatatgtgggccgtgcagggcatcgggcgccaacagcccctgctcgggtcggcctcagctgcgctgccagctccacctcacctgttcctcgtcccacacgtacaggtcccagtgcaggaccacgcgggcgcgctgccgcttccagatctcc

SEQ ID NO: 42842 - DNA, 278 bp, Homo sapiens
  misc_feature 1..278: note = chr11:445925-446203
  misc_feature 1..278: note = hypo
  source 1..278: mol_type = genomic DNA
cacttcagaagaccccgtccaccagaccgcctccccctgaggcccaacatgcagcagaggcagctcctccgtccctgcagcctccttttaactgtgggatatggcagccacccgtggagcggtccgggtgacaaagccagcgagagctagggagcgcccaggtgaaatcccacaggcaggtgtgagcaccaattgtcattacctttgccctgggcccctcagagacctgtcctccccccccgcccccaacagcctcctgggcgcggccacagacacag

SEQ ID NO: 42843 - DNA, 39 bp, Homo sapiens
  misc_feature 1..39: note = chr11:449334-449373
  misc_feature 1..39: note = hypo
  source 1..39: mol_type = genomic DNA
tgggatgacaggcgtgcgccgccgcgcccggcctgccta

SEQ ID NO: 42844 - DNA, 103 bp, Homo sapiens
  misc_feature 1..103: note = chr11:449589-449692
  misc_feature 1..103: note = hypo
  source 1..103: mol_type = genomic DNA
gtcaactaaaatcagcgtgtccgcaccattttcgcccgcccaatttcacgcgatcctgcgaaagaatgacccagaccggtccgggcgcggtggctcgcgcctg

SEQ ID NO: 42845 - DNA, 59 bp, Homo sapiens
  misc_feature 1..59: note = chr11:486036-486095
  misc_feature 1..59: note = hypo
  source 1..59: mol_type = genomic DNA
agtgtaaacagtgcacgggcgtgtgtgttcaccgtgtgcgcaggcgagtgtaaacacag

SEQ ID NO: 42846 - DNA, 245 bp, Homo sapiens
  misc_feature 1..245: note = chr11:487303-487548
  misc_feature 1..245: note = hypo
  source 1..245: mol_type = genomic DNA
ccctggccttcttcccggggtctggcaggtgctgctcaggtgtgggctgatctgccggtgtggggagtgggggtggctgtgccccagggtcaagggtcataccctgtcgcccacaggacaagttggatggctttgttcccgcgcactttcttggctggtacctgaaggtacggcacctcctcttcccggcctccccgccccggttctgaggcctgccgtgggctctggaccgtttctgtccatgg

SEQ ID NO: 42847 - DNA, 54 bp, Homo sapiens
  misc_feature 1..54: note = chr11:493145-493199
  misc_feature 1..54: note = hypo
  source 1..54: mol_type = genomic DNA
ccctgggagcccttccggcagcaactcaaccccagacagcgcccaggggctctg

SEQ ID NO: 42848 - DNA, 600 bp, Homo sapiens
  misc_feature 1..600: note = chr11:562246-562846
  misc_feature 1..600: note = hypo
  source 1..600: mol_type = genomic DNA
acagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggtgagcccggggacctgatcccctgtcactcccccacccctgatatgggcagatacggggatcacagggt

SEQ ID NO: 42849 - DNA, 30 bp, Homo sapiens
  misc_feature 1..30: note = chr11:571791-571821
  misc_feature 1..30: note = hypo
  source 1..30: mol_type = genomic DNA
ggcaggggcagcacacggcagtgtcgacca

SEQ ID NO: 42850 - DNA, 42 bp, Homo sapiens
  misc_feature 1..42: note = chr11:707906-707948
  misc_feature 1..42: note = hypo
  source 1..42: mol_type = genomic DNA
gcaaacactcaggctcgccactgagcccgtgaacattccaga

SEQ ID NO: 42851 - DNA, 30 bp, Homo sapiens; identical to SEQ ID NO: 15461
  misc_feature 1..30: note = chr11:762939-762969
  misc_feature 1..30: note = hypo
  source 1..30: mol_type = genomic DNA

SEQ ID NO: 42852 - DNA, 74 bp, Homo sapiens
  misc_feature 1..74: note = chr11:763302-763376
  misc_feature 1..74: note = hypo
  source 1..74: mol_type = genomic DNA
cgccctcacctgccccgccctcacctgtccccgccccgcagggagctcgaggagcagcacggcatccactgcaa

SEQ ID NO: 42853 - DNA, 30 bp, Homo sapiens; identical to SEQ ID NO: 15463
  misc_feature 1..30: note = chr11:763637-763667
  misc_feature 1..30: note = hypo
  source 1..30: mol_type = genomic DNA

SEQ ID NO: 42854 - DNA, 281 bp, Homo sapiens
  misc_feature 1..281: note = chr11:782269-782550
  misc_feature 1..281: note = hypo
  source 1..281: mol_type = genomic DNA
ggggaggggtggggccgttccctcccaagcacacttctggagctgctgcagtcgggggtgaccctaacctaccttgtgccttccttcccatgtgccggggcgggtcccacacacctctctcctgccccgactggctcccacctggggcacgcagttgggcaacccaggccctgctctgcccgtcgagcctccagggcaagtgcaagctcagcctgggcctggagacggcggatcggagcgtgtccaggtgctcagggactggtcaccgaaaggcaaggagc

SEQ ID NO: 42855 - DNA, 104 bp, Homo sapiens
  misc_feature 1..104: note = chr11:823903-824007
  misc_feature 1..104: note = hypo
  source 1..104: mol_type = genomic DNA
agagagaggagaggacggtgagcaggggagggaagccgagcgggtcctgggccccgctgcctccactggccgccgacctcccgcccacccgcagccctgctgga

SEQ ID NO: 42856 - DNA, 132 bp, Homo sapiens
  misc_feature 1..132: note = chr11:824852-824984
  misc_feature 1..132: note = hypo
  source 1..132: mol_type = genomic DNA
ggggctgtgagaccccgaccctctcgaggaaccctgcctgagacgcctccattaccactgcgcagtgagatgaggggactcacagttgccaagaggggtctttgccgtgggccccctcgccagccactcacc

SEQ ID NO: 42857 - DNA, 277 bp, Homo sapiens
  misc_feature 1..277: note = chr11:850546-850823
  misc_feature 1..277: note = hypo
  source 1..277: mol_type = genomic DNA
gaaggtttgcaccatcgcggggtccgccccctgcactcagagcggctgccccacgccctggtcccctctcctctcctctcctctcctcacttgatgagacgggacacgttgcacacgtgcgcgccggacagggccacccgggcactgcgcctctcctagggtcggggttcgagtccgggtcgtggccagttttgcgcggggccccggtgcctcctctgcgcccgctccctcctcggtgcagccgttatccttgcctcggccccgcccctccaggcag

SEQ ID NO: 42858 - DNA, 30 bp, Homo sapiens
  misc_feature 1..30: note = chr11:851077-851107
  misc_feature 1..30: note = hypo
  source 1..30: mol_type = genomic DNA
agctgaggtagagggcggacagggttccac

SEQ ID NO: 42859 - DNA, 58 bp, Homo sapiens
  misc_feature 1..58: note = chr11:858498-858556
  misc_feature 1..58: note = hypo
  source 1..58: mol_type = genomic DNA
ggctcacatgcaccccggatcccacccccgctgacactcaccccggttcccatgcacc

SEQ ID NO: 42860 - DNA, 383 bp, Homo sapiens
  misc_feature 1..383: note = chr11:859019-859402
  misc_feature 1..383: note = hypo
  source 1..383: mol_type = genomic DNA
gcaccccagctctcacgcacccccgggctcacaccaacagcttgcacccccggcacacatgcaccccggctcacacgcacccccgggctcacacgtgccctggctcacacgcacccctgggctcacatgcaccccggctcacacgcaccccaggtcacacgcatcccctcacatgcacccaggctcacacacccacccccagcccacactcatccccgctcacacacacccccactcacacacaccctggcccacacgcaccttggctcacgtgcaccccggctcacacgcaccccccctttcacacgcaccccgggctcacacgcaccccgggctcacacgcaccccccctttcacacgcaccccgggctcacatgcacccc

SEQ ID NO: 42861 - DNA, 33 bp, Homo sapiens
  misc_feature 1..33: note = chr11:860888-860921
  misc_feature 1..33: note = hypo
  source 1..33: mol_type = genomic DNA
ccagaaccagtcaaccgtcggcaccccaggacg

SEQ ID NO: 42862 - DNA, 476 bp, Homo sapiens
  misc_feature 1..476: note = chr11:862616-863092
  misc_feature 1..476: note = hypo
  source 1..476: mol_type = genomic DNA
tgtcctcttccttcccgtccctgtcggctgccaacttgctcatcatcaccggcgcctttgtcatggccatcggcttcgtgggctgcctgggtgccatcaaggagaacaagtgcctcctgctcactgtgagtgccggggcccaagcgatgctccgggtgggaccacgcagggtggggctccggtggcccccaggccttggctgccgcagtgaccccccagacgtgggcaccacctctggggccggacctccaggctggcagtgtggcccggggccctggccactgttgggtcttccaggccacactggggctggggggtgatttgcagagcggtgtgggggtcactcaagagaacgtgctgtaccttgtcaggggcctcccctgacgggacactggccctggtgagtgcaggcacagccccgcacacacgtacacacgcatgcgcagcctttcacgggcttgcggtctccgtgactc

SEQ ID NO: 42863 - DNA, 68 bp, Homo sapiens; identical to SEQ ID NO: 15467
  misc_feature 1..68: note = chr11:864749-864817
  misc_feature 1..68: note = hypo
  source 1..68: mol_type = genomic DNA

SEQ ID NO: 42864 - DNA, 470 bp, Homo sapiens
  misc_feature 1..470: note = chr11:865657-866127
  misc_feature 1..470: note = hypo
  source 1..470: mol_type = genomic DNA
cctcctgcctcagcccgacctgagcttgccccccagttccgctgctgtggcgtctccaactacactgactggttcgaggtgtacaacgccacgcgggtacctgactcctgctgcttggagttcagtgagagctgtgggctgcacgcccccggcacctggtggaaggcggtgagtgagacccccaccctgggggctggtaggggcctagagggcgggaccagcaggccctgccgtgacacgcatgacatccctccctgcagccgtgctacgagacggtgaaggtgtggcttcaggagaacctgctggctgtgggcatctttgggctgtgcacggcgctggtgcaggtatggcctgggggcctgcgggctccctgcccccactttgttaggaccttctgagcccagggaacaaagtagcaaagaccttgcccccaggaacccacgatcgggggaggccggggcaaaagcagg

SEQ ID NO: 42865 - DNA, 30 bp, Homo sapiens; identical to SEQ ID NO: 15469
  misc_feature 1..30: note = chr11:866956-866986
  misc_feature 1..30: note = hypo
  source 1..30: mol_type = genomic DNA

SEQ ID NO: 42866 - DNA, 30 bp, Homo sapiens; identical to SEQ ID NO: 15470
  misc_feature 1..30: note = chr11:875487-875517
  misc_feature 1..30: note = hypo
  source 1..30: mol_type = genomic DNA

SEQ ID NO: 42867 - DNA, 152 bp, Homo sapiens
  misc_feature 1..152: note = chr11:985308-985460
  misc_feature 1..152: note = hypo
  source 1..152: mol_type = genomic DNA
ctgggtacacaaatgtgaatgaactatattaaaaatgctctcatgatgtatgggtgcagccgggaggggcagggtgggctgcgggccactggagactggtgagcaccgttctgtcttgcccagaagaccctgcagtgcgaggccgcctgact

SEQ ID NO: 42868 - DNA, 107 bp, Homo sapiens
  misc_feature 1..107: note = chr11:986906-987013
  misc_feature 1..107: note = hypo
  source 1..107: mol_type = genomic DNA
atgaggctgtcaagacgcacatcgagacggtcatcaacgccctgaaggcgagtgccctgtccttgggttctgctcactccctgagcaggtgccgtgggtcttcctgt

SEQ ID NO: 42869 - DNA, 30 bp, Homo sapiens
  misc_feature 1..30: note = chr11:1008527-1008557
  misc_feature 1..30: note = hypo
  source 1..30: mol_type = genomic DNA
cagttgagctcagatcgtaccactttgctt

SEQ ID NO: 42870 - DNA, 344 bp, Homo sapiens
  misc_feature 1..344: note = chr11:1024866-1025210
  misc_feature 1..344: note = hypo
  source 1..344: mol_type = genomic DNA
tctggctgttgatgacgctgcacttgcgctcggcccaggagcgccggaaggcattgagactgcaggggtctgtcacgaagctcacgtccccgcacagcgggctctccttccacgagttcaccaactccagctcgctggatgccacgtacctgctgcgcgtctcgaagtcgtccttcatgttcccgttgaagttgccacacaagccgcagaggggatcctgcagacggtggcatcaggccgggcccaggggccgtgccatctgtctccacccctgcatcagggagggcctgggaggaggcagagggcgtgcggtacctgggaggcacgggcgatcctgatgagga

SEQ ID NO: 42871 - DNA, 293 bp, Homo sapiens
  misc_feature 1..293: note = chr11:1025896-1026189
  misc_feature 1..293: note = hypo
  source 1..293: mol_type = genomic DNA
cgttgacaccacagacgtcctgcagggagagggcgctgaggaggagccctggaggccgtgcctctgggtccccggcccctgcggcctggcacccgatggttaccgtggccaggatgtactcgcagttgccgtcgaatacgaagcgctggccgtcgaaggtgatgacgtggccctccccgtagagggtgcaggtggatgggcagtgggtgccctgctgacaggcccacctcccccttgagcaggagctgtggagacagcaggtgtgggtggtgggcctgcggccctcctgccat

SEQ ID NO: 42872 - DNA, 159 bp, Homo sapiens
  misc_feature 1..159: note = chr11:1027415-1027574
  misc_feature 1..159: note = hypo
  source 1..159: mol_type = genomic DNA
cgctgtggtggcactcggtggcacggtccgacagcgacaggcaggtgcgctcacaggcttggctgttgtagctgaaggtggtgttacccgtgcaggggatggctgtgggggacccgggcatcagactctccgggagggggcggccgggagggcaatctc

SEQ ID NO: 42873 - DNA, 61 bp, Homo sapiens
  misc_feature 1..61: note = chr11:1028309-1028370
  misc_feature 1..61: note = hypo
  source 1..61: mol_type = genomic DNA
gcgaggcggtgccctcggcgatacccatgctagtggtgaagtcatccgttgtgtccccgtt

SEQ ID NO: 42874 - DNA, 243 bp, Homo sapiens
  misc_feature 1..243: note = chr11:1029178-1029421
  misc_feature 1..243: note = hypo
  source 1..243: mol_type = genomic DNA
tggggtcaccgggagcgcccctccccacgggccacagggctcgtcctacctggaggaggatgtaggtgcaggtgccgtggaagcggtagggcctggcgtcaaatgtggtaacaaaggagccaccttccagggagcagtgtccggggcacggccgctccgtgcacacccagcggcccagggtgcaccggctgtgggtgggcgtgggggtagcggcatggtgggcagggccgctggagccagaca

SEQ ID NO: 42875 - DNA, 143 bp, Homo sapiens
  misc_feature 1..143: note = chr11:1030165-1030308
  misc_feature 1..143: note = hypo
  source 1..143: mol_type = genomic DNA
tctctctaggggtcccggggagagagagtgcctgcgactgccctcaccttccgggcagaagcacccgaaggtgcaggagctggagcagctgtgctgcgggttggagcaggtcttcacgcaggccgagccgcactcctggtaca

SEQ ID NO: 42876 - DNA, 33 bp, Homo sapiens
  misc_feature 1..33: note = chr11:1043870-1043903
  misc_feature 1..33: note = hypo
  source 1..33: mol_type = genomic DNA
tgctgccacttctcccggcgtggactggctgga

SEQ ID NO: 42877 - DNA, 151 bp, Homo sapiens
  misc_feature 1..151: note = chr11:1075796-1075947
  misc_feature 1..151: note = hypo
  source 1..151: mol_type = genomic DNA
gctgtgcacctgaagcggggtccgggccaggctgaggcccccgccggggtggagtccatcctgctgaccatcaaggatgacaccatctacctcacccgccacctggctgtgcttaacggggccgtgtgagtgtggtcggtggcacccctcc

SEQ ID NO: 42878 - DNA, 155 bp, Homo sapiens
  misc_feature 1..155: note = chr11:1077593-1077748
  misc_feature 1..155: note = hypo
  source 1..155: mol_type = genomic DNA
ccagggtcagcaccccgcactacagccccgggctgctcattgagaagagcgatgcctacaccaaagtctactcccgcgccggcctcaccctcatgtggaaccgggaggatgcactcatggtgctcaggggtccccggactcgtggggctggtggg

SEQ ID NO: 42879 - DNA, 16 bp, Homo sapiens
  misc_feature 1..16: note = chr11:1079536-1079552
  misc_feature 1..16: note = hypo
  source 1..16: mol_type = genomic DNA
ccgggcaccgggagct

SEQ ID NO: 42880 - DNA, 30 bp, Homo sapiens
  misc_feature 1..30: note = chr11:1080245-1080275
  misc_feature 1..30: note = hypo
  source 1..30: mol_type = genomic DNA
cagccggggtgacatcgcctccctggctgt

SEQ ID NO: 42881 - DNA, 41 bp, Homo sapiens
  misc_feature 1..41: note = chr11:1083467-1083508
  misc_feature 1..41: note = hypo
  source 1..41: mol_type = genomic DNA
tcaggctcacatctgcggggaagctgcgggctgtctgtggc

SEQ ID NO: 42882 - DNA, 30 bp, Homo sapiens
  misc_feature 1..30: note = chr11:1085664-1085694
  misc_feature 1..30: note = hypo
  source 1..30: mol_type = genomic DNA
ccctgccaactggggcgggtgtgccccggg

SEQ ID NO: 42883 - DNA, 198 bp, Homo sapiens
  misc_feature 1..198: note = chr11:1094942-1095140
  misc_feature 1..198: note = hypo
  source 1..198: mol_type = genomic DNA
agatcgcagtagaagcgtctcaggaggcagcagccgtcgagggtggctgtgtccagggcacggcttcccttgggtggcctctgtggggacctccgctgtggggacctccacggggtccagcggctagccctgcctccggatagccctgcctctggacggtgtgatcgtgggtctgtctcccttcgcaggtgaggaggt

SEQ ID NO: 42884 - DNA, 30 bp, Homo sapiens
  misc_feature 1..30: note = chr11:1095639-1095669
  misc_feature 1..30: note = hypo
  source 1..30: mol_type = genomic DNA
acgtcccttgcctcccgtccccaggagaac

SEQ ID NO: 42885 - DNA, 199 bp, Homo sapiens
  misc_feature 1..199: note = chr11:1103985-1104184
  misc_feature 1..199: note = hypo
  source 1..199: mol_type = genomic DNA
gaggcgagaggccagcgctggccccggaaggtcacccctcactccgccctccccccaggtactcggccaaggcccaggccctggaccacagctgctcctgctgcaaagaggagaaaaccagccagcgtgaggtggtcctgagctgccccaatggcggctcgctgacacacacctacacccacatcgagagctgccagtg

SEQ ID NO: 42886 - DNA, 62 bp, Homo sapiens
  misc_feature 1..62: note = chr11:1115115-1115177
  misc_feature 1..62: note = hypo
  source 1..62: mol_type = genomic DNA
gcgggtggtaaactgcgggtgcccctttgcggtgcccggatacctggcggggagccctgggg

SEQ ID NO: 42887 - DNA, 73 bp, Homo sapiens
  misc_feature 1..73: note = chr11:1140450-1140523
  misc_feature 1..73: note = hypo
  source 1..73: mol_type = genomic DNA
tcccgctctggaggccgcgtctcttccccggcggaccgtcctctacctgcagagccatcgggagcctctgctc

SEQ ID NO: 42888 - DNA, 30 bp, Homo sapiens; identical to SEQ ID NO: 15479
  misc_feature 1..30: note = chr11:1142462-1142492
  misc_feature 1..30: note = hypo
  source 1..30: mol_type = genomic DNA

SEQ ID NO: 42889 - DNA, 30 bp, Homo sapiens
  misc_feature 1..30: note = chr11:1148164-1148194
  misc_feature 1..30: note = hypo
  source 1..30: mol_type = genomic DNA
ccctggccagggtcccggtcacacctgcag

SEQ ID NO: 42890 - DNA, 54 bp, Homo sapiens
  misc_feature 1..54: note = chr11:1151771-1151825
  misc_feature 1..54: note = hypo
  source 1..54: mol_type = genomic DNA
ctttgccctgggttccgggcaggctgcatgtgccatgaacggctcccagcagca

SEQ ID NO: 42891 - DNA, 30 bp, Homo sapiens
  misc_feature 1..30: note = chr11:1152610-1152640
  misc_feature 1..30: note = hypo
  source 1..30: mol_type = genomic DNA
gcaggaattctgtcccggggctgctcccag

SEQ ID NO: 42892 - DNA, 30 bp, Homo sapiens
  misc_feature 1..30: note = chr11:1155200-1155230
  misc_feature 1..30: note = hypo
  source 1..30: mol_type = genomic DNA
gaggtgagtggagcccggaggcctgggtgg

SEQ ID NO: 42893 - DNA, 123 bp, Homo sapiens
  misc_feature 1..123: note = chr11:1155629-1155752
  misc_feature 1..123: note = hypo
  source 1..123: mol_type = genomic DNA
gttctccgagcactgcggtgccgcctacgaggattttaacatccagctacgccgcagccaggagtcagcggcccccacgctgagcagggtcctcatgaaggtggatggcgtggtcatccagct

SEQ ID NO: 42894 - DNA, 302 bp, Homo sapiens
  misc_feature 1..302: note = chr11:1214665-1214967
  misc_feature 1..302: note = hypo
  source 1..302: mol_type = genomic DNA
gagatcgggagaggccggaccctgcaggtctctgtgcttctgcagaaaggtgagacctgggccacacccaactgctccgaggccacctgtgagggcaacaacgtcatctccctgcgcccgcgcacgtgcccgagggtggagaagcccacttgtgccaacggctacccggctgtgaaggtggctgaccaagatggctgctgccatcactaccagtgccagtgtgagtggagcgccgagcgggacccagggcagccggggcagccactccccacccaggtggaaatgggcggggcagaggaggg

SEQ ID NO: 42895 - DNA, 30 bp, Homo sapiens
  misc_feature 1..30: note = chr11:1215395-1215425
  misc_feature 1..30: note = hypo
  source 1..30: mol_type = genomic DNA
tcctggacaactgcacgtacgtgctggtgc

SEQ ID NO: 42896 - DNA, 183 bp, Homo sapiens
  misc_feature 1..183: note = chr11:1215816-1215999
  misc_feature 1..183: note = hypo
  source 1..183: mol_type = genomic DNA
ccaggtcatgttctccggcctcatcttctccgtggaggtgcccttcagcaagtttgccaacaacaccgagggccagtgcggtgaggccacagggctcccgggcatcgtctggcattcgcgggggcgggggtgccgggcaggggcgaggccaccacgtgccgcgtgtgccggtgtctctgcttt

SEQ ID NO: 42897 - DNA, 30 bp, Homo sapiens
  misc_feature 1..30: note = chr11:1229945-1229975
  misc_feature 1..30: note = hypo
  source 1..30: mol_type = genomic DNA
cccctctgccagcctcgcaggcgctaagtc

SEQ ID NO: 42898 - DNA, 30 bp, Homo sapiens
  misc_feature 1..30: note = chr11:1241768-1241798
  misc_feature 1..30: note = hypo
  source 1..30: mol_type = genomic DNA
ggaggggggatgtcacgagggcttggctaa

SEQ ID NO: 42899 - DNA, 183 bp, Homo sapiens
  misc_feature 1..183: note = chr11:1244348-1244531
  misc_feature 1..183: note = hypo
  source 1..183: mol_type = genomic DNA
ccaggatgggtgccccgagcgcgtgccggacgctggtgttggctctggcggccatgctcgtggtgccgcaggcaggtaagagccccccactccgccccctctcgatgctgtcttcacggcgggggtctctgcaggtcgcttgcctgggagcttctcctgcagagtgcacgggcagatccccct

SEQ ID NO: 42900 - DNA, 67 bp, Homo sapiens; identical to SEQ ID NO: 15484
  misc_feature 1..67: note = chr11:1247815-1247882
  misc_feature 1..67: note = hypo
  source 1..67: mol_type = genomic DNA

SEQ ID NO: 42901 - DNA, 486 bp, Homo sapiens
  misc_feature 1..486: note = chr11:1250865-1251351
  misc_feature 1..486: note = hypo
  source 1..486: mol_type = genomic DNA
gaccttggtgtcccccgtgcatgggccggccctgcctcacgccgcgccccacaggcacggtgctggatgacatcacgcactctggctgcctgcccctcgggcagtgcccctgcacccacggcggccgcacctacagcccgggcacctccttcaacaccacctgcagctcctggtacttatgagcccaccagcctccgcctggggtggggtgtggagctcctggtatttatgaacccgccagcctctgcctggggtgggggtgtggagctcctggtgtgcacccaccagcctccgcctgcggtgggggtgtggagggtggggcccacctcctcccgacatgccggttctgctcacggcctccctccccagcacctgctccggggggctatggcagtgccaggacctgccgtgccctggcacctgctctgtgcagggcggggcccacatctccacctatgatgagaaactctacgacctgcatggtga

SEQ ID NO: 42902 - DNA, 178 bp, Homo sapiens
  misc_feature 1..178: note = chr11:1252902-1253080
  misc_feature 1..178: note = hypo
  source 1..178: mol_type = genomic DNA
gcccccagggcatggcggagatcctggtgccagcgcaggacaccagcattggaccagcggccccggaagcagccagctgggaggatggagcgggcagccctgccctggctcaggccgactttgcacaggggctggctttgcacaggggccgactgcacaggggcgccccccgccaggg

SEQ ID NO: 42903 - DNA, 30 bp, Homo sapiens
  misc_feature 1..30: note = chr11:1254339-1254369
  misc_feature 1..30: note = hypo
  source 1..30: mol_type = genomic DNA
ctgcagcgtttccttcgtgcctgtggacgg

SEQ ID NO: 42904 - DNA, 321 bp, Homo sapiens
  misc_feature 1..321: note = chr11:1254973-1255294
  misc_feature 1..321: note = hypo
  source 1..321: mol_type = genomic DNA
ctgcggggtgagggccgcagatccaggctgtgccgtctgtctcttgtagttcatgtacgggtgggaagctaagctgcctgggagcctctctgcagaaaagcacaggtaagtgccacccctgccctgccctgccctgccccgccccgcatcaccccgcctggcctggccccaacacgccccaccctgccccaccccacctgaaccctgccgggccaggtcagtcctcacctgggctctgccacaggcacccatgccctgacacgccagggacggaggggccagtgggtctctgccccgcagtgtggccggggtgtcctgggg

SEQ ID NO: 42905 - DNA, 48 bp, Homo sapiens
  misc_feature 1..48: note = chr11:1256469-1256517
  misc_feature 1..48: note = hypo
  source 1..48: mol_type = genomic DNA
cccactcctgcaggccgggcacactccagcccgcggccagcagcttgt

SEQ ID NO: 42906 - DNA, 141 bp, Homo sapiens
  misc_feature 1..141: note = chr11:1257678-1257819
  misc_feature 1..141: note = hypo
  source 1..141: mol_type = genomic DNA
ccaccctacaagatacgctacatggggatcttcctggtcatcgagacccacgggatggccgtgtcctgggaccggaagaccagcgtgttcatccgactgcaccaggactacaaggtgagctcgggccgtgcactcctaggc

SEQ ID NO: 42907 - DNA, 178 bp, Homo sapiens
  misc_feature 1..178: note = chr11:1263199-1263377
  misc_feature 1..178: note = hypo
  source 1..178: mol_type = genomic DNA
cagcccttccagggacgacggggagcttgggcacatggcgcccctcacagccacccacgctggccccaacaacaatggcaacctccagagctcgcccgacaggcacagccagcaccgcttccaaagagccgctgaccacgagcctggcgccaacactcacgagcgagctgtccacctc

SEQ ID NO: 42908 - DNA, 99 bp, Homo sapiens
  misc_feature 1..99: note = chr11:1263602-1263701
  misc_feature 1..99: note = hypo
  source 1..99: mol_type = genomic DNA
ggcggagaactaccccgaggtaagcatcgaccaggtcgggcaggtgctgacctgcagcctggagacggggctgacctgcaagaacgaagaccagacagg

SEQ ID NO: 42909 - DNA, 30 bp, Homo sapiens
  misc_feature 1..30: note = chr11:1274002-1274032
  misc_feature 1..30: note = hypo
  source 1..30: mol_type = genomic DNA
tggtccaggtgaggacgtgcatgttccctg

SEQ ID NO: 42910 - DNA, 35 bp, Homo sapiens
  misc_feature 1..35: note = chr11:1275653-1275688
  misc_feature 1..35: note = hypo
  source 1..35: mol_type = genomic DNA
gggtgacccaggtgccgcagcgatggcccagtgcc

SEQ ID NO: 42911 - DNA, 445 bp, Homo sapiens
  misc_feature 1..445: note = chr11:1276293-1276738
  misc_feature 1..445: note = hypo
  source 1..445: mol_type = genomic DNA
gacgactgtctccagcgggacggaaccactgccgccagttgcaaggacatggccaagacgtggctggtccccgacagcagaaaggatggctgctgggccccgactggcacaccccccactgccagccccgcagccccggtgtctagcacacccacccccaccccatgcccaccacagccgctctgtgatctgatgctgagccagtgagtcctcccctcgggggttgcaggccctggggcgcccccgcccgcccgcatgcacgcacgcacgcagctccctggggctgggggccctccgtcctgatcgctttgccccacagggtctttgctgagtgccacaaccttgtgcccccgggcccattcttcaacgcctgcatcagcgaccactgcaggggccgccttgaggtgccctgccagagcctggaggcttacgcagagctctgccg

SEQ ID NO: 42912 - DNA, 20 bp, Homo sapiens
  misc_feature 1..20: note = chr11:1359706-1359726
  misc_feature 1..20: note = hypo
  source 1..20: mol_type = genomic DNA
aatctcgggaccaggtggag

SEQ ID NO: 42913 - DNA, 40 bp, Homo sapiens
  misc_feature 1..40: note = chr11:1368324-1368364
  misc_feature 1..40: note = hypo
  source 1..40: mol_type = genomic DNA
acagggtgcaggtctcggtccccgacgtcaccctccagtg

SEQ ID NO: 42914 - DNA, 44 bp, Homo sapiens
  misc_feature 1..44: note = chr11:1374959-1375003
  misc_feature 1..44: note = hypo
  source 1..44: mol_type = genomic DNA
agctacctgtggagccggcgccttctctccgtccttctcacact

SEQ ID NO: 42915 - DNA, 183 bp, Homo sapiens
  misc_feature 1..183: note = chr11:1382225-1382408
  misc_feature 1..183: note = hypo
  source 1..183: mol_type = genomic DNA
catggcacagatgggcggccacctgaacgagtgggaggagtgcagtcccaggccctcccagagactgtgccatagtctccaccccaagtgacggtggagggatgctgggaacggtaagctttaatgcttggtgaatcttgcattgcctcattcatgaccggtaggtcacgtggtcatctgaca

SEQ ID NO: 42916 - DNA, 120 bp, Homo sapiens
  misc_feature 1..120: note = chr11:1393300-1393420
  misc_feature 1..120: note = hypo
  source 1..120: mol_type = genomic DNA
agcggccgaccttggcggcctgcagtgcccttggcctcccctcgggttgggctggcccatcaggctctgtacccgccctgctgcggctccacgtcgggctggcgccggctgaggaacaga

SEQ ID NO: 42917 - DNA, 30 bp, Homo sapiens
  misc_feature 1..30: note = chr11:1420766-1420796
  misc_feature 1..30: note = hypo
  source 1..30: mol_type = genomic DNA
ggattgtggcaaggccgggctggtcagctg

SEQ ID NO: 42918 - DNA, 30 bp, Homo sapiens
  misc_feature 1..30: note = chr11:1422084-1422114
  misc_feature 1..30: note = hypo
  source 1..30: mol_type = genomic DNA
cctccccaggctcctcgtggtgctgggacc

SEQ ID NO: 42919 - DNA, 408 bp, Homo sapiens
  misc_feature 1..408: note = chr11:1430714-1431122
  misc_feature 1..408: note = hypo
  source 1..408: mol_type = genomic DNA
ctgctcagggtgtgccgggggctttgagtcacttctgtgtctccttggaggctgtgtggcgtccgcggaagttggtgtctgtgcggtgtggttctgtttatgggtgttgtagagaaggcgccgtccagagacagagccactgctgaggtgggtggggggtgtatgaagggcacaaggacgctttgggggtgtcaggtatgatggccctcaggtcatggtttcacacgcgtgtgctttaaatgcgtgctggctgtcacgtgtcagtcgtgcctccacagagcttcaggaaccaccgagatggggagcctgccggagacacaggttttctgagcgcaccagcggctccaaaagcagagggaagagccctgcgtgcaggtggggcgctcatggcgtcggcctcgcagagcg

SEQ ID NO: 42920 - DNA, 42 bp, Homo sapiens
  misc_feature 1..42: note = chr11:1433065-1433107
  misc_feature 1..42: note = hypo
  source 1..42: mol_type = genomic DNA
tcctgcccactggcccggcctggcatccgggccctcatcttg

SEQ ID NO: 42921 - DNA, 30 bp, Homo sapiens
  misc_feature 1..30: note = chr11:1434266-1434296
  misc_feature 1..30: note = hypo
  source 1..30: mol_type = genomic DNA
catgttaggagcctgcgttcagaacccgca

SEQ ID NO: 42922 - DNA, 128 bp, Homo sapiens
  misc_feature 1..128: note = chr11:1442699-1442827
  misc_feature 1..128: note = hypo
  source 1..128: mol_type = genomic DNA
gccaggcagaggcagcggagcggctgcagtgcgtgtgaaatgcttcagggtggcacgaatttaactagagaggttcttttccaacgtgagcagttgtctcccaagagatgcgccgccccttccctctg

SEQ ID NO: 42923 - DNA, 373 bp, Homo sapiens
  misc_feature 1..373: note = chr11:1444579-1444952
  misc_feature 1..373: note = hypo
  source 1..373: mol_type = genomic DNA
ccttcagttaggagccgaggcctctggccaggttcaggcacgtggagagtgtgtgtggggagaagttctgagactgtgggaggggtaggggtgtgctgtggccacagtggttctggaatttgaggtgccttaggaggttcatgatgaaggatgcggcccacagtcgtgtgagcagaggacggcactcgcgagctccctggggctcctcagacccggtcaccgaacagcagagacgtgctctttcacattctggaggcgggaagtccaaggtccagggtgggctggctcttccaaggcctcaaggaagccctgccccaagcctcccccgctgggcgttccgggtgccccaggcctcccccgctgggcgttccgg

SEQ ID NO: 42924 - DNA, 61 bp, Homo sapiens
  misc_feature 1..61: note = chr11:1446330-1446391
  misc_feature 1..61: note = hypo
  source 1..61: mol_type = genomic DNA
tgatgggaagcctgacgtctgcatcgtcctgcgctgcgtggccggtcggtcccggcgctct

SEQ ID NO: 42925 - DNA, 30 bp, Homo sapiens
  misc_feature 1..30: note = chr11:1447472-1447502
  misc_feature 1..30: note = hypo
  source 1..30: mol_type = genomic DNA
gggatgtgtgtggggcgtgctccggggatg

SEQ ID NO: 42926 - DNA, 35 bp, Homo sapiens
  misc_feature 1..35: note = chr11:1450725-1450760
  misc_feature 1..35: note = hypo
  source 1..35: mol_type = genomic DNA
gccctgctgctctgtcgccagcatcctgctgtgcc

SEQ ID NO: 42927 - DNA, 66 bp, Homo sapiens
  misc_feature 1..66: note = chr11:1455198-1455264
  misc_feature 1..66: note = hypo
  source 1..66: mol_type = genomic DNA
cacagatgaaactgacggaaagggcaaaataaagctaaaagccgatggggccgggggaatggaggt

SEQ ID NO: 42928 - DNA, 30 bp, Homo sapiens
  misc_feature 1..30: note = chr11:1455520-1455550
  misc_feature 1..30: note = hypo
  source 1..30: mol_type = genomic DNA
atctgggtgtctgggcgcacctaggagtgg

SEQ ID NO: 42929 - DNA, 65 bp, Homo sapiens
  misc_feature 1..65: note = chr11:1461955-1462020
  misc_feature 1..65: note = hypo
  source 1..65: mol_type = genomic DNA
tgggatgaggaggggcggcgggcagccacagctgggcgcactggtggccccgtctcctgcaggta

SEQ ID NO: 42930 - DNA, 30 bp, Homo sapiens
  misc_feature 1..30: note = chr11:1463761-1463791
  misc_feature 1..30: note = hypo
  source 1..30: mol_type = genomic DNA
gaacaacatccgcatcgcagactttggcat

SEQ ID NO: 42931 - DNA, 767 bp, Homo sapiens
  misc_feature 1..767: note = chr11:1464204-1464971
  misc_feature 1..767: note = hypo
  source 1..767: mol_type = genomic DNA
cagggaatgtgggggcgtctggcaccacagccctggaggcctccttgagggccctgcggtgcaccatcaccctggggggagggcctggcagcgcccggagccccgccgctgacctctgcccttgcccgcaggtccccccactacgcctgccccgaggtgatccgggtgagtcagcgccgccgcgtgcagctctgtggggcccagggtggcggggacctgaccctggtgggaccccagcctgccgcacccccaggtgctgctaggctgcctgtccccgggccgactccctctgagcccaggccctccaaggcccccgccctgccctgcgccccccaacagcccgggcactgctgtccacagggggagaagtatgacggccggaaggcggacgtgtggagctgcggcgtcatcctgttcgccttgctggtggtgagaccctggccccctcaaccctgccctggcctctccccaaacctgcccccccacgctgacccccacacccggccgcccgcagggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacggtgcgtgccctcggagcggggcggccccagagcgtggcgggggggcgcgggggcgggcgtgtgcctgtgtgtgcacaggtgtgtgcccagacgtgtgggcacccag

SEQ ID NO: 42932 - DNA, 292 bp, Homo sapiens
  misc_feature 1..292: note = chr11:1466910-1467202
  misc_feature 1..292: note = hypo
  source 1..292: mol_type = genomic DNA
gggtggcctccagcccggcctgcactgccccaccggggtccgggggctgtctggcctgaccttcgtctgtactcagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtgtgtgtgccccgaggctgctgggcctccctccctgggccctggctgcgcggcactgccgcctg

SEQ ID NO: 42933 - DNA, 510 bp, Homo sapiens
  misc_feature 1..510: note = chr11:1469123-1469633
  misc_feature 1..510: note = hypo
  source 1..510: mol_type = genomic DNA
tcccagccccagacacgctgtcctgcctcaggccgggcaggcacatgggcgggtctggtggcgggctgggctgcagggctcctgctgcggtgaagccagccagcaagccaggcaagggcccgcgggccaggcagaggccgaggaggggtggggctgctgaggcgtggcccacgcctgcctgtgagggaccacgcaccatggcttacagggcctggggctagagcccggcgtggctgcaggccgagccgctcctcctgccagcccctgtgctgtgtccggtgggcctcggtggccctgctgcccctggggccggccagagttgaagccgagcagccgtcctgtgcccacctgcaggagctgaggagggcaggaggcgccgccgtcaagaggggcctctacctggggccagttttgcgagcctgggcgggtggcgccgcccccaaggctgcagtgtgctggctgccggtcggggtccttctctttgagccctggccccgtgcctacctggga

SEQ ID NO: 42934 - DNA, 47 bp, Homo sapiens
  misc_feature 1..47: note = chr11:1471413-1471460
  misc_feature 1..47: note = hypo
  source 1..47: mol_type = genomic DNA
tgcccccaccccgctcgctccctgcgcctccccgtagcctattagga

SEQ ID NO: 42935 - DNA, 193 bp, Homo sapiens
  misc_feature 1..193: note = chr11:1471865-1472058
  misc_feature 1..193: note = hypo
  source 1..193: mol_type = genomic DNA
ggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaaggtgagtgtctgcccggaggcgccagagtggggct

SEQ ID NO: 42936 - DNA, 127 bp, Homo sapiens
  misc_feature 1..127: note = chr11:1473513-1473640
  misc_feature 1..127: note = hypo
  source 1..127: mol_type = genomic DNA
gtggcctttctgcgccgatcaggtggcccttccagctgggtgcccaggtcggaggtgtgtaggtattgtcgcaagcccagatgcacagggctcagcagacttgggaaccttccgcctaggccctgac

SEQ ID NO: 42937 - DNA, 140 bp, Homo sapiens
  misc_feature 1..140: note = chr11:1477763-1477903
  misc_feature 1..140: note = hypo
  source 1..140: mol_type = genomic DNA
ctggcgcccccagggcggctccgggcccaggcccgtccagggcataaccccctgtctcccctaggccccagccgtcgcttcaagagggtggtggagaccatccaggcccagctgctgagcacacacgacccgcctgcggc

SEQ ID NO: 42938 - DNA, 168 bp, Homo sapiens
  misc_feature 1..168: note = chr11:1478164-1478332
  misc_feature 1..168: note = hypo
  source 1..168: mol_type = genomic DNA
gcgcctcttgtccaccgtagaaccccccccaccagcgccaggactaagctggggtgctgggcttaagggccagaaggtggccaccagctacgagagtagcctctgacgctggcaggtaaggcgcccggcctgtgctggggcggggaggggctgcgggcaggtcctcgg

SEQ ID NO: 42939 - DNA, 399 bp, Homo sapiens
  misc_feature 1..399: note = chr11:1483506-1483905
  misc_feature 1..399: note = hypo
  source 1..399: mol_type = genomic DNA
caggcgggcacagcccgggtgcggcggccgtgggggacggcgggtctgatgcatgcctctgccatggagtcgtctgtctgcttcggtgcctgcccctgcctcccacccacctcgtgtatagattttaacgcttctgttaacattagacctctgccacaggctgggatttctatacataagaacaaaagcaaacacctaggacagcaaacgccaggcggtacaggcgggaaggggctctccacggagatcgaggacacgaagcaaactgcctcttgcttgccttccccttttgtgcttcggacacacgcggactccagcaggcgccacggaaatgggcaagcccctgcagtgtacccctgtcataactgtgagcagctgcagctccggaacaataaatcc

SEQ ID NO: 42940 - DNA, 30 bp, Homo sapiens
  misc_feature 1..30: note = chr11:1517598-1517628
  misc_feature 1..30: note = hypo
  source 1..30: mol_type = genomic DNA
accaggagactgatgcgctacaggcagggc

SEQ ID NO: 42941 - DNA, 47 bp, Homo sapiens
  misc_feature 1..47: note = chr11:1553685-1553732
  misc_feature 1..47: note = hypo
  source 1..47: mol_type = genomic DNA
aggagcttccgtagacggtgcaggccaaaccccgagacaacagcccc

SEQ ID NO: 42942 - DNA, 35 bp, Homo sapiens
  misc_feature 1..35: note = chr11:1560806-1560841
  misc_feature 1..35: note = hypo
  source 1..35: mol_type = genomic DNA
aaattgtggcagagcgaattcgagtttgcaggacc

SEQ ID NO: 42943 - DNA, 176 bp, Homo sapiens
  misc_feature 1..176: note = chr11:1669565-1669741
  misc_feature 1..176: note = hypo
  source 1..176: mol_type = genomic DNA
tcaccggccagagggcgcagccacccggccttcccgaagcaggacagcggcctttccaagaccgcggagtccccgtgagggatggtgcctccggagcctggcatctcgggcggatgagaagctgagcgcggtcagatggcccgcagggtcccactgcgggccgagccctggctggg

SEQ ID NO: 42944 - DNA, 84 bp, Homo sapiens
  misc_feature 1..84: note = chr11:1760346-1760430
  misc_feature 1..84: note = hypo
  source 1..84: mol_type = genomic DNA
gtggttacaggaatataggaacggatgccagactggaagggcaggtgcacagatgggtttctgaatgcacgctggatggctgga

SEQ ID NO: 42945 - DNA, 30 bp, Homo sapiens
  misc_feature 1..30: note = chr11:1790238-1790268
  misc_feature 1..30: note = hypo
  source 1..30: mol_type = genomic DNA
ggaaaggaagcagtccgaggtcagagagag

SEQ ID NO: 42946 - DNA, 91 bp, Homo sapiens
  misc_feature 1..91: note = chr11:1795195-1795286
  misc_feature 1..91: note = hypo
  source 1..91: mol_type = genomic DNA
tggaataactgaatacgcagctcactgtcccccaagcttggttggggactcttccttcatattttaacaaaatccacggcacctctgggat

SEQ ID NO: 42947 - DNA, 30 bp, Homo sapiens
  misc_feature 1..30: note = chr11:1801108-1801138
  misc_feature 1..30: note = hypo
  source 1..30: mol_type = genomic DNA
aggccctcacctgcccgggccttcgctgct

SEQ ID NO: 42948 - DNA, 45 bp, Homo sapiens
  misc_feature 1..45: note = chr11:1825207-1825252
  misc_feature 1..45: note = hypo
  source 1..45: mol_type = genomic DNA
gtctggggcaccccacgatggaggggaagacggcccagggggcat

SEQ ID NO: 42949 - DNA, 57 bp, Homo sapiens
  misc_feature 1..57: note = chr11:1856532-1856589
  misc_feature 1..57: note = hypo
  source 1..57: mol_type = genomic DNA
ctgggctctcattgccggcgcccttgccgcgggcgtcctcctcgtctcctgcctcct

SEQ ID NO: 42950 - DNA, 102 bp, Homo sapiens
  misc_feature 1..102: note = chr11:1857426-1857528
  misc_feature 1..102: note = hypo
  source 1..102: mol_type = genomic DNA
cgtctccacccaggccggacacagacatgagacaaaagtgcaccgaggcacgctctgccccgtgtttgacgagacctgctgcttccacgtgagtcagggatg

SEQ ID NO: 42951 - DNA, 30 bp, Homo sapiens
  misc_feature 1..30: note = chr11:1857873-1857903
  misc_feature 1..30: note = hypo
  source 1..30: mol_type = genomic DNA
tgccctatgggccatcggaaagacaggcct

SEQ ID NO: 42952 - DNA, 30 bp, Homo sapiens
  misc_feature 1..30: note = chr11:1863098-1863128
  misc_feature 1..30: note = hypo
  source 1..30: mol_type = genomic DNA
ccaccccaggctgcacggggctgtttggtg

SEQ ID NO: 42953 - DNA, 30 bp, Homo sapiens
  misc_feature 1..30: note = chr11:1867693-1867723
  misc_feature 1..30: note = hypo
  source 1..30: mol_type = genomic DNA
acatggagatgagagcgcctgcctcactgg

SEQ ID NO: 42954 - DNA, 257 bp, Homo sapiens
  misc_feature 1..257: note = chr11:1868053-1868310
  misc_feature 1..257: note = hypo
  source 1..257: mol_type = genomic DNA
catttgttcactgtccgtctcttcctctgggagggaaaatccacgaagtcagggacctggagttatttgcagctgtgtcagtgctgctggggcgaggcatacacctgtgacgggacctcaggacggggacacgggtctgcatgaggattgtctaacagtccctacaagacgctggggccaccatgtacactggagtcctctggcagccagtgttccccgttgtgcggggctggccgtgaccacgctggaaacccccc

SEQ ID NO: 42955 - DNA, 58 bp, Homo sapiens
  misc_feature 1..58: note = chr11:1935022-1935080
  misc_feature 1..58: note = hypo
  source 1..58: mol_type = genomic DNA
cgttccagtcctagacgcctcaccccgcgctctgcggtgagcacgagctgtgcactgg

SEQ ID NO: 42956 - DNA, 30 bp, Homo sapiens
  misc_feature 1..30: note = chr11:1949952-1949982
  misc_feature 1..30: note = hypo
  source 1..30: mol_type = genomic DNA
ccaccccggctgcaacgccctcttggtgga

SEQ ID NO: 42957 - DNA, 83 bp, Homo sapiens
  misc_feature 1..83: note = chr11:1955308-1955391
  misc_feature 1..83: note = hypo
  source 1..83: mol_type = genomic DNA
aggccttccttctcccggggttcccattgtcattggccaatgatcagaaccactggctaaggccccggcgccctgcagaaccc

SEQ ID NO: 42958 - DNA, 158 bp, Homo sapiens
  misc_feature 1..158: note = chr11:1957372-1957530
  misc_feature 1..158: note = hypo
  source 1..158: mol_type = genomic DNA
aagctagcccacagccgggcctcgatgccccagccgcccatccagccttgtaaccatcttggtctttctagatcatgaatgtccgggccagagtgcagatgctggccaagttgtaagtagccgggtccgccctgggccaggcccgtgggtgtgcgttg

SEQ ID NO: 42959 - DNA, 482 bp, Homo sapiens
  misc_feature 1..482: note = chr11:1957864-1958346
  misc_feature 1..482: note = hypo
  source 1..482: mol_type = genomic DNA
ctccccagccccatccgtgctccgtaccccccgccccacatcctgccgcaggctgaaggtaagtggccagctacgggctgctgtgtgtggcagtccaggccagtacaggctggcgagagtaagtccaggcatgagcccaggggccacgggacggtgtccccctgcacaaggagccaggagacagtaagggagccgaggagccctcatgggggcccagcagccctgggtcgcgcagcccagcccaccctgcggtggagacaggccttcacccagtacacgcaggcctggccctcgggtcgtcgcagtgagtcactcatgttgttcacagatcaccacgctcaggagccgcattgaccaggcccagaagcagtgagtagccctgccgtcctcgctccgcactgggcacaggggcccttggggccagccgctgtagccagtccctaacaagggccggtggtggctggcctcggcagggcagtaac

SEQ ID NO: 42960 - DNA, 354 bp, Homo sapiens
  misc_feature 1..354: note = chr11:1958885-1959239
  misc_feature 1..354: note = hypo
  source 1..354: mol_type = genomic DNA
ggctacttggagtttcgatgttttctgggattcttctccctcctcctgtcgccttggcttccctgcggcgcccagggcgggctcctccgtggtgcacgtgacctcacggcctccctgttgtgccgtcaggggtcattgcagacccctctgagggtgggcagtcggcgtggtgtgcatgtgcctgcgtgtgtgcatgtgtgcatgtgccgagagtgcccaggaacgtgtgtgagggcacggcctttgccagccaggtgtcctgctgagcagccgcgtctgaatggggccggcctcgcgggccgaagcactcctgtcctccacccgccttcacccctcacccgcacccagctcctc

SEQ ID NO: 42961 - DNA, 88 bp, Homo sapiens
  misc_feature 1..88: note = chr11:1959951-1960039
  misc_feature 1..88: note = hypo
  source 1..88: mol_type = genomic DNA
tctgcatgggggccccggaggacacgagaggaggcaggtaggggctagccaatggcacagcgtcctggtcatccgcggggccagctca

SEQ ID NO: 42962 - DNA, 30 bp, Homo sapiens
  misc_feature 1..30: note = chr11:1976039-1976069
  misc_feature 1..30: note = hypo
  source 1..30: mol_type = genomic DNA
cggcagcccccagggcgccctgggattcct

SEQ ID NO: 42963 - DNA, 335 bp, Homo sapiens
  misc_feature 1..335: note = chr11:1981002-1981337
  misc_feature 1..335: note = hypo
  source 1..335: mol_type = genomic DNA
tctggacatcctcagcgtggcaggagtgggagagggaccctgacccaagagatagcaagtgggcccgcggccttgcctcggtcgcccccaacatgacagcccttcccctcgtggacatctccagctgggagcagggtcggggacagccagagacaaaggcaacaggacgagggagagagccgacagcgctgctccgtgtccccattcatgttcatttattgccatgcaggggtgatgcaaggcccaggcagtgccatgctgcgtgcatgggaaggggtggagggccctcgggaccgcaccgggctgtgctcatagctggacggccccacttctct

SEQ ID NO: 42964 - DNA, 133 bp, Homo sapiens
  misc_feature 1..133: note = chr11:2036968-2037101
  misc_feature 1..133: note = hypo
  source 1..133: mol_type = genomic DNA
tctctcctgccactccgcaggagccacttctgcccatcccagaaccagccctcagggcaggcttggtgccaccgctgtgctgggtgtgcacgatgcccgtgggccgccggctcccctccgtgctaatgccacc

SEQ ID NO: 42965 - DNA, 160 bp, Homo sapiens
  misc_feature 1..160: note = chr11:2040029-2040189
  misc_feature 1..160: note = hypo
  source 1..160: mol_type = genomic DNA
cctccagaggggccccgccacagtccatccccttcgcccaggtcccctcggatcagggcctgccagggtggtgtggcaaaggggcctgcatcgcgccaacctctcgcagctctccagcgggtgcagccaggctctggcccccacacgcttgggctttgct

SEQ ID NO: 42966 - DNA, 220 bp, Homo sapiens
  misc_feature 1..220: note = chr11:2042281-2042501
  misc_feature 1..220: note = hypo
  source 1..220: mol_type = genomic DNA
taccattggctcctgcgtctggggcacccacgtcacacccttcatctgctcagtcagcccgaggcagctcccagcctcaggaaagcccagaagcaattggaagagtctgggggtgggaggcgcgaggacatcggacagacctggcgcggccgggcggtgcaggcctgcttcagccttctttggcctgggcttgaaggcaggcctgcgcctgaggggtctg

SEQ ID NO: 42967 - DNA, 71 bp, Homo sapiens
  misc_feature 1..71: note = chr11:2048987-2049058
  misc_feature 1..71: note = hypo
  source 1..71: mol_type = genomic DNA
tctcgccactgcccacgccagcaccaaggcctgtcctctccaggcggtgccctcgccggtcctgctggctc

SEQ ID NO: 42968 - DNA, 30 bp, Homo sapiens
  misc_feature 1..30: note = chr11:2108079-2108109
  misc_feature 1..30: note = hypo
  source 1..30: mol_type = genomic DNA
tgggcgtgggggagtcggagctgcctgtgc

SEQ ID NO: 42969 - DNA, 30 bp, Homo sapiens
  misc_feature 1..30: note = chr11:2110642-2110672
  misc_feature 1..30: note = hypo
  source 1..30: mol_type = genomic DNA
tctgaacaccataaacgccaacacaaggtg

SEQ ID NO: 42970 - DNA, 30 bp, Homo sapiens
  misc_feature 1..30: note = chr11:2133297-2133327
  misc_feature 1..30: note = hypo
  source 1..30: mol_type = genomic DNA
tgtctttgcactttgcgaatctctgtggct

SEQ ID NO: 42971 - DNA, 94 bp, Homo sapiens
  misc_feature 1..94: note = chr11:2151140-2151234
  misc_feature 1..94: note = hypo
  source 1..94: mol_type = genomic DNA
cccaagcaacctggtcgatgggcagacctggcagctctcctgctctgtgggctcagacccgcctgacctccctactccccggcctcaccccacc

SEQ ID NO: 42972 - DNA, 30 bp, Homo sapiens
  misc_feature 1..30: note = chr11:2152412-2152442
  misc_feature 1..30: note = hypo
  source 1..30: mol_type = genomic DNA
accccgcccaccctacgggtgtatcccaaa

SEQ ID NO: 42973 - DNA, 39 bp, Homo sapiens
  misc_feature 1..39: note = chr11:2156080-2156119
  misc_feature 1..39: note = hypo
  source 1..39: mol_type = genomic DNA
tggggcccaaggaggcgcatgcaccgctcacccctgcca

SEQ ID NO: 42974 - DNA, 444 bp, Homo sapiens
  misc_feature 1..444: note = chr11:2209876-2210320
  misc_feature 1..444: note = hypo
  source 1..444: mol_type = genomic DNA
tcggggagtagtacccggaacccacagagaacccctaaaacacaaccgccaaacaccagattcaaaagtgggcgaaggacgtagacgggcgcctctccagggaaggtgtatccaggacagcagccgcagggaaaggtgctcaatgccacgaatcattagggcaatgccaatcaaaatcacggcgcgacaggattccacacccgttagggtggccaccgtcaacaaacccaaacaatgcagaacacaaaatagcaagtgctcacgagaatgtggagaaatcagagcccctgcggtgggtcgtgccgcagggcagccgctgcggacagcaccctggcagctcccccgcgggttaaagaggcactacaggctgccgcaatcctgttcctacgtggatgcccagaagaaatgaaacctatgtccacccaggaacgtgtgtgtgactgc

SEQ ID NO: 42975 - DNA, 128 bp, Homo sapiens
  misc_feature 1..128: note = chr11:2224689-2224817
  misc_feature 1..128: note = hypo
  source 1..128: mol_type = genomic DNA
tctgtcagctgcaggcgggtggcgggcggccgctctgataaggcctggtccctgcccctgtgcctctgtggggtgccggcacagcaagcctgggacctggccgccggcccctccgccaggtcaccggg

SEQ ID NO: 42976 - DNA, 30 bp, Homo sapiens
  misc_feature 1..30: note = chr11:2226048-2226078
  misc_feature 1..30: note = hypo
  source 1..30: mol_type = genomic DNA
tgacatccagtcacacggagagggacttgg

SEQ ID NO: 42977 - DNA, 470 bp, Homo sapiens
  misc_feature 1..470: note = chr11:2278369-2278839
  misc_feature 1..470: note = hypo
  source 1..470: mol_type = genomic DNA
ggaatccagccccagcgggcgggcggcagcagcagtgccggccctgcccagaacaggttcgacctgagccggcactgcccggctgccctggggctagggaggctgagacagagaagggaagccagagggtgggggtgggggcccggcactggcagagctgcctgccctcaacgaccgcccctgccggagacccccgccccacccgctgtggttctgctggcccaggtttcgctgggcccactcccagggtttggcatcactggagcccagggtcccccccgcaccctccccacagccttggccctgctgctgcctgcctcctccagggtaccccgaggcccacgtcaggagacccgcctcaggcagcagtggcccggtggctgcttctgcctagcccgcagcacgtgccaccctgggcgcactgccttcccgaaggctctcctccctccccggggcgctccctcccactc

SEQ ID NO: 42978 - DNA, 76 bp, Homo sapiens
  misc_feature 1..76: note = chr11:2289224-2289300
  misc_feature 1..76: note = hypo
  source 1..76: mol_type = genomic DNA
aaaacccaaagctagcgagagggcagcctccaggcacctctcactaactcctcccagaggccgttgaggtgggtct

SEQ ID NO: 42979 - DNA, 35 bp, Homo sapiens
  misc_feature 1..35: note = chr11:2428079-2428114
  misc_feature 1..35: note = hypo
  source 1..35: mol_type = genomic DNA
gcccaggcctggtcccggggcgaggtgggccaggc

SEQ ID NO: 42980 - DNA, 30 bp, Homo sapiens
  misc_feature 1..30: note = chr11:2435384-2435414
  misc_feature 1..30: note = hypo
  source 1..30: mol_type = genomic DNA
agcagggcgaaggcgcgggcctcactgttg

SEQ ID NO: 42981 - DNA, 42 bp, Homo sapiens
  misc_feature 1..42: note = chr11:2436543-2436585
  misc_feature 1..42: note = hypo
  source 1..42: mol_type = genomic DNA
aagagcaggctcttgcgtgacacggagcggtagagctcctgc

SEQ ID NO: 42982 - DNA, 207 bp, Homo sapiens
  misc_feature 1..207: note = chr11:2437991-2438198
  misc_feature 1..207: note = hypo
  source 1..207: mol_type = genomic DNA
gtgtctgcctgccagcgtccagcccttcagcacgcgttcgtctccagcaaaaagcacatcaaatgctcatcaaaattttccatcagcgggtgaacagacgcatcaaccacggtctgtccacaggctggaacctgactccgccttacaaaaggaatgaagcatggaatggcatacgcttcaacacggaggaaccgtcaaaccctcccg

SEQ ID NO: 42983 - DNA, 44 bp, Homo sapiens
  misc_feature 1..44: note = chr11:2491365-2491409
  misc_feature 1..44: note = hypo
  source 1..44: mol_type = genomic DNA
ttttttgtagagctggggtctggctatgtcgctgacaatcaaaa

SEQ ID NO: 42984 - DNA, 135 bp, Homo sapiens
  misc_feature 1..135: note = chr11:2541224-2541359
  misc_feature 1..135: note = hypo
  source 1..135: mol_type = genomic DNA
caggacgcgggagcccgcagaggctggaaggctgaaaagggccctgtcgcccccaccccccaggatgacgtatggcctgatgtggcattcctgcctcaggaccatggcaccaagtggtggcgctggggcccctgg

SEQ ID NO: 42985 - DNA, 167 bp, Homo sapiens
  misc_feature 1..167: note = chr11:2543288-2543455
  misc_feature 1..167: note = hypo
  source 1..167: mol_type = genomic DNA
atgttgaaatgatgtcggataattcaccgggtgccttcggggctggtactcgccgtcactgctcctgaggcctatttgctgtcaaggggaacaagtaggaggttgttttctggggtgcggtgggctccccgctcatgcagctccccgccccccgcatgaccacgccc

SEQ ID NO: 42986 - DNA, 207 bp, Homo sapiens
  misc_feature 1..207: note = chr11:2596517-2596724
  misc_feature 1..207: note = hypo
  source 1..207: mol_type = genomic DNA
ctgcagcccgagcctcggccatcgcgcgccctggcctggccattgttcccgccaggccccgcgcccctggtcgccctgggccccccaccgcccagggctgtggggcaaacagctcccattcagctgccctgcagctgtctggggggagcggcccctgaggcctgagttatgggctgtgttcctggcatttctcggacaaacagaact

SEQ ID NO: 42987 - DNA, 213 bp, Homo sapiens
  misc_feature 1..213: note = chr11:2753802-2754015
  misc_feature 1..213: note = hypo
  source 1..213: mol_type = genomic DNA
gcgagcgaaggggcccgaggcaccggtgcttccgacggggcccgagggccgtctgacctttccggccacggggcagcagttgcgtgagcaggaacaatcgccccagtgtgcaaggcacaagcggccttttcttcctcaccgggccggcgcacacagctcccagcctggcttcccttgaacaaacatatttattgtggccgccaccgaggcctc

SEQ ID NO: 42988 - DNA, 30 bp, Homo sapiens
  misc_feature 1..30: note = chr11:2770653-2770683
  misc_feature 1..30: note = hypo
  source 1..30: mol_type = genomic DNA
gtgtgaccctgggcacgctgctgagcctct

SEQ ID NO: 42989 - DNA, 178 bp, Homo sapiens
  misc_feature 1..178: note = chr11:2818207-2818385
  misc_feature 1..178: note = hypo
  source 1..178: mol_type = genomic DNA
aggcgaaattagatccgtggggagagattttacaacgtatgggctggtggcaagtggcggcaaaccgtccccacggggccacaacggggcattgttcacggcctcacctgggctgtctccagcaccccaggatttacgaggactcggcccagagcctcgatgccggccgctccgggca

SEQ ID NO: 42990 - DNA, 30 bp, Homo sapiens; identical to SEQ ID NO: 15520
  misc_feature 1..30: note = chr11:2829204-2829234
  misc_feature 1..30: note = hypo
  source 1..30: mol_type = genomic DNA

SEQ ID NO: 42991 - DNA, 30 bp, Homo sapiens
  misc_feature 1..30: note = chr11:2933495-2933525
  misc_feature 1..30: note = hypo
  source 1..30: mol_type = genomic DNA
cccacacctccccctcgggggctcaccgaa

SEQ ID NO: 42992 - DNA, 30 bp, Homo sapiens
  misc_feature 1..30: note = chr11:3150813-3150843
  misc_feature 1..30: note = hypo
  source 1..30: mol_type = genomic DNA
catggagaagatgcacgggggtgagaccag

SEQ ID NO: 42993 - DNA, 381 bp, Homo sapiens
  misc_feature 1..381: note = chr11:3164562-3164943
  misc_feature 1..381: note = hypo
  source 1..381: mol_type = genomic DNA
gtgggcgaaaacgcacggacgcgacacacccaagagaaacaagcacacgcccccaggtggtccgcgcacgcacgctcccagcagcatggctcagggccatcagagagcggacacagccagacatccacatgggtgaacggataaacatggatcacatctgtgcaacggatggaagaacattcggccttcaggaggcaggaagcacggcactcacacatgcgacgacacggatgagccgcagagatgcaccaagtcaaagaagccagataccaaaggccacatcttgtccgcttccacgcccacgcagtgtccaggacgggcaggtctggacacggaacgcagactggtgcttgccagggcccggcccggttctgtcccggt

SEQ ID NO: 42994 - DNA, 82 bp, Homo sapiens
  misc_feature 1..82: note = chr11:3169805-3169887
  misc_feature 1..82: note = hypo
  source 1..82: mol_type = genomic DNA
gcagggcgggggcaccgtcctctgcacttttgtacatctttgacattttctatcatacgaagccaaacgggagaggacacag

SEQ ID NO: 42995 - DNA, 48 bp, Homo sapiens
  misc_feature 1..48: note = chr11:3187905-3187953
  misc_feature 1..48: note = hypo
  source 1..48: mol_type = genomic DNA
ggtgggaccctgctccgcgtggcctgtggcaggcggcctctgcctctg

SEQ ID NO: 42996 - DNA, 162 bp, Homo sapiens
  misc_feature 1..162: note = chr11:3249641-3249803
  misc_feature 1..162: note = hypo
  source 1..162: mol_type = genomic DNA
aggctgggaagagggcggccaggcactgctccacgctgacggccgccaggagactcaggcccacgatgtagcagaagaagcgcagcgttgccaggctggtctgcacgaagcccgggaagtccagccggccttgcagcaagtcggggacgatggccaccatgt

SEQ ID NO: 42997 - DNA, 30 bp, Homo sapiens
  misc_feature 1..30: note = chr11:3398724-3398754
  misc_feature 1..30: note = hypo
  source 1..30: mol_type = genomic DNA
gggcagaaatgatttcggtcttttccctct

SEQ ID NO: 42998 - DNA, 93 bp, Homo sapiens
  misc_feature 1..93: note = chr11:3697398-3697491
  misc_feature 1..93: note = hypo
  source 1..93: mol_type = genomic DNA
ccaacagccagttctcgcagataggactgggtaaggctgcgcagttcgtccatggcatagtcctcaggcatgggaagccggccaatgtgggga

SEQ ID NO: 42999 - DNA, 30 bp, Homo sapiens
  misc_feature 1..30: note = chr11:3766731-3766761
  misc_feature 1..30: note = hypo
  source 1..30: mol_type = genomic DNA
tttagaagtgtaaaacggggaagaatatgg

SEQ ID NO: 43000 - DNA, 159 bp, Homo sapiens
  misc_feature 1..159: note = chr11:3828803-3828962
  misc_feature 1..159: note = hypo
  source 1..159: mol_type = genomic DNA
ctgggattacaggcgtgagctaccgcgcctggccctcacagggtttttatgaggattaaataaatgagataagaagtaagagtgcctgggatatactgggtgttcagaatgtgttattgctgtgaggatttaagtggaaaagtgcgatgttaggtatgg

SEQ ID NO: 43001 - DNA, 21 bp, Homo sapiens
  misc_feature 1..21: note = chr11:4785810-4785831
  misc_feature 1..21: note = hypo
  source 1..21: mol_type = genomic DNA
gaatactgggcagggcgcagt

SEQ ID NO: 43002 - DNA, 26 bp, Homo sapiens
  misc_feature 1..26: note = chr11:5169023-5169049
  misc_feature 1..26: note = hypo
  source 1..26: mol_type = genomic DNA
tttttttttttttttcggagacagag

SEQ ID NO: 43003 - DNA, 27 bp, Homo sapiens
  misc_feature 1..27: note = chr11:5177841-5177868
  misc_feature 1..27: note = hypo
  source 1..27: mol_type = genomic DNA
agccactgcacccggcctactgaatat

SEQ ID NO: 43004 - DNA, 159 bp, Homo sapiens; identical to SEQ ID NO: 15524
  misc_feature 1..159: note = chr11:5192016-5192175
  misc_feature 1..159: note = hypo
  source 1..159: mol_type = genomic DNA

SEQ ID NO: 43005 - DNA, 30 bp, Homo sapiens
  misc_feature 1..30: note = chr11:5192457-5192487
  misc_feature 1..30: note = hypo
  source 1..30: mol_type = genomic DNA
ttctgcctccagtcccgggatgccaacgag

SEQ ID NO: 43006 - DNA, 83 bp, Homo sapiens
  misc_feature 1..83: note = chr11:5330681-5330764
  misc_feature 1..83: note = hypo
  source 1..83: mol_type = genomic DNA
catacagaaaacttgcgcctacacctatttttttaagcattccatagattggatctcatttctctccacatttttatgtcttc

SEQ ID NO: 43007 - DNA, 104 bp, Homo sapiens
  misc_feature 1..104: note = chr11:6257172-6257276
  misc_feature 1..104: note = hypo
  source 1..104: mol_type = genomic DNA
aaaaaaaaagaaaagaaaaaaagaaaagtattttgccaatgttaaatacctggtttttatcattgtgctatagttatgtaagatcataacgttaggggaagatg

SEQ ID NO: 43008 - DNA, 82 bp, Homo sapiens
  misc_feature 1..82: note = chr11:6497227-6497309
  misc_feature 1..82: note = hypo
  source 1..82: mol_type = genomic DNA
ctttcaaactgacatccccatttccaccccagtccatgccagatgcccctcctttgtgctcccacagcgccctctgtacttc

SEQ ID NO: 43009 - DNA, 30 bp, Homo sapiens; identical to SEQ ID NO: 15526
  misc_feature 1..30: note = chr11:6731043-6731073
  misc_feature 1..30: note = hypo
  source 1..30: mol_type = genomic DNA

SEQ ID NO: 43010 - DNA, 30 bp, Homo sapiens
  misc_feature 1..30: note = chr11:7439190-7439220
  misc_feature 1..30: note = hypo
  source 1..30: mol_type = genomic DNA
cctatgtgaaagtctcgctgatgtgtgatg

SEQ ID NO: 43011 - DNA, 157 bp, Homo sapiens
  misc_feature 1..157: note = chr11:9405392-9405549
  misc_feature 1..157: note = hypo
  source 1..157: mol_type = genomic DNA
tggtaattactaatacgtaatgtgataaaaacctttcacacataaagttcatttaatcttccgtgttattgccttaggataaagtctcataagtggaattactgggtcagagtttaaacatttcgtttcgttttgtttttttgagacggagtttcgc

SEQ ID NO: 43012 - DNA, 37 bp, Homo sapiens
  misc_feature 1..37: note = chr11:9405789-9405826
  misc_feature 1..37: note = hypo
  source 1..37: mol_type = genomic DNA
tacaggcgtgaaccaccgcgcccggcagtttaaatat

SEQ ID NO: 43013 - DNA, 30 bp, Homo sapiens
  misc_feature 1..30: note = chr11:9830639-9830669
  misc_feature 1..30: note = hypo
  source 1..30: mol_type = genomic DNA
gacttagggataaagcgcttgcacaaaaga

SEQ ID NO: 43014 - DNA, 30 bp, Homo sapiens
  misc_feature 1..30: note = chr11:10509593-10509623
  misc_feature 1..30: note = hypo
  source 1..30: mol_type = genomic DNA
tggttttgcatccttcgggatcatgtggat

SEQ ID NO: 43015 - DNA, 40 bp, Homo sapiens
  misc_feature 1..40: note = chr11:10815867-10815907
  misc_feature 1..40: note = hypo
  source 1..40: mol_type = genomic DNA
acatttgaagctgggcgcggtagctcacgcctgtaattcc

SEQ ID NO: 43016 - DNA, 100 bp, Homo sapiens
  misc_feature 1..100: note = chr11:10865202-10865302
  misc_feature 1..100: note = hypo
  source 1..100: mol_type = genomic DNA
gagtcttgaaatgactgcagctcttgctaacaccttcatcgcagccagtgagagactctgaagctaagctccacctgattcctgacgtatagcaactgtg

SEQ ID NO: 43017 - DNA, 30 bp, Homo sapiens
  misc_feature 1..30: note = chr11:12288561-12288591
  misc_feature 1..30: note = hypo
  source 1..30: mol_type = genomic DNA
ttgggaactagacagcggtctcgattcaca

SEQ ID NO: 43018 - DNA, 18 bp, Homo sapiens
  misc_feature 1..18: note = chr11:13691880-13691898
  misc_feature 1..18: note = hypo
  source 1..18: mol_type = genomic DNA
gctggagtgcagtgacgc

SEQ ID NO: 43019 - DNA, 23 bp, Homo sapiens
  misc_feature 1..23: note = chr11:14558164-14558187
  misc_feature 1..23: note = hypo
  source 1..23: mol_type = genomic DNA
tttttatttttgagacggagtct

SEQ ID NO: 43020 - DNA, 42 bp, Homo sapiens
  misc_feature 1..42: note = chr11:14564357-14564399
  misc_feature 1..42: note = hypo
  source 1..42: mol_type = genomic DNA
atctttgcaggttggcgaagctaatggattccttctcagaat

SEQ ID NO: 43021 - DNA, 84 bp, Homo sapiens
  misc_feature 1..84: note = chr11:15084438-15084522
  misc_feature 1..84: note = hypo
  source 1..84: mol_type = genomic DNA
gtgggacacccaatgcgtgcctgtgaagcagagggcctagtctgggaattgtgccatgctatggcatatcgggggaacctgccc

SEQ ID NO: 43022 - DNA, 23 bp, Homo sapiens
  misc_feature 1..23: note = chr11:16255262-16255285
  misc_feature 1..23: note = hypo
  source 1..23: mol_type = genomic DNA
aacataaaacaggcccggtgcgg

SEQ ID NO: 43023 - DNA, 108 bp, Homo sapiens
  misc_feature 1..108: note = chr11:16988399-16988507
  misc_feature 1..108: note = hypo
  source 1..108: mol_type = genomic DNA
ctgaattcaggccaccgtttctactgccaccaccttcactgggctatctcacagcaagaagagctgccccagccttgtggcttcatgaagtggcgaaatggttcatct

SEQ ID NO: 43024 - DNA, 16 bp, Homo sapiens
  misc_feature 1..16: note = chr11:17037317-17037333
  misc_feature 1..16: note = hypo
  source 1..16: mol_type = genomic DNA
ccgagatcgcgccgct

SEQ ID NO: 43025 - DNA, 154 bp, Homo sapiens
  misc_feature 1..154: note = chr11:17100671-17100825
  misc_feature 1..154: note = hypo
  source 1..154: mol_type = genomic DNA
aaatcaaactcctgtcgacaagcttaaagtaactggcaagacgctgggaaactagatactgaaacatccgctcttaacttttaacctgtcactatttgaaataaagttatcagggatagccgggcgcggtggctcacgcctgtaatcccagcac

SEQ ID NO: 43026 - DNA, 33 bp, Homo sapiens
  misc_feature 1..33: note = chr11:17566248-17566281
  misc_feature 1..33: note = hypo
  source 1..33: mol_type = genomic DNA
tacacgggcggggggcggggcaatctagtccgt

SEQ ID NO: 43027 - DNA, 97 bp, Homo sapiens
  misc_feature 1..97: note = chr11:17633812-17633909
  misc_feature 1..97: note = hypo
  source 1..97: mol_type = genomic DNA
tgggatcctgggcctcgccgtgcgggtgggtggggaccgctgctgcccactctgggagtgtgcctgtgagtcatgggatcagcggagcctcctgcat

SEQ ID NO: 43028 - DNA, 44 bp, Homo sapiens
  misc_feature 1..44: note = chr11:17784927-17784971
  misc_feature 1..44: note = hypo
  source 1..44: mol_type = genomic DNA
ccctgggttgagtctcggctcagagaacacgtgcccagagtgcc

SEQ ID NO: 43029 - DNA, 43 bp, Homo sapiens
  misc_feature 1..43: note = chr11:18656839-18656882
  misc_feature 1..43: note = hypo
  source 1..43: mol_type = genomic DNA
acatgtactaaaaatcgtacacttaagacgggtgagaatgata

SEQ ID NO: 43030 - DNA, 30 bp, Homo sapiens
  misc_feature 1..30: note = chr11:18950570-18950600
  misc_feature 1..30: note = hypo
  source 1..30: mol_type = genomic DNA
ctatgcttttattaacggtgccactgtaaa

SEQ ID NO: 43031 - DNA, 179 bp, Homo sapiens
  misc_feature 1..179: note = chr11:19567961-19568140
  misc_feature 1..179: note = hypo
  source 1..179: mol_type = genomic DNA
gaggctgagctgctgcgggaaggtaggaaacagcctggcagctgggcagtgcggccacctccactgcccctttgcagaatcctcagctttccaaagccacctgcagggtggggcggcttcatgaagaatggagggctgtgtacagaaggaaggactggtcaccacggcaaccaccctct

SEQ ID NO: 43032 - DNA, 30 bp, Homo sapiens
  misc_feature 1..30: note = chr11:23326534-23326564
  misc_feature 1..30: note = hypo
  source 1..30: mol_type = genomic DNA
agctgcctgcatgtgcggtggcctgctggc

SEQ ID NO: 43033 - DNA, 138 bp, Homo sapiens
  misc_feature 1..138: note = chr11:27495243-27495381
  misc_feature 1..138: note = hypo
  source 1..138: mol_type = genomic DNA
gcctaatagaccccacggaatcattacctgtaccaactacggctttaagggtacttcgtttcttgctctctgccatggcgttgagtcgttttactctataatggagacatttttaatgaatacattaaaacaagcagg

SEQ ID NO: 43034 - DNA, 210 bp, Homo sapiens
  misc_feature 1..210: note = chr11:32728943-32729153
  misc_feature 1..210: note = hypo
  source 1..210: mol_type = genomic DNA
taaccactatagatacgtgttgtgctttctatactgtccctttagatcaagatagtcaacacctatttgttttttcctgggaaagtcaaaaatttacctggatagtgatgcgtcagggatttactgaggaacctcaaggatattaaatttccttgtaacactacacttgcataatatggggacaagttttttcgacgttctaaagatgtg

SEQ ID NO: 43035 - DNA, 17 bp, Homo sapiens
  misc_feature 1..17: note = chr11:32859995-32860012
  misc_feature 1..17: note = hypo
  source 1..17: mol_type = genomic DNA
tccggaaaaaaaaaaaa

SEQ ID NO: 43036 - DNA, 37 bp, Homo sapiens
  misc_feature 1..37: note = chr11:32935022-32935059
  misc_feature 1..37: note = hypo
  source 1..37: mol_type = genomic DNA
gctaccgcacccggtctttcctcgtccttttaatact

SEQ ID NO: 43037 - DNA, 104 bp, Homo sapiens
  misc_feature 1..104: note = chr11:33181185-33181289
  misc_feature 1..104: note = hypo
  source 1..104: mol_type = genomic DNA
gcgcgcgcctgtactcccagctacggaggaggctgaggtggcaggatcacagagcgcagggaggtcgaagctatggtgagctgtgatggcgtcacagcactcta

SEQ ID NO: 43038 - DNA, 29 bp, Homo sapiens
  misc_feature 1..29: note = chr11:33202774-33202803
  misc_feature 1..29: note = hypo
  source 1..29: mol_type = genomic DNA
acacctgtaattagccgggtgtggtggtg

SEQ ID NO: 43039 - DNA, 15 bp, Homo sapiens
  misc_feature 1..15: note = chr11:33262877-33262892
  misc_feature 1..15: note = hypo
  source 1..15: mol_type = genomic DNA
cgcaaagaaattaat

SEQ ID NO: 43040 - DNA, 224 bp, Homo sapiens
  misc_feature 1..224: note = chr11:33269863-33270087
  misc_feature 1..224: note = hypo
  source 1..224: mol_type = genomic DNA
tagaggcctgaaccacggtgcccggcctgttctgaaagttttaaaggcacagctatcttcaacgttcatccactctggcgccctgggaacagttccttacattatgtcctctagaagagctggactaacacatatgcaggataggttatgatgcggtacgagaattgaacttcaacccgggaggcggaagttgcagtgagctgagatagcgccactgcactcaa

SEQ ID NO: 43041 - DNA, 37 bp, Homo sapiens
  misc_feature 1..37: note = chr11:33277673-33277710
  misc_feature 1..37: note = hypo
  source 1..37: mol_type = genomic DNA
ggattacatgtgcgagccaccgcgcccggcctccttt

SEQ ID NO: 43042 - DNA, 32 bp, Homo sapiens
  misc_feature 1..32: note = chr11:33874352-33874384
  misc_feature 1..32: note = hypo
  source 1..32: mol_type = genomic DNA
tccaagaagaatgaggtcgcacagatacttga

SEQ ID NO: 43043 - DNA, 33 bp, Homo sapiens
  misc_feature 1..33: note = chr11:33880993-33881026
  misc_feature 1..33: note = hypo
  source 1..33: mol_type = genomic DNA
aatgcttctgacaggcggcgcatttgaaacatt

SEQ ID NO: 43044 - DNA, 23 bp, Homo sapiens
  misc_feature 1..23: note = chr11:33951225-33951248
  misc_feature 1..23: note = hypo
  source 1..23: mol_type = genomic DNA
gggcacggtggctcacgcctgta

SEQ ID NO: 43045 - DNA, 30 bp, Homo sapiens
  misc_feature 1..30: note = chr11:33976661-33976691
  misc_feature 1..30: note = hypo
  source 1..30: mol_type = genomic DNA
gcacaggctcagtgccgacagatctttctg

SEQ ID NO: 43046 - DNA, 30 bp, Homo sapiens
  misc_feature 1..30: note = chr11:33993944-33993974
  misc_feature 1..30: note = hypo
  source 1..30: mol_type = genomic DNA
ttttaagttttctgccgtaaacatacagca

SEQ ID NO: 43047 - DNA, 30 bp, Homo sapiens
  misc_feature 1..30: note = chr11:34517691-34517721
  misc_feature 1..30: note = hypo
  source 1..30: mol_type = genomic DNA
aaggattcggagaaacgcccaggcggggag

SEQ ID NO: 43048 - DNA, 30 bp, Homo sapiens; identical to SEQ ID NO: 15538
  misc_feature 1..30: note = chr11:34534277-34534307
  misc_feature 1..30: note = hypo
  source 1..30: mol_type = genomic DNA

SEQ ID NO: 43049 - DNA, 195 bp, Homo sapiens
  misc_feature 1..195: note = chr11:34535053-34535248
  misc_feature 1..195: note = hypo
  source 1..195: mol_type = genomic DNA
gcaagccgtcacatccgtgtcaaacagctcccggaggccctgggactgcacccagcgcaggtgccggccctggagctggagatggacgagcagacccaggccccaggccgagcctctgagccctgacaccccttacgattcatccaaaaaagcaaagaaaaggcgcttacgtgagggcagcggtggctaggtcca

SEQ ID NO: 43050 - DNA, 30 bp, Homo sapiens
  misc_feature 1..30: note = chr11:34536053-34536083
  misc_feature 1..30: note = hypo
  source 1..30: mol_type = genomic DNA
gccatcttgggcagccgagatgttgtattc

SEQ ID NO: 43051 - DNA, 20 bp, Homo sapiens
  misc_feature 1..20: note = chr11:34577250-34577270
  misc_feature 1..20: note = hypo
  source 1..20: mol_type = genomic DNA
aactcaaatctgaagcgtcc

SEQ ID NO: 43052 - DNA, 166 bp, Homo sapiens
  misc_feature 1..166: note = chr11:35134173-35134339
  misc_feature 1..166: note = hypo
  source 1..166: mol_type = genomic DNA
gcggggggcggggggcggaggggggtgagcaacccgtttcaggtttcttccaaaaagacgtgtgcaggaggctagctgaacttagccacagtttcagagatgcatagaaatgaaactactggaagcatttggcttcagttaaacttggggccgagcagagccaaga

SEQ ID NO: 43053 - DNA, 290 bp, Homo sapiens
  misc_feature 1..290: note = chr11:35684922-35685212
  misc_feature 1..290: note = hypo
  source 1..290: mol_type = genomic DNA
gagggagatagaaagcgaggcaggggaagagagtgagtcggaggaagagagcgagtcagaggaagagagcgagacagaggaagagagtgaggatgagagcgatgaggagagtgaagaagacagcgaggaagaaatggaggatgagcaagaaagcgaggccgaagaagacaaccaagaagaaggggaatccgaggcggagggagaaactgaggcagaaagtgaatttgacccagaaatagaaatggaagcagagagagtggccaagaggaagtgtccggaccatgggcttg

SEQ ID NO: 43054 - DNA, 98 bp, Homo sapiens
  misc_feature 1..98: note = chr11:36687119-36687217
  misc_feature 1..98: note = hypo
  source 1..98: mol_type = genomic DNA
gtcaacccaatcccctgaggcctatgtaaatcagtcaccgccccctcaactttctgtacaaaccaattgcagtccgccacaaacgaggccctcttcca

SEQ ID NO: 43055 - DNA, 36 bp, Homo sapiens
  misc_feature 1..36: note = chr11:43544024-43544060
  misc_feature 1..36: note = hypo
  source 1..36: mol_type = genomic DNA
gccttgggagtggtccgcatccgtgggtagacgctg

SEQ ID NO: 43056 - DNA, 83 bp, Homo sapiens; identical to SEQ ID NO: 15542
  misc_feature 1..83: note = chr11:44922891-44922974
  misc_feature 1..83: note = hypo
  source 1..83: mol_type = genomic DNA

SEQ ID NO: 43057 - DNA, 33 bp, Homo sapiens
  misc_feature 1..33: note = chr11:46298483-46298516
  misc_feature 1..33: note = hypo
  source 1..33: mol_type = genomic DNA
ttacaagctgaaaatcggctgggcatggtggct

SEQ ID NO: 43058 - DNA, 30 bp, Homo sapiens
  misc_feature 1..30: note = chr11:46405775-46405805
  misc_feature 1..30: note = hypo
  source 1..30: mol_type = genomic DNA
actgtcatggaaacccgagtgagccaccag

SEQ ID NO: 43059 - DNA, 17 bp, Homo sapiens
  misc_feature 1..17: note = chr11:46614283-46614300
  misc_feature 1..17: note = hypo
  source 1..17: mol_type = genomic DNA
ggcgacagagctagcct

SEQ ID NO: 43060 - DNA, 30 bp, Homo sapiens
  misc_feature 1..30: note = chr11:46774904-46774934
  misc_feature 1..30: note = hypo
  source 1..30: mol_type = genomic DNA
aagaggttcacagagcggatgacctgttgt

SEQ ID NO: 43061 - DNA, 19 bp, Homo sapiens
  misc_feature 1..19: note = chr11:46777041-46777060
  misc_feature 1..19: note = hypo
  source 1..19: mol_type = genomic DNA
ccaccgcacctggccccat

SEQ ID NO: 43062 - DNA, 30 bp, Homo sapiens
  misc_feature 1..30: note = chr11:46916192-46916222
  misc_feature 1..30: note = hypo
  source 1..30: mol_type = genomic DNA
ttggcacggaggatccggtccagggtgaca

SEQ ID NO: 43063 - DNA, 266 bp, Homo sapiens
  misc_feature 1..266: note = chr11:47358971-47359237
  misc_feature 1..266: note = hypo
  source 1..266: mol_type = genomic DNA
tgggcctggacatgccgatggcgttgaccgcgtagacgcgcatctcgtacaccacgccctcgatcatgcgccgcgcttcatgactcagctcctgaatcaggtcgaagttcagccgcatccaccggtagctcttcttcttcttgcgctccaggatgtagcctggctcaggggaggtggcagctctggtctggaacccaggcatccccacaccaccttccctcggatctgtttggcgccctcacacctccatccggtgcccttgcact

SEQ ID NO: 43064 - DNA, 65 bp, Homo sapiens
  misc_feature 1..65: note = chr11:47367760-47367825
  misc_feature 1..65: note = hypo
  source 1..65: mol_type = genomic DNA
tgctcttcttctcatcgcgcctcatgcccttgagcctctttagcatgccgcgcaggtcagtgacg

SEQ ID NO: 43065 - DNA, 56 bp, Homo sapiens
  misc_feature 1..56: note = chr11:47599259-47599315
  misc_feature 1..56: note = hypo
  source 1..56: mol_type = genomic DNA
gctggaaaacagactcgctgacatcctgcagcacaatcacccggttgtgggcctcc

SEQ ID NO: 43066 - DNA, 35 bp, Homo sapiens
  misc_feature 1..35: note = chr11:49212608-49212643
  misc_feature 1..35: note = hypo
  source 1..35: mol_type = genomic DNA
cctgaggtcaggaggcgcgatctcggctcactgca

SEQ ID NO: 43067 - DNA, 30 bp, Homo sapiens
  misc_feature 1..30: note = chr11:50205839-50205869
  misc_feature 1..30: note = hypo
  source 1..30: mol_type = genomic DNA
atcgatgagctggcacggaagctggaggga

SEQ ID NO: 43068 - DNA, 156 bp, Homo sapiens
  misc_feature 1..156: note = chr11:50256725-50256881
  misc_feature 1..156: note = hypo
  source 1..156: mol_type = genomic DNA
cctcccgtgcttgatcgcttatataatctctgctcactgtaatctcaacctcccgggctggattccatatatataaatacatacatatatttgtttgtttagacgttatctcagtctgtccaacaggctggagtgcagtggcgcgatctcggccca

SEQ ID NO: 43069 - DNA, 35 bp, Homo sapiens
  misc_feature 1..35: note = chr11:55743005-55743040
  misc_feature 1..35: note = hypo
  source 1..35: mol_type = genomic DNA
attacaggcgtgagccaccgcgcccggcccaggat

SEQ ID NO: 43070 - DNA, 30 bp, Homo sapiens; identical to SEQ ID NO: 15545
  misc_feature 1..30: note = chr11:57150498-57150528
  misc_feature 1..30: note = hypo
  source 1..30: mol_type = genomic DNA

SEQ ID NO: 43071 - DNA, 203 bp, Homo sapiens
  misc_feature 1..203: note = chr11:57235255-57235458
  misc_feature 1..203: note = hypo
  source 1..203: mol_type = genomic DNA
acaacctcatccgcacgctgcggccaggcacctttgggtccaacctgctcaccctgtggctcttctccaacaacctctccaccatctacccgggcactttccgccacttgcaagccctggaggagctggacctcggtgacaaccggcacctgcgctcgctggagcccgacaccttccagggcctggagcggctgcagtcgctg

SEQ ID NO: 43072 - DNA, 30 bp, Homo sapiens
  misc_feature 1..30: note = chr11:57311435-57311465
  misc_feature 1..30: note = hypo
  source 1..30: mol_type = genomic DNA
tcctgcttccctcagcgtccaccatcaact

SEQ ID NO: 43073 - DNA, 37 bp, Homo sapiens
  misc_feature 1..37: note = chr11:57423900-57423937
  misc_feature 1..37: note = hypo
  source 1..37: mol_type = genomic DNA
aaatgtttactattattataaccggactcagaaactc

SEQ ID NO: 43074 - DNA, 36 bp, Homo sapiens
  misc_feature 1..36: note = chr11:57437198-57437234
  misc_feature 1..36: note = hypo
  source 1..36: mol_type = genomic DNA
gggattacaggcgtgagcccccgtgcccagctggca

SEQ ID NO: 43075 - DNA, 31 bp, Homo sapiens
  misc_feature 1..31: note = chr11:57500991-57501022
  misc_feature 1..31: note = hypo
  source 1..31: mol_type = genomic DNA
gtgctgcgattacaggcgtgagtcaccgcgc

SEQ ID NO: 43076 - DNA, 41 bp, Homo sapiens
  misc_feature 1..41: note = chr11:57548681-57548722
  misc_feature 1..41: note = hypo
  source 1..41: mol_type = genomic DNA
tacaggcgtgagcaaccgcacctggccgagaagctgctatt

SEQ ID NO: 43077 - DNA, 16 bp, Homo sapiens
  misc_feature 1..16: note = chr11:58821650-58821666
  misc_feature 1..16: note = hypo
  source 1..16: mol_type = genomic DNA
gcgtggcctcctattc

SEQ ID NO: 43078 - DNA, 139 bp, Homo sapiens
  misc_feature 1..139: note = chr11:58835182-58835321
  misc_feature 1..139: note = hypo
  source 1..139: mol_type = genomic DNA
actttatctctgtatcgcttaggaggagttatttaattcactttagactttgttaagttaaatattaatgttaaaatgcccagggctattttgttcaagacagttgccactaatcacgtgatttttttttttttttttt

SEQ ID NO: 43079 - DNA, 30 bp, Homo sapiens; identical to SEQ ID NO: 15547
  misc_feature 1..30: note = chr11:59312651-59312681
  misc_feature 1..30: note = hypo
  source 1..30: mol_type = genomic DNA

SEQ ID NO: 43080 - DNA, 19 bp, Homo sapiens
  misc_feature 1..19: note = chr11:59328895-59328914
  misc_feature 1..19: note = hypo
  source 1..19: mol_type = genomic DNA
accttaaaggctgggcgcg

SEQ ID NO: 43081 - DNA, 138 bp, Homo sapiens
  misc_feature 1..138: note = chr11:59329214-59329352
  misc_feature 1..138: note = hypo
  source 1..138: mol_type = genomic DNA
agaaaggacctcgggtctccagggacagcaaattgtgggaaagcaaatatatgggaaattaatgttagataaaggcaggttcctaaagcttgttaaatgtacttctgtggtcccctctgttcacgtctccaagctgtt

SEQ ID NO: 43082 - DNA, 30 bp, Homo sapiens; identical to SEQ ID NO: 15548
  misc_feature 1..30: note = chr11:59609810-59609840
  misc_feature 1..30: note = hypo
  source 1..30: mol_type = genomic DNA

SEQ ID NO: 43083 - DNA, 170 bp, Homo sapiens
  misc_feature 1..170: note = chr11:59807961-59808131
  misc_feature 1..170: note = hypo
  source 1..170: mol_type = genomic DNA
tgtcttgatttggaccggtgctgagaacctccatggtaaataacaagttttagagaatgcttcctcgaaggagttaatcataatgatcgctttccatgcaggtgttttactccctgaagaaatctgatcttattctaactggctagaagaagaagcgctttcaggccaag

SEQ ID NO: 43084 - DNA, 120 bp, Homo sapiens
  misc_feature 1..120: note = chr11:59841396-59841516
  misc_feature 1..120: note = hypo
  source 1..120: mol_type = genomic DNA
ggaaagagagggagagagagaccgtggggagcggcagcgggagcaggagcgggagagggagagggagagggcagcactatgagttttaagaagcaattgaaaatgtatgcaggttccagg

SEQ ID NO: 43085 - DNA, 30 bp, Homo sapiens
  misc_feature 1..30: note = chr11:60282848-60282878
  misc_feature 1..30: note = hypo
  source 1..30: mol_type = genomic DNA
gttgccattgcagaccgtcactccctgagg

SEQ ID NO: 43086 - DNA, 33 bp, Homo sapiens
  misc_feature 1..33: note = chr11:60409097-60409130
  misc_feature 1..33: note = hypo
  source 1..33: mol_type = genomic DNA
aattagaatacatggcggggcacggtggctcac

SEQ ID NO: 43087 - DNA, 30 bp, Homo sapiens
  misc_feature 1..30: note = chr11:60892552-60892582
  misc_feature 1..30: note = hypo
  source 1..30: mol_type = genomic DNA
ccccacagcctcccacgtggataacgaata

SEQ ID NO: 43088 - DNA, 47 bp, Homo sapiens
  misc_feature 1..47: note = chr11:60897862-60897909
  misc_feature 1..47: note = hypo
  source 1..47: mol_type = genomic DNA
catttggtaaagaaccggcagcgctgacctagcgtcacgcggatggc

SEQ ID NO: 43089 - DNA, 171 bp, Homo sapiens; identical to SEQ ID NO: 5117
  misc_feature 1..171: note = chr11:60941596-60941767
  misc_feature 1..171: note = hypo
  source 1..171: mol_type = genomic DNA

SEQ ID NO: 43090 - DNA, 335 bp, Homo sapiens
  misc_feature 1..335: note = chr11:61038940-61039275
  misc_feature 1..335: note = hypo
  source 1..335: mol_type = genomic DNA
actgccaagcaccatcgtcctcacacatctactgagagcaggataaactcggtccaaccctttttgtgaaagtggaacttgacagcaccggagggagactgcggccagcctgaggccagcctctggaggggccaggacgcttgtctcctctgggtgaggcggggcagccaggtaaagcagctgaaggcgagcaggttgtcattcacctggcagatgcataactcacaggggtcaccaggcgaccagatctgtccaatcggaaactcaaccccgttgtcgtcaagagagcagcctggatgaggacaatggcagagaaaagacggcacaagacctag

SEQ ID NO: 43091 - DNA, 124 bp, Homo sapiens
  misc_feature 1..124: note = chr11:61049497-61049621
  misc_feature 1..124: note = hypo
  source 1..124: mol_type = genomic DNA
ggtccatgcctgccccgaggtgcgggatgtgactcagacagctgggagcggggctgaaatctagtgcttgtcttgttaataggttcacacatcgagcaggtatttaatgcgagtatcagagact

SEQ ID NO: 43092 - DNA, 129 bp, Homo sapiens
  misc_feature 1..129: note = chr11:61058212-61058341
  misc_feature 1..129: note = hypo
  source 1..129: mol_type = genomic DNA
aggagatataattcccgctgtccccctccccctcccccaccactcccaggcgtctcacctgtacacctgatgccaacagctgtctccgtcatcgagaagcccacggggcacactcgggccacctcctga

SEQ ID NO: 43093 - DNA, 89 bp, Homo sapiens
  misc_feature 1..89: note = chr11:61058795-61058884
  misc_feature 1..89: note = hypo
  source 1..89: mol_type = genomic DNA
tgccactcccacagccgaaggagcagagggctgagaggagaagtgcaggtgagacacgaggaactggggcctcccgtctgcccctcgga

SEQ ID NO: 43094 - DNA, 30 bp, Homo sapiens
  misc_feature 1..30: note = chr11:61633635-61633665
  misc_feature 1..30: note = hypo
  source 1..30: mol_type = genomic DNA
cttcactctccctgacggctgccattggtc

SEQ ID NO: 43095 - DNA, 81 bp, Homo sapiens
  misc_feature 1..81: note = chr11:61641410-61641491
  misc_feature 1..81: note = hypo
  source 1..81: mol_type = genomic DNA
catggtaagtgtgagcggagatccccattccctgtgggttcccttccctgggggcaggcagcgatgcgggctggagggtgg

SEQ ID NO: 43096 - DNA, 454 bp, Homo sapiens
  misc_feature 1..454: note = chr11:61664512-61664966
  misc_feature 1..454: note = hypo
  source 1..454: mol_type = genomic DNA
gcaggccaccagccacggggagagggaggcctggctcatcccccagtaacccacagccctctgaatactaagggaggactcaaatagtcctccccacagcaagtaagtggtgatggcggaggtggggtggcttcaggatttgggtttaatcccaagcacgagggcgggcagggaaaggatttggtttcattccttcagatgcccaagccttggccagagccccagggtgcaggagtgagggcgcgtggccacccagcctgtaccaacaaagcctgcctttattaaatagagatcgcgttacattccatccaaagaaggaaatccggacgtggtgagggatgcgtccaggtgggagctccgaacgctggtcctgagtgggctctgatgggtgggagggcccaggtcctgcctgcccacccaggccccacatgccagggcgcgtgtctgcatggcc

SEQ ID NO: 43097 - DNA, 59 bp, Homo sapiens
  misc_feature 1..59: note = chr11:61665728-61665787
  misc_feature 1..59: note = hypo
  source 1..59: mol_type = genomic DNA
ccttcaggcctgggccgcgccctaagcctcctgggggaagaagccgagcttggccagtg

SEQ ID NO: 43098 - DNA, 48 bp, Homo sapiens
  misc_feature 1..48: note = chr11:61666088-61666136
  misc_feature 1..48: note = hypo
  source 1..48: mol_type = genomic DNA
agacaagcaggtacacgctgtcacatgccacagcggtggtccagacct

SEQ ID NO: 43099 - DNA, 134 bp, Homo sapiens
  misc_feature 1..134: note = chr11:61669877-61670011
  misc_feature 1..134: note = hypo
  source 1..134: mol_type = genomic DNA
aaaggagtcaagtaacgcttgcaaaggctgactcaccctggcccgggaagatggcgagatgtagtaatggcttttggagtccccgagccggattcggtggcggcaggtgcgggtcagcccgctcagggcacatg

SEQ ID NO: 43100 - DNA, 87 bp, Homo sapiens
  misc_feature 1..87: note = chr11:61675013-61675100
  misc_feature 1..87: note = hypo
  source 1..87: mol_type = genomic DNA
gttcccgcgcccagccggtgtacctcaaacaggctggccgtcagctcttccagctcctgttctagctgctcccgcaccttggacagc

SEQ ID NO: 43101 - DNA, 23 bp, Homo sapiens
  misc_feature 1..23: note = chr11:61736670-61736693
  misc_feature 1..23: note = hypo
  source 1..23: mol_type = genomic DNA
ttgcctggggctgggcgcggtgg

SEQ ID NO: 43102 - DNA, 82 bp, Homo sapiens
  misc_feature 1..82: note = chr11:61736993-61737075
  misc_feature 1..82: note = hypo
  source 1..82: mol_type = genomic DNA
aatgttggcctggaaagtacagtttatgttgggggatgctggttagggtggagaataggggcaagatcgggcagggttgtgt

SEQ ID NO: 43103 - DNA, 30 bp, Homo sapiens
  misc_feature 1..30: note = chr11:61784772-61784802
  misc_feature 1..30: note = hypo
  source 1..30: mol_type = genomic DNA
ctacaatttcccagacggatgattcattcc

SEQ ID NO: 43104 - DNA, 228 bp, Homo sapiens
  misc_feature 1..228: note = chr11:62370522-62370750
  misc_feature 1..228: note = hypo
  source 1..228: mol_type = genomic DNA
tggactctcacccaacgacacacgcccagcgttccaagcccaaactgggctccaccttgtcccccacccttccagcaggtttccacgcccctgctcaccgtagacgtgaaagcccagcacacaggtgtaggtagcccattcccggtctcggctctcatagcgattcttcagctgcttgcagcctccagccacgtcccctggggagagggagcccgcccagctcagctc

SEQ ID NO: 43105 - DNA, 95 bp, Homo sapiens
  misc_feature 1..95: note = chr11:62421710-62421805
  misc_feature 1..95: note = hypo
  source 1..95: mol_type = genomic DNA
aactcaggactttaaaaaaatgaagcataggaaggtttttttgttggtgttgttgttgttattgttgtttattttgtgaccgtgcagtgatagga

SEQ ID NO: 43106 - DNA, 30 bp, Homo sapiens
  misc_feature 1..30: note = chr11:62440622-62440652
  misc_feature 1..30: note = hypo
  source 1..30: mol_type = genomic DNA
acttccagggataaccgtgggacattcttg

SEQ ID NO: 43107 - DNA, 60 bp, Homo sapiens
  misc_feature 1..60: note = chr11:62445431-62445491
  misc_feature 1..60: note = hypo
  source 1..60: mol_type = genomic DNA
ctctcctcagcagcccggcgcatctcatcttcctgtagccgctgtcgtgctgctgacaac

SEQ ID NO: 43108 - DNA, 46 bp, Homo sapiens
  misc_feature 1..46: note = chr11:63572099-63572145
  misc_feature 1..46: note = hypo
  source 1..46: mol_type = genomic DNA
tttatgtcctgggtccggttattcctaaagtcggcctgtatccctg

SEQ ID NO: 43109 - DNA, 44 bp, Homo sapiens
  misc_feature 1..44: note = chr11:63609969-63610013
  misc_feature 1..44: note = hypo
  source 1..44: mol_type = genomic DNA
gccgggcctgattcctgtattctttaaaacgggaaaaaagacaa

SEQ ID NO: 43110 - DNA, 102 bp, Homo sapiens
  misc_feature 1..102: note = chr11:63779116-63779218
  misc_feature 1..102: note = hypo
  source 1..102: mol_type = genomic DNA
atcagggctgcgggacgaagacatggagcagggcagtgcatcagggttctgggcagagtggccagggcaggcaggatggcccttgtgcgtgttcgaacaatg

SEQ ID NO: 43111 - DNA, 30 bp, Homo sapiens
  misc_feature 1..30: note = chr11:63780950-63780980
  misc_feature 1..30: note = hypo
  source 1..30: mol_type = genomic DNA
ggaggccagggtggccggagcaaagtggag

SEQ ID NO: 43112 - DNA, 82 bp, Homo sapiens
  misc_feature 1..82: note = chr11:63783734-63783816
  misc_feature 1..82: note = hypo
  source 1..82: mol_type = genomic DNA
cctgggctccagccccgatccgcagcctgcgtccgtggtaactgccagagctcatcagggaaagcagcgggtgaggccaggc

SEQ ID NO: 43113 - DNA, 233 bp, Homo sapiens
  misc_feature 1..233: note = chr11:63849387-63849620
  misc_feature 1..233: note = hypo
  source 1..233: mol_type = genomic DNA
tggactcccggctctcgagtgccgcgttctacctgctgtgttctaaatggacatgccatccccacagctgtgtcaataaagcagccatttacagagcgggcgccggatcccgtgacaggttgaaaagtgtgtgagctgcagcgtcctgggctggggcagaggggccgtggcgagaacagatggggctgtgcccatctccccaggccctcctgtggctgcgcctggagcctccc

SEQ ID NO: 43114 - DNA, 79 bp, Homo sapiens
  misc_feature 1..79: note = chr11:63955145-63955224
  misc_feature 1..79: note = hypo
  source 1..79: mol_type = genomic DNA
atttctggaataagacgttgctcttttacctttaagaaaggatctggggccgggcaccgtggctcagcctgtaatccca

SEQ ID NO: 43115 - DNA, 47 bp, Homo sapiens
  misc_feature 1..47: note = chr11:63978814-63978861
  misc_feature 1..47: note = hypo
  source 1..47: mol_type = genomic DNA
taccacatgctgagccggccccagccgccacccgaccccctcctgct

SEQ ID NO: 43116 - DNA, 30 bp, Homo sapiens
  misc_feature 1..30: note = chr11:64042980-64043010
  misc_feature 1..30: note = hypo
  source 1..30: mol_type = genomic DNA
aggaaagccccctaccggcccctcatagcc

SEQ ID NO: 43117 - DNA, 30 bp, Homo sapiens
  misc_feature 1..30: note = chr11:64054355-64054385
  misc_feature 1..30: note = hypo
  source 1..30: mol_type = genomic DNA
aaccaactgtggtcccgggtggggggcggg

SEQ ID NO: 43118 - DNA, 77 bp, Homo sapiens
  misc_feature 1..77: note = chr11:64105954-64106031
  misc_feature 1..77: note = hypo
  source 1..77: mol_type = genomic DNA
cataaaacagccaggcgctcttaagccagctttacaattgtgcagatgaagtggagccgagttttcactctgctcta

SEQ ID NO: 43119 - DNA, 38 bp, Homo sapiens
  misc_feature 1..38: note = chr11:64120222-64120260
  misc_feature 1..38: note = hypo
  source 1..38: mol_type = genomic DNA
cagctgcaggcccagcgggccagcgtggaggcacagga

SEQ ID NO: 43120 - DNA, 30 bp, Homo sapiens
  misc_feature 1..30: note = chr11:64120879-64120909
  misc_feature 1..30: note = hypo
  source 1..30: mol_type = genomic DNA
gttcaggccctgagccgggagaacagggag

SEQ ID NO: 43121 - DNA, 54 bp, Homo sapiens
  misc_feature 1..54: note = chr11:64124704-64124758
  misc_feature 1..54: note = hypo
  source 1..54: mol_type = genomic DNA
ctccacggtcagcgccggggcccggagatggagctgggacgagtgtgtggacag

SEQ ID NO: 43122 - DNA, 30 bp, Homo sapiens
  misc_feature 1..30: note = chr11:64292470-64292500
  misc_feature 1..30: note = hypo
  source 1..30: mol_type = genomic DNA
acccgaggaagaggtcgtggggacctctta

SEQ ID NO: 43123 - DNA, 82 bp, Homo sapiens
  misc_feature 1..82: note = chr11:64488590-64488672
  misc_feature 1..82: note = hypo
  source 1..82: mol_type = genomic DNA
gaggtgtattgtgtacgcaggtgtgtgtgcctgtgtaggtgtgtgtctgggtgggtgccaccgagcgcgtgtatcattgtca

SEQ ID NO: 43124 - DNA, 30 bp, Homo sapiens
  misc_feature 1..30: note = chr11:64507459-64507489
  misc_feature 1..30: note = hypo
  source 1..30: mol_type = genomic DNA
tgaccccccagccctcgggccgcaccagga

SEQ ID NO: 43125 - DNA, 30 bp, Homo sapiens
  misc_feature 1..30: note = chr11:64572043-64572073
  misc_feature 1..30: note = hypo
  source 1..30: mol_type = genomic DNA
ccaccttcagggcctcgggctgtgccagcg

SEQ ID NO: 43126 - DNA, 23 bp, Homo sapiens
  misc_feature 1..23: note = chr11:64578577-64578600
  misc_feature 1..23: note = hypo
  source 1..23: mol_type = genomic DNA
gtttgttttgagacacggtcttt

SEQ ID NO: 43127 - DNA, 30 bp, Homo sapiens
  misc_feature 1..30: note = chr11:64610130-64610160
  misc_feature 1..30: note = hypo
  source 1..30: mol_type = genomic DNA
ttgtctggtcaagaacgtcctctttcctca

SEQ ID NO: 43128 - DNA, 87 bp, Homo sapiens
  misc_feature 1..87: note = chr11:64667987-64668074
  misc_feature 1..87: note = hypo
  source 1..87: mol_type = genomic DNA
aggacatggtgctgccgcccgctgcccccctgcgtgcgccatgagttctggggccggttggggccagagcagcgggaaggggagctc

SEQ ID NO: 43129 - DNA, 96 bp, Homo sapiens
  misc_feature 1..96: note = chr11:64669480-64669576
  misc_feature 1..96: note = hypo
  source 1..96: mol_type = genomic DNA
ccagggtgtctccatcgccctcctcttccctttcatcttccttctcctctgagcatgaccctaagctgccagcagggcccccgacaggtggtgaag

SEQ ID NO: 43130 - DNA, 24 bp, Homo sapiens
  misc_feature 1..24: note = chr11:64809584-64809608
  misc_feature 1..24: note = hypo
  source 1..24: mol_type = genomic DNA
tttttttttgagtctcgctctgtc

SEQ ID NO: 43131 - DNA, 24 bp, Homo sapiens
  misc_feature 1..24: note = chr11:64809848-64809872
  misc_feature 1..24: note = hypo
  source 1..24: mol_type = genomic DNA
gagccaccgcgcccggctgatttt

SEQ ID NO: 43132 - DNA, 30 bp, Homo sapiens
  misc_feature 1..30: note = chr11:64878823-64878853
  misc_feature 1..30: note = hypo
  source 1..30: mol_type = genomic DNA
agatcagcctgaagacgctgctggagtgtg

SEQ ID NO: 43133 - DNA, 142 bp, Homo sapiens
  misc_feature 1..142: note = chr11:64883942-64884084
  misc_feature 1..142: note = hypo
  source 1..142: mol_type = genomic DNA
ttggggcaggtggcacggggcctccccaaagccgctccagctccccagtgagggcggccacctcctcggctaccacagcatgggcttggtgagccctggcgcagtctagggccaggggtgtgagggccgcctcattttcgtt

SEQ ID NO: 43134 - DNA, 44 bp, Homo sapiens
  misc_feature 1..44: note = chr11:64903259-64903303
  misc_feature 1..44: note = hypo
  source 1..44: mol_type = genomic DNA
ttccccgtaaggccacgtataactttttttcccccttttctttt

SEQ ID NO: 43135 - DNA, 44 bp, Homo sapiens
  misc_feature 1..44: note = chr11:64903423-64903467
  misc_feature 1..44: note = hypo
  source 1..44: mol_type = genomic DNA
tcagccccacaaggtgttgggattacaggcgtgagccacaacac

SEQ ID NO: 43136 - DNA, 36 bp, Homo sapiens
  misc_feature 1..36: note = chr11:64950292-64950328
  misc_feature 1..36: note = hypo
  source 1..36: mol_type = genomic DNA
gattatgagcagctgcgggtgcgatgcctgcagagt

SEQ ID NO: 43137 - DNA, 102 bp, Homo sapiens
  misc_feature 1..102: note = chr11:64951749-64951851
  misc_feature 1..102: note = hypo
  source 1..102: mol_type = genomic DNA
tcggaacccagggtgcggaacccacagtgcggatccactttggcccagcgccacacccacctgctccagtctgcaggggcgcagtctcgcccccttccctcg

SEQ ID NO: 43138 - DNA, 40 bp, Homo sapiens
  misc_feature 1..40: note = chr11:64975460-64975500
  misc_feature 1..40: note = hypo
  source 1..40: mol_type = genomic DNA
ccagctgcctccacacgggcagggccggggcctctcttac

SEQ ID NO: 43139 - DNA, 52 bp, Homo sapiens
  misc_feature 1..52: note = chr11:64977482-64977534
  misc_feature 1..52: note = hypo
  source 1..52: mol_type = genomic DNA
cctcagtccatcttccggaagtttgacctggacaagtcgggcagcatgagtg

SEQ ID NO: 43140 - DNA, 81 bp, Homo sapiens
  misc_feature 1..81: note = chr11:65028546-65028627
  misc_feature 1..81: note = hypo
  source 1..81: mol_type = genomic DNA
cgcacctggcctgggatggacattttaaaggttcctgatacatattgctaaattgttttctcgaaacgctctataccatcc

SEQ ID NO: 43141 - DNA, 140 bp, Homo sapiens
  misc_feature 1..140: note = chr11:65091300-65091440
  misc_feature 1..140: note = hypo
  source 1..140: mol_type = genomic DNA
tgttacaaatggttgcagtgtgtgatgaaggaaagaactggggctcgggaagggcgggactgtgaagctggaacacaggctggcggcagcagggaagagtttcgctggccaggctgacgctgaggcgatggggtgctgct

SEQ ID NO: 43142 - DNA, 169 bp, Homo sapiens
  misc_feature 1..169: note = chr11:65127486-65127655
  misc_feature 1..169: note = hypo
  source 1..169: mol_type = genomic DNA
tctgaaactccttgacgatgagactgttcctgtctgacccttgtcccgtgctgctctgtaaaatggaacgctggggagctggggcctgtttttgccccttgcttgtaggttttagtgaatgaaaagaagcttttgtgttactttcagcttgcttcgttgtcctaattga

SEQ ID NO: 43143 - DNA, 30 bp, Homo sapiens
  misc_feature 1..30: note = chr11:65306390-65306420
  misc_feature 1..30: note = hypo
  source 1..30: mol_type = genomic DNA
gggggccggtaggggcgcctcgggtctcaa

SEQ ID NO: 43144 - DNA, 30 bp, Homo sapiens
  misc_feature 1..30: note = chr11:65309028-65309058
  misc_feature 1..30: note = hypo
  source 1..30: mol_type = genomic DNA
gggagttgtccagtccgagggaggagctgg

SEQ ID NO: 43145 - DNA, 232 bp, Homo sapiens
  misc_feature 1..232: note = chr11:65413881-65414113
  misc_feature 1..232: note = hypo
  source 1..232: mol_type = genomic DNA
ggcatggagtcctgccgcccctcactaacgcctccctccccgcagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctg

SEQ ID NO: 43146 - DNA, 30 bp, Homo sapiens
  misc_feature 1..30: note = chr11:65463016-65463046
  misc_feature 1..30: note = hypo
  source 1..30: mol_type = genomic DNA
ccccatggtggcaaacgtctacagttctag

SEQ ID NO: 43147 - DNA, 83 bp, Homo sapiens
  misc_feature 1..83: note = chr11:65478528-65478611
  misc_feature 1..83: note = hypo
  source 1..83: mol_type = genomic DNA
gcgtgagccaccgcgcccagccgttttgtcccattattttagatgccaagaacctgtacaccctccaccggtgacaccttcac

SEQ ID NO: 43148 - DNA, 149 bp, Homo sapiens
  misc_feature 1..149: note = chr11:65511031-65511180
  misc_feature 1..149: note = hypo
  source 1..149: mol_type = genomic DNA
gctgggattacaggcgtgagccaccgcaccctcttggccctttttaataagggcactgatctcattcatgacagttccaccctcatgactaatcatctcaccccaagccctatctcctagttccatcgcctttacggttgggatttcaa

SEQ ID NO: 43149 - DNA, 30 bp, Homo sapiens
  misc_feature 1..30: note = chr11:65511454-65511484
  misc_feature 1..30: note = hypo
  source 1..30: mol_type = genomic DNA
agcctcaccccctgccgagttggcagggca

SEQ ID NO: 43150 - DNA, 154 bp, Homo sapiens
  misc_feature 1..154: note = chr11:65551581-65551735
  misc_feature 1..154: note = hypo
  source 1..154: mol_type = genomic DNA
aggcagaaggagcatcgggaggaggggccagagctgggaacaggccaaggcttgttcaggggacgcgggagacagcagtgtggctggcatacagggacccagctggaaggggattgggaggtcaacggcggccccagcacgccaggcctcaggc

SEQ ID NO: 43151 - DNA, 69 bp, Homo sapiens
  misc_feature 1..69: note = chr11:65629450-65629519
  misc_feature 1..69: note = hypo
  source 1..69: mol_type = genomic DNA
agctactggccagctcggcactcaggagcccgagtgatactgctggtgctctaccgggagcacctggtg

SEQ ID NO: 43152 - DNA, 87 bp, Homo sapiens
  misc_feature 1..87: note = chr11:65685085-65685172
  misc_feature 1..87: note = hypo
  source 1..87: mol_type = genomic DNA
caggcacttaatgcccgctgcacggatggctgaatccgcctccagtacacccaagcggtccgtgaagtcgtccgtgtaaacacagat

SEQ ID NO: 43153 - DNA, 41 bp, Homo sapiens
  misc_feature 1..41: note = chr11:65722778-65722819
  misc_feature 1..41: note = hypo
  source 1..41: mol_type = genomic DNA
aaagagttaggtactcggctgtacgccgtggctcacacctg

SEQ ID NO: 43154 - DNA, 30 bp, Homo sapiens
  misc_feature 1..30: note = chr11:65741409-65741439
  misc_feature 1..30: note = hypo
  source 1..30: mol_type = genomic DNA
gccatgaagacaagccggtgagtcatgacc

SEQ ID NO: 43155 - DNA, 101 bp, Homo sapiens
  misc_feature 1..101: note = chr11:66048072-66048173
  misc_feature 1..101: note = hypo
  source 1..101: mol_type = genomic DNA
ggggggctgagtcagcgccaggcagcctggggggtgggaggggtgacgcccgccgcctgctggtggtgccagctctggggtacagacggcacccttctgct

SEQ ID NO: 43156 - DNA, 33 bp, Homo sapiens
  misc_feature 1..33: note = chr11:66324511-66324544
  misc_feature 1..33: note = hypo
  source 1..33: mol_type = genomic DNA
gtgagccaccgcgctcggcggggctctgggttt

SEQ ID NO: 43157 - DNA, 124 bp, Homo sapiens
  misc_feature 1..124: note = chr11:66325272-66325396
  misc_feature 1..124: note = hypo
  source 1..124: mol_type = genomic DNA
ggcgtctgcacaagccgccccgcattcaggaaaagtgccagctggagatcaacttcaacacactgcagaccaagttgcggctcagccaccggcctgccttcatgccctccgagggcaagctggt

SEQ ID NO: 43158 - DNA, 189 bp, Homo sapiens
  misc_feature 1..189: note = chr11:66411368-66411557
  misc_feature 1..189: note = hypo
  source 1..189: mol_type = genomic DNA
tgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggta

SEQ ID NO: 43159 - DNA, 156 bp, Homo sapiens
  misc_feature 1..156: note = chr11:66511194-66511350
  misc_feature 1..156: note = hypo
  source 1..156: mol_type = genomic DNA
ttcagtgcagtcaaacgtggaaaggggcctggatagggaggggtcgactcccaggtcccacctttgcgggggaagctggtccccctggattaggctgggagatgcttggggctggttgtaaggtaaaagacggggggtcgttttttctttttttga

SEQ ID NO: 43160 - DNA, 94 bp, Homo sapiens
  misc_feature 1..94: note = chr11:66513159-66513253
  misc_feature 1..94: note = hypo
  source 1..94: mol_type = genomic DNA
cattttacaaataaccgaacctaggctagaacccagggcgctgactcataggccagtgttcttttcccaactgcgctgtcataccgacatgaga

SEQ ID NO: 43161 - DNA, 93 bp, Homo sapiens
  misc_feature 1..93: note = chr11:66513553-66513646
  misc_feature 1..93: note = hypo
  source 1..93: mol_type = genomic DNA
ccggcgtgagccaccgtgcccggcccgatatgggaatatcgtaacagaggacgtgtgaaggaatagttagactctacacgtacctggaaacca

SEQ ID NO: 43162 - DNA, 16 bp, Homo sapiens
  misc_feature 1..16: note = chr11:66515380-66515396
  misc_feature 1..16: note = hypo
  source 1..16: mol_type = genomic DNA
gcgcagggcagcatta

SEQ ID NO: 43163 - DNA, 82 bp, Homo sapiens
  misc_feature 1..82: note = chr11:66557367-66557449
  misc_feature 1..82: note = hypo
  source 1..82: mol_type = genomic DNA
acttattcatccagacgtgtgtttgttcaagtcagtgtcagtgagctagatactatctgtaggtacagtgtcttaagatatg

SEQ ID NO: 43164 - DNA, 864 bp, Homo sapiens
  misc_feature 1..864: note = chr11:66625148-66626012
  misc_feature 1..864: note = hypo
  source 1..864: mol_type = genomic DNA
ccaagtgggcacctgcgccagccccacctgtgcctgggctgtggccccttcctacagggcgctcaccatggccccgccgctcctgctgctgctgctggccagtggagcggccgcctgcccgctgccctgcgtctgccagaacctgtccgagtcgctcagcaccctctgtgcccaccgaggcctgctgtttgtgccgcccaacgtggaccggcgcacagtggagctgcggctggctgacaacttcatccaggccctggggccccctgacttccgcaacatgacgggactggtggacctgacactgtctcgcaatgccatcacccgcattggggcccgcgcctttggggacctcgagagcctgcgttccctccaccttgacggcaacaggctggtggagctgggcaccgggagcctccggggccccgtcaatctgcagcacctcatcctcagcggcaaccagctgggccgcatcgcgccgggagccttcgacgacttcctagagagcctggaggacctggacctgtcctacaacaacctccggcaggtgccctgggccggcatcggcgccatgcctgccctgcacaccctcaacctggaccataaccttattgacgcactgcccccaggcgccttcgcccagctcggtcagctctcccgcctggacctcacctccaaccgcctggccacgctggctccggacccgcttttctctcgtgggcgtgatgcagaggcctctcccgcccccctggtgctgagctttagcgggaaccccctgcactgcaactgtgagctgctgtggctgcggcggctggcgcggccggacgacctggaaacgtgcgcctccccgcccggcctggccggccg

SEQ ID NO: 43165 - DNA, 96 bp, Homo sapiens
  misc_feature 1..96: note = chr11:66626839-66626935
  misc_feature 1..96: note = hypo
  source 1..96: mol_type = genomic DNA
ctgaagcacatggcccgcgcccgcgtgttatttctgcctctgctggtgccatccccccaccccattcccctcgcttgcctgcgtcctgtgccagtg

SEQ ID NO: 43166 - DNA, 250 bp, Homo sapiens
  misc_feature 1..250: note = chr11:66631300-66631550
  misc_feature 1..250: note = hypo
  source 1..250: mol_type = genomic DNA
tggggtggtctttgccgtgggcaatgactttgaccagcagggagtcgtagtggggcgagatgacggctccttggaaggcggaagcattatccaggcggatgcccatgccctctccgctccggaacacctgtgggaagggtgaggcgtgaggacctgcgccagaaactgcggtcaaaagtgccccacccaccccgaggctggccaggtgtgcacccagcagctgctgagagcagagcgtggggtgtctgca

SEQ ID NO: 43167 - DNA, 67 bp, Homo sapiens
  misc_feature 1..67: note = chr11:66648961-66649028
  misc_feature 1..67: note = hypo
  source 1..67: mol_type = genomic DNA
tcaggaaggcacctacgacgacctgcaggctgaggcagggcgagggcctggccgtcacctgccccgc

SEQ ID NO: 43168 - DNA, 149 bp, Homo sapiens
  misc_feature 1..149: note = chr11:66897593-66897742
  misc_feature 1..149: note = hypo
  source 1..149: mol_type = genomic DNA
tggctaatttttttttttttcttgcaccaaagctttctaaagttagtgatttatttctgacaagtttgcaaaacccaagagagagcagttttctgggttgaactcatacttcgtgtttactcgagtctgagtcacggcacctgacttcc

SEQ ID NO: 43169 - DNA, 295 bp, Homo sapiens
  misc_feature 1..295: note = chr11:67072101-67072396
  misc_feature 1..295: note = hypo
  source 1..295: mol_type = genomic DNA
ccactctagacctatcgaccgcgtgggggcccatgaatccgtgtagacaagggctgcaggtgaatgtgatgcatgctagactttgagagcccctaccctaaggggaatgaggagccatgacagttgcccactgccctgccaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatccca

SEQ ID NO: 43170 - DNA, 40 bp, Homo sapiens; identical to SEQ ID NO: 15582
  misc_feature 1..40: note = chr11:67210017-67210057
  misc_feature 1..40: note = hypo
  source 1..40: mol_type = genomic DNA

SEQ ID NO: 43171 - DNA, 30 bp, Homo sapiens
  misc_feature 1..30: note = chr11:67442110-67442140
  misc_feature 1..30: note = hypo
  source 1..30: mol_type = genomic DNA
gtgttacccaacaggcgtggggcagggctg

SEQ ID NO: 43172 - DNA, 202 bp, Homo sapiens
  misc_feature 1..202: note = chr11:67462628-67462830
  misc_feature 1..202: note = hypo
  source 1..202: mol_type = genomic DNA
agatccgccttaagccgtatgaggtagccacggaaccgcaggcaagactcactcgctcggtccagcagtaggacttatcatgatttacacaagcaacaccagctgcagtgaggcttgtgactattcacacacacttttaacctccagaatatcccgaccaccaagcaagtactttgtcgcacccttgcgacgtttctttact

SEQ ID NO: 43173 - DNA, 159 bp, Homo sapiens
  misc_feature 1..159: note = chr11:67764095-67764254
  misc_feature 1..159: note = hypo
  source 1..159: mol_type = genomic DNA
agagcacctcgaagccgctgtagataaagaaaggcacgaggtggcgcaggcggtagtcacgcacgtgcttgaagggcagctggaagatgttgccccagcccacgctgcgcagatcgatctcctccgtgggccggtaagcggctccgcacaaacccagca

SEQ ID NO: 43174 - DNA, 147 bp, Homo sapiens; identical to SEQ ID NO: 15585
  misc_feature 1..147: note = chr11:67781462-67781609
  misc_feature 1..147: note = hypo
  source 1..147: mol_type = genomic DNA

SEQ ID NO: 43175 - DNA, 165 bp, Homo sapiens
  misc_feature 1..165: note = chr11:67797137-67797302
  misc_feature 1..165: note = hypo
  source 1..165: mol_type = genomic DNA
tgtcctccctctgcacgggcatgggacatgccctctgcctccttcctgtcctggcctgcccaactcctacctaccctcagcgcagatcctcccaacacacacatgcaggcagcctcggggcctctgcgggtccctctaccacagcattcccggggaaaggcccgg

SEQ ID NO: 43176 - DNA, 119 bp, Homo sapiens
  misc_feature 1..119: note = chr11:67811705-67811824
  misc_feature 1..119: note = hypo
  source 1..119: mol_type = genomic DNA
cctgaaccagtgcagcgtgagcaccacgcacaagtgcctcattgccgaggcctggtgctctgtgcgagacctgcccgccctgcaggaggccctgcgggacagctcggtgagcagcctga

SEQ ID NO: 43177 - DNA, 30 bp, Homo sapiens
  misc_feature 1..30: note = chr11:67915948-67915978
  misc_feature 1..30: note = hypo
  source 1..30: mol_type = genomic DNA
tgaccagccgttattcggcactcaaatagg

SEQ ID NO: 43178 - DNA, 154 bp, Homo sapiens; identical to SEQ ID NO: 15587
  misc_feature 1..154: note = chr11:68111091-68111245
  misc_feature 1..154: note = hypo
  source 1..154: mol_type = genomic DNA

SEQ ID NO: 43179 - DNA, 227 bp, Homo sapiens
  misc_feature 1..227: note = chr11:68132977-68133204
  misc_feature 1..227: note = hypo
  source 1..227: mol_type = genomic DNA
ttcagaaacaagtgacggtcctcttctggaaccttctctcactctgtcctggttttctcagtccacactcgctgtgaggaggacaatggcggctgctcccacctgtgcctgctgtccccaagcgagcctttctacacatgcgcctgccccacgggtgtgcagctgcaggacaacggcaggacgtgtaaggcaggtgaggcggtgggacgggacggggcgggcgggcg

SEQ ID NO: 43180 - DNA, 30 bp, Homo sapiens
  misc_feature 1..30: note = chr11:68210102-68210132
  misc_feature 1..30: note = hypo
  source 1..30: mol_type = genomic DNA
gccttttgctgctaacgatgtataaaagct

SEQ ID NO: 43181 - DNA, 30 bp, Homo sapiens
  misc_feature 1..30: note = chr11:68225302-68225332
  misc_feature 1..30: note = hypo
  source 1..30: mol_type = genomic DNA
ggtgctccctgctctcgcttccagccatct

SEQ ID NO: 43182 - DNA, 37 bp, Homo sapiens
  misc_feature 1..37: note = chr11:68226712-68226749
  misc_feature 1..37: note = hypo
  source 1..37: mol_type = genomic DNA
gggattacaggcgtgaccgcgccgtgacctcctgtgg

SEQ ID NO: 43183 - DNA, 82 bp, Homo sapiens
  misc_feature 1..82: note = chr11:68385159-68385241
  misc_feature 1..82: note = hypo
  source 1..82: mol_type = genomic DNA
aataaatgcgttaagcaaaagaagtaagatatgtaagcatctatacgaagctctaaaaccgaccaaacgaattgatgggaga

SEQ ID NO: 43184 - DNA, 143 bp, Homo sapiens
  misc_feature 1..143: note = chr11:68385590-68385733
  misc_feature 1..143: note = hypo
  source 1..143: mol_type = genomic DNA
cagcctggatttgcccgcccatggagaggacacgttccggatcgtcctcttccacacagtagactctgtcctgccgaagggagaagtctgcatccctgggttagacacgtctcatggagtcctctgcccgtgaccaggggggg

SEQ ID NO: 43185 - DNA, 30 bp, Homo sapiens
  misc_feature 1..30: note = chr11:68412854-68412884
  misc_feature 1..30: note = hypo
  source 1..30: mol_type = genomic DNA
acaaagcccagaagccgcccaaccatgtga

SEQ ID NO: 43186 - DNA, 161 bp, Homo sapiens
  misc_feature 1..161: note = chr11:68417837-68417998
  misc_feature 1..161: note = hypo
  source 1..161: mol_type = genomic DNA
aggccctggggacatcgtggccctggggacatcatggtccctgcctccatggagctgacgctctagaggagccggacacaaaaggcaaaatgaaagcacgcgagcttcatcatcagccagactacaggcttaaaagagcgttggcgccacaactaaaattc

SEQ ID NO: 43187 - DNA, 242 bp, Homo sapiens
  misc_feature 1..242: note = chr11:68432989-68433231
  misc_feature 1..242: note = hypo
  source 1..242: mol_type = genomic DNA
gacccagaaataagacgtgaagaagttgggataatgccatcaaaagggtcacggcgccctcatgattctcttgacaggcatgaatttatataataatcaaaaagcattttcaccattaagcagccccacagcctgccaaggccatcgtggatgacggtcgcattactcacgcgcgttgccacccaaccggctggggcatcgccgcacttcccattctgctgggaacacgtagaattaagatg

SEQ ID NO: 43188 - DNA, 30 bp, Homo sapiens
  misc_feature 1..30: note = chr11:68564345-68564375
  misc_feature 1..30: note = hypo
  source 1..30: mol_type = genomic DNA
accatgagcggccctcgtcctcggaggtag

SEQ ID NO: 43189 - DNA, 30 bp, Homo sapiens
  misc_feature 1..30: note = chr11:68672906-68672936
  misc_feature 1..30: note = hypo
  source 1..30: mol_type = genomic DNA
cagtcaggtgctcagcgtggtgccaaggac

SEQ ID NO: 43190 - DNA, 30 bp, Homo sapiens
  misc_feature 1..30: note = chr11:68692056-68692086
  misc_feature 1..30: note = hypo
  source 1..30: mol_type = genomic DNA
gtgttggctggaggccgctcttagctgttt

SEQ ID NO: 43191 - DNA, 38 bp, Homo sapiens
  misc_feature 1..38: note = chr11:68771669-68771707
  misc_feature 1..38: note = hypo
  source 1..38: mol_type = genomic DNA
gacaagccacaggagcgggaacacgggtgtgtgcagac

SEQ ID NO: 43192 - DNA, 76 bp, Homo sapiens
  misc_feature 1..76: note = chr11:68804728-68804804
  misc_feature 1..76: note = hypo
  source 1..76: mol_type = genomic DNA
acctggagcaggtcccgggtgctcaaccgcagacggccagtctccaggctgcggggacgctcgggtccttcttggg

SEQ ID NO: 43193 - DNA, 161 bp, Homo sapiens
  misc_feature 1..161: note = chr11:68965052-68965213
  misc_feature 1..161: note = hypo
  source 1..161: mol_type = genomic DNA
ccccagtggtggatccgtttttggtcctcatagctctgccttttctagaatcgcatcaatagacccatgcagttggcagtctcttcagtgtggcttctttcactttgtattatgcctttaacatccagccatagttacagggacatcgctggcacctcgca

SEQ ID NO: 43194 - DNA, 334 bp, Homo sapiens
  misc_feature 1..334: note = chr11:69192486-69192820
  misc_feature 1..334: note = hypo
  source 1..334: mol_type = genomic DNA
tggcagaggctgttccgaggctgctccgatgtgtgggaactgagggggttcccaggatgtgagactttcagtgctgaaactgggaaagtcctgggcgagccgggacaagtcgctcaccctactagagacagttgggcgaaggagacacattgggatcagtctcccatggccttcaagtgtcagggcaggggctggggacctcccatataacgagcagcctcaggagactccaggcaggcaggagcgtcgggggctgcgactccagaatggccaaggcttctaccgtccagcccctttgtaacacagagcacccaacgggcgcagccgcccccat

SEQ ID NO: 43195 - DNA, 30 bp, Homo sapiens
  misc_feature 1..30: note = chr11:69206384-69206414
  misc_feature 1..30: note = hypo
  source 1..30: mol_type = genomic DNA
ccctgacactggctgcgagcacttttcact

SEQ ID NO: 43196 - DNA, 104 bp, Homo sapiens
  misc_feature 1..104: note = chr11:69280529-69280633
  misc_feature 1..104: note = hypo
  source 1..104: mol_type = genomic DNA
tctccaggtgattctcgtgtgcagccaagttagagaacactgactcccggggaggtggattacctgtcctcccggcaaagcgcaggactcgcagtttggcaagc

SEQ ID NO: 43197 - DNA, 67 bp, Homo sapiens
  misc_feature 1..67: note = chr11:69339948-69340015
  misc_feature 1..67: note = hypo
  source 1..67: mol_type = genomic DNA
gccctcatccctgcccgccccgtccccatgcttgcctccacgggcctctcctcgcacaggaggaggg

SEQ ID NO: 43198 - DNA, 167 bp, Homo sapiens
  misc_feature 1..167: note = chr11:69360946-69361113
  misc_feature 1..167: note = hypo
  source 1..167: mol_type = genomic DNA
gaccagccacattgacgtcacgtggaagcttgttagactggcccacttggacccagtaagccagaatgtgcattgtgataagatcccctgatctcccctgcaccgcatgctttgagaagctctgctctaggacgcggagcctgaggccaggacgttggtgccgaccc

SEQ ID NO: 43199 - DNA, 30 bp, Homo sapiens
  misc_feature 1..30: note = chr11:69458784-69458814
  misc_feature 1..30: note = hypo
  source 1..30: mol_type = genomic DNA
cctccccttgagagccggctccttaggtga

SEQ ID NO: 43200 - DNA, 30 bp, Homo sapiens
  misc_feature 1..30: note = chr11:69466053-69466083
  misc_feature 1..30: note = hypo
  source 1..30: mol_type = genomic DNA
cgccaggcaggcgggcgccaccgccacccg

SEQ ID NO: 43201 - DNA, 147 bp, Homo sapiens
  misc_feature 1..147: note = chr11:69498970-69499117
  misc_feature 1..147: note = hypo
  source 1..147: mol_type = genomic DNA
acgcatagtggctaccggggacccagccctgccatggcctgaggcattgtccctctaggtgggagcgtgtaggactcatgcacccccccgggaggctccaagagagtcccccatttgacctacaccccttatttcttagaaggccct

SEQ ID NO: 43202 - DNA, 75 bp, Homo sapiens
  misc_feature 1..75: note = chr11:69970448-69970523
  misc_feature 1..75: note = hypo
  source 1..75: mol_type = genomic DNA
ccctcagctcctgtacgaagagtgggcacgctatggagttttctataagtaccagcccatcgacctggtcaggta

SEQ ID NO: 43203 - DNA, 30 bp, Homo sapiens
  misc_feature 1..30: note = chr11:70005678-70005708
  misc_feature 1..30: note = hypo
  source 1..30: mol_type = genomic DNA
aggatgtgccccacacgcccctggtcctgg

SEQ ID NO: 43204 - DNA, 30 bp, Homo sapiens
  misc_feature 1..30: note = chr11:70022959-70022989
  misc_feature 1..30: note = hypo
  source 1..30: mol_type = genomic DNA
tgcgtcagaataactcggggctcccagccc

SEQ ID NO: 43205 - DNA, 258 bp, Homo sapiens
  misc_feature 1..258: note = chr11:70050908-70051166
  misc_feature 1..258: note = hypo
  source 1..258: mol_type = genomic DNA
tttaaaggcggtctacgaaacatagctgacatttgagatgtatgtgtgcttggttttatttatatcgtcatgtagttactgtgtgctgggaaaagtacaccagaaggtgagcggtgggtatggacaggttggtagcgggcgactctgccttcctccccagaagttcagcatagcggttaagggtcgactctggcaccacactcttagggtttcagaacatggctctgccatcgtctagctacacgatctcaggaatgt

SEQ ID NO: 43206 - DNA, 30 bp, Homo sapiens
  misc_feature 1..30: note = chr11:71098989-71099019
  misc_feature 1..30: note = hypo
  source 1..30: mol_type = genomic DNA
acatcctgacagtcccgacattctgacagt

SEQ ID NO: 43207 - DNA, 57 bp, Homo sapiens
  misc_feature 1..57: note = chr11:71117658-71117715
  misc_feature 1..57: note = hypo
  source 1..57: mol_type = genomic DNA
atctgagatcttccacgtcacgacgctgctccctaccacggacgattggaacttcca

SEQ ID NO: 43208 - DNA, 111 bp, Homo sapiens
  misc_feature 1..111: note = chr11:71192722-71192833
  misc_feature 1..111: note = hypo
  source 1..111: mol_type = genomic DNA
tgcgtatctgcagttcgtcggtggagtcagcctctgacacgccccgcagtgaagtgtcttttttccctctgaaaaatccattcatcctgccacgtgcgggtatttgtcctg

SEQ ID NO: 43209 - DNA, 30 bp, Homo sapiens
  misc_feature 1..30: note = chr11:71507973-71508003
  misc_feature 1..30: note = hypo
  source 1..30: mol_type = genomic DNA
ccacgtggggcagcccgttaactacagagc

SEQ ID NO: 43210 - DNA, 29 bp, Homo sapiens
  misc_feature 1..29: note = chr11:71781578-71781607
  misc_feature 1..29: note = hypo
  source 1..29: mol_type = genomic DNA
cccagtggctcacagcggtaatcccagca

SEQ ID NO: 43211 - DNA, 30 bp, Homo sapiens
  misc_feature 1..30: note = chr11:72109516-72109546
  misc_feature 1..30: note = hypo
  source 1..30: mol_type = genomic DNA
taagtaaagcatcaccgagaggttgtaaca

SEQ ID NO: 43212 - DNA, 46 bp, Homo sapiens
  misc_feature 1..46: note = chr11:72475677-72475723
  misc_feature 1..46: note = hypo
  source 1..46: mol_type = genomic DNA
ccatctttgttcctgcgggcggcggtggccacgccccaaaggtgta

SEQ ID NO: 43213 - DNA, 78 bp, Homo sapiens
  misc_feature 1..78: note = chr11:72532300-72532378
  misc_feature 1..78: note = hypo
  source 1..78: mol_type = genomic DNA
ctgggaacatcatggcgcccgagggccggatgggcatttggcagcctctgcgcgaggagtcctcgcagtggttatgca

SEQ ID NO: 43214 - DNA, 30 bp, Homo sapiens
  misc_feature 1..30: note = chr11:72532613-72532643
  misc_feature 1..30: note = hypo
  source 1..30: mol_type = genomic DNA
gggcaggtgagcagccgactcccttagcgc

SEQ ID NO: 43215 - DNA, 30 bp, Homo sapiens; identical to SEQ ID NO: 15597
  misc_feature 1..30: note = chr11:72905832-72905862
  misc_feature 1..30: note = hypo
  source 1..30: mol_type = genomic DNA

SEQ ID NO: 43216 - DNA, 155 bp, Homo sapiens
  misc_feature 1..155: note = chr11:73073174-73073329
  misc_feature 1..155: note = hypo
  source 1..155: mol_type = genomic DNA
tgcctgctgagcctgcgcgccgagccggacgtggaggcctgcatcgccgtctgttccgcccgcatcctctgcatcggggcggtgcccgggctgcagcctcgctgccaccggtgaggcctgggcggcggggtgggcggcaccgcgggcctgggaga

SEQ ID NO: 43217 - DNA, 98 bp, Homo sapiens
  misc_feature 1..98: note = chr11:73310342-73310440
  misc_feature 1..98: note = hypo
  source 1..98: mol_type = genomic DNA
gggtgtcagattgcacgtaggttttttttgttttttgagacggagtctggatctatagccaggctggagtaaagtgggggcgatcgcaggtcactgca

SEQ ID NO: 43218 - DNA, 30 bp, Homo sapiens
  misc_feature 1..30: note = chr11:73805524-73805554
  misc_feature 1..30: note = hypo
  source 1..30: mol_type = genomic DNA
ttctggaacatacaccgaatggcaaaaagt

SEQ ID NO: 43219 - DNA, 40 bp, Homo sapiens
  misc_feature 1..40: note = chr11:74246636-74246676
  misc_feature 1..40: note = hypo
  source 1..40: mol_type = genomic DNA
agccacggcacccagcccaagatgacgtttatatcttctc

SEQ ID NO: 43220 - DNA, 48 bp, Homo sapiens
  misc_feature 1..48: note = chr11:74302595-74302643
  misc_feature 1..48: note = hypo
  source 1..48: mol_type = genomic DNA
acatgtgaacaggctcggtttattattgctcatagctgcagccccagc

SEQ ID NO: 43221 - DNA, 35 bp, Homo sapiens
  misc_feature 1..35: note = chr11:75100584-75100619
  misc_feature 1..35: note = hypo
  source 1..35: mol_type = genomic DNA
cattaaaagcaatgacggccgggcgcggtggctca

SEQ ID NO: 43222 - DNA, 56 bp, Homo sapiens
  misc_feature 1..56: note = chr11:75152480-75152536
  misc_feature 1..56: note = hypo
  source 1..56: mol_type = genomic DNA
cagagggccaagctccgggacaagcccgggtctgcccgacacgctcaccctcttgt

SEQ ID NO: 43223 - DNA, 91 bp, Homo sapiens; identical to SEQ ID NO: 15601
  misc_feature 1..91: note = chr11:75459473-75459564
  misc_feature 1..91: note = hypo
  source 1..91: mol_type = genomic DNA

SEQ ID NO: 43224 - DNA, 30 bp, Homo sapiens
  misc_feature 1..30: note = chr11:75879446-75879476
  misc_feature 1..30: note = hypo
  source 1..30: mol_type = genomic DNA
gccctcctggcatcccgttgggaaacacgt

SEQ ID NO: 43225 - DNA, 609 bp, Homo sapiens
  misc_feature 1..609: note = chr11:76371627-76372236
  misc_feature 1..609: note = hypo
  source 1..609: mol_type = genomic DNA
gctcaagaaagctgtcggggatgagctcaatctcattgtagctcaaatccagattcaagagctgggaaagggggcggccgctggcattcccgctgggggctgagaggggcagggctgaccagccctcggaaggtgcgtggatgcccttgctgtcctggggtggccctgtggggagccggatgaggttgttggacaagttcaggtagatgagtctcgggagcgcggccaggtcggggaaatggagcagtttgttctcccgcaggtcaagccaggtgagctggaactcagcctggggctgggaggccgtctgaaaggcctcgatgctgttgcagctcaggtctagcacccgcagctgctggaggctgaagtcggagatgcaggtgagggaattcctggagaggttgagatgggtcaggcggggcagaccctcgaaggcgccatcctcgatgtccatcagcacgttgctatgcaggtcaagctgctccagcgcaggcatgtcccggaaggtgtggcgggtgaggcgagtcagactgttctccgccagtgagagggtatgcaggctgggtgcctcccccagcagccgctccagcaggccgctgtacaggctgt

SEQ ID NO: 43226 - DNA, 169 bp, Homo sapiens
  misc_feature 1..169: note = chr11:76902500-76902669
  misc_feature 1..169: note = hypo
  source 1..169: mol_type = genomic DNA
ctgatgggagggctgcgcagcccttgtgtgcagatgggaatggaattccctctcaggttgccacggcatctgatggagaaactcctcagcaaacaggagttccttcacacttgccctgaagcagctggagtgtgggcgtcccgcagactcacctcggaggctggagcct

SEQ ID NO: 43227 - DNA, 18 bp, Homo sapiens
  misc_feature 1..18: note = chr11:77025115-77025133
  misc_feature 1..18: note = hypo
  source 1..18: mol_type = genomic DNA
aaaaatatttaaggccgg

SEQ ID NO: 43228 - DNA, 85 bp, Homo sapiens
  misc_feature 1..85: note = chr11:82214234-82214319
  misc_feature 1..85: note = hypo
  source 1..85: mol_type = genomic DNA
tctcaaaaaaaaaaaaaaaaaaaagagttaaaatcaggtctctatcttttaccagtcatatgaccttggtcggttattcaaattc

SEQ ID NO: 43229 - DNA, 30 bp, Homo sapiens
  misc_feature 1..30: note = chr11:83561479-83561509
  misc_feature 1..30: note = hypo
  source 1..30: mol_type = genomic DNA
gccaccgcggcagcccggggtaagttttct

SEQ ID NO: 43230 - DNA, 30 bp, Homo sapiens
  misc_feature 1..30: note = chr11:85359853-85359883
  misc_feature 1..30: note = hypo
  source 1..30: mol_type = genomic DNA
caaatgacctcttatcgatataaaacaggt

SEQ ID NO: 43231 - DNA, 24 bp, Homo sapiens
  misc_feature 1..24: note = chr11:85379748-85379772
  misc_feature 1..24: note = hypo
  source 1..24: mol_type = genomic DNA
agattaagaaacatgcggccgggc

SEQ ID NO: 43232 - DNA, 150 bp, Homo sapiens
  misc_feature 1..150: note = chr11:85564833-85564983
  misc_feature 1..150: note = hypo
  source 1..150: mol_type = genomic DNA
aaaataaaaaaatctcgttaagctgtaaaaaataaaaataaaaataaaaatacatatccaggtacatactctttctttctttgagacagaggctcgctctgtcacccgtgcagtggcagtctcggctcactgagatctcagccttccagg

SEQ ID NO: 43233 - DNA, 30 bp, Homo sapiens
  misc_feature 1..30: note = chr11:85906245-85906275
  misc_feature 1..30: note = hypo
  source 1..30: mol_type = genomic DNA
cccagccgcacccaccgctgccccaggagc

SEQ ID NO: 43234 - DNA, 21 bp, Homo sapiens
  misc_feature 1..21: note = chr11:92929514-92929535
  misc_feature 1..21: note = hypo
  source 1..21: mol_type = genomic DNA
aattgctgggtcaaacgataa

SEQ ID NO: 43235 - DNA, 20 bp, Homo sapiens
  misc_feature 1..20: note = chr11:94064787-94064807
  misc_feature 1..20: note = hypo
  source 1..20: mol_type = genomic DNA
gccaccgcgcctggcccaag

SEQ ID NO: 43236 - DNA, 26 bp, Homo sapiens
  misc_feature 1..26: note = chr11:94892054-94892080
  misc_feature 1..26: note = hypo
  source 1..26: mol_type = genomic DNA
tcctccctgggcgacaaagcaagact

SEQ ID NO: 43237 - DNA, 30 bp, Homo sapiens
  misc_feature 1..30: note = chr11:94924721-94924751
  misc_feature 1..30: note = hypo
  source 1..30: mol_type = genomic DNA
acaagaaagttagtacgttcatccactgtg

SEQ ID NO: 43238 - DNA, 41 bp, Homo sapiens
  misc_feature 1..41: note = chr11:95020639-95020680
  misc_feature 1..41: note = hypo
  source 1..41: mol_type = genomic DNA
ggattacaggcgtgagccaccgcgcccggcctggttgctcc

SEQ ID NO: 43239 - DNA, 30 bp, Homo sapiens; identical to SEQ ID NO: 15603
  misc_feature 1..30: note = chr11:95488699-95488729
  misc_feature 1..30: note = hypo
  source 1..30: mol_type = genomic DNA

SEQ ID NO: 43240 - DNA, 30 bp, Homo sapiens; identical to SEQ ID NO: 15604
  misc_feature 1..30: note = chr11:95658721-95658751
  misc_feature 1..30: note = hypo
  source 1..30: mol_type = genomic DNA

SEQ ID NO: 43241 - DNA, 17 bp, Homo sapiens
  misc_feature 1..17: note = chr11:102158484-102158501
  misc_feature 1..17: note = hypo
  source 1..17: mol_type = genomic DNA
cccggcccctgtttact

SEQ ID NO: 43242 - DNA, 38 bp, Homo sapiens
  misc_feature 1..38: note = chr11:102961347-102961385
  misc_feature 1..38: note = hypo
  source 1..38: mol_type = genomic DNA
aaagcatttctcagtcgggcgaggtggctcactcctgt

SEQ ID NO: 43243 - DNA, 30 bp, Homo sapiens
  misc_feature 1..30: note = chr11:109880267-109880297
  misc_feature 1..30: note = hypo
  source 1..30: mol_type = genomic DNA
ctgtctccaggtggccgggcatggggctca

SEQ ID NO: 43244 - DNA, 40 bp, Homo sapiens
  misc_feature 1..40: note = chr11:111154502-111154542
  misc_feature 1..40: note = hypo
  source 1..40: mol_type = genomic DNA
gtcttcctagcacagcgccggtcaccgggaaggtactcag

SEQ ID NO: 43245 - DNA, 100 bp, Homo sapiens
  misc_feature 1..100: note = chr11:111156679-111156779
  misc_feature 1..100: note = hypo
  source 1..100: mol_type = genomic DNA
tgaggaagcagacaccggttccctccatgacccttccccttgggtgaaagaagatgggagtattgcctgggggtcatatgaatgccgcagagcttattga

SEQ ID NO: 43246 - DNA, 23 bp, Homo sapiens
  misc_feature 1..23: note = chr11:113373844-113373867
  misc_feature 1..23: note = hypo
  source 1..23: mol_type = genomic DNA
cgagactccgtctcaaaaaaaaa

SEQ ID NO: 43247 - DNA, 185 bp, Homo sapiens; identical to SEQ ID NO: 15606
  misc_feature 1..185: note = chr11:113552799-113552984
  misc_feature 1..185: note = hypo
  source 1..185: mol_type = genomic DNA

SEQ ID NO: 43248 - DNA, 151 bp, Homo sapiens
  misc_feature 1..151: note = chr11:113560972-113561123
  misc_feature 1..151: note = hypo
  source 1..151: mol_type = genomic DNA
cgtccaggtagccagcgcaaagcatgcggggggtgagggctccgctgtacacgcaagagctgttgcagagctgagtgctgaacaagggcaccaccgtgtcctggagcatatccgagctgtaagctatgagagacaccgagaaaaactgcag

SEQ ID NO: 43249 - DNA, 67 bp, Homo sapiens
  misc_feature 1..67: note = chr11:113800743-113800810
  misc_feature 1..67: note = hypo
  source 1..67: mol_type = genomic DNA
caccgcacccggcctcgcccattttaaaacagggctgcttgtcttttgttgtcgttgagttgtggga

SEQ ID NO: 43250 - DNA, 171 bp, Homo sapiens
  misc_feature 1..171: note = chr11:114115465-114115636
  misc_feature 1..171: note = hypo
  source 1..171: mol_type = genomic DNA
taaattcctaaaaatcggatcaaacaaactcctctgtcttaaccctttgttttttaaattgttagggacccctctggaggggaaaggcacaggcagccgcccccttcccccccaccgccgccttcacccccacccggctgggtggctgccgatgtacgttttaattaccgg

SEQ ID NO: 43251 - DNA, 30 bp, Homo sapiens
  misc_feature 1..30: note = chr11:114121201-114121231
  misc_feature 1..30: note = hypo
  source 1..30: mol_type = genomic DNA
gaagggccacaagcccgaggagatcccgcc

SEQ ID NO: 43252 - DNA, 30 bp, Homo sapiens
  misc_feature 1..30: note = chr11:115763341-115763371
  misc_feature 1..30: note = hypo
  source 1..30: mol_type = genomic DNA
cagaaatggcactgccggggaggtcttaag

SEQ ID NO: 43253 - DNA, 32 bp, Homo sapiens; identical to SEQ ID NO: 15607
  misc_feature 1..32: note = chr11:116890012-116890044
  misc_feature 1..32: note = hypo
  source 1..32: mol_type = genomic DNA

SEQ ID NO: 43254 - DNA, 75 bp, Homo sapiens
  misc_feature 1..75: note = chr11:116952331-116952406
  misc_feature 1..75: note = hypo
  source 1..75: mol_type = genomic DNA
tccgtctcaaaataaataaattaatcaaaaaaataaagtctttgaggctagaaaacgtcccgggaaagagagagc

SEQ ID NO: 43255 - DNA, 30 bp, Homo sapiens
  misc_feature 1..30: note = chr11:117010343-117010373
  misc_feature 1..30: note = hypo
  source 1..30: mol_type = genomic DNA
tttgagttctctaaacgtgaattctttcta

SEQ ID NO: 43256 - DNA, 30 bp, Homo sapiens
  misc_feature 1..30: note = chr11:117054963-117054993
  misc_feature 1..30: note = hypo
  source 1..30: mol_type = genomic DNA
ctggtggggtaggaacggggagtgttcttg

SEQ ID NO: 43257 - DNA, 52 bp, Homo sapiens
  misc_feature 1..52: note = chr11:118768516-118768568
  misc_feature 1..52: note = hypo
  source 1..52: mol_type = genomic DNA
aaaccagcacaaaagcgcagcgctctatttacagctccggctggcacctgcc

SEQ ID NO: 43258 - DNA, 32 bp, Homo sapiens
  misc_feature 1..32: note = chr11:118781045-118781077
  misc_feature 1..32: note = hypo
  source 1..32: mol_type = genomic DNA
attcctgctcccagacgcgcccctcacccagg

SEQ ID NO: 43259 - DNA, 46 bp, Homo sapiens
  misc_feature 1..46: note = chr11:119524180-119524226
  misc_feature 1..46: note = hypo
  source 1..46: mol_type = genomic DNA
tgagggacacatccccgttcctccagacccgcgcccctccaacagg

SEQ ID NO: 43260 - DNA, 284 bp, Homo sapiens
  misc_feature 1..284: note = chr11:120008071-120008355
  misc_feature 1..284: note = hypo
  source 1..284: mol_type = genomic DNA
cgggcctcaaagtcccggatgggctcgagcagctggtggtctcggaaggcggcgccctccaggtggggcttgagatgcagctcgcagaaggaggcctggcacaccaggcaggacttgaccgccttctgcttgttgccgatgcaggagtcgcacagcacctcctcggagccggacttggaccgtgaaaaaaggcccgtgtcggcccgggggtagctgttccgccgggtctccccgggctccatgatggacaccgtgggcttccgggactccgagaaaatggactt

SEQ ID NO: 43261 - DNA, 63 bp, Homo sapiens
  misc_feature 1..63: note = chr11:120008655-120008718
  misc_feature 1..63: note = hypo
  source 1..63: mol_type = genomic DNA
gctgccactggggcccgacgggctccgggcatccctggcttctgggctcgacccgttgctcct

SEQ ID NO: 43262 - DNA, 30 bp, Homo sapiens; identical to SEQ ID NO: 15610
  misc_feature 1..30: note = chr11:120367603-120367633
  misc_feature 1..30: note = hypo
  source 1..30: mol_type = genomic DNA

SEQ ID NO: 43263 - DNA, 30 bp, Homo sapiens
  misc_feature 1..30: note = chr11:120384093-120384123
  misc_feature 1..30: note = hypo
  source 1..30: mol_type = genomic DNA
gactgtctgtgctcgcgtggtcaggggcga

SEQ ID NO: 43264 - DNA, 30 bp, Homo sapiens
  misc_feature 1..30: note = chr11:120410117-120410147
  misc_feature 1..30: note = hypo
  source 1..30: mol_type = genomic DNA
aaggaaccacttgtgcgaacatgatcttat

SEQ ID NO: 43265 - DNA, 109 bp, Homo sapiens
  misc_feature 1..109: note = chr11:120748772-120748881
  misc_feature 1..109: note = hypo
  source 1..109: mol_type = genomic DNA
gtcattaagaaacagcgtcatcagcccccagggctcatccttcagcccccaacccaggccagcaagggaccgtgccctgaggcatcctccacagcggctgcagtttctt

SEQ ID NO: 43266 - DNA, 32 bp, Homo sapiens
  misc_feature 1..32: note = chr11:120772673-120772705
  misc_feature 1..32: note = hypo
  source 1..32: mol_type = genomic DNA
ttggttcttttcttgcgcgtgtgtgcctacag

SEQ ID NO: 43267 - DNA, 30 bp, Homo sapiens
  misc_feature 1..30: note = chr11:120837904-120837934
  misc_feature 1..30: note = hypo
  source 1..30: mol_type = genomic DNA
ctcggttttccgggacgagtttgatctggc

SEQ ID NO: 43268 - DNA, 30 bp, Homo sapiens
  misc_feature 1..30: note = chr11:120998803-120998833
  misc_feature 1..30: note = hypo
  source 1..30: mol_type = genomic DNA
ccccaagcgggagaccgtgtgcctgctcag

SEQ ID NO: 43269 - DNA, 30 bp, Homo sapiens
  misc_feature 1..30: note = chr11:121000904-121000934
  misc_feature 1..30: note = hypo
  source 1..30: mol_type = genomic DNA
acctatgacttctgccgtaagttggggttg

SEQ ID NO: 43270 - DNA, 162 bp, Homo sapiens
  misc_feature 1..162: note = chr11:121023638-121023800
  misc_feature 1..162: note = hypo
  source 1..162: mol_type = genomic DNA
ccagccccgctgcgccgccatccgcctgaagagtgactgcagccactactgcgtggagggctgtcactgcgacgctggctacgtcctcaacggcaagagctgcatcctgccccacagctgcggctgctactccgatggcaaatattacgaggtatgggaggc

SEQ ID NO: 43271 - DNA, 144 bp, Homo sapiens
  misc_feature 1..144: note = chr11:121152141-121152285
  misc_feature 1..144: note = hypo
  source 1..144: mol_type = genomic DNA
atagtgtgtgcttccagagctcggggacttcgcagcctccatagtagcgttcactccctggagccactttatgtactcttaacttgtcttgtctcattcctttgactatgccagactttgtagcccccacggcctggtgttggg

SEQ ID NO: 43272 - DNA, 30 bp, Homo sapiens
  misc_feature 1..30: note = chr11:121910451-121910481
  misc_feature 1..30: note = hypo
  source 1..30: mol_type = genomic DNA
gtgagcaactgcgcccggccactattctct

SEQ ID NO: 43273 - DNA, 21 bp, Homo sapiens
  misc_feature 1..21: note = chr11:122402739-122402760
  misc_feature 1..21: note = hypo
  source 1..21: mol_type = genomic DNA
aagacatattgttgccgggca

SEQ ID NO: 43274 - DNA, 95 bp, Homo sapiens
  misc_feature 1..95: note = chr11:123169348-123169443
  misc_feature 1..95: note = hypo
  source 1..95: mol_type = genomic DNA
agtgggaggcacagccggaactgcgccctccatggagcaggtggagctgggaacaggtgggagggagccctgcctccttccgagttggcagggtg

SEQ ID NO: 43275 - DNA, 30 bp, Homo sapiens
  misc_feature 1..30: note = chr11:123457234-123457264
  misc_feature 1..30: note = hypo
  source 1..30: mol_type = genomic DNA
gtccctctgggggtccgccctcgggtgaca

SEQ ID NO: 43276 - DNA, 30 bp, Homo sapiens
  misc_feature 1..30: note = chr11:124526915-124526945
  misc_feature 1..30: note = hypo
  source 1..30: mol_type = genomic DNA
gacttgccactgagccggctgtgcccaata

SEQ ID NO: 43277 - DNA, 30 bp, Homo sapiens
  misc_feature 1..30: note = chr11:124743216-124743246
  misc_feature 1..30: note = hypo
  source 1..30: mol_type = genomic DNA
gggcttctacagctgcgtggccaagagttc

SEQ ID NO: 43278 - DNA, 69 bp, Homo sapiens
  misc_feature 1..69: note = chr11:125220613-125220682
  misc_feature 1..69: note = hypo
  source 1..69: mol_type = genomic DNA
gtccaggccgtcctccgtctcacagtctgaggacgggtgagccctggggaggggcgagcttggtgcttg

SEQ ID NO: 43279 - DNA, 73 bp, Homo sapiens
  misc_feature 1..73: note = chr11:125755569-125755642
  misc_feature 1..73: note = hypo
  source 1..73: mol_type = genomic DNA
ccaacccccaggccacggacaggcacctaggaaccaggccgcaaggcagggggtaagccgtaggagcttcatc

SEQ ID NO: 43280 - DNA, 81 bp, Homo sapiens
  misc_feature 1..81: note = chr11:126083885-126083966
  misc_feature 1..81: note = hypo
  source 1..81: mol_type = genomic DNA
tccttaatgtttctccggtgagtctaggcacttggtgatttaaagtagagttgttctcagtataaagaatttatgtggccg

SEQ ID NO: 43281 - DNA, 20 bp, Homo sapiens
  misc_feature 1..20: note = chr11:126154214-126154234
  misc_feature 1..20: note = hypo
  source 1..20: mol_type = genomic DNA
cactgcgcccagcccttcat

SEQ ID NO: 43282 - DNA, 231 bp, Homo sapiens
  misc_feature 1..231: note = chr11:126273042-126273273
  misc_feature 1..231: note = hypo
  source 1..231: mol_type = genomic DNA
cccacaaggggagggcgtggctcgtgaaattcctgattgggtatagcccagcaagccccaagactcgcccagtttgcttagcgcaacactgacgctgttttggaatgaagacaagacaatgtagaactttactggggaagaggtcgaagaagggctaattgtcttgttgttcaagactggttagcgctgctcacctctgacgctgctcacctctgacgccaaaggtttttc

SEQ ID NO: 43283 - DNA, 35 bp, Homo sapiens
  misc_feature 1..35: note = chr11:128657930-128657965
  misc_feature 1..35: note = hypo
  source 1..35: mol_type = genomic DNA
tcctgacctcatgatctgcccgcctcggcctccta

SEQ ID NO: 43284 - DNA, 66 bp, Homo sapiens
  misc_feature 1..66: note = chr11:129866993-129867059
  misc_feature 1..66: note = hypo
  source 1..66: mol_type = genomic DNA
gggcaaaactgtcaacggtgcaaacgtggaagtaaaaaaatatggattttacgtgtaggttatgtt

SEQ ID NO: 43285 - DNA, 35 bp, Homo sapiens
  misc_feature 1..35: note = chr11:130058066-130058101
  misc_feature 1..35: note = hypo
  source 1..35: mol_type = genomic DNA
tggaaaagcatggcccggggcgctgggtggtgctg

SEQ ID NO: 43286 - DNA, 102 bp, Homo sapiens
  misc_feature 1..102: note = chr11:130060305-130060407
  misc_feature 1..102: note = hypo
  source 1..102: mol_type = genomic DNA
agccctgcccccacacgtgccctccttcttgtctcctgcgcagacagctgcagctttggcctgcacgcccgcggtgtggagctgatgcgcttcaccacgccc

SEQ ID NO: 43287 - DNA, 30 bp, Homo sapiens
  misc_feature 1..30: note = chr11:130090184-130090214
  misc_feature 1..30: note = hypo
  source 1..30: mol_type = genomic DNA
tggctattcttgtaacggcaccgtggacaa

SEQ ID NO: 43288 - DNA, 190 bp, Homo sapiens
  misc_feature 1..190: note = chr11:130515653-130515843
  misc_feature 1..190: note = hypo
  source 1..190: mol_type = genomic DNA
taaaatcctagactccgcttctgtttcggtattcagtatctaccacagtgcacggcacacattaggccctcaacaatatttgctgaatgaaaaaaacatgggaggaggcaaaactcagaagtggcagagccaggaattaaaaccaggacctcttactcctgaccccatgttctcccgcggacatccccca

SEQ ID NO: 43289 - DNA, 30 bp, Homo sapiens; identical to SEQ ID NO: 15616
  misc_feature 1..30: note = chr11:130717573-130717603
  misc_feature 1..30: note = hypo
  source 1..30: mol_type = genomic DNA

SEQ ID NO: 43290 - DNA, 226 bp, Homo sapiens
  misc_feature 1..226: note = chr11:130785458-130785684
  misc_feature 1..226: note = hypo
  source 1..226: mol_type = genomic DNA
ctggctcctggctcacggaacggtaccaagataacacaaaatctcgaataatcatctggatggtgcggttgatctcccgttccagctgcctttctgcctcagggcatggaggacaggtggccaacgggatgaagcgttccagatgcagtcgacctgaagccactccagcgaggctggagcccagccatcctcccagcaccactagcaatgccgacagaaggcacag

SEQ ID NO: 43291 - DNA, 112 bp, Homo sapiens
  misc_feature 1..112: note = chr11:131522754-131522866
  misc_feature 1..112: note = hypo
  source 1..112: mol_type = genomic DNA
ggtggccatgggtggcggtcactccgccttcagaaagccacttggaatgcaacctgcacaattgccttcatcctttaccgccctgccagattgttgacggaagcaaccttat

SEQ ID NO: 43292 - DNA, 169 bp, Homo sapiens
  misc_feature 1..169: note = chr11:131631013-131631182
  misc_feature 1..169: note = hypo
  source 1..169: mol_type = genomic DNA
agactaaatcagagacgccgtgaaagtggcaagaggcagggaggagaatcgactttgcaggacctgttatgcgttacggctttttctgtgtgaacacatcctattcctcacagcagttcagtgtagtaggcttattagtcacattttacaggtgcggtaactgaaattc

SEQ ID NO: 43293 - DNA, 101 bp, Homo sapiens
  misc_feature 1..101: note = chr11:131766877-131766978
  misc_feature 1..101: note = hypo
  source 1..101: mol_type = genomic DNA
ggcctaggcttagatttttgaaagaaaaaggtttcactcacctaaatgtctggcaggcatttgacgtccgtggctgaatagccatgcgttgctgcgtctct

SEQ ID NO: 43294 - DNA, 38 bp, Homo sapiens
  misc_feature 1..38: note = chr11:131799626-131799664
  misc_feature 1..38: note = hypo
  source 1..38: mol_type = genomic DNA
tcgtgaaggtttcctcgaaggatcgtgaaattccacga

SEQ ID NO: 43295 - DNA, 48 bp, Homo sapiens
  misc_feature 1..48: note = chr11:132484374-132484422
  misc_feature 1..48: note = hypo
  source 1..48: mol_type = genomic DNA
gggcctctgcactgacgtgtcttcatgttataccgcttgtgtgtctgt

SEQ ID NO: 43296 - DNA, 30 bp, Homo sapiens
  misc_feature 1..30: note = chr11:132792371-132792401
  misc_feature 1..30: note = hypo
  source 1..30: mol_type = genomic DNA
gggaagacggagcaccgagaccaggagacc

SEQ ID NO: 43297 - DNA, 104 bp, Homo sapiens; identical to SEQ ID NO: 15619
  misc_feature 1..104: note = chr11:133231728-133231832
  misc_feature 1..104: note = hypo
  source 1..104: mol_type = genomic DNA

SEQ ID NO: 43298 - DNA, 192 bp, Homo sapiens
  misc_feature 1..192: note = chr11:133386010-133386202
  misc_feature 1..192: note = hypo
  source 1..192: mol_type = genomic DNA
agagcttggggactgcgacccccgcagagggagagcaaggctggcagctggtgggtggaggcagacagcacagtgcagctctggggaaggctctgaggtacctggagaggcttcgtgtcagtctccatcagaggagacgcatctcccaccagcagacctgacttgatatctccactgcgttctgttatggcc

SEQ ID NO: 43299 - DNA, 30 bp, Homo sapiens
  misc_feature 1..30: note = chr11:133805206-133805236
  misc_feature 1..30: note = hypo
  source 1..30: mol_type = genomic DNA
cagcccgaggaccaccgttcagaaggaact

SEQ ID NO: 43300 - DNA, 219 bp, Homo sapiens
  misc_feature 1..219: note = chr11:134011075-134011294
  misc_feature 1..219: note = hypo
  source 1..219: mol_type = genomic DNA
tggtgctggggttgccgatggggagaaaacacggtgtaccctgaagtgacatcctcccgggtgggaggatggtggtcagggaaggctccccaaagtggcctctctgggtgcggtgtgaagggtggctggttagcaggcaagatggtatggagggaggtggtgatcaggagagaatgctgtgtatgaagacgcagaagcaacagacggactggctgatgg

SEQ ID NO: 43301 - DNA, 34 bp, Homo sapiens
  misc_feature 1..34: note = chr11:134274891-134274925
  misc_feature 1..34: note = hypo
  source 1..34: mol_type = genomic DNA
gtcctccccgtgccacgagcggccgtctctccca

SEQ ID NO: 43302 - DNA, 30 bp, Homo sapiens
  misc_feature 1..30: note = chr11:134458505-134458535
  misc_feature 1..30: note = hypo
  source 1..30: mol_type = genomic DNA
tgctggattccctgccgagagctgcacctg

SEQ ID NO: 43303 - DNA, 30 bp, Homo sapiens
  misc_feature 1..30: note = chr11:134526234-134526264
  misc_feature 1..30: note = hypo
  source 1..30: mol_type = genomic DNA
aggcccggaggctggcgcgtaggaggctaa

SEQ ID NO: 43304 - DNA, 30 bp, Homo sapiens
  misc_feature 1..30: note = chr11:134607499-134607529
  misc_feature 1..30: note = hypo
  source 1..30: mol_type = genomic DNA
caggcaaagtcataccgaagcctcaggctc

SEQ ID NO: 43305 - DNA, 94 bp, Homo sapiens
  misc_feature 1..94: note = chr11:134608582-134608676
  misc_feature 1..94: note = hypo
  source 1..94: mol_type = genomic DNA
gtgtgtctctctgtgcgtgtctgtgtgagtccgtgtgtctctccatgagtgtctgtgcgagtctgtgtgtctctccgtgcgtgtctgtgcgagt

SEQ ID NO: 43306 - DNA, 30 bp, Homo sapiens
  misc_feature 1..30: note = chr12:299633-299663
  misc_feature 1..30: note = hypo
  source 1..30: mol_type = genomic DNA
actgcaagaacagtgcggaactagggcagg

SEQ ID NO: 43307 - DNA, 35 bp, Homo sapiens
  misc_feature 1..35: note = chr12:709027-709062
  misc_feature 1..35: note = hypo
  source 1..35: mol_type = genomic DNA
cagtgtcccattgcccgtctcgggcacaggagtag

SEQ ID NO: 43308 - DNA, 34 bp, Homo sapiens
  misc_feature 1..34: note = chr12:1650728-1650762
  misc_feature 1..34: note = hypo
  source 1..34: mol_type = genomic DNA
caggtgctggctcaaccctcgccccaaaacctca

SEQ ID NO: 43309 - DNA, 76 bp, Homo sapiens
  misc_feature 1..76: note = chr12:1651130-1651206
  misc_feature 1..76: note = hypo
  source 1..76: mol_type = genomic DNA
ataatattgcattttcgacacatacagcatgttatacagtaaccaaatcaagaatcctggtcgaaaccttaccaaa

SEQ ID NO: 43310 - DNA, 34 bp, Homo sapiens
  misc_feature 1..34: note = chr12:1716758-1716792
  misc_feature 1..34: note = hypo
  source 1..34: mol_type = genomic DNA
tctcctccgacatgccgagcgtctttgagtctcc

SEQ ID NO: 43311 - DNA, 42 bp, Homo sapiens
  misc_feature 1..42: note = chr12:1948142-1948184
  misc_feature 1..42: note = hypo
  source 1..42: mol_type = genomic DNA
cacgaccagtgacaccgggcttctacccgggcaatttggcaa

SEQ ID NO: 43312 - DNA, 173 bp, Homo sapiens
  misc_feature 1..173: note = chr12:1948419-1948592
  misc_feature 1..173: note = hypo
  source 1..173: mol_type = genomic DNA
caggatggctgagctcgaatgcctgttggatcgcgcaacttttcagaacacagctgggtcccaggtactgaagctaaaacaagggtaaggagcgcttcatcgcagggacctgatcgttctcagacagctaggcagagacaccaaggactctgcaggcacgaagaaactgaaag

SEQ ID NO: 43313 - DNA, 45 bp, Homo sapiens
  misc_feature 1..45: note = chr12:2017790-2017835
  misc_feature 1..45: note = hypo
  source 1..45: mol_type = genomic DNA
ccacgccaactcccacgccggactgcctcacggacatccccacgc

SEQ ID NO: 43314 - DNA, 32 bp, Homo sapiens
  misc_feature 1..32: note = chr12:2018113-2018145
  misc_feature 1..32: note = hypo
  source 1..32: mol_type = genomic DNA
cacgacactgtggcccgcgctggccttccacg

SEQ ID NO: 43315 - DNA, 134 bp, Homo sapiens
  misc_feature 1..134: note = chr12:2040511-2040645
  misc_feature 1..134: note = hypo
  source 1..134: mol_type = genomic DNA
ctggtggcagagtggcggatgccgtggtggagcactgcatggagcactgacggatgacacgtgcacatggcgatgaggacgacacctaaacgtggcagtcagtggagggaaagccagaacgggattcatgacac

SEQ ID NO: 43316 - DNA, 30 bp, Homo sapiens
  misc_feature 1..30: note = chr12:2046347-2046377
  misc_feature 1..30: note = hypo
  source 1..30: mol_type = genomic DNA
ggtgctcagagcactcgtttctaatgtgcc

SEQ ID NO: 43317 - DNA, 53 bp, Homo sapiens
  misc_feature 1..53: note = chr12:2088785-2088838
  misc_feature 1..53: note = hypo
  source 1..53: mol_type = genomic DNA
ttaagtaaataactacgaacggaacttgttggatcatacgctagttatatgtt

SEQ ID NO: 43318 - DNA, 40 bp, Homo sapiens
  misc_feature 1..40: note = chr12:2245461-2245501
  misc_feature 1..40: note = hypo
  source 1..40: mol_type = genomic DNA
ctattcggccatcttggctcctcctcgagacctttcttgt

SEQ ID NO: 43319 - DNA, 194 bp, Homo sapiens; identical to SEQ ID NO: 5128
  misc_feature 1..194: note = chr12:2566053-2566247
  misc_feature 1..194: note = hypo
  source 1..194: mol_type = genomic DNA

SEQ ID NO: 43320 - DNA, 30 bp, Homo sapiens; identical to SEQ ID NO: 15624
  misc_feature 1..30: note = chr12:2590465-2590495
  misc_feature 1..30: note = hypo
  source 1..30: mol_type = genomic DNA

SEQ ID NO: 43321 - DNA, 37 bp, Homo sapiens
  misc_feature 1..37: note = chr12:2921106-2921143
  misc_feature 1..37: note = hypo
  source 1..37: mol_type = genomic DNA
attctggtttgagcacgcaccccgccccacaatcctt

SEQ ID NO: 43322 - DNA, 313 bp, Homo sapiens
  misc_feature 1..313: note = chr12:2964499-2964812
  misc_feature 1..313: note = hypo
  source 1..313: mol_type = genomic DNA
tggtggtaggcttgccgggtgaagccagggaactcccaggactcgctggggaggaagaactcacgctgagcccacgtttgggagggtgggagggactcgctggcctggaccatctagggagagacaaaagggagcctggggaaggttgtgcagacaggggtgcagaaaggtgggtgaggcactccgctctccttcccaggcacgacctctgccagcccaggattctcatgaggacgcagaagtcctggcagggccgcatctccatccctctccttcccggcggaagttatggctgctgcgtatcatcttcaca

SEQ ID NO: 43323 - DNA, 30 bp, Homo sapiens
  misc_feature 1..30: note = chr12:3640833-3640863
  misc_feature 1..30: note = hypo
  source 1..30: mol_type = genomic DNA
tgagggcggccttcgcgtcaagcgtctcag

SEQ ID NO: 43324 - DNA, 30 bp, Homo sapiens
  misc_feature 1..30: note = chr12:4019070-4019100
  misc_feature 1..30: note = hypo
  source 1..30: mol_type = genomic DNA
cacctatcaagtgctcgacagccacgtgtg

SEQ ID NO: 43325 - DNA, 196 bp, Homo sapiens
  misc_feature 1..196: note = chr12:4194712-4194908
  misc_feature 1..196: note = hypo
  source 1..196: mol_type = genomic DNA
ttgttcactgagacccgtatggagtaaaaggaaggcagggactgttatcctgattcttgcagacttgcaaatggaaatataaagacgttaatcaactttgccaaagtcacacagtaagctgagaggggaaccgaaacataagtcaggcctctgctcctgacatagggcctcatgcataagtcgcagtaaacttcaa

SEQ ID NO: 43326 - DNA, 30 bp, Homo sapiens
  misc_feature 1..30: note = chr12:4217500-4217530
  misc_feature 1..30: note = hypo
  source 1..30: mol_type = genomic DNA
cccacaatggaggaccgggtcccctcaggt

SEQ ID NO: 43327 - DNA, 84 bp, Homo sapiens
  misc_feature 1..84: note = chr12:4268526-4268610
  misc_feature 1..84: note = hypo
  source 1..84: mol_type = genomic DNA
aggttgtgactggcacggaaggcttctgggatgctggtaacgttctatttcttgatttgggtgctggttacataagtgttctgt

SEQ ID NO: 43328 - DNA, 17 bp, Homo sapiens
  misc_feature 1..17: note = chr12:4272614-4272631
  misc_feature 1..17: note = hypo
  source 1..17: mol_type = genomic DNA
agcgagactctgtctca

SEQ ID NO: 43329 - DNA, 30 bp, Homo sapiens
  misc_feature 1..30: note = chr12:4280922-4280952
  misc_feature 1..30: note = hypo
  source 1..30: mol_type = genomic DNA
tgtacccagtgttagcgctaacttgtgagt

SEQ ID NO: 43330 - DNA, 30 bp, Homo sapiens
  misc_feature 1..30: note = chr12:4356247-4356277
  misc_feature 1..30: note = hypo
  source 1..30: mol_type = genomic DNA
agtgcaatgagaatccgagcatctcctcta

SEQ ID NO: 43331 - DNA, 75 bp, Homo sapiens
  misc_feature 1..75: note = chr12:4405652-4405727
  misc_feature 1..75: note = hypo
  source 1..75: mol_type = genomic DNA
agctattgtctaccacgcctcgtgtgcacacgcacacacacgcaagttccctcagtcagccgagaatcctgccat

SEQ ID NO: 43332 - DNA, 30 bp, Homo sapiens
  misc_feature 1..30: note = chr12:4411192-4411222
  misc_feature 1..30: note = hypo
  source 1..30: mol_type = genomic DNA
aaaggcaatgattcacgcttttgttttcat

SEQ ID NO: 43333 - DNA, 132 bp, Homo sapiens
  misc_feature 1..132: note = chr12:4554801-4554933
  misc_feature 1..132: note = hypo
  source 1..132: mol_type = genomic DNA
ctccctccggcatggcggcaggggcttatttttggaaggcagatgaaggctgctgacatgaaaccaaagcctccatcgggcactcgggttgagagcagagggacccaggctgagccgcggccggtagagacc

SEQ ID NO: 43334 - DNA, 30 bp, Homo sapiens
  misc_feature 1..30: note = chr12:4734872-4734902
  misc_feature 1..30: note = hypo
  source 1..30: mol_type = genomic DNA
gagagagagagcaagcgagcgagaaggcag

SEQ ID NO: 43335 - DNA, 146 bp, Homo sapiens
  misc_feature 1..146: note = chr12:4829055-4829201
  misc_feature 1..146: note = hypo
  source 1..146: mol_type = genomic DNA
actcctcacacctgacgctgctcagggagaagccaggcagctataatagtgttcttggccggagaacatctggcctagcaggcagggtgtcatctatgaagctgggtggagagaaagctgttggggaaaccagccccacaccaccc

SEQ ID NO: 43336 - DNA, 30 bp, Homo sapiens
  misc_feature 1..30: note = chr12:4959461-4959491
  misc_feature 1..30: note = hypo
  source 1..30: mol_type = genomic DNA
gagagggggacccctcgaccatgtggatgg

SEQ ID NO: 43337 - DNA, 141 bp, Homo sapiens
  misc_feature 1..141: note = chr12:5315393-5315534
  misc_feature 1..141: note = hypo
  source 1..141: mol_type = genomic DNA
cccaaagtgctgggattacaggcgtgacccagaaagttgagtaacttcttaaaggctatgtgaattattttcatttcacatcactattcacttgagcagtgagatttacacacttatcagctcttacgcttgctctttaaa

SEQ ID NO: 43338 - DNA, 106 bp, Homo sapiens
  misc_feature 1..106: note = chr12:5323880-5323986
  misc_feature 1..106: note = hypo
  source 1..106: mol_type = genomic DNA
gcagggggctagtggcgttctattttcttgtggagtgatggcctggaaaatataatgtacgggagatgtaatggtgacccaccgacctggccgggatgccttgctt

SEQ ID NO: 43339 - DNA, 141 bp, Homo sapiens
  misc_feature 1..141: note = chr12:5335908-5336049
  misc_feature 1..141: note = hypo
  source 1..141: mol_type = genomic DNA
tgctgaaattgaaaacgcctgttaatagcacaagtgacacatcatagatcactcgctgacaggctgaactgggcgccatcttgaagaacgtaggctgcatgctaatgacgcccaggaggagctgcgcgctgcattgtggag

SEQ ID NO: 43340 - DNA, 30 bp, Homo sapiens
  misc_feature 1..30: note = chr12:5384595-5384625
  misc_feature 1..30: note = hypo
  source 1..30: mol_type = genomic DNA
ggccaggtcctgccccggctgtggatccca

SEQ ID NO: 43341 - DNA, 20 bp, Homo sapiens
  misc_feature 1..20: note = chr12:5561269-5561289
  misc_feature 1..20: note = hypo
  source 1..20: mol_type = genomic DNA
ttttttttttgttgacggag

SEQ ID NO: 43342 - DNA, 54 bp, Homo sapiens
  misc_feature 1..54: note = chr12:5713384-5713438
  misc_feature 1..54: note = hypo
  source 1..54: mol_type = genomic DNA
tgtggttggtggtgccgatggctacgatagagaatacaacgtaagaggcagttt

SEQ ID NO: 43343 - DNA, 21 bp, Homo sapiens
  misc_feature 1..21: note = chr12:5720406-5720427
  misc_feature 1..21: note = hypo
  source 1..21: mol_type = genomic DNA
ttacagcggtgagccaccaca

SEQ ID NO: 43344 - DNA, 30 bp, Homo sapiens
  misc_feature 1..30: note = chr12:6180349-6180379
  misc_feature 1..30: note = hypo
  source 1..30: mol_type = genomic DNA
gagagggcaacttctcgctgccttgagttg

SEQ ID NO: 43345 - DNA, 30 bp, Homo sapiens
  misc_feature 1..30: note = chr12:6316943-6316973
  misc_feature 1..30: note = hypo
  source 1..30: mol_type = genomic DNA
ttccagaggaggtcccggtagagagaagtt

SEQ ID NO: 43346 - DNA, 218 bp, Homo sapiens
  misc_feature 1..218: note = chr12:6483568-6483786
  misc_feature 1..218: note = hypo
  source 1..218: mol_type = genomic DNA
gaagacgagcttgtccgagttgaggttgatgttgaggctgacggggtagctgaagtactctccgaaaagcaggccgaattgccagtacatcatgccaaaggtgcagagccacagcactgcccagaaggccgtcttcatgcggttgtgctgggagcacaccaggcggatggcgccgtggatggtggtgttgttgcagaagaactcgaagagctctcggt

SEQ ID NO: 43347 - DNA, 30 bp, Homo sapiens
  misc_feature 1..30: note = chr12:6484000-6484030
  misc_feature 1..30: note = hypo
  source 1..30: mol_type = genomic DNA
ccccttcatgagccccggagtggattgggg

SEQ ID NO: 43348 - DNA, 30 bp, Homo sapiens
  misc_feature 1..30: note = chr12:6495108-6495138
  misc_feature 1..30: note = hypo
  source 1..30: mol_type = genomic DNA
gaaaggtgagagctacgcaatggggtggat

SEQ ID NO: 43349 - DNA, 69 bp, Homo sapiens
  misc_feature 1..69: note = chr12:6623485-6623554
  misc_feature 1..69: note = hypo
  source 1..69: mol_type = genomic DNA
aagaaccgccccactcgggaagccataacacacctgcttggtgtagccttgacccgttataaccatatg

SEQ ID NO: 43350 - DNA, 30 bp, Homo sapiens
  misc_feature 1..30: note = chr12:6804680-6804710
  misc_feature 1..30: note = hypo
  source 1..30: mol_type = genomic DNA
gggtaggtgagtccccgaaggcccccagca

SEQ ID NO: 43351 - DNA, 16 bp, Homo sapiens
  misc_feature 1..16: note = chr12:7462672-7462688
  misc_feature 1..16: note = hypo
  source 1..16: mol_type = genomic DNA
gcgcctggcaggagac

SEQ ID NO: 43352 - DNA, 81 bp, Homo sapiens
  misc_feature 1..81: note = chr12:7767211-7767292
  misc_feature 1..81: note = hypo
  source 1..81: mol_type = genomic DNA
gcatatgtttgtaaccgccctcgatccctggtggatcgaggagggaaaatgtgggaataaagacaagagaccaaagaagac

SEQ ID NO: 43353 - DNA, 33 bp, Homo sapiens
  misc_feature 1..33: note = chr12:7864862-7864895
  misc_feature 1..33: note = hypo
  source 1..33: mol_type = genomic DNA
gaacgcggctcgtagcgtcgttgcatcagtatc

SEQ ID NO: 43354 - DNA, 84 bp, Homo sapiens
  misc_feature 1..84: note = chr12:7921500-7921584
  misc_feature 1..84: note = hypo
  source 1..84: mol_type = genomic DNA
tataggcatgagccaccacgccgggccttgttactggcatttttagatgtaattaaaatccatattaatcgtcttcaagtaaaa

SEQ ID NO: 43355 - DNA, 43 bp, Homo sapiens
  misc_feature 1..43: note = chr12:7960433-7960476
  misc_feature 1..43: note = hypo
  source 1..43: mol_type = genomic DNA
ttagctttagaaaattgggtagcaagcccgcaggtgtgtatga

SEQ ID NO: 43356 - DNA, 41 bp, Homo sapiens
  misc_feature 1..41: note = chr12:7963835-7963876
  misc_feature 1..41: note = hypo
  source 1..41: mol_type = genomic DNA
tttaagtaggatagtgatatacagtccgacttctgtatctg

SEQ ID NO: 43357 - DNA, 18 bp, Homo sapiens
  misc_feature 1..18: note = chr12:7973388-7973406
  misc_feature 1..18: note = hypo
  source 1..18: mol_type = genomic DNA
aattaaacaacagtccgg

SEQ ID NO: 43358 - DNA, 30 bp, Homo sapiens
  misc_feature 1..30: note = chr12:7980007-7980037
  misc_feature 1..30: note = hypo
  source 1..30: mol_type = genomic DNA
actacagaggcacaccgccaccatgcctgg

SEQ ID NO: 43359 - DNA, 30 bp, Homo sapiens
  misc_feature 1..30: note = chr12:7986413-7986443
  misc_feature 1..30: note = hypo
  source 1..30: mol_type = genomic DNA
gtggggagaaccagtcgtcttcaccttgcc

SEQ ID NO: 43360 - DNA, 30 bp, Homo sapiens
  misc_feature 1..30: note = chr12:8023514-8023544
  misc_feature 1..30: note = hypo
  source 1..30: mol_type = genomic DNA
tgtcttcgtgatgttcgaccagttccacat

SEQ ID NO: 43361 - DNA, 96 bp, Homo sapiens
  misc_feature 1..96: note = chr12:8117682-8117778
  misc_feature 1..96: note = hypo
  source 1..96: mol_type = genomic DNA
agatgtggagaacagcgcaggaataataactttagtggaattagtccctgaataaaccattataaatagaatacatttagctgggcgtggtggcac

SEQ ID NO: 43362 - DNA, 18 bp, Homo sapiens
  misc_feature 1..18: note = chr12:8122686-8122704
  misc_feature 1..18: note = hypo
  source 1..18: mol_type = genomic DNA
gcccgaactacaattctt

SEQ ID NO: 43363 - DNA, 22 bp, Homo sapiens
  misc_feature 1..22: note = chr12:8127118-8127140
  misc_feature 1..22: note = hypo
  source 1..22: mol_type = genomic DNA
ccgtgcccggccaaggtcataa

SEQ ID NO: 43364 - DNA, 38 bp, Homo sapiens
  misc_feature 1..38: note = chr12:8168255-8168293
  misc_feature 1..38: note = hypo
  source 1..38: mol_type = genomic DNA
ttgaaagtggctgggcgaggtgcctcatgcctgtaatc

SEQ ID NO: 43365 - DNA, 32 bp, Homo sapiens
  misc_feature 1..32: note = chr12:8170444-8170476
  misc_feature 1..32: note = hypo
  source 1..32: mol_type = genomic DNA
atggcatcggctgggcgcggtggacttgtcag

SEQ ID NO: 43366 - DNA, 89 bp, Homo sapiens
  misc_feature 1..89: note = chr12:8322396-8322485
  misc_feature 1..89: note = hypo
  source 1..89: mol_type = genomic DNA
taggaggtcacaagtcggcctcttaatttttacagttgccgttaaaacattaaggtaatattgagggtgcagaatggctccttcctcat

SEQ ID NO: 43367 - DNA, 21 bp, Homo sapiens
  misc_feature 1..21: note = chr12:8748055-8748076
  misc_feature 1..21: note = hypo
  source 1..21: mol_type = genomic DNA
ccaaagcgctgggattacagg

SEQ ID NO: 43368 - DNA, 30 bp, Homo sapiens
  misc_feature 1..30: note = chr12:8748716-8748746
  misc_feature 1..30: note = hypo
  source 1..30: mol_type = genomic DNA
tggcttgaactaaagcgtgtcaatggcttc

SEQ ID NO: 43369 - DNA, 28 bp, Homo sapiens
  misc_feature 1..28: note = chr12:8751148-8751176
  misc_feature 1..28: note = hypo
  source 1..28: mol_type = genomic DNA
aggtttacttgacttcgaagtcatactg

SEQ ID NO: 43370 - DNA, 198 bp, Homo sapiens
  misc_feature 1..198: note = chr12:8790007-8790205
  misc_feature 1..198: note = hypo
  source 1..198: mol_type = genomic DNA
tgcagagggagacatcgcagctgtctttgggcttggcttcccgccttgttttggagggcctttctgctttgtggctctgtatggcccccagaagatagtggcccggctcaagaagtatgaggctgcctatggaaaacagttcactccatgctagctgctagctgaccatgctaatagccctaacgagaagttgtacca

SEQ ID NO: 43371 - DNA, 61 bp, Homo sapiens
  misc_feature 1..61: note = chr12:8799944-8800005
  misc_feature 1..61: note = hypo
  source 1..61: mol_type = genomic DNA
tccaaccttacttcccgactagacaactgcatgaaaaattggatagcgaattatgagtcca

SEQ ID NO: 43372 - DNA, 81 bp, Homo sapiens; identical to SEQ ID NO: 15635
  misc_feature 1..81: note = chr12:8808559-8808640
  misc_feature 1..81: note = hypo
  source 1..81: mol_type = genomic DNA

SEQ ID NO: 43373 - DNA, 25 bp, Homo sapiens
  misc_feature 1..25: note = chr12:8869424-8869449
  misc_feature 1..25: note = hypo
  source 1..25: mol_type = genomic DNA
caggctcaagcgatcttcccacctc

SEQ ID NO: 43374 - DNA, 80 bp, Homo sapiens
  misc_feature 1..80: note = chr12:8908240-8908320
  misc_feature 1..80: note = hypo
  source 1..80: mol_type = genomic DNA
atctcttcctaacaccgcagtgatatgacggatgcttttacattgcaagtcaaatcagcctttgctcaaaatcctccgat

SEQ ID NO: 43375 - DNA, 179 bp, Homo sapiens
  misc_feature 1..179: note = chr12:8975182-8975361
  misc_feature 1..179: note = hypo
  source 1..179: mol_type = genomic DNA
gtatataaagctacgcggagcgatctctgcccctgaccctggaaaaatctgtctcacccacaaagatgtgggctcagctccttctaggaatgttggccctatcaccagccattgcagaagaacttccgtgagtgcttggtgtcagaattggtttattagggcagcggcttcttcgccta

SEQ ID NO: 43376 - DNA, 147 bp, Homo sapiens
  misc_feature 1..147: note = chr12:8982341-8982488
  misc_feature 1..147: note = hypo
  source 1..147: mol_type = genomic DNA
catggatagcaacttcgttccagtgaatgacaaggtgagttgggaggaggagaaggagtggcgcagggagaacagggaaaaggatgagagattctctagggtggaagtcctctcagcctgggcgtggcaaggcgaggccctctgggt

SEQ ID NO: 43377 - DNA, 103 bp, Homo sapiens
  misc_feature 1..103: note = chr12:8983831-8983934
  misc_feature 1..103: note = hypo
  source 1..103: mol_type = genomic DNA
gccactgcacccggcctgagtgcttacttcttaacagactgttttctctagagctgcaacaaggaagtgctgggttcaaagcgtggcccgcagcagcactatt

SEQ ID NO: 43378 - DNA, 30 bp, Homo sapiens
  misc_feature 1..30: note = chr12:9006991-9007021
  misc_feature 1..30: note = hypo
  source 1..30: mol_type = genomic DNA
cctaatccacacccacggcctatgaaagca

SEQ ID NO: 43379 - DNA, 135 bp, Homo sapiens
  misc_feature 1..135: note = chr12:9016413-9016548
  misc_feature 1..135: note = hypo
  source 1..135: mol_type = genomic DNA
aacctactccatcatcgaacgccagcccttggtctgagcctgcggctgtagatgtggaactcacagcatatgcattgttggcccagcttaccaagcccagcctgactcaaaaggagatagcgaaggccactagca

SEQ ID NO: 43380 - DNA, 21 bp, Homo sapiens
  misc_feature 1..21: note = chr12:9018124-9018145
  misc_feature 1..21: note = hypo
  source 1..21: mol_type = genomic DNA
aaactccgtctcaacaacaac

SEQ ID NO: 43381 - DNA, 30 bp, Homo sapiens
  misc_feature 1..30: note = chr12:9026553-9026583
  misc_feature 1..30: note = hypo
  source 1..30: mol_type = genomic DNA
ctcatagggcagtagcggtacatagagggt

SEQ ID NO: 43382 - DNA, 105 bp, Homo sapiens
  misc_feature 1..105: note = chr12:9203172-9203277
  misc_feature 1..105: note = hypo
  source 1..105: mol_type = genomic DNA
acagccgcccaaatgcgcttgtggatatgagcctccctgtgctcccggagggggccgggagtaggcaggatctgctcttttgggtgcagctgcagctgcccaatc

SEQ ID NO: 43383 - DNA, 29 bp, Homo sapiens
  misc_feature 1..29: note = chr12:10085916-10085945
  misc_feature 1..29: note = hypo
  source 1..29: mol_type = genomic DNA
gtaaaactggctgggcgcggtgtctgtca

SEQ ID NO: 43384 - DNA, 28 bp, Homo sapiens
  misc_feature 1..28: note = chr12:10086245-10086273
  misc_feature 1..28: note = hypo
  source 1..28: mol_type = genomic DNA
gcttttggtgcttcggtgcagagacaga

SEQ ID NO: 43385 - DNA, 41 bp, Homo sapiens
  misc_feature 1..41: note = chr12:10363278-10363319
  misc_feature 1..41: note = hypo
  source 1..41: mol_type = genomic DNA
agtttaattttcagtcgctcatgttaggttttttttttttt

SEQ ID NO: 43386 - DNA, 30 bp, Homo sapiens
  misc_feature 1..30: note = chr12:10364485-10364515
  misc_feature 1..30: note = hypo
  source 1..30: mol_type = genomic DNA
ctcttttccagaagacgagccccctttctg

SEQ ID NO: 43387 - DNA, 32 bp, Homo sapiens
  misc_feature 1..32: note = chr12:10823904-10823936
  misc_feature 1..32: note = hypo
  source 1..32: mol_type = genomic DNA
taatagcgttgaaatagcgaaggggaattaag

SEQ ID NO: 43388 - DNA, 166 bp, Homo sapiens
  misc_feature 1..166: note = chr12:12848390-12848556
  misc_feature 1..166: note = hypo
  source 1..166: mol_type = genomic DNA
acctttaagatgttgcggggccaaatccaatgccggtgcaggtgtcccatatatcctgagagacaaaaagaggtcagattggtcagatccctcgagacagttcccaaattcctgacttctgttaccgcgactgttcttcgcaattccacctcggcctgtgttcagg

SEQ ID NO: 43389 - DNA, 93 bp, Homo sapiens
  misc_feature 1..93: note = chr12:13025675-13025768
  misc_feature 1..93: note = hypo
  source 1..93: mol_type = genomic DNA
ggctgatgggtggagcggaggagttttgaggagccagatgagatgaggcacctggggacaggtgaccccagcagctgccgcttgcaggagaga

SEQ ID NO: 43390 - DNA, 187 bp, Homo sapiens
  misc_feature 1..187: note = chr12:13030748-13030935
  misc_feature 1..187: note = hypo
  source 1..187: mol_type = genomic DNA
gccagcccggctcagcgaagtcaattcatcagctattttcacttgggaaagagaaattaagggcagagccgcagtccctgccaaacctaacagtctaaaaagcagactgtgtaacttaccaaggcctcagggcaacattagctgcaaatgagctcagcagggcgggggcctccgcacagttctctag

SEQ ID NO: 43391 - DNA, 16 bp, Homo sapiens
  misc_feature 1..16: note = chr12:13035999-13036015
  misc_feature 1..16: note = hypo
  source 1..16: mol_type = genomic DNA
gtgtttaaggccgggc

SEQ ID NO: 43392 - DNA, 385 bp, Homo sapiens
  misc_feature 1..385: note = chr12:13079626-13080011
  misc_feature 1..385: note = hypo
  source 1..385: mol_type = genomic DNA
gagcaagtatcccggcgattcttctgcttggacagggttgggacaaggcgtcggccagtcatccacattgtctttttgcagatccactaatcttccatgcaggctccaacagctccttcccggcctgggaacccaaatccgcaggaagaatctcggggtgttgtcttggcttattcattcagagctgtcgtgtgtggttctgcaaacagtactcagatgcgttccctctccccgtagggatcttgctggagatgcccagggttaacagtggaactccatatggagacagaggcatggggggagcttcgctggagatgggacagcctgctccaccgcgaagcctactgaggctctcttcttacgtaccccgcgcaatctcatctcc

SEQ ID NO: 43393 - DNA, 94 bp, Homo sapiens; identical to SEQ ID NO: 15639
  misc_feature 1..94: note = chr12:13215216-13215310
  misc_feature 1..94: note = hypo
  source 1..94: mol_type = genomic DNA

SEQ ID NO: 43394 - DNA, 30 bp, Homo sapiens
  misc_feature 1..30: note = chr12:13229039-13229069
  misc_feature 1..30: note = hypo
  source 1..30: mol_type = genomic DNA
tctggccaacaccaccggcacagtgacggc

SEQ ID NO: 43395 - DNA, 30 bp, Homo sapiens
  misc_feature 1..30: note = chr12:13716358-13716388
  misc_feature 1..30: note = hypo
  source 1..30: mol_type = genomic DNA
cgccactggggcagccggctggtccagttc

SEQ ID NO: 43396 - DNA, 36 bp, Homo sapiens
  misc_feature 1..36: note = chr12:14817857-14817893
  misc_feature 1..36: note = hypo
  source 1..36: mol_type = genomic DNA
taagccctgagggggcgcggtgtctcacacctgtaa

SEQ ID NO: 43397 - DNA, 18 bp, Homo sapiens
  misc_feature 1..18: note = chr12:14905519-14905537
  misc_feature 1..18: note = hypo
  source 1..18: mol_type = genomic DNA
aaaaaaaaagctggccgg

SEQ ID NO: 43398 - DNA, 30 bp, Homo sapiens
  misc_feature 1..30: note = chr12:14926203-14926233
  misc_feature 1..30: note = hypo
  source 1..30: mol_type = genomic DNA
agtcaaatctttattcggatagtgagaagg

SEQ ID NO: 43399 - DNA, 52 bp, Homo sapiens
  misc_feature 1..52: note = chr12:14929885-14929937
  misc_feature 1..52: note = hypo
  source 1..52: mol_type = genomic DNA
aacatagacaagatacgaggcattgtaactgccctgtcgccacccgcctctc

SEQ ID NO: 43400 - DNA, 82 bp, Homo sapiens
  misc_feature 1..82: note = chr12:17629461-17629543
  misc_feature 1..82: note = hypo
  source 1..82: mol_type = genomic DNA
ttccagctcccactccgacgggccagtatttttgtctcctctatcactcccgcctactcttctgaaaacctgctctaccagt

SEQ ID NO: 43401 - DNA, 35 bp, Homo sapiens
  misc_feature 1..35: note = chr12:19636251-19636286
  misc_feature 1..35: note = hypo
  source 1..35: mol_type = genomic DNA
aggtaaggttaaatccgtctcgtctcccatgatct

SEQ ID NO: 43402 - DNA, 25 bp, Homo sapiens
  misc_feature 1..25: note = chr12:21833068-21833093
  misc_feature 1..25: note = hypo
  source 1..25: mol_type = genomic DNA
aattcaagtttgggccgaagtttaa

SEQ ID NO: 43403 - DNA, 81 bp, Homo sapiens
  misc_feature 1..81: note = chr12:22698115-22698196
  misc_feature 1..81: note = hypo
  source 1..81: mol_type = genomic DNA
gatcactcctctgtctccaaaaaaagaaaaaaaagaaagaaagaaatagagataccaggcacatctcgaatagtgaaataa

SEQ ID NO: 43404 - DNA, 187 bp, Homo sapiens
  misc_feature 1..187: note = chr12:25059405-25059592
  misc_feature 1..187: note = hypo
  source 1..187: mol_type = genomic DNA
ctgaagctatgggtgcgaaagagaatctctatgtcagttttctccgctgtaaaatgagacaatagcaacacttcatgtttgtcaactgggatagatgagcattaatatatgaaacttatgtatattacttagaaccatgcctgatgtcagccatgcagaataggtgaaagaacgggcatggctctgt

SEQ ID NO: 43405 - DNA, 77 bp, Homo sapiens; identical to SEQ ID NO: 15643
  misc_feature 1..77: note = chr12:25081492-25081569
  misc_feature 1..77: note = hypo
  source 1..77: mol_type = genomic DNA

SEQ ID NO: 43406 - DNA, 25 bp, Homo sapiens
  misc_feature 1..25: note = chr12:25191255-25191280
  misc_feature 1..25: note = hypo
  source 1..25: mol_type = genomic DNA
caaaattgcaaatgacgaactataa

SEQ ID NO: 43407 - DNA, 30 bp, Homo sapiens
  misc_feature 1..30: note = chr12:25195744-25195774
  misc_feature 1..30: note = hypo
  source 1..30: mol_type = genomic DNA
aaagttcataaaacacgttgttatattggt

SEQ ID NO: 43408 - DNA, 30 bp, Homo sapiens
  misc_feature 1..30: note = chr12:25262919-25262949
  misc_feature 1..30: note = hypo
  source 1..30: mol_type = genomic DNA
gaaattttaaaattccgtattgaatgttaa

SEQ ID NO: 43409 - DNA, 30 bp, Homo sapiens
  misc_feature 1..30: note = chr12:25537400-25537430
  misc_feature 1..30: note = hypo
  source 1..30: mol_type = genomic DNA
tcacctgacaccttccgtgtttaaccggga

SEQ ID NO: 43410 - DNA, 30 bp, Homo sapiens
  misc_feature 1..30: note = chr12:26555243-26555273
  misc_feature 1..30: note = hypo
  source 1..30: mol_type = genomic DNA
acttcccatcactaccgtctatctagcgtc

SEQ ID NO: 43411 - DNA, 37 bp, Homo sapiens
  misc_feature 1..37: note = chr12:26555819-26555856
  misc_feature 1..37: note = hypo
  source 1..37: mol_type = genomic DNA
cactactccaacagccgctggacgaggtgctaggaat

SEQ ID NO: 43412 - DNA, 153 bp, Homo sapiens
  misc_feature 1..153: note = chr12:27489449-27489602
  misc_feature 1..153: note = hypo
  source 1..153: mol_type = genomic DNA
ctatgtatgccctgccgcaccctgtttccttctcttactcaggtgctgtcacacttactggtccctgacacatactgtttacattgtatcacactaggctataatatcccatttacccacccaattttttaacttaaaatatttttaaacctg

SEQ ID NO: 43413 - DNA, 30 bp, Homo sapiens
  misc_feature 1..30: note = chr12:29374034-29374064
  misc_feature 1..30: note = hypo
  source 1..30: mol_type = genomic DNA
ctcccttaccaggggcgtattcctgtaagg

SEQ ID NO: 43414 - DNA, 20 bp, Homo sapiens
  misc_feature 1..20: note = chr12:30859424-30859444
  misc_feature 1..20: note = hypo
  source 1..20: mol_type = genomic DNA
acaagcgtaagccactgtac

SEQ ID NO: 43415 - DNA, 41 bp, Homo sapiens
  misc_feature 1..41: note = chr12:30947564-30947605
  misc_feature 1..41: note = hypo
  source 1..41: mol_type = genomic DNA
gcccctcaaagtgctgggattacaggcgttatccactgcgc

SEQ ID NO: 43416 - DNA, 30 bp, Homo sapiens
  misc_feature 1..30: note = chr12:31255181-31255211
  misc_feature 1..30: note = hypo
  source 1..30: mol_type = genomic DNA
ccaggaacctaagagcgcacaccaggtgga

SEQ ID NO: 43417 - DNA, 16 bp, Homo sapiens
  misc_feature 1..16: note = chr12:32087179-32087195
  misc_feature 1..16: note = hypo
  source 1..16: mol_type = genomic DNA
gtgccacagctactcc

SEQ ID NO: 43418 - DNA, 27 bp, Homo sapiens
  misc_feature 1..27: note = chr12:32340317-32340344
  misc_feature 1..27: note = hypo
  source 1..27: mol_type = genomic DNA
aatctatgggctgggcgcggtggctca

SEQ ID NO: 43419 - DNA, 151 bp, Homo sapiens; identical to SEQ ID NO: 15647
  misc_feature 1..151: note = chr12:32597645-32597796
  misc_feature 1..151: note = hypo
  source 1..151: mol_type = genomic DNA

SEQ ID NO: 43420 - DNA, 40 bp, Homo sapiens
  misc_feature 1..40: note = chr12:32831140-32831180
  misc_feature 1..40: note = hypo
  source 1..40: mol_type = genomic DNA
ttttttcatgaacaccgccccccgctgctccgacccctgc

SEQ ID NO: 43421 - DNA, 240 bp, Homo sapiens
  misc_feature 1..240: note = chr12:32831300-32831540
  misc_feature 1..240: note = hypo
  source 1..240: mol_type = genomic DNA
caccgcgctcggtcctgaacacacattttgtttgtttgtttgtttgtttacaaaacccctggagaacccgcgtattctaacctgggctggtttttgtatttttgcaaaataacaccccacacattctcgtatcagcgtgcagatttttttgcacccagtttggttgtttgcggccataagcttttctttaagcctttccaacccgtccttctagagaaagtgtcttcataaggaagtcac

SEQ ID NO: 43422 - DNA, 157 bp, Homo sapiens
  misc_feature 1..157: note = chr12:33205564-33205721
  misc_feature 1..157: note = hypo
  source 1..157: mol_type = genomic DNA
cagaggccaagaccccggggtgggatcagggaccatcccctcacggggcataaggtcatttttcccccagagcctggatccctgtcccccacggggcaagctgggtccctggagccctggagtggagcggcgagtcccggggcggtgcctgtctcag

SEQ ID NO: 43423 - DNA, 43 bp, Homo sapiens
  misc_feature 1..43: note = chr12:34362659-34362702
  misc_feature 1..43: note = hypo
  source 1..43: mol_type = genomic DNA
aggccggcaggctcccgtgcacctcagtcggcctctgcactgc

SEQ ID NO: 43424 - DNA, 30 bp, Homo sapiens
  misc_feature 1..30: note = chr12:34364426-34364456
  misc_feature 1..30: note = hypo
  source 1..30: mol_type = genomic DNA
cccccccagtctcggcgcagaggctgccgg

SEQ ID NO: 43425 - DNA, 25 bp, Homo sapiens
  misc_feature 1..25: note = chr12:34463931-34463956
  misc_feature 1..25: note = hypo
  source 1..25: mol_type = genomic DNA
tgcgtgtcgtgctcacggggacacc

SEQ ID NO: 43426 - DNA, 85 bp, Homo sapiens
  misc_feature 1..85: note = chr12:34464016-34464101
  misc_feature 1..85: note = hypo
  source 1..85: mol_type = genomic DNA
ggtgcctctccctccctttcaagccttatcttcccttctgggtcttcttgccactttgggctgcacgccgcgcgtgccacacgct

SEQ ID NO: 43427 - DNA, 81 bp, Homo sapiens
  misc_feature 1..81: note = chr12:34494888-34494969
  misc_feature 1..81: note = hypo
  source 1..81: mol_type = genomic DNA
accacgcaccccattcggtgcatacacggggtcccgggtttgcactccccgagcggctggacactgcggggggctgcccaa

SEQ ID NO: 43428 - DNA, 268 bp, Homo sapiens
  misc_feature 1..268: note = chr12:34502619-34502887
  misc_feature 1..268: note = hypo
  source 1..268: mol_type = genomic DNA
atttggcctaacccacgcggggtccagcctctccgggggtgtgaaccccggacctcagggtcctcaggacccagtgcatgcgcagcaggtgggacttggggttggccgggggccaagagccccactttgcggtaccggttttttccttccaccagtgtttcggcctccccgttcaagcctccctgcggctgtgggcggctaccccaggggaccagctgctccgagggcgcgagcctaggaccctgcttatgcacggcaggggtggtgt

SEQ ID NO: 43429 - DNA, 93 bp, Homo sapiens
  misc_feature 1..93: note = chr12:34519278-34519371
  misc_feature 1..93: note = hypo
  source 1..93: mol_type = genomic DNA
ggaccgtaggcactccgtggccatgagtcagggatgccaagggtcccctgggccccgcgcatgctcagtagagaggcaatgcctcccatgttg

SEQ ID NO: 43430 - DNA, 113 bp, Homo sapiens
  misc_feature 1..113: note = chr12:34520137-34520250
  misc_feature 1..113: note = hypo
  source 1..113: mol_type = genomic DNA
acaaaacagctgccacgacctccactttcaagtcttcgtgcaccttgggctagccgcctttggccggaggcgctcagtgtgtgcgaaccagggatgcgcggggtcccctgggc

SEQ ID NO: 43431 - DNA, 30 bp, Homo sapiens
  misc_feature 1..30: note = chr12:34522309-34522339
  misc_feature 1..30: note = hypo
  source 1..30: mol_type = genomic DNA
gggatccacgcattgcggtggggaggcact

SEQ ID NO: 43432 - DNA, 30 bp, Homo sapiens
  misc_feature 1..30: note = chr12:38543382-38543412
  misc_feature 1..30: note = hypo
  source 1..30: mol_type = genomic DNA
aggcttgacctgagacgcaggggcattgtg

SEQ ID NO: 43433 - DNA, 30 bp, Homo sapiens
  misc_feature 1..30: note = chr12:38549417-38549447
  misc_feature 1..30: note = hypo
  source 1..30: mol_type = genomic DNA
cccctgcgccgggcccgggggagttgtgga

SEQ ID NO: 43434 - DNA, 177 bp, Homo sapiens
  misc_feature 1..177: note = chr12:38550692-38550869
  misc_feature 1..177: note = hypo
  source 1..177: mol_type = genomic DNA
gcgggcaccccaaagcgtcaagaatgaccccacgggaaggggaaagcatgtcggtcttaaagagggacgttgaggcagcccggagaaaaaaacagggaggctggggtccttccaccgatgacagtgccttcccggcatcccatgtgccatctccgggcgggtcgtggagtccctggc

SEQ ID NO: 43435 - DNA, 207 bp, Homo sapiens
  misc_feature 1..207: note = chr12:38551229-38551436
  misc_feature 1..207: note = hypo
  source 1..207: mol_type = genomic DNA
tcccggcagcccctgcgccagactcggggttgtcgtggagttcctgacttgaacccagggtgcgtgtcgcgcccacggggggacaccccaaagcggcaagaatgccccctgggaagggaacaggacgccaggcttgaaaggggactttgaagcagtccaggaaaaaacttcccacggaccacggtgccttcccggcagcccctttgc

SEQ ID NO: 43436 - DNA, 43 bp, Homo sapiens
  misc_feature 1..43: note = chr12:38551858-38551901
  misc_feature 1..43: note = hypo
  source 1..43: mol_type = genomic DNA
gtccctggcttgcaccgagggtgcgggtcgcacccatgggggc

SEQ ID NO: 43437 - DNA, 36 bp, Homo sapiens
  misc_feature 1..36: note = chr12:38553830-38553866
  misc_feature 1..36: note = hypo
  source 1..36: mol_type = genomic DNA
cctctgcagtgggcccgggagcgtcctggagtccct

SEQ ID NO: 43438 - DNA, 96 bp, Homo sapiens
  misc_feature 1..96: note = chr12:38595440-38595536
  misc_feature 1..96: note = hypo
  source 1..96: mol_type = genomic DNA
tctgagggcccagctcgggcctgccgggtggccagggaagatgttggtagcggcagtggtggggctggcgcccctgcgttgcggcccctgggctcc

SEQ ID NO: 43439 - DNA, 30 bp, Homo sapiens
  misc_feature 1..30: note = chr12:40501737-40501767
  misc_feature 1..30: note = hypo
  source 1..30: mol_type = genomic DNA
acagttatgtatctgcggtcaggttacatt

SEQ ID NO: 43440 - DNA, 30 bp, Homo sapiens
  misc_feature 1..30: note = chr12:41925162-41925192
  misc_feature 1..30: note = hypo
  source 1..30: mol_type = genomic DNA
tgtcggtgcttacaacgtcctctccaagtc

SEQ ID NO: 43441 - DNA, 24 bp, Homo sapiens
  misc_feature 1..24: note = chr12:42654216-42654240
  misc_feature 1..24: note = hypo
  source 1..24: mol_type = genomic DNA
gataatagtacttgccgggaggcg

SEQ ID NO: 43442 - DNA, 83 bp, Homo sapiens
  misc_feature 1..83: note = chr12:42654300-42654383
  misc_feature 1..83: note = hypo
  source 1..83: mol_type = genomic DNA
ccatctcaaaaaaaaaaaaacaaaaaagaattattgtgggttgataacacaaagtactgtggctggtacggtaagttctatgc

SEQ ID NO: 43443 - DNA, 21 bp, Homo sapiens
  misc_feature 1..21: note = chr12:43957389-43957410
  misc_feature 1..21: note = hypo
  source 1..21: mol_type = genomic DNA
ccaccgcgcccggccctcaga

SEQ ID NO: 43444 - DNA, 86 bp, Homo sapiens
  misc_feature 1..86: note = chr12:47628723-47628809
  misc_feature 1..86: note = hypo
  source 1..86: mol_type = genomic DNA
ccaacctgcactgggcgctccgcccagaggtgagtccctcccagcccttctctccttctgtcctagccatccgcagagccatcctg

SEQ ID NO: 43445 - DNA, 140 bp, Homo sapiens
  misc_feature 1..140: note = chr12:47629068-47629208
  misc_feature 1..140: note = hypo
  source 1..140: mol_type = genomic DNA
aactaccgtgaggtccgcgagttccgctccgaccaccatctggtacgtttttacttcctcacccgcgtgtactccgattacctccagaccatcttgaaagagctgcagtcgggcgagcacgcccccgacctggtcatcat

SEQ ID NO: 43446 - DNA, 30 bp, Homo sapiens
  misc_feature 1..30: note = chr12:48590883-48590913
  misc_feature 1..30: note = hypo
  source 1..30: mol_type = genomic DNA
taagtctgatggtctcggtacatgcgatac

SEQ ID NO: 43447 - DNA, 18 bp, Homo sapiens
  misc_feature 1..18: note = chr12:49108598-49108616
  misc_feature 1..18: note = hypo
  source 1..18: mol_type = genomic DNA
tataaggcggccaggcgc

SEQ ID NO: 43448 - DNA, 25 bp, Homo sapiens
  misc_feature 1..25: note = chr12:49174695-49174720
  misc_feature 1..25: note = hypo
  source 1..25: mol_type = genomic DNA
cattctggccaggtgcggtggctca

SEQ ID NO: 43449 - DNA, 17 bp, Homo sapiens
  misc_feature 1..17: note = chr12:49455664-49455681
  misc_feature 1..17: note = hypo
  source 1..17: mol_type = genomic DNA
agagtctcgcactgtcg

SEQ ID NO: 43450 - DNA, 35 bp, Homo sapiens
  misc_feature 1..35: note = chr12:49596187-49596222
  misc_feature 1..35: note = hypo
  source 1..35: mol_type = genomic DNA
aatcagacagccgggcgcggtggctcacgcctgta

SEQ ID NO: 43451 - DNA, 147 bp, Homo sapiens; identical to SEQ ID NO: 1598
  misc_feature 1..147: note = chr12:49657607-49657754
  misc_feature 1..147: note = hypo
  source 1..147: mol_type = genomic DNA

SEQ ID NO: 43452 - DNA, 30 bp, Homo sapiens
  misc_feature 1..30: note = chr12:50790622-50790652
  misc_feature 1..30: note = hypo
  source 1..30: mol_type = genomic DNA
tctagatgtgttggccgggtgcagtggctc

SEQ ID NO: 43453 - DNA, 32 bp, Homo sapiens
  misc_feature 1..32: note = chr12:50897742-50897774
  misc_feature 1..32: note = hypo
  source 1..32: mol_type = genomic DNA
tttcttttctttagacggagtgtttgctctct

SEQ ID NO: 43454 - DNA, 497 bp, Homo sapiens
  misc_feature 1..497: note = chr12:51421089-51421586
  misc_feature 1..497: note = hypo
  source 1..497: mol_type = genomic DNA
ccagcctgggtggcagagcaaaaccctgtctcaaaaaaaaaggatagccacctggaaggaacatttcctcgcgcccccagagccacatcatagtatctgctgccccaccaagagcaccccacacctgggaggaaccgagaaacatcagctagtgcagccagtttgaccgccttaggtgtcctcccaagcctccgtagtgaattgttttcctcctcgcccagctgactcgattctccccagacttcatcctacctacccaaaagcaatcccactctatcgccagtttcagcctcacaccgtatcttttgctctgaagatgagactgccaaactggtgaagagggaataaatggcctaacaaattaccgtaattttctgcaatgtcgtttacagccaccaaaaacattagatcctcccgccaccctcactccccgacccctcgcactgcttacagcattaaaggtaattgagcttctttattcacgtaaaaacagctag

SEQ ID NO: 43455 - DNA, 21 bp, Homo sapiens
  misc_feature 1..21: note = chr12:51565449-51565470
  misc_feature 1..21: note = hypo
  source 1..21: mol_type = genomic DNA
cgcacccggccgaaaggagat

SEQ ID NO: 43456 - DNA, 98 bp, Homo sapiens
  misc_feature 1..98: note = chr12:51930708-51930806
  misc_feature 1..98: note = hypo
  source 1..98: mol_type = genomic DNA
ctctcaccagcagtgcgtagatggatgtggtgagccactcccaagtttttgctcttaaaaagactgagcatgaagctgggcgctgtggctcatgcctg

SEQ ID NO: 43457 - DNA, 148 bp, Homo sapiens
  misc_feature 1..148: note = chr12:52387912-52388060
  misc_feature 1..148: note = hypo
  source 1..148: mol_type = genomic DNA
cggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgt

SEQ ID NO: 43458 - DNA, 94 bp, Homo sapiens
  misc_feature 1..94: note = chr12:52388344-52388438
  misc_feature 1..94: note = hypo
  source 1..94: mol_type = genomic DNA
caggcagctctgagccgcgctttcccctcctccctgggatggacgctgccgggagactgccagtggagacggaatctgccgctttgtctgtcca

SEQ ID NO: 43459 - DNA, 30 bp, Homo sapiens
  misc_feature 1..30: note = chr12:52467638-52467668
  misc_feature 1..30: note = hypo
  source 1..30: mol_type = genomic DNA
tctgaggaactggatcgtgccctgcgcaag

SEQ ID NO: 43460 - DNA, 30 bp, Homo sapiens
  misc_feature 1..30: note = chr12:52913808-52913838
  misc_feature 1..30: note = hypo
  source 1..30: mol_type = genomic DNA
gcaccagcaccaaaccggttcctgaagctg

SEQ ID NO: 43461 - DNA, 30 bp, Homo sapiens
  misc_feature 1..30: note = chr12:52914057-52914087
  misc_feature 1..30: note = hypo
  source 1..30: mol_type = genomic DNA
gacacacttgactggcgagacatggtggct

SEQ ID NO: 43462 - DNA, 102 bp, Homo sapiens
  misc_feature 1..102: note = chr12:53069161-53069263
  misc_feature 1..102: note = hypo
  source 1..102: mol_type = genomic DNA
tgctgcttccggagccgtagctgccatggccgccgccgccacctccagagccatagctgccacctccggagccgtagctgctacctccggagccatagctgc

SEQ ID NO: 43463 - DNA, 210 bp, Homo sapiens
  misc_feature 1..210: note = chr12:53189513-53189723
  misc_feature 1..210: note = hypo
  source 1..210: mol_type = genomic DNA
agccacctccatagccgctcccaaagccacctccatagccacctgcaaaggcacagctgctccgccctcccccaaagcctccagcccgggagccgccagctgccacgctgatggagatgctcttgttgccgcccaggttgtagaggctgcgactgccaaagccacctgctccgctccggaagccataggcccctccgccagctcccccag

SEQ ID NO: 43464 - DNA, 30 bp, Homo sapiens
  misc_feature 1..30: note = chr12:53455806-53455836
  misc_feature 1..30: note = hypo
  source 1..30: mol_type = genomic DNA
ctgtgctggccatgccgctgtagaggggag

SEQ ID NO: 43465 - DNA, 30 bp, Homo sapiens
  misc_feature 1..30: note = chr12:53456042-53456072
  misc_feature 1..30: note = hypo
  source 1..30: mol_type = genomic DNA
gcctggggaaggctacgttgggtcggttta

SEQ ID NO: 43466 - DNA, 240 bp, Homo sapiens
  misc_feature 1..240: note = chr12:53662984-53663224
  misc_feature 1..240: note = hypo
  source 1..240: mol_type = genomic DNA
gtgtctaccccacagcgtcctcccctctacctggaacgaattctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgca

SEQ ID NO: 43467 - DNA, 30 bp, Homo sapiens
  misc_feature 1..30: note = chr12:53813830-53813860
  misc_feature 1..30: note = hypo
  source 1..30: mol_type = genomic DNA
ggaaacacagttttccggttgcttgtcaat

SEQ ID NO: 43468 - DNA, 120 bp, Homo sapiens
  misc_feature 1..120: note = chr12:53885488-53885608
  misc_feature 1..120: note = hypo
  source 1..120: mol_type = genomic DNA
ttacaggcgtgagccaccgcgcccggcaggcatagaggtattaaataatctgcccacagggccatagctattaagaagctcaagctctgctgggcgcagtggctcacgcctgtaatccca

SEQ ID NO: 43469 - DNA, 97 bp, Homo sapiens; identical to SEQ ID NO: 1599
  misc_feature 1..97: note = chr12:54720206-54720303
  misc_feature 1..97: note = hypo
  source 1..97: mol_type = genomic DNA

SEQ ID NO: 43470 - DNA, 111 bp, Homo sapiens
  misc_feature 1..111: note = chr12:55356770-55356881
  misc_feature 1..111: note = hypo
  source 1..111: mol_type = genomic DNA
tggggtggtggtggccggtctcgggggcatgtgtacagacacatcttggagatggctttccgaaggcggtctctgggtgactggggttcaggctctcgggacagaatcctg

SEQ ID NO: 43471 - DNA, 30 bp, Homo sapiens
  misc_feature 1..30: note = chr12:55786344-55786374
  misc_feature 1..30: note = hypo
  source 1..30: mol_type = genomic DNA
tgctgagggaccgggcgcctgcctgctcca

SEQ ID NO: 43472 - DNA, 30 bp, Homo sapiens
  misc_feature 1..30: note = chr12:56094359-56094389
  misc_feature 1..30: note = hypo
  source 1..30: mol_type = genomic DNA
ctcagccagcagcagcgtgcggagacggga

SEQ ID NO: 43473 - DNA, 43 bp, Homo sapiens; identical to SEQ ID NO: 15661
  misc_feature 1..43: note = chr12:56441277-56441320
  misc_feature 1..43: note = hypo
  source 1..43: mol_type = genomic DNA

SEQ ID NO: 43474 - DNA, 30 bp, Homo sapiens
  misc_feature 1..30: note = chr12:57493886-57493916
  misc_feature 1..30: note = hypo
  source 1..30: mol_type = genomic DNA
gggaaaggtgtgagccgagggagggccaga

SEQ ID NO: 43475 - DNA, 56 bp, Homo sapiens
  misc_feature 1..56: note = chr12:57559766-57559822
  misc_feature 1..56: note = hypo
  source 1..56: mol_type = genomic DNA
gcctgcagggcagctcggctctggcagtgcctatactggagcgggcaggaagctgg

SEQ ID NO: 43476 - DNA, 214 bp, Homo sapiens
  misc_feature 1..214: note = chr12:57881112-57881326
  misc_feature 1..214: note = hypo
  source 1..214: mol_type = genomic DNA
ctttgtcactaattccgcacatggtaactccgaactctaaaactctgaccgttaagagcttgcatcgagagccactgcgagtagctgctgttatgacatggccatttcattctccacaacaagagaagcagccgcggcttcagtcaccgccctccagcagcgtaagaggataaaagtgcgacttgccctaaaacctaaacgtctcttctggatc

SEQ ID NO: 43477 - DNA, 90 bp, Homo sapiens
  misc_feature 1..90: note = chr12:58241509-58241599
  misc_feature 1..90: note = hypo
  source 1..90: mol_type = genomic DNA
accttcgaatcccgaaaggggtgtgtgcgtgtgggcggacctaggactccagagtataagagctggaactgacctcgggactgtgtcccc

SEQ ID NO: 43478 - DNA, 39 bp, Homo sapiens
  misc_feature 1..39: note = chr12:62429791-62429830
  misc_feature 1..39: note = hypo
  source 1..39: mol_type = genomic DNA
attacaggcgtgagccaccgcgcccggccaatgattctt

SEQ ID NO: 43479 - DNA, 31 bp, Homo sapiens
  misc_feature 1..31: note = chr12:62539074-62539105
  misc_feature 1..31: note = hypo
  source 1..31: mol_type = genomic DNA
cctcctgtcagttggcggtggcctcagattc

SEQ ID NO: 43480 - DNA, 31 bp, Homo sapiens
  misc_feature 1..31: note = chr12:62539225-62539256
  misc_feature 1..31: note = hypo
  source 1..31: mol_type = genomic DNA
cctccgcacccccgtccgtggaaaaattgtc

SEQ ID NO: 43481 - DNA, 42 bp, Homo sapiens
  misc_feature 1..42: note = chr12:62563338-62563380
  misc_feature 1..42: note = hypo
  source 1..42: mol_type = genomic DNA
atagatgttttaggccgggcacagtggctcacgcctgtaatc

SEQ ID NO: 43482 - DNA, 168 bp, Homo sapiens
  misc_feature 1..168: note = chr12:62580835-62581003
  misc_feature 1..168: note = hypo
  source 1..168: mol_type = genomic DNA
aacgagaatagtacacgccaatgtaatacatagtttgtgcattgactatggaggtgtatattcaataaagacagcagcacacagatatgttcagcgttcaaaatgtgtcaaaattcccagttgtagtgtcaataaaaacatccacagtgtctccgcattgaggacaaa

SEQ ID NO: 43483 - DNA, 22 bp, Homo sapiens
  misc_feature 1..22: note = chr12:62603703-62603725
  misc_feature 1..22: note = hypo
  source 1..22: mol_type = genomic DNA
aggcgcaggggctcacgcctgt

SEQ ID NO: 43484 - DNA, 40 bp, Homo sapiens
  misc_feature 1..40: note = chr12:62630994-62631034
  misc_feature 1..40: note = hypo
  source 1..40: mol_type = genomic DNA
atccattctgttcgccgggcgcggtggctcacgcctgtaa

SEQ ID NO: 43485 - DNA, 30 bp, Homo sapiens
  misc_feature 1..30: note = chr12:63788043-63788073
  misc_feature 1..30: note = hypo
  source 1..30: mol_type = genomic DNA
aaagaaaaaaaaaagcgggaggagtgagta

SEQ ID NO: 43486 - DNA, 163 bp, Homo sapiens
  misc_feature 1..163: note = chr12:64783185-64783348
  misc_feature 1..163: note = hypo
  source 1..163: mol_type = genomic DNA
ttggatcaagtgagccgcctgagattgccaagcgtcctgtgcgcatctcattaacgcatctgcttattcatgcatttattcttttgctggggagggggtggaggggaacggtgtctcactcattctgtagctcaggctggagtgcaggtggggcgatctcggc

SEQ ID NO: 43487 - DNA, 42 bp, Homo sapiens
  misc_feature 1..42: note = chr12:64797450-64797492
  misc_feature 1..42: note = hypo
  source 1..42: mol_type = genomic DNA
aaataaattttggaccggacaccgtggctcacgcctgtaatc

SEQ ID NO: 43488 - DNA, 20 bp, Homo sapiens
  misc_feature 1..20: note = chr12:64799707-64799727
  misc_feature 1..20: note = hypo
  source 1..20: mol_type = genomic DNA
ttgatcgtccaaatgccttc

SEQ ID NO: 43489 - DNA, 170 bp, Homo sapiens; identical to SEQ ID NO: 15669
  misc_feature 1..170: note = chr12:65516360-65516530
  misc_feature 1..170: note = hypo
  source 1..170: mol_type = genomic DNA

SEQ ID NO: 43490 - DNA, 29 bp, Homo sapiens
  misc_feature 1..29: note = chr12:65530856-65530885
  misc_feature 1..29: note = hypo
  source 1..29: mol_type = genomic DNA
ctagaaaaggccaggcgtggtggcctttt

SEQ ID NO: 43491 - DNA, 22 bp, Homo sapiens
  misc_feature 1..22: note = chr12:65557212-65557234
  misc_feature 1..22: note = hypo
  source 1..22: mol_type = genomic DNA
gagaagtgatagcatcggccgg

SEQ ID NO: 43492 - DNA, 23 bp, Homo sapiens
  misc_feature 1..23: note = chr12:65562063-65562086
  misc_feature 1..23: note = hypo
  source 1..23: mol_type = genomic DNA
ttgactaacgtttttctgtacag

SEQ ID NO: 43493 - DNA, 30 bp, Homo sapiens
  misc_feature 1..30: note = chr12:65787081-65787111
  misc_feature 1..30: note = hypo
  source 1..30: mol_type = genomic DNA
agaatttcaacctttcgttttattataagg

SEQ ID NO: 43494 - DNA, 44 bp, Homo sapiens
  misc_feature 1..44: note = chr12:66208320-66208364
  misc_feature 1..44: note = hypo
  source 1..44: mol_type = genomic DNA
aatagacagataggccgggcgccgtggctcacgcctgtaatccc

SEQ ID NO: 43495 - DNA, 30 bp, Homo sapiens
  misc_feature 1..30: note = chr12:66211140-66211170
  misc_feature 1..30: note = hypo
  source 1..30: mol_type = genomic DNA
tgttcacttaaagtccggaaggattaaaat

SEQ ID NO: 43496 - DNA, 22 bp, Homo sapiens
  misc_feature 1..22: note = chr12:66242342-66242364
  misc_feature 1..22: note = hypo
  source 1..22: mol_type = genomic DNA
ttaaaagtttaaggccgggtgc

SEQ ID NO: 43497 - DNA, 81 bp, Homo sapiens
  misc_feature 1..81: note = chr12:68978219-68978300
  misc_feature 1..81: note = hypo
  source 1..81: mol_type = genomic DNA
aaatctcatagtctccgaggtcactaagagctttatttccttgccaggagcggtggctcacacctgtaatcccagcacttt

SEQ ID NO: 43498 - DNA, 21 bp, Homo sapiens
  misc_feature 1..21: note = chr12:68978600-68978621
  misc_feature 1..21: note = hypo
  source 1..21: mol_type = genomic DNA
tttttccgttttcactagaaa

SEQ ID NO: 43499 - DNA, 19 bp, Homo sapiens
  misc_feature 1..19: note = chr12:69751028-69751047
  misc_feature 1..19: note = hypo
  source 1..19: mol_type = genomic DNA
tttttgtttttgagacgga

SEQ ID NO: 43500 - DNA, 16 bp, Homo sapiens
  misc_feature 1..16: note = chr12:69754426-69754442
  misc_feature 1..16: note = hypo
  source 1..16: mol_type = genomic DNA
acacagcccctggcac

SEQ ID NO: 43501 - DNA, 120 bp, Homo sapiens
  misc_feature 1..120: note = chr12:69754562-69754682
  misc_feature 1..120: note = hypo
  source 1..120: mol_type = genomic DNA
gccaccgcgcccagccgtggttcattctttttaaagaaaaatttcctttcctttataaataaaaatcagaaggggtacaaatagttgtttttatcaggagccagtgggtcctgccttaaa

SEQ ID NO: 43502 - DNA, 114 bp, Homo sapiens; identical to SEQ ID NO: 15674
  misc_feature 1..114: note = chr12:69964176-69964290
  misc_feature 1..114: note = hypo
  source 1..114: mol_type = genomic DNA

SEQ ID NO: 43503 - DNA, 23 bp, Homo sapiens
  misc_feature 1..23: note = chr12:69999350-69999373
  misc_feature 1..23: note = hypo
  source 1..23: mol_type = genomic DNA
atcacaattactggccgggcgcg

SEQ ID NO: 43504 - DNA, 30 bp, Homo sapiens
  misc_feature 1..30: note = chr12:70024017-70024047
  misc_feature 1..30: note = hypo
  source 1..30: mol_type = genomic DNA
agccctactgcagtgcgtgggcttcttcct

SEQ ID NO: 43505 - DNA, 254 bp, Homo sapiens
  misc_feature 1..254: note = chr12:70087493-70087747
  misc_feature 1..254: note = hypo
  source 1..254: mol_type = genomic DNA
cacagcagtgctcaccgagcgaaagatgagcagggaggtgagattgacgtagcgcatcagcgtccttctaagcaggcgcccgtgctcgtcgcttccgtgaacactgctagagatgaggaacattagcctgtctggccagggcaaattcacaaactggttccaccatcggttcactaccagagtaacataaaaccctgtagaataacaggaaattataaagcagtttcttacagcagacacgttggtgacactga

SEQ ID NO: 43506 - DNA, 30 bp, Homo sapiens
  misc_feature 1..30: note = chr12:70173245-70173275
  misc_feature 1..30: note = hypo
  source 1..30: mol_type = genomic DNA
tgaactccaattactcgaacattttctctt

SEQ ID NO: 43507 - DNA, 137 bp, Homo sapiens
  misc_feature 1..137: note = chr12:71626492-71626629
  misc_feature 1..137: note = hypo
  source 1..137: mol_type = genomic DNA
aaaatgctggtattacaggcgtaagccaacacacatggccctatttacttctttagtccattagattagatatcatttgcctgaaaaatcaggttagccattgtttcaaatgggctacttaccgtctaatatttcat

SEQ ID NO: 43508 - DNA, 37 bp, Homo sapiens
  misc_feature 1..37: note = chr12:72054795-72054832
  misc_feature 1..37: note = hypo
  source 1..37: mol_type = genomic DNA
cacattggctgggcacggtggctcatgcctgtaatcc

SEQ ID NO: 43509 - DNA, 30 bp, Homo sapiens
  misc_feature 1..30: note = chr12:72077720-72077750
  misc_feature 1..30: note = hypo
  source 1..30: mol_type = genomic DNA
ttttcggattgttaccggtggaaggtgtcc

SEQ ID NO: 43510 - DNA, 16 bp, Homo sapiens
  misc_feature 1..16: note = chr12:72634641-72634657
  misc_feature 1..16: note = hypo
  source 1..16: mol_type = genomic DNA
gcgcctggcctctcca

SEQ ID NO: 43511 - DNA, 20 bp, Homo sapiens
  misc_feature 1..20: note = chr12:73732468-73732488
  misc_feature 1..20: note = hypo
  source 1..20: mol_type = genomic DNA
gcgcccggccatttactggt

SEQ ID NO: 43512 - DNA, 30 bp, Homo sapiens
  misc_feature 1..30: note = chr12:74092079-74092109
  misc_feature 1..30: note = hypo
  source 1..30: mol_type = genomic DNA
gctataaacttgcttcgttttttctttaaa

SEQ ID NO: 43513 - DNA, 25 bp, Homo sapiens
  misc_feature 1..25: note = chr12:74930406-74930431
  misc_feature 1..25: note = hypo
  source 1..25: mol_type = genomic DNA
catgtaaggcactgtcgcaagattt

SEQ ID NO: 43514 - DNA, 43 bp, Homo sapiens
  misc_feature 1..43: note = chr12:77085862-77085905
  misc_feature 1..43: note = hypo
  source 1..43: mol_type = genomic DNA
gtactgagtgtgtaacgccaaaggttcttttgtttgtttgttt

SEQ ID NO: 43515 - DNA, 30 bp, Homo sapiens; identical to SEQ ID NO: 15677
  misc_feature 1..30: note = chr12:77150018-77150048
  misc_feature 1..30: note = hypo
  source 1..30: mol_type = genomic DNA

SEQ ID NO: 43516 - DNA, 30 bp, Homo sapiens
  misc_feature 1..30: note = chr12:79842607-79842637
  misc_feature 1..30: note = hypo
  source 1..30: mol_type = genomic DNA
tttccaattctttagcgctcaaggacgctt

SEQ ID NO: 43517 - DNA, 96 bp, Homo sapiens
  misc_feature 1..96: note = chr12:80488160-80488256
  misc_feature 1..96: note = hypo
  source 1..96: mol_type = genomic DNA
tgtagggaagaggaacgaggaacaacaaacaggtaaataaatacattaaattgtttccttgtttaccgtctattctttgtgggtttggtgactcat

SEQ ID NO: 43518 - DNA, 30 bp, Homo sapiens
  misc_feature 1..30: note = chr12:89794228-89794258
  misc_feature 1..30: note = hypo
  source 1..30: mol_type = genomic DNA
tgcaaacatttttggcgtgggaacactccc

SEQ ID NO: 43519 - DNA, 156 bp, Homo sapiens
  misc_feature 1..156: note = chr12:90313545-90313701
  misc_feature 1..156: note = hypo
  source 1..156: mol_type = genomic DNA
ggcctcctccttggccgggcgctgggcgggaggcgggagcgagcgtgctagccaagcatgtgggccgcgctgaggcttgacgaggccggcgtcccttttcctgaggcacgtgcgccgccgccgccatcatgccgtgcgcgccgccctaatgctttt

SEQ ID NO: 43520 - DNA, 33 bp, Homo sapiens
  misc_feature 1..33: note = chr12:93711081-93711114
  misc_feature 1..33: note = hypo
  source 1..33: mol_type = genomic DNA
ttacagtccaatgaccgccgtgggtcataatcc

SEQ ID NO: 43521 - DNA, 30 bp, Homo sapiens
  misc_feature 1..30: note = chr12:93797551-93797581
  misc_feature 1..30: note = hypo
  source 1..30: mol_type = genomic DNA
tgaaaagtaatctatcgctggtgctacttt

SEQ ID NO: 43522 - DNA, 30 bp, Homo sapiens; identical to SEQ ID NO: 15678
  misc_feature 1..30: note = chr12:94641622-94641652
  misc_feature 1..30: note = hypo
  source 1..30: mol_type = genomic DNA

SEQ ID NO: 43523 - DNA, 81 bp, Homo sapiens; identical to SEQ ID NO: 15679
  misc_feature 1..81: note = chr12:95465839-95465920
  misc_feature 1..81: note = hypo
  source 1..81: mol_type = genomic DNA

SEQ ID NO: 43524 - DNA, 20 bp, Homo sapiens
  misc_feature 1..20: note = chr12:96881018-96881038
  misc_feature 1..20: note = hypo
  source 1..20: mol_type = genomic DNA
agccacgacacccagccaat

SEQ ID NO: 43525 - DNA, 30 bp, Homo sapiens
  misc_feature 1..30: note = chr12:97073402-97073432
  misc_feature 1..30: note = hypo
  source 1..30: mol_type = genomic DNA
ctgcgtgcccgtggacgtgacagacacctt

SEQ ID NO: 43526 - DNA, 133 bp, Homo sapiens
  misc_feature 1..133: note = chr12:98763899-98764032
  misc_feature 1..133: note = hypo
  source 1..133: mol_type = genomic DNA
ctatgaatgaggtaccggctagattgttggcaacacagcaggtagacaagagtcagtccctgttatcaagggatcacagttcagtgagctaaatagaaacgtgccttcaactgcactgcgctacactgaaaca

SEQ ID NO: 43527 - DNA, 38 bp, Homo sapiens
  misc_feature 1..38: note = chr12:98947863-98947901
  misc_feature 1..38: note = hypo
  source 1..38: mol_type = genomic DNA
ctaggattacaggcgtgagccaccgcgccgggccaata

SEQ ID NO: 43528 - DNA, 42 bp, Homo sapiens; identical to SEQ ID NO: 15681
  misc_feature 1..42: note = chr12:98948376-98948418
  misc_feature 1..42: note = hypo
  source 1..42: mol_type = genomic DNA

SEQ ID NO: 43529 - DNA, 24 bp, Homo sapiens
  misc_feature 1..24: note = chr12:98986204-98986228
  misc_feature 1..24: note = hypo
  source 1..24: mol_type = genomic DNA
ttaagaatttcaagccgggcatgg

SEQ ID NO: 43530 - DNA, 35 bp, Homo sapiens
  misc_feature 1..35: note = chr12:100595448-100595483
  misc_feature 1..35: note = hypo
  source 1..35: mol_type = genomic DNA
ccgaggctggagtgccgtggtgcgatctcagctca

SEQ ID NO: 43531 - DNA, 30 bp, Homo sapiens
  misc_feature 1..30: note = chr12:101025517-101025547
  misc_feature 1..30: note = hypo
  source 1..30: mol_type = genomic DNA
ttgtgagaggctactcggagcgtaacactg

SEQ ID NO: 43532 - DNA, 30 bp, Homo sapiens
  misc_feature 1..30: note = chr12:102158693-102158723
  misc_feature 1..30: note = hypo
  source 1..30: mol_type = genomic DNA
ctcaaaaaggatttccgcctctggaagaag

SEQ ID NO: 43533 - DNA, 30 bp, Homo sapiens; identical to SEQ ID NO: 15682
  misc_feature 1..30: note = chr12:104690709-104690739
  misc_feature 1..30: note = hypo
  source 1..30: mol_type = genomic DNA

SEQ ID NO: 43534 - DNA, 85 bp, Homo sapiens
  misc_feature 1..85: note = chr12:104695389-104695474
  misc_feature 1..85: note = hypo
  source 1..85: mol_type = genomic DNA
caggcgtgagccaccgtgcccggctgcttttgttgaatttaaagtggatgtgagaagctcctaagaatatcgttcactgtaaaag

SEQ ID NO: 43535 - DNA, 102 bp, Homo sapiens
  misc_feature 1..102: note = chr12:104696536-104696638
  misc_feature 1..102: note = hypo
  source 1..102: mol_type = genomic DNA
gattgcaggcgtgagccaccgcgcccggccattcccattgttatgtatactttgctatttgctgctggtgagacagataaggagtcacgtctttaactgcac

SEQ ID NO: 43536 - DNA, 30 bp, Homo sapiens
  misc_feature 1..30: note = chr12:104698273-104698303
  misc_feature 1..30: note = hypo
  source 1..30: mol_type = genomic DNA
caccagaaaaaagttcgcaagatggaagaa

SEQ ID NO: 43537 - DNA, 30 bp, Homo sapiens
  misc_feature 1..30: note = chr12:104975785-104975815
  misc_feature 1..30: note = hypo
  source 1..30: mol_type = genomic DNA
gcactacgtcattatcgtcagcatcatcat

SEQ ID NO: 43538 - DNA, 78 bp, Homo sapiens
  misc_feature 1..78: note = chr12:105018625-105018703
  misc_feature 1..78: note = hypo
  source 1..78: mol_type = genomic DNA
tctttttggctcacagacggccacctttttggctgtgtcctcacatggtctttccacggtgcccgtgcactcctggtt

SEQ ID NO: 43539 - DNA, 30 bp, Homo sapiens
  misc_feature 1..30: note = chr12:105056939-105056969
  misc_feature 1..30: note = hypo
  source 1..30: mol_type = genomic DNA
ttccagaggcctgggcgagccctgtctaac

SEQ ID NO: 43540 - DNA, 141 bp, Homo sapiens
  misc_feature 1..141: note = chr12:105069324-105069465
  misc_feature 1..141: note = hypo
  source 1..141: mol_type = genomic DNA
aaccgaactaacaaccgctgttatgagccgagtgcttactcagtgccaagtgctttgtttggactttattcaatccaggggttgaagaaccactcactctggagtcagattcctggtcctaaaccacgtacttaagcaaat

SEQ ID NO: 43541 - DNA, 30 bp, Homo sapiens
  misc_feature 1..30: note = chr12:105104162-105104192
  misc_feature 1..30: note = hypo
  source 1..30: mol_type = genomic DNA
cttcggtggcacttccgtgggctctctggg

SEQ ID NO: 43542 - DNA, 200 bp, Homo sapiens
  misc_feature 1..200: note = chr12:107138858-107139058
  misc_feature 1..200: note = hypo
  source 1..200: mol_type = genomic DNA
taggaagaatttgggcggcatgtttcacctcattctgaattgcattttttgcctccaattctgcttttctttcttctttcattcccacttccattttattgtctcgaatcttttatattgctatacactcccttaaattcttttggatttaaccatcagtttcctcatctataaatgggggataacgttcttttaagggt

SEQ ID NO: 43543 - DNA, 158 bp, Homo sapiens
  misc_feature 1..158: note = chr12:108898965-108899123
  misc_feature 1..158: note = hypo
  source 1..158: mol_type = genomic DNA
gtcagacatagatgccggcagttgagccaatcatgttaaagacagcggctccatctccccttgtctttgtcagccacgtgtacagcaaacaccagacatgatgaccccagtcaactggaaagcctattcacataacaagattagggtggggtggccag

SEQ ID NO: 43544 - DNA, 58 bp, Homo sapiens
  misc_feature 1..58: note = chr12:109208616-109208674
  misc_feature 1..58: note = hypo
  source 1..58: mol_type = genomic DNA
ggtgggaaggaagagcgccatgggggcggtgcggacgagcgcacgggccagtctcctc

SEQ ID NO: 43545 - DNA, 30 bp, Homo sapiens
  misc_feature 1..30: note = chr12:109343659-109343689
  misc_feature 1..30: note = hypo
  source 1..30: mol_type = genomic DNA
agaatttaaacttcccgggagtagccctca

SEQ ID NO: 43546 - DNA, 30 bp, Homo sapiens
  misc_feature 1..30: note = chr12:109719635-109719665
  misc_feature 1..30: note = hypo
  source 1..30: mol_type = genomic DNA
ccacccagcagttaccgggccccagcccag

SEQ ID NO: 43547 - DNA, 37 bp, Homo sapiens
  misc_feature 1..37: note = chr12:110506967-110507004
  misc_feature 1..37: note = hypo
  source 1..37: mol_type = genomic DNA
aggcacggtgcctcacgcctgtaatcccagcattttg

SEQ ID NO: 43548 - DNA, 38 bp, Homo sapiens
  misc_feature 1..38: note = chr12:110563206-110563244
  misc_feature 1..38: note = hypo
  source 1..38: mol_type = genomic DNA
ttttttctgttgagacggagtctctctctgtcccccag

SEQ ID NO: 43549 - DNA, 258 bp, Homo sapiens
  misc_feature 1..258: note = chr12:110717541-110717799
  misc_feature 1..258: note = hypo
  source 1..258: mol_type = genomic DNA
ggagaagaattggtacgaaatggtgcagagctggtctcagagggcaacaacagccagccctccatgaccacactcccaccgtgcactcacgtgcccctcttgaagcggctctgatcctgtgacctaaccagtttccacctggcttctctcagtgcgttgccatatagtataattttttgtttgtttgtttcgtgtagggttttgttggttcttttccaagtatcaatcaaaactacatgccaacgtccactccttgga

SEQ ID NO: 43550 - DNA, 30 bp, Homo sapiens; identical to SEQ ID NO: 15684
  misc_feature 1..30: note = chr12:110782730-110782760
  misc_feature 1..30: note = hypo
  source 1..30: mol_type = genomic DNA

SEQ ID NO: 43551 - DNA, 23 bp, Homo sapiens
  misc_feature 1..23: note = chr12:110840421-110840444
  misc_feature 1..23: note = hypo
  source 1..23: mol_type = genomic DNA
agccactacgcccggccaataaa

SEQ ID NO: 43552 - DNA, 39 bp, Homo sapiens
  misc_feature 1..39: note = chr12:110908132-110908171
  misc_feature 1..39: note = hypo
  source 1..39: mol_type = genomic DNA
gacctcgtgatccgcccgcatggccgtcctttttgtctc

SEQ ID NO: 43553 - DNA, 35 bp, Homo sapiens
  misc_feature 1..35: note = chr12:110915431-110915466
  misc_feature 1..35: note = hypo
  source 1..35: mol_type = genomic DNA
attacaggcgtgagtcaacgcgcccagtcttgtca

SEQ ID NO: 43554 - DNA, 30 bp, Homo sapiens; identical to SEQ ID NO: 15686
  misc_feature 1..30: note = chr12:111296630-111296660
  misc_feature 1..30: note = hypo
  source 1..30: mol_type = genomic DNA

SEQ ID NO: 43555 - DNA, 30 bp, Homo sapiens
  misc_feature 1..30: note = chr12:111355976-111356006
  misc_feature 1..30: note = hypo
  source 1..30: mol_type = genomic DNA
tgtgagccctcgcaacggctggaaaatgaa

SEQ ID NO: 43556 - DNA, 224 bp, Homo sapiens
  misc_feature 1..224: note = chr12:111369069-111369293
  misc_feature 1..224: note = hypo
  source 1..224: mol_type = genomic DNA
caggatcccagagctcggatccagcctcaacgacccagatagccctgcagtggctttcttgtccctggtatttttagccctcggtcatctatcttgcctgcactggggacagcggcactcagacaagcccatttttactggtgcccttcagatgcccgcgggctcagctgtctcggtgcctggcattccgggggtattgttcctctctacgagtcccagattcc

SEQ ID NO: 43557 - DNA, 30 bp, Homo sapiens
  misc_feature 1..30: note = chr12:111535459-111535489
  misc_feature 1..30: note = hypo
  source 1..30: mol_type = genomic DNA
gactgcacaagacagcgttttctcacagca

SEQ ID NO: 43558 - DNA, 30 bp, Homo sapiens
  misc_feature 1..30: note = chr12:111763122-111763152
  misc_feature 1..30: note = hypo
  source 1..30: mol_type = genomic DNA
gctaatgctaatgaccgctgccacttacca

SEQ ID NO: 43559 - DNA, 23 bp, Homo sapiens
  misc_feature 1..23: note = chr12:112281623-112281646
  misc_feature 1..23: note = hypo
  source 1..23: mol_type = genomic DNA
tgtttgtttttgagacggagtct

SEQ ID NO: 43560 - DNA, 68 bp, Homo sapiens
  misc_feature 1..68: note = chr12:112605535-112605603
  misc_feature 1..68: note = hypo
  source 1..68: mol_type = genomic DNA
gagacacacactgcccgccaccccagccactgcgcaggacatgagctcgggggcgtggagcctcctcc

SEQ ID NO: 43561 - DNA, 91 bp, Homo sapiens
  misc_feature 1..91: note = chr12:112610355-112610446
  misc_feature 1..91: note = hypo
  source 1..91: mol_type = genomic DNA
gtgttcataagtgttcgttcgatggacgtctaaatgaatctagcccttgtaaatgccccttgtcatggggcatgcccgcatcaggcagcag

SEQ ID NO: 43562 - DNA, 30 bp, Homo sapiens; identical to SEQ ID NO: 15688
  misc_feature 1..30: note = chr12:112628549-112628579
  misc_feature 1..30: note = hypo
  source 1..30: mol_type = genomic DNA

SEQ ID NO: 43563 - DNA, 30 bp, Homo sapiens
  misc_feature 1..30: note = chr12:112630855-112630885
  misc_feature 1..30: note = hypo
  source 1..30: mol_type = genomic DNA
gcaacttactctttgcggaatccagattga

SEQ ID NO: 43564 - DNA, 30 bp, Homo sapiens
  misc_feature 1..30: note = chr12:112820695-112820725
  misc_feature 1..30: note = hypo
  source 1..30: mol_type = genomic DNA
ttggtgctcaatgcccgacacttaatatgt

SEQ ID NO: 43565 - DNA, 152 bp, Homo sapiens
  misc_feature 1..152: note = chr12:112825982-112826134
  misc_feature 1..152: note = hypo
  source 1..152: mol_type = genomic DNA
ctccagcctgggcaacctaacgagtccatctcaaaaaataaaaataaaaataaaaataaaaaagttgttagcacaaaggaaaagtggacaaaagatattattgaagagttttcactcaaggaaaagcaaacactgtacgtttttgttccttc

SEQ ID NO: 43566 - DNA, 30 bp, Homo sapiens; identical to SEQ ID NO: 15690
  misc_feature 1..30: note = chr12:112919571-112919601
  misc_feature 1..30: note = hypo
  source 1..30: mol_type = genomic DNA

SEQ ID NO: 43567 - DNA, 36 bp, Homo sapiens
  misc_feature 1..36: note = chr12:113677751-113677787
  misc_feature 1..36: note = hypo
  source 1..36: mol_type = genomic DNA
gctgctccaagctgccggctgcgctgcctttcactt

SEQ ID NO: 43568 - DNA, 98 bp, Homo sapiens
  misc_feature 1..98: note = chr12:113725864-113725962
  misc_feature 1..98: note = hypo
  source 1..98: mol_type = genomic DNA
gtcttcaccgcatggcgtgtggaaggcggggccggcatgttctgagggcgggggctgaggcgtgcacctgtgtgtggaggtgacgggtgtcctcctcg

SEQ ID NO: 43569 - DNA, 36 bp, Homo sapiens
  misc_feature 1..36: note = chr12:113795723-113795759
  misc_feature 1..36: note = hypo
  source 1..36: mol_type = genomic DNA
ggcgtgagccaccgcgcccgacggcatctaggtttt

SEQ ID NO: 43570 - DNA, 143 bp, Homo sapiens
  misc_feature 1..143: note = chr12:114130077-114130220
  misc_feature 1..143: note = hypo
  source 1..143: mol_type = genomic DNA
gcatgcgcacccatgcgccgcacacactccgacacatgcaccctccagctcaaataggtggacgtgcttgggaaaaccatggagtaagtgagccccacagagagggaccgtgaaatccctgttgccgccggggccaccagaat

SEQ ID NO: 43571 - DNA, 49 bp, Homo sapiens
  misc_feature 1..49: note = chr12:114236483-114236532
  misc_feature 1..49: note = hypo
  source 1..49: mol_type = genomic DNA
ctgtcacctcatcagcgaggccgtgcctgggtcccgagtgagggcgctc

SEQ ID NO: 43572 - DNA, 180 bp, Homo sapiens
  misc_feature 1..180: note = chr12:114240258-114240438
  misc_feature 1..180: note = hypo
  source 1..180: mol_type = genomic DNA
ccctacagatggggacgtggctcagggaggtacagtgcttgcctgagtcacacagccgggaggcgacacgcccgggtgcgctcagttaatcctcggagatgagtgttcctctcatgcccgttttacagaggaggaaactgaggcacagaacaaccctgaggtaaccgccctgaggtcaca

SEQ ID NO: 43573 - DNA, 30 bp, Homo sapiens
  misc_feature 1..30: note = chr12:114295503-114295533
  misc_feature 1..30: note = hypo
  source 1..30: mol_type = genomic DNA
gctggcgaggctctccgagggtccccatgc

SEQ ID NO: 43574 - DNA, 152 bp, Homo sapiens
  misc_feature 1..152: note = chr12:114329563-114329715
  misc_feature 1..152: note = hypo
  source 1..152: mol_type = genomic DNA
aagataaaacttttgcgaacacgcctctgttaaagggacttgatttaaatttcaggtaggcagagtataattgccccacgaagtgtaatcacactgcctggattcaaacctctccaatgtgattccctctgtcttcccgctcatttccctgt

SEQ ID NO: 43575 - DNA, 49 bp, Homo sapiens
  misc_feature 1..49: note = chr12:114337939-114337988
  misc_feature 1..49: note = hypo
  source 1..49: mol_type = genomic DNA
ggaagcccgagcctgcgaaatctcaaaggaaggacgaaaacaacggcaa

SEQ ID NO: 43576 - DNA, 74 bp, Homo sapiens
  misc_feature 1..74: note = chr12:116756120-116756194
  misc_feature 1..74: note = hypo
  source 1..74: mol_type = genomic DNA
gggttgaactgtggccgcacctggttagcaccgttctttttcttcttctgaaggaaaggcgtggctgttccgag

SEQ ID NO: 43577 - DNA, 59 bp, Homo sapiens
  misc_feature 1..59: note = chr12:116842266-116842325
  misc_feature 1..59: note = hypo
  source 1..59: mol_type = genomic DNA
tgtctggtcaccgcacgtcgttattcagttcacacacagctaagcgtgcagctgtgttg

SEQ ID NO: 43578 - DNA, 172 bp, Homo sapiens
  misc_feature 1..172: note = chr12:116941191-116941363
  misc_feature 1..172: note = hypo
  source 1..172: mol_type = genomic DNA
acacagggcgtgggacgctggataaaacctaaagagacctgacccactgccctctaggtgcttagcctctgaccacaccaagctagcgacattccaatctctcataaaaagcatttcaaaatgaaagagactgggcaaataaatcgtggtacatgcacggaatgcgatggcc

SEQ ID NO: 43579 - DNA, 30 bp, Homo sapiens
  misc_feature 1..30: note = chr12:117472788-117472818
  misc_feature 1..30: note = hypo
  source 1..30: mol_type = genomic DNA
agccgggcaggagagcgccaggtgatttct

SEQ ID NO: 43580 - DNA, 30 bp, Homo sapiens
  misc_feature 1..30: note = chr12:117473067-117473097
  misc_feature 1..30: note = hypo
  source 1..30: mol_type = genomic DNA
gggcacaggggctgacggaagatgatttat

SEQ ID NO: 43581 - DNA, 211 bp, Homo sapiens
  misc_feature 1..211: note = chr12:117473987-117474198
  misc_feature 1..211: note = hypo
  source 1..211: mol_type = genomic DNA
gcctggggtggcacacgctgctgtctggtgtctactaggctctgccaggtgcttacaatgacaatgacagcacagagtcaagagcctctcagccgcagcttggcacctacccaggaggtcgtgcgcattaaccaaaagctgagcctccccaggccgcactcactttcccggggccattcgcccgctccctgtgtagcgggtcacctggccc

SEQ ID NO: 43582 - DNA, 198 bp, Homo sapiens
  misc_feature 1..198: note = chr12:117474577-117474775
  misc_feature 1..198: note = hypo
  source 1..198: mol_type = genomic DNA
cctgcctagggttcccgctgggaccacaccaggctcaacgctagagtggagatggggcatctcagcaccatctgggctccgtgcgtttgcagccttaagcacaagtcacggtcccctagaacagtgtccggggcctgtgcttatgatgggctgtaccgaatgaactcccccagcctttaatgtagaaggggtagggcc

SEQ ID NO: 43583 - DNA, 30 bp, Homo sapiens
  misc_feature 1..30: note = chr12:117484341-117484371
  misc_feature 1..30: note = hypo
  source 1..30: mol_type = genomic DNA
ggagggctgcaggggcgctcaccatctgcc

SEQ ID NO: 43584 - DNA, 347 bp, Homo sapiens
  misc_feature 1..347: note = chr12:117529912-117530259
  misc_feature 1..347: note = hypo
  source 1..347: mol_type = genomic DNA
cctcaaagggcttttcggcagatcagatgattgacaagtgctcaagaaagagcagctgtcacctcattcacagctggctgcgttttttaaggagcggaactggtggctcaaagaaggacacagcctggatgagacatctgagcgaagtggcacaggacggctccagcaccgagctcagtgcacatggaacgccatcctccagggtcccgctctgtggctgcgacagatggtgagatgatggggcccaggtgaacagaatgaaaaataccagcatgggctagagcaggcaggtgcctttggttgatccccagccctgtgggaagcttccacagcgggcattctcctgc

SEQ ID NO: 43585 - DNA, 87 bp, Homo sapiens
  misc_feature 1..87: note = chr12:117530986-117531073
  misc_feature 1..87: note = hypo
  source 1..87: mol_type = genomic DNA
ctggagggcagggaccgcatctggtccaccctggtagcagaatatggcaattggtgaatgagccgaggccaccgtctgaggccactt

SEQ ID NO: 43586 - DNA, 151 bp, Homo sapiens
  misc_feature 1..151: note = chr12:117532401-117532552
  misc_feature 1..151: note = hypo
  source 1..151: mol_type = genomic DNA
tgcgggctccaggagcgctgaggatgggtgtttaacccttaaaggtcggatggagagatggctttctggatgggagcagcaggtaagccaacccctgaacaataatgagcattcgtttcataaagagacagggttaacgctgtgcgcggtg

SEQ ID NO: 43587 - DNA, 20 bp, Homo sapiens
  misc_feature 1..20: note = chr12:117533167-117533187
  misc_feature 1..20: note = hypo
  source 1..20: mol_type = genomic DNA
acgcccggcctagaccttac

SEQ ID NO: 43588 - DNA, 67 bp, Homo sapiens
  misc_feature 1..67: note = chr12:117544227-117544294
  misc_feature 1..67: note = hypo
  source 1..67: mol_type = genomic DNA
cctcaatgtcttcatcggtataataggccccacaatcccatctttgaagagtcggaacaagggtgaa

SEQ ID NO: 43589 - DNA, 60 bp, Homo sapiens
  misc_feature 1..60: note = chr12:117563240-117563300
  misc_feature 1..60: note = hypo
  source 1..60: mol_type = genomic DNA
gagggtgactcatgccgaatatatactgcctagacagtgacaattcgcagcatctctcac

SEQ ID NO: 43590 - DNA, 38 bp, Homo sapiens
  misc_feature 1..38: note = chr12:118177130-118177168
  misc_feature 1..38: note = hypo
  source 1..38: mol_type = genomic DNA
gcctgggcgacagagcaagactccgcctcaaaaatata

SEQ ID NO: 43591 - DNA, 37 bp, Homo sapiens
  misc_feature 1..37: note = chr12:118198752-118198789
  misc_feature 1..37: note = hypo
  source 1..37: mol_type = genomic DNA
caaggggcagcccctcgcaggccgggtttcgaccgcc

SEQ ID NO: 43592 - DNA, 39 bp, Homo sapiens
  misc_feature 1..39: note = chr12:118860397-118860436
  misc_feature 1..39: note = hypo
  source 1..39: mol_type = genomic DNA
aaagtcaaatagtagcgtgtgtttaacatacatcacaag

SEQ ID NO: 43593 - DNA, 87 bp, Homo sapiens
  misc_feature 1..87: note = chr12:120148309-120148396
  misc_feature 1..87: note = hypo
  source 1..87: mol_type = genomic DNA
cagacaccagctggccgtgcccatgcaagcattacctggtcactgaagggcagcgtgcagttcatgtctagacggtcatcaccttcc

SEQ ID NO: 43594 - DNA, 30 bp, Homo sapiens
  misc_feature 1..30: note = chr12:120152067-120152097
  misc_feature 1..30: note = hypo
  source 1..30: mol_type = genomic DNA
gcatgttcagtcctacgttgaatcggtgag

SEQ ID NO: 43595 - DNA, 30 bp, Homo sapiens; identical to SEQ ID NO: 15699
  misc_feature 1..30: note = chr12:120574326-120574356
  misc_feature 1..30: note = hypo
  source 1..30: mol_type = genomic DNA

SEQ ID NO: 43596 - DNA, 63 bp, Homo sapiens
  misc_feature 1..63: note = chr12:120580446-120580509
  misc_feature 1..63: note = hypo
  source 1..63: mol_type = genomic DNA
agctgggtgtctgagcggcccatgtacagccctgccaacacccggttccgccgctctaccccc

SEQ ID NO: 43597 - DNA, 30 bp, Homo sapiens
  misc_feature 1..30: note = chr12:120740933-120740963
  misc_feature 1..30: note = hypo
  source 1..30: mol_type = genomic DNA
aaaataaaaggaatgcgtgtgtgtgcttaa

SEQ ID NO: 43598 - DNA, 42 bp, Homo sapiens
  misc_feature 1..42: note = chr12:120932999-120933041
  misc_feature 1..42: note = hypo
  source 1..42: mol_type = genomic DNA
acgtcatctctctaacggccgctttttcgtccattagaatac

SEQ ID NO: 43599 - DNA, 155 bp, Homo sapiens
  misc_feature 1..155: note = chr12:121366974-121367129
  misc_feature 1..155: note = hypo
  source 1..155: mol_type = genomic DNA
caagtgagccctcttcgtctcagagcagtgaaggctatgggaggatgaggaggggctgaatctgggggttcaaacacagcctcagattgtttctggaaccccccttctctccaatctccagactcagccctcaagtcaggcgggctgggtgtctt

SEQ ID NO: 43600 - DNA, 30 bp, Homo sapiens
  misc_feature 1..30: note = chr12:121641645-121641675
  misc_feature 1..30: note = hypo
  source 1..30: mol_type = genomic DNA
gaactaaaaagaggccgggcgcggtggctc

SEQ ID NO: 43601 - DNA, 30 bp, Homo sapiens
  misc_feature 1..30: note = chr12:121688301-121688331
  misc_feature 1..30: note = hypo
  source 1..30: mol_type = genomic DNA
tctcaccaacatctacgtggcttggtctct

SEQ ID NO: 43602 - DNA, 82 bp, Homo sapiens
  misc_feature 1..82: note = chr12:122107201-122107283
  misc_feature 1..82: note = hypo
  source 1..82: mol_type = genomic DNA
gctctgaccccactccggccgcccgtcccggagtcccactcaccgtgtttcacgttgtccttccactcgcccacatagtagt

SEQ ID NO: 43603 - DNA, 46 bp, Homo sapiens; identical to SEQ ID NO: 15700
  misc_feature 1..46: note = chr12:122141060-122141106
  misc_feature 1..46: note = hypo
  source 1..46: mol_type = genomic DNA

SEQ ID NO: 43604 - DNA, 104 bp, Homo sapiens
  misc_feature 1..104: note = chr12:122204974-122205078
  misc_feature 1..104: note = hypo
  source 1..104: mol_type = genomic DNA
gacatgctgtccctacgtctggccattgatgcacctgctcctcctggagctcataaaataaaaaaaggccgtgagctcctgcaaggtttcttttttgttttgtt

SEQ ID NO: 43605 - DNA, 85 bp, Homo sapiens
  misc_feature 1..85: note = chr12:122213608-122213693
  misc_feature 1..85: note = hypo
  source 1..85: mol_type = genomic DNA
gcaagacaaagcagccgtgagcctcgggctcctgtgccctcggcccggacttcagactgcagggggctcccgggctccttcccag

SEQ ID NO: 43606 - DNA, 166 bp, Homo sapiens
  misc_feature 1..166: note = chr12:122281163-122281329
  misc_feature 1..166: note = hypo
  source 1..166: mol_type = genomic DNA
tctgacctaggtcatcgctcaaaaacagcctcccatccactctagcctattctttctgttcctcagacgctcagggcatgctcctacctcggcccttgctgatccctctgccaggaatgcctttcttcccgctgttcacatggccagctcccgctcatgatctaga

SEQ ID NO: 43607 - DNA, 81 bp, Homo sapiens; identical to SEQ ID NO: 15702
  misc_feature 1..81: note = chr12:122285027-122285108
  misc_feature 1..81: note = hypo
  source 1..81: mol_type = genomic DNA

SEQ ID NO: 43608 - DNA, 30 bp, Homo sapiens; identical to SEQ ID NO: 15703
  misc_feature 1..30: note = chr12:122292767-122292797
  misc_feature 1..30: note = hypo
  source 1..30: mol_type = genomic DNA

SEQ ID NO: 43609 - DNA, 112 bp, Homo sapiens
  misc_feature 1..112: note = chr12:122439399-122439511
  misc_feature 1..112: note = hypo
  source 1..112: mol_type = genomic DNA
caggtgagcatatgacggaggaggagatgttggattgctttgcttcactgtttggcctgaatcccgagggatggaaatccgagcctgcaacctgctccgtcaaaggtacccc

SEQ ID NO: 43610 - DNA, 53 bp, Homo sapiens
  misc_feature 1..53: note = chr12:122458643-122458696
  misc_feature 1..53: note = hypo
  source 1..53: mol_type = genomic DNA
ctaggaaaaggcctgcggtctctccatttccacagtagcgtgttccccaaaga

SEQ ID NO: 43611 - DNA, 30 bp, Homo sapiens
  misc_feature 1..30: note = chr12:122591572-122591602
  misc_feature 1..30: note = hypo
  source 1..30: mol_type = genomic DNA
ctggcaggggttcaacgtcaccagccctcc

SEQ ID NO: 43612 - DNA, 50 bp, Homo sapiens
  misc_feature 1..50: note = chr12:122602863-122602913
  misc_feature 1..50: note = hypo
  source 1..50: mol_type = genomic DNA
ggtaaagcacaataccgcagaaaagggaggaatgccgtacattccagtgt

SEQ ID NO: 43613 - DNA, 30 bp, Homo sapiens; identical to SEQ ID NO: 15707
  misc_feature 1..30: note = chr12:122622042-122622072
  misc_feature 1..30: note = hypo
  source 1..30: mol_type = genomic DNA

SEQ ID NO: 43614 - DNA, 41 bp, Homo sapiens
  misc_feature 1..41: note = chr12:122622344-122622385
  misc_feature 1..41: note = hypo
  source 1..41: mol_type = genomic DNA
aagcctgggagccaacgctgagtccacgtagtgtgcaggta

SEQ ID NO: 43615 - DNA, 89 bp, Homo sapiens
  misc_feature 1..89: note = chr12:122623990-122624079
  misc_feature 1..89: note = hypo
  source 1..89: mol_type = genomic DNA
gcagcacggctctcacggggagtggttcccgcctggtcactccccaccctgccaccgctctgcctctgagtaaacggtcggcacatgtg

SEQ ID NO: 43616 - DNA, 30 bp, Homo sapiens
  misc_feature 1..30: note = chr12:122691182-122691212
  misc_feature 1..30: note = hypo
  source 1..30: mol_type = genomic DNA
ggtcacgtggagcgacgtgcggctatccgc

SEQ ID NO: 43617 - DNA, 240 bp, Homo sapiens
  misc_feature 1..240: note = chr12:123128928-123129168
  misc_feature 1..240: note = hypo
  source 1..240: mol_type = genomic DNA
ggagccagaaaggagatggttttcttcgggagtcgggcggcttcttcgcagcccgggctctcctccgactgcccaggccaaactccgcctcattcccccagtcaatggcctgatggcctgtaggcatgccagtgtctgactatgtgctcttccgccagcgtgctaccctcgatgtcctctcgatgtccagccacctgtgtctgcctgctagggtctcggggttttattttattttatttt

SEQ ID NO: 43618 - DNA, 41 bp, Homo sapiens
  misc_feature 1..41: note = chr12:123333308-123333349
  misc_feature 1..41: note = hypo
  source 1..41: mol_type = genomic DNA
acactcccccactcccgtattccctgcgctgcaggtgctgc

SEQ ID NO: 43619 - DNA, 38 bp, Homo sapiens
  misc_feature 1..38: note = chr12:123881693-123881731
  misc_feature 1..38: note = hypo
  source 1..38: mol_type = genomic DNA
gccagctggcctatgcgggcctccgctgccatgtttgc

SEQ ID NO: 43620 - DNA, 32 bp, Homo sapiens
  misc_feature 1..32: note = chr12:124117199-124117231
  misc_feature 1..32: note = hypo
  source 1..32: mol_type = genomic DNA
aaagctactggtggccgggcgcggtggctcac

SEQ ID NO: 43621 - DNA, 30 bp, Homo sapiens
  misc_feature 1..30: note = chr12:124284067-124284097
  misc_feature 1..30: note = hypo
  source 1..30: mol_type = genomic DNA
agagtggagatggcacgatgccatggctag

SEQ ID NO: 43622 - DNA, 30 bp, Homo sapiens
  misc_feature 1..30: note = chr12:124393574-124393604
  misc_feature 1..30: note = hypo
  source 1..30: mol_type = genomic DNA
ccgcaccattccaggcgcctggtctggaac

SEQ ID NO: 43623 - DNA, 30 bp, Homo sapiens
  misc_feature 1..30: note = chr12:124397588-124397618
  misc_feature 1..30: note = hypo
  source 1..30: mol_type = genomic DNA
atcgcggccccaccacggtccttttcccca

SEQ ID NO: 43624 - DNA, 92 bp, Homo sapiens
  misc_feature 1..92: note = chr12:124404180-124404272
  misc_feature 1..92: note = hypo
  source 1..92: mol_type = genomic DNA
gtccctggcagtcaccgctctgccttccatctgtaaggatttacttgctctgaacacttcatgtcaatggcatcatacggtgtgtgacttca

SEQ ID NO: 43625 - DNA, 47 bp, Homo sapiens
  misc_feature 1..47: note = chr12:124651773-124651820
  misc_feature 1..47: note = hypo
  source 1..47: mol_type = genomic DNA
gccgcctcccccactcgggtctgtttttcagccgtggctccggcagt

SEQ ID NO: 43626 - DNA, 207 bp, Homo sapiens
  misc_feature 1..207: note = chr12:124716795-124717002
  misc_feature 1..207: note = hypo
  source 1..207: mol_type = genomic DNA
gcttaggagcaccagcgctgcctagggaaaccctggcccctccttccctgggatcatctgggtcccccagggctcaggctttacaacccctgctgcttggttacccacctcccacctggggcccctgacagatcaggggacaagcagatagagggctcaccagtgcagtccagtgtatgctgccgggcgggccggagcagagtgagt

SEQ ID NO: 43627 - DNA, 173 bp, Homo sapiens; identical to SEQ ID NO: 15711
  misc_feature 1..173: note = chr12:124778198-124778371
  misc_feature 1..173: note = hypo
  source 1..173: mol_type = genomic DNA

SEQ ID NO: 43628 - DNA, 30 bp, Homo sapiens
  misc_feature 1..30: note = chr12:124782655-124782685
  misc_feature 1..30: note = hypo
  source 1..30: mol_type = genomic DNA
ccactatccagtgaacgacaccacctttct

SEQ ID NO: 43629 - DNA, 223 bp, Homo sapiens
  misc_feature 1..223: note = chr12:124788775-124788998
  misc_feature 1..223: note = hypo
  source 1..223: mol_type = genomic DNA
ccagccctgcagctccgcgggagtgtcctgggccttggcggggacttcccgagccgtctcaccgcccaggcccacgggacgccagcctatatcggtctgggctttcacggcttctggtgtctcctgcccagcgcttccagcttgggtggactttaggtgttttttcagcgggaccctttggcaaatggtgcccggagctctggcttcccgggccagcctgtga

SEQ ID NO: 43630 - DNA, 33 bp, Homo sapiens
  misc_feature 1..33: note = chr12:124843830-124843863
  misc_feature 1..33: note = hypo
  source 1..33: mol_type = genomic DNA
aggtgtcatctatcacgccgcctccagatgaac

SEQ ID NO: 43631 - DNA, 129 bp, Homo sapiens
  misc_feature 1..129: note = chr12:124869876-124870005
  misc_feature 1..129: note = hypo
  source 1..129: mol_type = genomic DNA
ggcaggggagccactcgctcaggacccatttgcctccgggtcctcattccaacgcgctgacagcccgaattcctggctgagtcagtctggtccaccgcgctccttcccccacaccgtgagacagggctg

SEQ ID NO: 43632 - DNA, 60 bp, Homo sapiens
  misc_feature 1..60: note = chr12:124893479-124893539
  misc_feature 1..60: note = hypo
  source 1..60: mol_type = genomic DNA
ccagttccaagtcagcggcagcacgttgtcacgtggcactgggcacggtgagaggattta

SEQ ID NO: 43633 - DNA, 45 bp, Homo sapiens
  misc_feature 1..45: note = chr12:124989304-124989349
  misc_feature 1..45: note = hypo
  source 1..45: mol_type = genomic DNA
aaaaggcaaagaagccgctcagaaaggccacgcactgcatgattc

SEQ ID NO: 43634 - DNA, 54 bp, Homo sapiens; identical to SEQ ID NO: 15714
  misc_feature 1..54: note = chr12:125009346-125009400
  misc_feature 1..54: note = hypo
  source 1..54: mol_type = genomic DNA

SEQ ID NO: 43635 - DNA, 70 bp, Homo sapiens
  misc_feature 1..70: note = chr12:125092426-125092496
  misc_feature 1..70: note = hypo
  source 1..70: mol_type = genomic DNA
ccgaaagccaagctccgtgtccatcgcgaaggcactgggcatgtggctatgcagccgtgacaaaggatga

SEQ ID NO: 43636 - DNA, 33 bp, Homo sapiens; identical to SEQ ID NO: 15716
  misc_feature 1..33: note = chr12:125102143-125102176
  misc_feature 1..33: note = hypo
  source 1..33: mol_type = genomic DNA

SEQ ID NO: 43637 - DNA, 40 bp, Homo sapiens
  misc_feature 1..40: note = chr12:125102525-125102565
  misc_feature 1..40: note = hypo
  source 1..40: mol_type = genomic DNA
tgtggctgttttctccgctcccctgcggtggagaaggaag

SEQ ID NO: 43638 - DNA, 65 bp, Homo sapiens
  misc_feature 1..65: note = chr12:125102819-125102884
  misc_feature 1..65: note = hypo
  source 1..65: mol_type = genomic DNA
ctcagtgttctcatccgtaaaatagggaaaataacagtttccagggccatcgttcaccttttttt

SEQ ID NO: 43639 - DNA, 58 bp, Homo sapiens
  misc_feature 1..58: note = chr12:125119323-125119381
  misc_feature 1..58: note = hypo
  source 1..58: mol_type = genomic DNA
ctttgctctgtgtcccgtggttacaaaatggctgttgccaattcgacattttaggcag

SEQ ID NO: 43640 - DNA, 146 bp, Homo sapiens
  misc_feature 1..146: note = chr12:125152108-125152254
  misc_feature 1..146: note = hypo
  source 1..146: mol_type = genomic DNA
cttgctaaatgcttgcgtagtgaggcccctgcatctccttttgccgagactgggggaggctgaatggcaccaggccctgtctctcagccccgctcagccccatccctctagttcagtcctgtgggaccgcccgatccttgtgcagc

SEQ ID NO: 43641 - DNA, 30 bp, Homo sapiens; identical to SEQ ID NO: 15719
  misc_feature 1..30: note = chr12:125167715-125167745
  misc_feature 1..30: note = hypo
  source 1..30: mol_type = genomic DNA

SEQ ID NO: 43642 - DNA, 30 bp, Homo sapiens
  misc_feature 1..30: note = chr12:125200849-125200879
  misc_feature 1..30: note = hypo
  source 1..30: mol_type = genomic DNA
gtcttgagcacttcccgtgtgcccagcaca

SEQ ID NO: 43643 - DNA, 188 bp, Homo sapiens
  misc_feature 1..188: note = chr12:125565948-125566136
  misc_feature 1..188: note = hypo
  source 1..188: mol_type = genomic DNA
aagggcctaagcagccgattattggctcgggggctttaagatcattgtgcttcgttttctgcatgtttttcctgacttgttccttacccagctgggtgcaggtgctcacggagctctgctccatgctcactcaggcgttctcagcaaaactcatctctcctatgggtaatccccgtcgaggccatgcg

SEQ ID NO: 43644 - DNA, 30 bp, Homo sapiens
  misc_feature 1..30: note = chr12:125578422-125578452
  misc_feature 1..30: note = hypo
  source 1..30: mol_type = genomic DNA
ggcatttggtggcttcgtggcaggcattat

SEQ ID NO: 43645 - DNA, 186 bp, Homo sapiens
  misc_feature 1..186: note = chr12:125813536-125813722
  misc_feature 1..186: note = hypo
  source 1..186: mol_type = genomic DNA
tatggactgaatgttcgcattctcccccacccccaaatgtatttgctgaagccctaatctccaatgtgatggtatcaggaggtggagccctcgaggggtaattagatttaggtgaggttgcgagggtggggccctcatgagtgcttttataagtagagaaagaagtaccagcgcttcctccctcat

SEQ ID NO: 43646 - DNA, 34 bp, Homo sapiens
  misc_feature 1..34: note = chr12:125977301-125977335
  misc_feature 1..34: note = hypo
  source 1..34: mol_type = genomic DNA
tcagccactcagccacgcccgcagatctcacttg

SEQ ID NO: 43647 - DNA, 29 bp, Homo sapiens
  misc_feature 1..29: note = chr12:126243099-126243128
  misc_feature 1..29: note = hypo
  source 1..29: mol_type = genomic DNA
tgagccaccgcgcccggctgatgattgtg

SEQ ID NO: 43648 - DNA, 43 bp, Homo sapiens
  misc_feature 1..43: note = chr12:127051899-127051942
  misc_feature 1..43: note = hypo
  source 1..43: mol_type = genomic DNA
cttcccgaagggagccgcccctgctccccggcacctgctccca

SEQ ID NO: 43649 - DNA, 40 bp, Homo sapiens
  misc_feature 1..40: note = chr12:128310415-128310455
  misc_feature 1..40: note = hypo
  source 1..40: mol_type = genomic DNA
agtgaggaaacagcacggagacaaccggtgaatgaggaag

SEQ ID NO: 43650 - DNA, 35 bp, Homo sapiens; identical to SEQ ID NO: 15721
  misc_feature 1..35: note = chr12:128311016-128311051
  misc_feature 1..35: note = hypo
  source 1..35: mol_type = genomic DNA

SEQ ID NO: 43651 - DNA, 166 bp, Homo sapiens
  misc_feature 1..166: note = chr12:128899701-128899867
  misc_feature 1..166: note = hypo
  source 1..166: mol_type = genomic DNA
agggtctttgctttccgagaaaccagagaggtgcggggcagctgccggctgaagggggacctggggctgtgtgtggctgagctggagctcctgtccagctggttcagtgccccgacggtgggtgccgggaggaagaagtccatggaccagccggaggggacccctg

SEQ ID NO: 43652 - DNA, 193 bp, Homo sapiens
  misc_feature 1..193: note = chr12:128964823-128965016
  misc_feature 1..193: note = hypo
  source 1..193: mol_type = genomic DNA
gaattcatggacagtcgggcccaggcaatttgatacatttggcttctgtgattattctgcatggaccttcttcgtggaatctaaaacctctgtatttcttaagctaaagtagacagcaataagccagtaagcttgcgcccaaagtctgagatagttccagatctacatcagaggtctccgccagctactggag

SEQ ID NO: 43653 - DNA, 30 bp, Homo sapiens
  misc_feature 1..30: note = chr12:129028675-129028705
  misc_feature 1..30: note = hypo
  source 1..30: mol_type = genomic DNA
tgtggttcctggtcccgggcccaggccggc

SEQ ID NO: 43654 - DNA, 30 bp, Homo sapiens
  misc_feature 1..30: note = chr12:129441934-129441964
  misc_feature 1..30: note = hypo
  source 1..30: mol_type = genomic DNA
ttgagattgggatatcgttttggaaaggcg

SEQ ID NO: 43655 - DNA, 120 bp, Homo sapiens
  misc_feature 1..120: note = chr12:129520220-129520340
  misc_feature 1..120: note = hypo
  source 1..120: mol_type = genomic DNA
agcactggttttcagcaactgtctgtggagctgcattgagtgctgctgggagaggcagtgttcccagattttactctgaaatcgagagtgaaggaaagcacttgcacagtcaaaaaaatg

SEQ ID NO: 43656 - DNA, 173 bp, Homo sapiens
  misc_feature 1..173: note = chr12:130037653-130037826
  misc_feature 1..173: note = hypo
  source 1..173: mol_type = genomic DNA
ccccttttgagactccgagagtgttgcgcgtttgctcccagctgtgtctgagtcactgcttgtggctcatcagtcaggctccctgctggtcgctctcaccactgctgccccgatgcccagctcttcactctgccacagtggcccgtggtccctggctgcgtgagtccatcctg

SEQ ID NO: 43657 - DNA, 30 bp, Homo sapiens
  misc_feature 1..30: note = chr12:130216152-130216182
  misc_feature 1..30: note = hypo
  source 1..30: mol_type = genomic DNA
gaaggtgcagtgggccgatataaggaaatt

SEQ ID NO: 43658 - DNA, 30 bp, Homo sapiens
  misc_feature 1..30: note = chr12:130308451-130308481
  misc_feature 1..30: note = hypo
  source 1..30: mol_type = genomic DNA
atttaatctcattcccgttaaaataactaa

SEQ ID NO: 43659 - DNA, 65 bp, Homo sapiens
  misc_feature 1..65: note = chr12:130325114-130325179
  misc_feature 1..65: note = hypo
  source 1..65: mol_type = genomic DNA
tatcttttatgtctccgagaaggcacacacagaaagtaaaaagcccagggcgggggctgcgcagc

SEQ ID NO: 43660 - DNA, 301 bp, Homo sapiens; identical to SEQ ID NO: 5141
  misc_feature 1..301: note = chr12:130821371-130821672
  misc_feature 1..301: note = hypo
  source 1..301: mol_type = genomic DNA

SEQ ID NO: 43661 - DNA, 106 bp, Homo sapiens
  misc_feature 1..106: note = chr12:130918507-130918613
  misc_feature 1..106: note = hypo
  source 1..106: mol_type = genomic DNA
catggccggaggagtcgggggacttgttcacctgtggtctgtaaccagccgggacataaacccaggcctgagagatgccagtccccctctccgggtatggggctgt

SEQ ID NO: 43662 - DNA, 86 bp, Homo sapiens
  misc_feature 1..86: note = chr12:130920592-130920678
  misc_feature 1..86: note = hypo
  source 1..86: mol_type = genomic DNA
cacctcaggtggaaacgggctcaacacaacaggagagatgagagcgggttctgggtggggatgcgggcacacgttctggctcccag

SEQ ID NO: 43663 - DNA, 30 bp, Homo sapiens
  misc_feature 1..30: note = chr12:130947254-130947284
  misc_feature 1..30: note = hypo
  source 1..30: mol_type = genomic DNA
atcatggggccaaagcgcaagcaccctcct

SEQ ID NO: 43664 - DNA, 39 bp, Homo sapiens
  misc_feature 1..39: note = chr12:131077323-131077362
  misc_feature 1..39: note = hypo
  source 1..39: mol_type = genomic DNA
gtgagaagagcgtttcgcccagcacgtggatttgtttcc

SEQ ID NO: 43665 - DNA, 30 bp, Homo sapiens
  misc_feature 1..30: note = chr12:131159790-131159820
  misc_feature 1..30: note = hypo
  source 1..30: mol_type = genomic DNA
acgatgggtgtctcacgcttctacctaagg

SEQ ID NO: 43666 - DNA, 30 bp, Homo sapiens
  misc_feature 1..30: note = chr12:131229952-131229982
  misc_feature 1..30: note = hypo
  source 1..30: mol_type = genomic DNA
acacataaacccaaacgtgccacccaattt

SEQ ID NO: 43667 - DNA, 123 bp, Homo sapiens
  misc_feature 1..123: note = chr12:131268359-131268482
  misc_feature 1..123: note = hypo
  source 1..123: mol_type = genomic DNA
cagctattggctgaccgctgacatatgtagacaaggggacaacccctgggaagcagacgtaaaatagaaacaataaatttaaaaactgatgagggacatcaacgcctacgtaccagagacagg

SEQ ID NO: 43668 - DNA, 56 bp, Homo sapiens
  misc_feature 1..56: note = chr12:131271976-131272032
  misc_feature 1..56: note = hypo
  source 1..56: mol_type = genomic DNA
agcagctggagagtccgctgcccacaccaccccgggctccacggcctcacccccag

SEQ ID NO: 43669 - DNA, 30 bp, Homo sapiens
  misc_feature 1..30: note = chr12:131335293-131335323
  misc_feature 1..30: note = hypo
  source 1..30: mol_type = genomic DNA
gtgtgtattcatgtgcgtgtgtgtgagaat

SEQ ID NO: 43670 - DNA, 166 bp, Homo sapiens
  misc_feature 1..166: note = chr12:131383570-131383736
  misc_feature 1..166: note = hypo
  source 1..166: mol_type = genomic DNA
ctagctgctgcttaacggcctgcactattgtgctgctcacattcccattagcagagtgggagcgctctcgttctcccgtagctttgataccagcctgtgttattaaacttttggaactctgccattctgataagtgaaaaatgtaattccgcgtggctttaatttg

SEQ ID NO: 43671 - DNA, 30 bp, Homo sapiens
  misc_feature 1..30: note = chr12:131387248-131387278
  misc_feature 1..30: note = hypo
  source 1..30: mol_type = genomic DNA
ctagagatccaggtccggtttgtctttcct

SEQ ID NO: 43672 - DNA, 34 bp, Homo sapiens
  misc_feature 1..34: note = chr12:131389290-131389324
  misc_feature 1..34: note = hypo
  source 1..34: mol_type = genomic DNA
acgggatctgggagccggccgcctgggcacgggc

SEQ ID NO: 43673 - DNA, 30 bp, Homo sapiens
  misc_feature 1..30: note = chr12:131402594-131402624
  misc_feature 1..30: note = hypo
  source 1..30: mol_type = genomic DNA
caccgggtcatcctccgtcattagatgatg

SEQ ID NO: 43674 - DNA, 263 bp, Homo sapiens
  misc_feature 1..263: note = chr12:131433182-131433445
  misc_feature 1..263: note = hypo
  source 1..263: mol_type = genomic DNA
attgggactaacttacgcgagtgtctcgttcttggttctctgagagcagagcccagtgccaacactcacgtgtgagcagtgctttagagtgtgagtccagggggccaaagtgggggacgggggcaacagacacagaagtggggaagcggcaatgcagggaaatgctaccgtgttgcaaccatgatggttggagggagaaaagcgggtttgtccactggatcctgcacttcatgggctcgagtacctcacgtttctgggtgctt

SEQ ID NO: 43675 - DNA, 53 bp, Homo sapiens
  misc_feature 1..53: note = chr12:131500873-131500926
  misc_feature 1..53: note = hypo
  source 1..53: mol_type = genomic DNA
tggaggctcaggagacgcttgctgagtgagtgctgtgccggagtcagtgccct

SEQ ID NO: 43676 - DNA, 30 bp, Homo sapiens
  misc_feature 1..30: note = chr12:131513475-131513505
  misc_feature 1..30: note = hypo
  source 1..30: mol_type = genomic DNA
gcccttcagaaaggtcgtaaccatttatcc

SEQ ID NO: 43677 - DNA, 53 bp, Homo sapiens
  misc_feature 1..53: note = chr12:131535504-131535557
  misc_feature 1..53: note = hypo
  source 1..53: mol_type = genomic DNA
gttcctaacaggccacgggctggtcccggttcacggcccgggtgttgggaacc

SEQ ID NO: 43678 - DNA, 27 bp, Homo sapiens
  misc_feature 1..27: note = chr12:131547329-131547356
  misc_feature 1..27: note = hypo
  source 1..27: mol_type = genomic DNA
atacaagggtcacgtggtaaatatatt

SEQ ID NO: 43679 - DNA, 30 bp, Homo sapiens
  misc_feature 1..30: note = chr12:131569185-131569215
  misc_feature 1..30: note = hypo
  source 1..30: mol_type = genomic DNA
tcatgcaggtggtcccgctggaggtaagag

SEQ ID NO: 43680 - DNA, 75 bp, Homo sapiens
  misc_feature 1..75: note = chr12:131615224-131615299
  misc_feature 1..75: note = hypo
  source 1..75: mol_type = genomic DNA
aggggtgcaggtgtgcggaacagcgatgctggcccatcccgtgcgggggaagagcgaggccggcccatcccgtgc

SEQ ID NO: 43681 - DNA, 190 bp, Homo sapiens
  misc_feature 1..190: note = chr12:131619032-131619222
  misc_feature 1..190: note = hypo
  source 1..190: mol_type = genomic DNA
tgatcctttcagatacggtttcccgggacctaaagattgtagctgaataatgcatgatattgttgtttcccagaaacaggtgttttatttttattgcattagcattatgagaacaagctggctgcggcttctctgagagctgaagtgctggaacacttctgggttttacaggcaccggttgcccggagct

SEQ ID NO: 43682 - DNA, 61 bp, Homo sapiens
  misc_feature 1..61: note = chr12:131623336-131623397
  misc_feature 1..61: note = hypo
  source 1..61: mol_type = genomic DNA
ccacggctacagctgcgccgggtgtgtggcacgctccatgagtcaccgtggaatgaacgca

SEQ ID NO: 43683 - DNA, 30 bp, Homo sapiens
  misc_feature 1..30: note = chr12:131624881-131624911
  misc_feature 1..30: note = hypo
  source 1..30: mol_type = genomic DNA
agggctggtgacagccgtgtcttctgtgtt

SEQ ID NO: 43684 - DNA, 42 bp, Homo sapiens
  misc_feature 1..42: note = chr12:131687270-131687312
  misc_feature 1..42: note = hypo
  source 1..42: mol_type = genomic DNA
gcagtccctcctccccgcgacgtgacgcggcctgtgcatttt

SEQ ID NO: 43685 - DNA, 87 bp, Homo sapiens
  misc_feature 1..87: note = chr12:131725445-131725532
  misc_feature 1..87: note = hypo
  source 1..87: mol_type = genomic DNA
aaaaaaaaaaataaataaaataaaaagaaattcattgcttcaccacacatagctaaacagaacactggagaacgtagtttgtgttct

SEQ ID NO: 43686 - DNA, 33 bp, Homo sapiens
  misc_feature 1..33: note = chr12:131767017-131767050
  misc_feature 1..33: note = hypo
  source 1..33: mol_type = genomic DNA
cgttgtcaccatcctcgacgtcagccccacaag

SEQ ID NO: 43687 - DNA, 39 bp, Homo sapiens
  misc_feature 1..39: note = chr12:131768368-131768407
  misc_feature 1..39: note = hypo
  source 1..39: mol_type = genomic DNA
cacaacacaccacaacgccatgaccgcagcaccacaaca

SEQ ID NO: 43688 - DNA, 30 bp, Homo sapiens
  misc_feature 1..30: note = chr12:131769387-131769417
  misc_feature 1..30: note = hypo
  source 1..30: mol_type = genomic DNA
gtgagcacgtgctcacggcagcgccagagc

SEQ ID NO: 43689 - DNA, 37 bp, Homo sapiens
  misc_feature 1..37: note = chr12:131772177-131772214
  misc_feature 1..37: note = hypo
  source 1..37: mol_type = genomic DNA
gacaatgatcacagacggggcacgtatggcattgtat

SEQ ID NO: 43690 - DNA, 30 bp, Homo sapiens
  misc_feature 1..30: note = chr12:131834216-131834246
  misc_feature 1..30: note = hypo
  source 1..30: mol_type = genomic DNA
atttccaacatcgtccgagaatttatgaag

SEQ ID NO: 43691 - DNA, 30 bp, Homo sapiens
  misc_feature 1..30: note = chr12:131850690-131850720
  misc_feature 1..30: note = hypo
  source 1..30: mol_type = genomic DNA
gacgtcccctatgaacgaggcccacaggca

SEQ ID NO: 43692 - DNA, 30 bp, Homo sapiens
  misc_feature 1..30: note = chr12:131852434-131852464
  misc_feature 1..30: note = hypo
  source 1..30: mol_type = genomic DNA
ccctcacttggtctccggcctgccctctgc

SEQ ID NO: 43693 - DNA, 62 bp, Homo sapiens
  misc_feature 1..62: note = chr12:131928846-131928908
  misc_feature 1..62: note = hypo
  source 1..62: mol_type = genomic DNA
acgctgggctctgagcggttctggccagtcccctccatcagggcccccgagtccctccggct

SEQ ID NO: 43694 - DNA, 122 bp, Homo sapiens
  misc_feature 1..122: note = chr12:131979037-131979159
  misc_feature 1..122: note = hypo
  source 1..122: mol_type = genomic DNA
gctcttcccgtggcccggagggccctgtcggaaacagcttgaggacccggagttcccaggagtctcctgccagccttcgtctctgcctgcccctctcgccatagtagcgggaagggtggtag

SEQ ID NO: 43695 - DNA, 197 bp, Homo sapiens
  misc_feature 1..197: note = chr12:132044061-132044258
  misc_feature 1..197: note = hypo
  source 1..197: mol_type = genomic DNA
tctatgaaccagcagcgctgaggtcactggtgctgaggccatgggactcgtggaggtgttctgtccatgggagagaagccctgagcatctgggagccatgaggaggaatctccagagacaaacgggagaattaaccagaggccccgccccattatcataactcggctccactcacatggccccgccctgttcattca

SEQ ID NO: 43696 - DNA, 30 bp, Homo sapiens
  misc_feature 1..30: note = chr12:132068982-132069012
  misc_feature 1..30: note = hypo
  source 1..30: mol_type = genomic DNA
agaactcatcaataccgggacaccgtgacg

SEQ ID NO: 43697 - DNA, 300 bp, Homo sapiens
  misc_feature 1..300: note = chr12:132076528-132076828
  misc_feature 1..300: note = hypo
  source 1..300: mol_type = genomic DNA
ccgacaccagggagacgcgttttctgcactgactcctacgctcccgcgtggacatccccagcatgatttctgtctccacccacttcgcacacaccccgccccggccagacacccccaaacccacacagggtgcagggacaccgccctggccttggctgtggctgtcacactcgcctgtcccgccttggccccaagtcctgccagcccggctccgtccccgccccactcccagtggctctgtgcctgcctccctcccgggctctgccagccctgcctctcccgccacgcacagctcaggcg

SEQ ID NO: 43698 - DNA, 157 bp, Homo sapiens
  misc_feature 1..157: note = chr12:132106066-132106223
  misc_feature 1..157: note = hypo
  source 1..157: mol_type = genomic DNA
ttcagctctgggcgacgctgccgggctgcttcccaagttccagatccaccacacccccagggggttccagcctgcagcgggggctgagacccacagctctgctgtgtacatgagaacacacacaggcacatgcacacctacgcgcatgtacacacat

SEQ ID NO: 43699 - DNA, 80 bp, Homo sapiens
  misc_feature 1..80: note = chr12:132168266-132168346
  misc_feature 1..80: note = hypo
  source 1..80: mol_type = genomic DNA
atttctgggtggggccgtgcctggcgctaggaggtgagctgggcccaggcctgggggcagctctgcgtccccaccacctt

SEQ ID NO: 43700 - DNA, 34 bp, Homo sapiens
  misc_feature 1..34: note = chr12:132171651-132171685
  misc_feature 1..34: note = hypo
  source 1..34: mol_type = genomic DNA
agaatgggaatcacgcgtgcgtgtttcctgctct

SEQ ID NO: 43701 - DNA, 522 bp, Homo sapiens; identical to SEQ ID NO: 1602
  misc_feature 1..522: note = chr12:132221602-132222124
  misc_feature 1..522: note = hypo
  source 1..522: mol_type = genomic DNA

SEQ ID NO: 43702 - DNA, 62 bp, Homo sapiens
  misc_feature 1..62: note = chr12:132240207-132240269
  misc_feature 1..62: note = hypo
  source 1..62: mol_type = genomic DNA
gaaagcatctgcccacgttcacagcattgatgattgtttgtccagcacgttctaaacaaaca

SEQ ID NO: 43703 - DNA, 21 bp, Homo sapiens
  misc_feature 1..21: note = chr12:132244054-132244075
  misc_feature 1..21: note = hypo
  source 1..21: mol_type = genomic DNA
aaatagtaggccgggcgcggt

SEQ ID NO: 43704 - DNA, 30 bp, Homo sapiens
  misc_feature 1..30: note = chr12:132279981-132280011
  misc_feature 1..30: note = hypo
  source 1..30: mol_type = genomic DNA
gtggtccctggctaccgcagctctgtctaa

SEQ ID NO: 43705 - DNA, 133 bp, Homo sapiens; identical to SEQ ID NO: 15732
  misc_feature 1..133: note = chr12:132280877-132281010
  misc_feature 1..133: note = hypo
  source 1..133: mol_type = genomic DNA

SEQ ID NO: 43706 - DNA, 82 bp, Homo sapiens
  misc_feature 1..82: note = chr12:132284411-132284493
  misc_feature 1..82: note = hypo
  source 1..82: mol_type = genomic DNA
gggcccccagccctccgacagcagccactggactccccttccccgtctccacgcctcctgcggtcaccgcacaccccttctt

SEQ ID NO: 43707 - DNA, 104 bp, Homo sapiens
  misc_feature 1..104: note = chr12:132325069-132325173
  misc_feature 1..104: note = hypo
  source 1..104: mol_type = genomic DNA
acgtggcctgttctccgtgactcactctgggctgacccctgcctgcagggtccggacgttcccacgggactcaccactggggcacgacacggtgcgtgcactca

SEQ ID NO: 43708 - DNA, 84 bp, Homo sapiens
  misc_feature 1..84: note = chr12:132329560-132329644
  misc_feature 1..84: note = hypo
  source 1..84: mol_type = genomic DNA
atgcctgtcccatgccgctcaggtcaggggctctgccgcaggatgccctgtcccgcgctgcccaggccccgcctcccagcccac

SEQ ID NO: 43709 - DNA, 166 bp, Homo sapiens
  misc_feature 1..166: note = chr12:132329877-132330043
  misc_feature 1..166: note = hypo
  source 1..166: mol_type = genomic DNA
tggtgtccctgcagccggcacagatgcaccgcttctggcggggcctgccgctgcacctggacagcgtggacgccgtgtacgagcgcaccagcgaccacaagatcgtcttctttaaaggtgggtgggcctccccgtcgcactccgggcttcccgggccctctgtccg

SEQ ID NO: 43710 - DNA, 45 bp, Homo sapiens
  misc_feature 1..45: note = chr12:132333398-132333443
  misc_feature 1..45: note = hypo
  source 1..45: mol_type = genomic DNA
ggacgctgctatgagcgtgagtgtgcaaacgtctctccaagaccc

SEQ ID NO: 43711 - DNA, 164 bp, Homo sapiens
  misc_feature 1..164: note = chr12:132333503-132333667
  misc_feature 1..164: note = hypo
  source 1..164: mol_type = genomic DNA
tatttttgacgttttggggagcctatgttctgtctcccgcagcggctgcacaatttcatactccctccccggcagcgcccggctctgccgtccccatatcctcccgacacaggtgactttccacgttcttgacagtgggggcgagggggcgtctcattgtggtt

SEQ ID NO: 43712 - DNA, 80 bp, Homo sapiens
  misc_feature 1..80: note = chr12:132335471-132335551
  misc_feature 1..80: note = hypo
  source 1..80: mol_type = genomic DNA
gcctcctacttcttccgtggccaggagtactggaaagtgctggatggcgagctggaggtggcacccgggtacccacagtc

SEQ ID NO: 43713 - DNA, 95 bp, Homo sapiens
  misc_feature 1..95: note = chr12:132348589-132348684
  misc_feature 1..95: note = hypo
  source 1..95: mol_type = genomic DNA
accctggctgtctgtcgggcagccccggcgaggagttgagtccccttaccgctgcgaatgagctgtcctccaccccacgtcggagacctcagcgc

SEQ ID NO: 43714 - DNA, 42 bp, Homo sapiens
  misc_feature 1..42: note = chr12:132349937-132349979
  misc_feature 1..42: note = hypo
  source 1..42: mol_type = genomic DNA
ggacagtgactcactcgtcaggaacgacggggcacctgccag

SEQ ID NO: 43715 - DNA, 109 bp, Homo sapiens
  misc_feature 1..109: note = chr12:132377954-132378063
  misc_feature 1..109: note = hypo
  source 1..109: mol_type = genomic DNA
agcgcgcaacgtgtacggtgaacagcactaacttttccccggtcctctctcccagagcaatcgctgttggctgtgtcttctgtgagtgagcccccgggctcttttggct

SEQ ID NO: 43716 - DNA, 37 bp, Homo sapiens
  misc_feature 1..37: note = chr12:132415173-132415210
  misc_feature 1..37: note = hypo
  source 1..37: mol_type = genomic DNA
tttttctttttgaggcgtggtctccctttgtggtcca

SEQ ID NO: 43717 - DNA, 37 bp, Homo sapiens
  misc_feature 1..37: note = chr12:132415270-132415307
  misc_feature 1..37: note = hypo
  source 1..37: mol_type = genomic DNA
agatcctcccacctcagcctcccgaacatcgagggct

SEQ ID NO: 43718 - DNA, 157 bp, Homo sapiens
  misc_feature 1..157: note = chr12:132423589-132423746
  misc_feature 1..157: note = hypo
  source 1..157: mol_type = genomic DNA
agatgcatttttaacagctgaattcatgtgtgaaatgacgtaaggtccgcgtagtccttctttctcagagaccagcgtgcgaggcccaagggacccaccttccgtcacccgttctgctttgtttacagggtgtgtccgcagccggccaggtggtatc

SEQ ID NO: 43719 - DNA, 238 bp, Homo sapiens
  misc_feature 1..238: note = chr12:132617211-132617449
  misc_feature 1..238: note = hypo
  source 1..238: mol_type = genomic DNA
ggactgcagtaaggacgcctcgtgggatgtgccaaaccgctgcgtggagcctgggctgacttctctggatcttggtgcaactggcgtggcccttccaggaagccgggccacctggctcagagacgccagaccctggccggcaatggggctgccaggggcggggacgctggaggagctaggggtgtgggccactgtgctgcctgccccggcctggcggcctctccgtagcagagctgag

SEQ ID NO: 43720 - DNA, 30 bp, Homo sapiens
  misc_feature 1..30: note = chr12:132617675-132617705
  misc_feature 1..30: note = hypo
  source 1..30: mol_type = genomic DNA
ccaccctgacctgggcggagtgtgggggtg

SEQ ID NO: 43721 - DNA, 134 bp, Homo sapiens
  misc_feature 1..134: note = chr12:132643874-132644008
  misc_feature 1..134: note = hypo
  source 1..134: mol_type = genomic DNA
tgcccctgtgtgctccgcaccacgtctgtctcgatggcgcccctcgaagacctcgggaagctccccgttcgctgtggccccccggggtctgtcccctgcagcactgttctctgggggctcgtggtccgagttct

SEQ ID NO: 43722 - DNA, 30 bp, Homo sapiens
  misc_feature 1..30: note = chr12:132648490-132648520
  misc_feature 1..30: note = hypo
  source 1..30: mol_type = genomic DNA
accgcagagcctgggcgtgcaggtggcacg

SEQ ID NO: 43723 - DNA, 161 bp, Homo sapiens
  misc_feature 1..161: note = chr12:132653008-132653169
  misc_feature 1..161: note = hypo
  source 1..161: mol_type = genomic DNA
gggtcctctgggggccgatgctgagacggggtctaggccgggataacgggatagtccattgctgggccagggctgctgagcgtgggtggggactgccgactgcagtacagacccagacggcaggagcccggcaaagcctgcccttccgaggagcctcacgt

SEQ ID NO: 43724 - DNA, 44 bp, Homo sapiens
  misc_feature 1..44: note = chr12:132666377-132666421
  misc_feature 1..44: note = hypo
  source 1..44: mol_type = genomic DNA
ctcgtgtgcccgccacgctgtcttcctgccgctggtgaagtctg
